United States Patent 9,012,723 (ISOLATED NOVEL ACID AND PROTEIN MOLECULES FROM SOY AND METHODS OF USING THOSE MOLECULES TO GENERATE TRANSGENE PLANTS WITH ENHANCED AGRONOMIC TRAITS) - sequence listing, part 30

SEQ ID NO: 171080 - protein, 368 aa, Glycine max
  Coding DNA Sequence Number=SeqID_79395
  Gene Ontology: Mol. function=microtubule motor activity; Cellular component=microtubule associated complex; Biological process =microtubule-based movement
  Homolog annotation: Hit_ID=A7Q5T0; Match level="QueryCoverage=22%, HitCoverage=12%, E-value=6e-29, Identity=80%"; Hit description =Chromosome chr14 scaffold_54, whole genome shotgun sequence
  Pfam annotation: Domain name=Kinesin; Domain location=175-368; Score=- 107.6; E_value=3.9e-08; Accession=PF00225.14; Description=Kinesin motor domain
MAAFRWKSFEENEDHPELSSNTYTKTFIGIDGAGKRLADEVSPETCKFMYLNAYDLIGEGERDRSQEECFVKLWRLKVPARTHQEDASHLFFHCSKVQPIWWETMSWLQLKGAFPLNPKQHFLHHLGLQPAGVRNSRWHCWWLALTSSIWKVRNSIIFSNATFDANKLFDEAIFLLWSWLRGYEKDFTVHFNQWEQAFKRRDDCWVGANEFYNFSNATSWRERKEAESVFVEVEPILRSAMDGHNDGTNEEPRIVPRALEEFFRQASLDNSSSFTFTMSISTSWTNVNEASSRSHSLTRINIFRHGDALEAKSEVSKLWMIDLEGCKQLLKTGAKGLTLDEGRAINLSLSALGDVVAALKRKRCHVPY

SEQ ID NO: 171081 - protein, 95 aa, Glycine max
  Coding DNA Sequence Number=SeqID_79396
  Homolog annotation: Hit_ID=A1IW39; Match level="QueryCoverage=52%, HitCoverage=92%, E-value=3e-11, Identity=70%"; Hit description =Putative uncharacterized protein ophh-69
MMSLKAMEGACDGQMKQRGHIIEALVPKKNGAKGSAEAVGCKKEESVGKRSALEGRTRTSSAGRSESKNVDLNNASVGENPIPRKPKVPPQGSST

SEQ ID NO: 171082 - protein, 111 aa, Glycine max
  Coding DNA Sequence Number=SeqID_79397
MTFLGETSSQTIVNSMLGFIFPNGSIIHNDSGVYFQTSTPVPIRVPNNCDFARLKTIIHTTLQLIDKQFLDEIHYRQPFTDTGCTIDELKDLIKQVALEGIPPHGIHASQT

SEQ ID NO: 171083 - protein, 119 aa, Glycine max
  Coding DNA Sequence Number=SeqID_79398
MTTGRDRDEYCFPIPRLPNVYSYPILDGLKFFISFPYPSGIPHQNRDGFGRISTSTGFIAMPSCGIQMLDYGIRQASWGEIDTAGVLEDVEELGQRAQRDSTRSTRGVNLEANCIVQAC

SEQ ID NO: 171084 - protein, 247 aa, Glycine max
  Coding DNA Sequence Number=SeqID_79399
MGIKCFHNGFHSCNCYRGGYGETDVSSEGSEIGFDIQSEEAQVDDESPETTLTGMLTVMNKPETLGSSFWPLGAPIIHRFFCECFFSSPVFRACSSFVVLLLRAWAAIFVHFGSFVSAFSSSRCVVIRVECIMVRTRGLGRTLSRVIGKGLVREDEHHADDVSLRRRPTASTRRRRVDVAIVEDVPHMDEDIPERTADVDVADVEGITVDGAEGSPADHAEGFPGGPRDPSILTSFADHVAHSIWSG

SEQ ID NO: 171085 - protein, 129 aa, Glycine max
  Coding DNA Sequence Number=SeqID_79400
  Homolog annotation: Hit_ID=A5B110; Match level="QueryCoverage=79%, HitCoverage=15%, E-value=2e-22, Identity=53%"; Hit description =Putative uncharacterized protein
MARPMVIPSSHSHYSMNQVSEKMMGISSQASNKVFDRFPPEFNPVDGRHLRPILISDNNEIFNFEMADGIFQGSDFVNVKDHLSCEDGLTFDSFQLSSPLQRTPMPVIQFLNNVGHSGEKLKMVIGICC

SEQ ID NO: 171086 - protein, 82 aa, Glycine max
  Coding DNA Sequence Number=SeqID_79401
MYNKEEEEEEEEEEEEEEEEVEGRAQARGLTVCLDTQHGEAKSIFFSTVTLKQPFVASDFFTVTHTMILAVRIDSEGYRNMH

SEQ ID NO: 171087 - protein, 79 aa, Glycine max
  Coding DNA Sequence Number=SeqID_79402
MLQCEGFSSKLRYDFEILNGESVRNWVANMILKFHDDPTVNRFEIVVFLRQIWWAAGKRKGFERRRGKTKMKSKRRQLT

SEQ ID NO: 171088 - protein, 255 aa, Glycine max
  Coding DNA Sequence Number=SeqID_79403
MIDGEDVMQSYLPRILDRRLQEDWARATKEDPRVLMKGVSTCTQQNCWDTQQTVNGQLCPSVKAISGRPFFRKTLSPKKFRKTLLPEEEGGLPEELQKTFRKKCLPEKGSFGILPSSSGRSCLEKMNSKKLFPELLFIAGGSSFGMRMLNFRKKFFRKLLFSIPKEVVPEQLLPEVDIMDEDQWRYDYAMSQEVHMDYDYDNEEECGVNESHVDCSNAFNTSQVFGTRDDVLQWARTVAYENGFVAVIMRSDTDT

SEQ ID NO: 171089 - protein, 58 aa, Glycine max
  Coding DNA Sequence Number=SeqID_79404
MKKKESKRRKQAVEEGTWSNQQRLKSHMEMPKKPTNELHVKLSGMGTTEISMAFSFIR

SEQ ID NO: 171090 - protein, 139 aa, Glycine max
  Coding DNA Sequence Number=SeqID_79405
MARTKKTKQMTSEATKEIADKIASQGSFVAHRHKDVLTVAIGRPKHLGHVCAAGVGVMIKQYFGPAPSTSRTQMQSQFQSQMQSEGLTMPPKPEVCPSTARVSTKESCVDPSGNNPDTVKVGVKKVTNAYAHIPVPTEE

SEQ ID NO: 171091 - protein, 113 aa, Glycine max
  Coding DNA Sequence Number=SeqID_79406
MKIPLYDFTKHGYFSEHEDQELSHHNNDQSDDEGVVVPTSPLLQYHQPRLERPVSPDPSSPPYRATQLVTKVCVTVANRSTYNCAAPRVWVCHCRDLDTVLAPGSWVHELVGR

SEQ ID NO: 171092 - protein, 217 aa, Glycine max
  Coding DNA Sequence Number=SeqID_79407
MPLTVSGTHWRRSDMLQHISHSPWVAYTGVIAVLVCSCIRASYKVTHTRDMVAYSCAHATHRGWHMSLVVGDIYWSHGGDTLLRVCHSLWVAYTRVMMGARVHMPWVTCIRDTMICSYIRASYKVTYTGDSVLEEGLTKGTFPIGAKLSCLGIFFGFITDTPYEVISILLVDGSPTSMGIIASMSYVSRLVKSSMQGPKDDSVSCLYLFVSLRMFDK

SEQ ID NO: 171093 - protein, 364 aa, Glycine max
  Coding DNA Sequence Number=SeqID_79408
  Homolog annotation: Hit_ID=A5B5G7; Match level="QueryCoverage=57%, HitCoverage=15%, E-value=3e-07, Identity=24%"; Hit description =Putative uncharacterized protein
MASRKRKAPSTPTQDRFDRSRFTSQEAWERYTDIIVPRKLLPERNVVVYYTEFDEFKEELERRCWDKELTDFGDGNIDVAIVKEFYANLYDPEDKSPKQVKVKGHLIKFDEDTLNTFLKTPIIVEEGESLCAYSIFSLLRPDPQELATKLYIPGRGFELNSVLSFSNLIPTSHTSDVTLDRARLINGIIMKMDMNMGYLISHQIFLTAQHDTSRLGFPTLITALCKARGVQSDSRSLESLSPAINLAYIKKNYWNLDDPIIAFRGPRKAKGKRSEAPSTSTSEAPIPSSSTLPPSSSTDIPVIPPTPSQIPLPAPLSAGPADFIFTLQMLHSMLQSIHRGQYIIMQILQGLGLTSIMSTEEFDA

SEQ ID NO: 171094 - protein, 65 aa, Glycine max
  Coding DNA Sequence Number=SeqID_79409
  Subcellular localization annotation: CTP_CleavageSite=57; ConfidenceScore=5.50e-01
MTVVTPSKTTSRTFSLDLSRSSPASVNHSTLPRALNHSAPACVANIIDWMCYFMSVSLAQAKNHR

SEQ ID NO: 171095 - protein, 296 aa, Glycine max
  Coding DNA Sequence Number=SeqID_79410
  Gene Ontology: Mol. function=DNA binding; Cellular component=nucleus; Biological process=regulation of transcription
  Homolog annotation: Hit_ID=A9P0V4; Match level="QueryCoverage=15%, HitCoverage=13%, E-value=3e-17, Identity=86%"; Hit description =Putative uncharacterized protein
  Pfam annotation: Domain name=DUF247; Domain location=1-271; Score= -168.0; E_value=0.012; Accession=PF03140.6; Description=Plant protein of unknown function
MGRAPCCNKVGLKKGPWTPEQDQKLLAYIQEHGHGSWRAFLPKAGNSSSLLKEEGEQEWKGSYGSSITSFSSSLHDEFTMNMEGTWASEFLRPSGSHDDHIVEEGFTNLLLKTNFDDPTLLSEGVKRSSEEILRDMNPDEDVRSVATIPSVKELHKAGIGFQPAKLGGISGIEYDEGTYVEIMRAIIDTCEDVKLLVQREIIQQTELSDQVVEDLFNGMRKSIRPTNTLDLEKEIKKVNAKYDDSQKVNRAMVKYVYSAGKFYTDKWMGIFAEEGDHVFKTQNISPYTLILSRIQP

SEQ ID NO: 171096 - protein, 64 aa, Glycine max
  Coding DNA Sequence Number=SeqID_79411
MSLLPENHKSQSEAFIGKQKGIEGYWKGYLPQDCILRKECTGATEANRTLEGHPKMMAVVEANK

SEQ ID NO: 171097 - protein, 141 aa, Glycine max
  Coding DNA Sequence Number=SeqID_79412
  Gene Ontology: Mol. function=asparaginase activity; Biological process=glycoprotein catabolic process
  Homolog annotation: Hit_ID=P50288; Match level="QueryCoverage=68%, HitCoverage=29%, E-value=6e-39, Identity=81%"; Hit description=L -asparaginase precursor (EC 3.5.1.1) (L-asparagine amidohydrolase) [Contains: ...
  Homolog annotation: Hit description=L-asparaginase subunit alpha; L -asparaginase subunit beta]
  Pfam annotation: Domain name=Asparaginase_2; Domain location=1-140; Score=-122.6; E_value=0.00042; Accession=PF01112.9; Description =Asparaginase
MDSSSGQGMKNALLEPKCSSYEKNHDSLLVQPSYKPDKVRSDPYFAGTYANELCAMLATGKGETILCATVARDVAVLMEFKGVFLKEAANCVVHERTSKGLVGLVDVSAAGEVAMPYNTLGMFRACATEDGYSEIAIWPSS

SEQ ID NO: 171098 - protein, 389 aa, Glycine max
  Coding DNA Sequence Number=SeqID_79413
  Pfam annotation: Domain name=Retrotrans_gag; Domain location=30-123; Score=0.8; E_value=0.045; Accession=PF03732.8; Description =Retrotransposon gag protein
MEEAQIWAKKVEQAEKFFEVQEIPLFHKLQYASMSMEGATTHWFYIWSQSNLDSDWESFSTAFIKRFGDRYGSHVFKRLSILKQEKQTETETHIKKWETSIEFLKERTNISELKHMLRKILNEEVDSHASQQEKNSMEGRGSEFSEAKASFWVRKVELPSFDRSIDGGTDLKGSSFECDSDPLQFLKLENRSKEGSVIKNHTLCGGEETKNDEAKLAREKKIEKVMDEEVDPSIKREKHKENGVTNVGCEDDFLDNPITDLIKKEVEAGDSTKPHCFQDSDFHKKIVMVKQKSFMKVVGTTMVLESWNVNLLGEPLALNFVASMADNLAMELRQKECTEPVKLIKVIWSPTLIPPTTEATRLQFASKGSGSFPVKLQGVQLSSSNQTKL

SEQ ID NO: 171099 - protein, 65 aa, Glycine max
  Coding DNA Sequence Number=SeqID_79414
MLVAKIGICGESFVFYPVKDYLKKFYSPNFYEVQLLWVNLVTADGLPATVIGHNKQDSDVMTAKT

SEQ ID NO: 171100 - protein, 441 aa, Glycine max
  Coding DNA Sequence Number=SeqID_79415
  Homolog annotation: Hit_ID=A5BSR3; Match level="QueryCoverage=25%, HitCoverage=37%, E-value=3e-08, Identity=31%"; Hit description =Putative uncharacterized protein
MMIENPPLIEDPQSPIKRHVKWKMTRTNQYGHMTSQAAQQIADKIDSLEEQMRHDEFVPQGREDILNTAVGRPDHRGRVRAAGSGVTISQYYGRTSRASRTLREQVRNEIEEENKRSLEARKKELKDAIVIEMSQKGDNVSALAHFDLNVLGARGCMSNVKIVQSWWRWENIYDEPSTIHCMAYVDDVIRVLNTFITWPTPLVKVVSDEDLAITLNKVAKAAELNNDVAEQDPLRELIKTLIDIYNKPVKFVWDVSQFGIPNVDSSLFLTYTDVREITSGDKCLNIAILQLWTMYMNEWSNSLGQQLVYGFLEPQSIHNAKDRRGQCEEYIQKWLKELQRQLYLGAYLNHAFKKLNTTADGKDPQTAPQWIELKTNVQRRGYKCGYYVMHWMWNIIGAELKSDWSMWFDNGTSLDTEAITTLHKKWAAYFLKLRTIQCTKQ

SEQ ID NO: 171101 - protein, 28 aa, Glycine max
  Coding DNA Sequence Number=SeqID_79416
MAKRLQEDWVIDVGEDHRVLMSLRGSIV

SEQ ID NO: 171102 - protein, 114 aa, Glycine max
  Coding DNA Sequence Number=SeqID_79417
MRDTGHWTFCGNIQFLFMLVLEASCVSPIPVELVGILTKPWLSGILDVPLSPPSSSSRSSLPDADMEFIGCMTHLPQRTSFLYWLDAIGVKLEDNEEEDLSKDSGFWWLGITQQ

SEQ ID NO: 171103 - protein, 318 aa, Glycine max
  Coding DNA Sequence Number=SeqID_79418
  Homolog annotation: Hit_ID=A5AKA6; Match level="QueryCoverage=84%, HitCoverage=29%, E-value=2e-13, Identity=23%"; Hit description =Putative uncharacterized protein
  Subcellular localization annotation: CTP_CleavageSite=41; ConfidenceScore=5.47e-01
MAEPSKKRKGSSFTTTAAGQRHHGTSGDPPAPPPPSFSSPRSLTLFSSDDQRQRYYSLFSNRVILDPKYLDVEFFDGETFDCYKVFQNSELVEFMSLKLSYYPELVRVFYNNLKIQDGVIFSEVHHIPIVVDQSLFYSMTKLSSQGVPFEGTLVDDWKHVYSSHNAHKMVGNDHADMTGKLLAGSFTFECRIMHYILCRVMLPRSTSLAQASEEDLILLWALQTGRQIDRAHLVRYHMHKALRVNALLPYPHLVTMFLQYFNVPLEDEPFLKVKISFAIGVGAVTSFGYCKDMDGQWVRKQDLPPPIPDECTPSPPPQ

SEQ ID NO: 171104 - protein, 96 aa, Glycine max
  Coding DNA Sequence Number=SeqID_79419
  Subcellular localization annotation: CTP_CleavageSite=66; ConfidenceScore=5.10e-01
MVYGQLNALSEYHPLSEASTRLVDKRNLEGNLSRRHVLSASSARSVSHLSSSRLSVSLALSENSLTCAKRENDAKHDVEELPCYGRINPHLGILVE

SEQ ID NO: 171105 - protein, 664 aa, Glycine max
  Coding DNA Sequence Number=SeqID_79420
  Gene Ontology: Mol. function=nucleotide binding; Cellular component =Golgi apparatus; Biological process=regulation of transcription, DNA- dependent
  Homolog annotation: Hit_ID=A7PGG5; Match level="QueryCoverage=70%, HitCoverage=92%, E-value=0.0, Identity=87%"; Hit description =Chromosome chr17 scaffold_16, whole genome shotgun sequence
  Pfam annotation: Domain name=DUF246; Domain location=234-582; Score =722.4; E_value=3.2e-214; Accession=PF03138.5; Description=Plant protein family
MSAWARRDEGAKRNHSPSSGKALNEGSPRIPAEHLAYQSPTLSNPLALRRIQLHSKREDLAVSGNAPRNSGIGSLAAGLDLELGEGELNPIEPLGFGARVRGVAFMKEAVLLGDKKSERKRGGGRVVWEGLMMMGLKGQSNNNNNSKLKNSVVVSSARSSRMKLWMIRATTSVLLWTCVVQLTALGDMWGPRVLKGWPSCFTHGESAVLIELPSATTPRVLPPKRVYKNNGYLMVSCNGGLNQMRAAICDMVAIARYLNVTLIVPELDKASFWADPSEFQDIFDVDHFITSLRDEVRILKELPPRLKTRVENGFLYSMPPISWSDISYYKNQILPLIQKYKVVHLNRTDARLANNDQPLEIQRLRCRVNFSALRFTSQIEELGKRVIKLLRQNGPFLVLHLRYEMDMLAFSGCTQGCNNDEVEELTRMRYAYPWWKEKIINSDLKRKDGLCPLTPEETALTLRALDIDQNIQIYIAAGEIYGGDRRMASLAKNYPKLVRKETLLEPSDLQFFQNHSSQMAALDYLVSLESDIFVPTYDGNMAKVVEGHRRYLGFKKTILLNRKLLVDLIDQYHDGILNWNEFSSAVKEVHADRMGGATKRLVMPDRPKEEDYFYANPEECLELSDDMLRSTCLRWVSTQFSEEDDSYLYHRGSHIVTVRMGRGE

SEQ ID NO: 171106 - protein, 164 aa, Glycine max
  Coding DNA Sequence Number=SeqID_79421
  Homolog annotation: Hit_ID=A5C8K0; Match level="QueryCoverage=31%, HitCoverage=2%, E-value=4e-07, Identity=57%"; Hit description =Putative uncharacterized protein
MEKSEKKNFSEKKMKKAYITWDDNDMELSEDSENEEINLCLMAYESDEESNVISPRKDILDDIVESLEQMHIHGKDSKGKGEGSNEDPPVEVKANNDLPREWKASRDHPLDNIIGDISKWGDCVLEFVDTKNQLADIFTKPLPKETFFAIRRELGLLDVSDLDK

SEQ ID NO: 171107 - protein, 61 aa, Glycine max
  Coding DNA Sequence Number=SeqID_79422
MDTCMTQLEEDELNCHHQKMGDCRSKDFDFDVLMMPCDHALLKFNSRQKSKKFKIHHQENL

SEQ ID NO: 171108 - protein, 119 aa, Glycine max
  Coding DNA Sequence Number=SeqID_79423
MGSRCGHTVTREGGATIWICSDHSSTDYGFQHDTYVEPDIPKVPVAPEAAPFDVEQPRHVVDACQAIAKRLECLLNLRIVTVGTKIHEVMEDCIKIARGVTTDGNVYVSSRRRGRMDQP

SEQ ID NO: 171109 - protein, 74 aa, Glycine max
  Coding DNA Sequence Number=SeqID_79424
MDENQWMYDSIMFEEVDMDDKNEQECDMNEQHVDCSDAFNTSQVFGTRDDDLRWARSVAHENGQIRGIKEVPTC

SEQ ID NO: 171110 - protein, 42 aa, Glycine max
  Coding DNA Sequence Number=SeqID_79425
MEVELVLKFGMSLGFARVQVDNKAWDANIVASYSVNMILKLC

SEQ ID NO: 171111 - protein, 377 aa, Glycine max
  Coding DNA Sequence Number=SeqID_79426
MSRKENLISELHPRKETWKIAVHITDMWDVKKHNERQAIDMVLIDQMEVARPEIPTNVHMITEIVDIISGIALRHTLVDVVGVVVEVIERKTVNPAYRILMTLWEDYALQLDDAIEKNHFVREPLVLMLTLAKIKDAKVSLECPKYKNGSKLYVNSDDIAKIRKFCDSLCVPFYVGGLTEEGSGSQSQYTINSQRSDWDKFLHNAQMVSLGDISRLREWMPAIRARTKLVIRFPVMKMEHNGEKANFHFWDATCIKMFGKTVEECRQELIAGGDEIKVFPECVDDLVGKTLALRFKYRVNMRQSSVMDVSQEEHHIHTLTLKIGLQPSLSQSTDYDPRNTAFITPAKRLSGQQATNEFDSEDTTPYELSTNKHIKAE

SEQ ID NO: 171112 - protein, 494 aa, Glycine max
  Coding DNA Sequence Number=SeqID_79427
  Gene Ontology: Mol. function=helicase activity; Cellular component =chromatin; Biological process=viral genome replication
  Homolog annotation: Hit_ID=A2Q378; Match level="QueryCoverage=99%, HitCoverage=34%, E-value=1e-127, Identity=43%"; Hit description =Putative uncharacterized protein
  Pfam annotation: Domain name=DUF889; Domain location=297-494; Score =258.3; E_value=1.6e-74; Accession=PF05970.5; Description=Eukaryotic protein of unknown function (DUF889)
MRMMFSSAKGSQSYKDIRIIDNVVYHTFREACFAKGFLGSDQEFVGVLREANTWGTPHFLRKLFVNLLFMNTMERPEYVWEQTWRWMADDIVFNHRSQGIQLTDKETMHLCLTQIENMLQANRKSLRDFPSMPYPIGYAANPHQNKLIYNEMAYNKEVLATEFNRCYHSMTVASQLGRVYFLYGYGGTGKTFMWKNLSSVVWSNGGIVLIVASSRIASLLLPGGRTTHSKFVIPVPTTQNSTCNIHQGSDFAELLQRTKLIIWDEAPMCHKFSFEALDKSLKDIMHNNKLFGGKVIVFCGDFRKILLVVPRGNRSDIAHASLNASYIWDHCQILKLTKNMRLQSNPSNHSSTDELKQFSDWLLDIGDGKLGQPNDGHCEITIPGEFLIMDFEDPIQAIVDATYPDLLQNYNNANFLQKRAILASTKDVVDKINDYVLSLIPGDEKILTPEFLNTLKTSGIPNHKLRIKIGIPIILLRNLDQASGLCNGTRLIVT

SEQ ID NO: 171113 - protein, 16 aa, Glycine max
  Coding DNA Sequence Number=SeqID_79428
MGTRGQDDGIISACVP

SEQ ID NO: 171114 - protein, 56 aa, Glycine max
  Coding DNA Sequence Number=SeqID_79429
  Gene Ontology: Mol. function=metalloendopeptidase activity; Cellular component=chloroplast thylakoid membrane; Biological process =proteolysis
  Homolog annotation: Hit_ID=A7Q3E4; Match level="QueryCoverage=92%, HitCoverage=9%, E-value=5e-17, Identity=82%"; Hit description =Chromosome chr13 scaffold_48, whole genome shotgun sequence
MAGFMLPPSDGIGVVVDASVFHESFLDGGIAKLLLGNVLKEGTAISINPLVISSMP

SEQ ID NO: 171115 - protein, 269 aa, Glycine max
  Coding DNA Sequence Number=SeqID_79430
MVSNPSRAQKKAKTSKRKQGEWSQDALNRLDTWFTDESKKNDYKMIYAMKNVRISKYLDLEWFSQQGFNFSNLLEAQGLSKLVQMKGIFYPKLVKVFYTCAHADLEGNLFSIVNGVEMVIDTEVWKEVAGLDMGGVCEFEETTNGYNKMQTNGGMLLDPTRNLRNHLGVGGMSTEEKMLVYLITYILSLRSSNHAQMDEEVEAEAPQEPAHQWSPFKSLMIQKKGAMFHLDQEHSAKVHSSLKNITTWLENIETRLTLNNLLNPDDDEA

SEQ ID NO: 171116 - protein, 56 aa, Glycine max
  Coding DNA Sequence Number=SeqID_79431
MSVVVYKDWVFTDQAFPNDLVKSLVLHDHHGYAASLLKKKSKQEFQLSLASFLVIK

SEQ ID NO: 171117 - protein, 172 aa, Glycine max
  Coding DNA Sequence Number=SeqID_79432
MTLTIPDLFLKPFQVNWDATVFEVFNPDFPLYIKHEDLSEITHGGQCLNIFVLQLWILHLTETSMRARNFDVYGFLKPQSIQRSGQSQFDTESYIKSWMQSSKRDVYLGAYLNGRHWQMVVILPKENLVVWFCSLHNRPDNYLKGITNSTLKGLDDTPQPKSKAAARWIVVK

SEQ ID NO: 171118 - protein, 79 aa, Glycine max
  Coding DNA Sequence Number=SeqID_79433
MGAKFTIKTPLPLKFNSHKNDERISLGELVWLSGNPLLALSVTFRAERNSSWVGTALSVLLVLREISKSVIVQIPTIKM

SEQ ID NO: 171119 - protein, 366 aa, Glycine max
  Coding DNA Sequence Number=SeqID_79434
  Gene Ontology: Mol. function=sodium ion binding; Cellular component =integral to membrane; Biological process=amino acid transport
  Homolog annotation: Hit_ID=A7Q3S1; Match level="QueryCoverage=98%, HitCoverage=97%, E-value=1e-105, Identity=51%"; Hit description =Chromosome chr13 scaffold_48, whole genome shotgun sequence
  Pfam annotation: Domain name=Aa_trans; Domain location=19-358; Score =65.7; E_value=1.6e-16; Accession=PF01490.9; Description =Transmembrane amino acid transporter protein
  Pfam annotation: Domain name=Trp_Tyr_perm; Domain location=22-355; Score=-248.9; E_value=0.0033; Accession=PF03222.4; Description =Tryptophantyrosine permease family
  Pfam module annotation: Pfam domain module=Aa_trans::Trp_Tyr_perm; Domain location=19-358::22-355
MSPEPGAHAPLLPGSKDVPPATVSGAVFNVATSIIGAGIMSLPAILKVLGVIPALVLILVIAFLAELSVEFLMRFTRAGQTTTYAGVMREAFGPLGAVAAQVAVVITNLGSAVSTLLAVAFVTICTVLAIVAIVEGRTQSPRLVPRLDQHTSFFDLFTAVPVIVTAYTFHFNVHPIGFELAKPSEMATAVRIALLLCGVIYFSIGLSGYLLFGDSTQSDILVNFDQNAGSALGSLLNVLVRLSYAFHVMLTFPLLNFSLRTNVDEFFFPKKPLLATDSKRFVSLTLVLLVLSYIAAIVVPDIWYIFQFMGSTSAVCLAFIFPGAIVLRDSYGISTRRDKIIALFMVILAAITSVIAISTNIYKAFQ

SEQ ID NO: 171120 - protein, 118 aa, Glycine max
  Coding DNA Sequence Number=SeqID_79435
  Homolog annotation: Hit_ID=A9P7W0; Match level="QueryCoverage=42%, HitCoverage=9%, E-value=5e-12, Identity=66%"; Hit description =Putative uncharacterized protein
MAESSPPETPELTTEFGAGSGSGQNWGVRRVGLRAEIDTSPPFGSVKEAVTRFEKTGPWIPLFNFGEAYKYFCIRAAKMLPFLSLSDSPCIQFKHSVALDLWNYAPVVIYSLMLEIVC

SEQ ID NO: 171121 - protein, 20 aa, Glycine max
  Coding DNA Sequence Number=SeqID_79436
MENKMKGTTIASGIQVVKQK

SEQ ID NO: 171122 - protein, 102 aa, Glycine max
  Coding DNA Sequence Number=SeqID_79437
  Homolog annotation: Hit_ID=A6FJQ2; Match level="QueryCoverage=37%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPYLPVDIVAYNQSKIH

SEQ ID NO: 171123 - protein, 308 aa, Glycine max
  Coding DNA Sequence Number=SeqID_79438
  Gene Ontology: Mol. function=receptor activity
  Homolog annotation: Hit_ID=A7Q3Q4; Match level="QueryCoverage=51%, HitCoverage=76%, E-value=3e-57, Identity=69%"; Hit description =Chromosome chr13 scaffold_48, whole genome shotgun sequence
  Pfam annotation: Domain name=PRA1; Domain location=135-288; Score =241.7; E_value=1.6e-69; Accession=PF03208.10; Description=PRA1 family protein
MTFSPHQHQSQSHQQWCWTVVGWRWSTVVLGEGGSAHAHLTLGRLFLDIYLYILTPPSRFSSFPNPKGPATESPLPIALSISSRAAIGDSRATMASPSSLPISSQSSASAAGASQSQPPIATPAFRAFISRISSSLRHAFAQRRPWTELIDRSSMSRPDTLAEAYSRIRKNFAYFRVNYLTLIVLALAVSLISHPFSLFVLFGLLASWSFLYLFRPSDQPVVLFGRTFADRETLGILVVLTVFVIFLTSVGSLLISALMVGLAIVCAHGAFRVPEDLFLDDQEPNSSGFLSFLGGAAASAAAPAVARV

SEQ ID NO: 171124 - protein, 301 aa, Glycine max
  Coding DNA Sequence Number=SeqID_79439
  Gene Ontology: Mol. function=binding; Cellular component=endoplasmic reticulum; Biological process=intracellular protein transport
  Homolog annotation: Hit_ID=A9PB12; Match level="QueryCoverage=92%, HitCoverage=92%, E-value=1e-113, Identity=70%"; Hit description =Putative uncharacterized protein
  Pfam annotation: Domain name=NSF; Domain location=111-122; Score=6.2; E_value=34; Accession=PF02071.11; Description=Aromatic-di-Alanine (AdAR) repeat
  Pfam annotation: Domain name=NSF; Domain location=131-142; Score=3.0; E_value=99; Accession=PF02071.11; Description=Aromatic-di-Alanine (AdAR) repeat
  Pfam annotation: Domain name=NSF; Domain location=32-43; Score=7.7; E_ value=20; Accession=PF02071.11; Description=Aromatic-di-Alanine (AdAR) repeat
  Pfam annotation: Domain name=NSF; Domain location=72-83; Score=14.2; E_value=0.5; Accession=PF02071.11; Description=Aromatic-di-Alanine (AdAR) repeat
  Pfam annotation: Domain name=NSF; Domain location=91-102; Score=4.5; E_value=60; Accession=PF02071.11; Description=Aromatic-di-Alanine (AdAR) repeat
  Pfam annotation: Domain name=TPR_1; Domain location=112-145; Score =16.3; E_value=0.059; Accession=PF00515.19; Description =Tetratricopeptide repeat
  Pfam annotation: Domain name=TPR_2; Domain location=112-145; Score =16.3; E_value=0.12; Accession=PF07719.8; Description=Tetratricopeptid e repeat
  Pfam annotation: Domain name=TPR_2; Domain location=53-86; Score=4.8; E_value=7.6; Accession=PF07719.8; Description=Tetratricopeptide repeat
  Pfam module annotation: Pfam domain module=NSF::NSF::NSF::NSF::NSF::TP R_1::TPR_2::TPR_2; Domain location=111-122::131-142::32-43::72-83::91- 102::112-145::112-145::53-86
MGDHLARAEDFENKAEKKLSGWGLFGSKFEDAADLFDKSANSYKLAKSWDKAGSTYIKLANCNLKLESKHEAAQAYVDAAHCYKKTNINESVSCLDNAVNIFCEIGRLSMAARYLKEIAELYESEQNIEQAVVYYEKSADFYENEEVNTSANQCKQKVAQFSAQLEQYQRSIEIYEDIARQSLSNNLLKYGVKGHLLNAGICQLCKDDVIAITNALERYQVQYFSRIYILRPDLDPTFSGTREYRLLADIAAAIDEEDVGKFTEVIKEFDSMTPLDSWKTTLLLRVKEKLKAKELEEDDLT

SEQ ID NO: 171125 - protein, 81 aa, Glycine max
  Coding DNA Sequence Number=SeqID_79440
  Subcellular localization annotation: CTP_CleavageSite=41; ConfidenceScore=5.15e-01
MGSSSLYLSQNMVTVCHLLRCSFTILLRNNLRSHLFFRGTSSESDKGHTFFLQSNLKIKGEKNRTKNALAWAKRRDLQHRR

SEQ ID NO: 171126 - protein, 235 aa, Glycine max
  Coding DNA Sequence Number=SeqID_79441
  Gene Ontology: Mol. function=motor activity; Cellular component=cell projection
  Homolog annotation: Hit_ID=UPI00016621D1; Match level="QueryCoverage =82%, HitCoverage=35%, E-value=2e-12, Identity=29%"; Hit description =UPI00016621D1 related cluster
MAEVNEVQELMKADMEAMKEQMVTMMEAMMSMKKIMEVNAAARLHALDFRGLHVLTFRGLHALAFRGLHALAFRGLHVLAFRGLHVLAFRGLHVLTYRGLHALAFRRLRALDFKGLHVLAFRGLHALSFKGIHVLTFREDCAFKGLHVLAFRGLQVLTFRGLQVLAFRGLHVLAFRGLHVLAFRGLHVLALGGLHVLTLGGLHVLTFRGLHVLAFSGLHVLAFRGLHVLAFRGLH

SEQ ID NO: 171127 - protein, 155 aa, Glycine max
  Coding DNA Sequence Number=SeqID_79442
HSIQQYPPLELIHKRCTLSCSQSTTQVDVPSTYTTKDVPSNVLRQRSQAVKPLILCEWGNKRILRREKGDTKEFKRLVLRSFGKGRRETQKEFKRLVLGEFFFAKGEEMKRMNSTSFQGLENQKTLESFWHKEEEEVQRDSRLVKDCIRLIGKVY

SEQ ID NO: 171128 - protein, 173 aa, Glycine max
  Coding DNA Sequence Number=SeqID_79443
MNILTTHDQRWEQELILYNQYEEERTPNLESVFEEFMAYHASSKANQNSMKNHEIHFGKNYSIENFQRGQELQPYYQNEAERGSNMDKLLMQFMETTKSTQQALQNVEIQVGELAEAVTQFMSRREKSFVETEAQEKKMSRKIRNKYNNNGRSIQQQKTNREIFSIAITFLIN

SEQ ID NO: 171129 - protein, 158 aa, Glycine max
  Coding DNA Sequence Number=SeqID_79444
  Homolog annotation: Hit_ID=A5BEJ0; Match level="QueryCoverage=24%, HitCoverage=3%, E-value=7e-07, Identity=60%"; Hit description =Putative uncharacterized protein
MGFMLVNLKKLGYHNDPFIMAEQARQVFYVQDPCDERWIMASPPSSPPPPPPPPSYASASPSIVKCTRKASHLRSLSTRPPGAERPVVHVDPATDKADGPHKKKLRTYLGIVVHDKMDVMYENWKEVPTAQKDLIWEDIQAEFEIPEASNSRRKKKLL

SEQ ID NO: 171130 - protein, 96 aa, Glycine max
  Coding DNA Sequence Number=SeqID_79445
MSSHTHCMLVSSFVMGSRKVHITFLNCTHGALRPQMRKKEHALRHPYQTCARAKAMGEVEEVQEQMKDDMEAMMSMKKIMKADVGSSDLGIIRRGG

SEQ ID NO: 171131 - protein, 90 aa, Glycine max
  Coding DNA Sequence Number=SeqID_79446
MGEPRNPSAQPIFFSADGPPPAVEEKRKLDLNEERLKVIEGFGDYPFTDMTDLCLVPDVIIPPKFKLQNMVKRESESLKEYAQRWRDLAA

SEQ ID NO: 171132 - protein, 69 aa, Glycine max
  Coding DNA Sequence Number=SeqID_79447
MSRNLTDCATIPSLTSGMLWNFTDCATMFPFDFWHLAKLLRLPNDGCQVPRSGHAKVASQQTDGPRTKL

SEQ ID NO: 171133 - protein, 134 aa, Glycine max
  Coding DNA Sequence Number=SeqID_79448
MLSVLCVNVDKFTIIMWEYIAGNESKVQRFAINLDDDSNDDDYMISNSYVEDSLDEEEDIDDISDIDEEGGSETAFWESASSYSNIKWSHPNEEDICGFDMRSTFNIVQELFVGMEFESKNALKNALQKYVMKG

SEQ ID NO: 171134 - protein, 40 aa, Glycine max
  Coding DNA Sequence Number=SeqID_79449
MRPPLSSSETPVSAKYGKEGEMGVTYFKSFWVGTIVIEIN

SEQ ID NO: 171135 - protein, 112 aa, Glycine max
  Coding DNA Sequence Number=SeqID_79450
MGSGRSRRRLPVNVPSCRRFRKTERRVYGKGFTGSRKYLQSIRLRQERGLRTIGRIELAYGRIEVKAARFLDLAQFLTKLHKISSTSSDMDNRSKEQLCACKVYVAGHLALG

SEQ ID NO: 171136 - protein, 64 aa, Glycine max
  Coding DNA Sequence Number=SeqID_79451
MAESPQEQVQMVEMAVGSYLECHRLLGCRGPTPSRGRRLVSWSGHLCIKLLHAYNVLDKWPQIS

SEQ ID NO: 171137 - protein, 253 aa, Glycine max
  Coding DNA Sequence Number=SeqID_79452
ARQHGAGIAGFRRGLEQGALHVDHDQGGRHGSLGKSGSRPGKAGPTGTERRANRIRRRPARAARCARTSRNGAARRAPAGNGAAALRGGNGSVPARRPRRYWCPAPWPAPAPGPASAGPTRSWPRRPATRCRGASAKARGRRRFRRDARPARSREPDRADQAVVGLDDGQAHAVAGGRVGIAADQWRQRVRAVQLPTDRHTTVSRRCRARDAGAGRRYPGQARVAASRQEAGAWGSHVAKIVPARLRAGHGTA

SEQ ID NO: 171138 - protein, 131 aa, Glycine max
  Coding DNA Sequence Number=SeqID_79453
MAVQLIHDRVVMECLEGVWETLKGNERCRFRATIRLTATSLPVEWILPTPTPYRLVEPVQLIEVSSSEEDLEEDPKELPPELAMDAPDLPEDDEDPLSDVDSPEDIMSASEADSTEESGPEGTANSDDSSS

SEQ ID NO: 171139 - protein, 133 aa, Glycine max
  Coding DNA Sequence Number=SeqID_79454
MRGQDIYSSQDKATTLPSSSECEEAKGAESSEEIYPQEEGLPLVVKEKCKEALSEIQLAKRTVFTFRLSDFFGCGETEKELSLTRKPSCGAFDEILRGCEEASLLWRAKSSVGSSYGVLDGHSILGNGLILRT

SEQ ID NO: 171140 - protein, 72 aa, Glycine max
  Coding DNA Sequence Number=SeqID_79455
MNWIHASSTIESGAPRIALPCTIHLSSTLKSYPEAHELIVIHASSTIESGAPRIDCLALFVYPPPSNLIGGP

SEQ ID NO: 171141 - protein, 143 aa, Glycine max
  Coding DNA Sequence Number=SeqID_79456
ITPTRHPVDPEKSNRALRFPALVTGLCQSYRMLVPPSKPARHPVDPEKSNRVLGFPALITGLCQFYGVPVTPSKVIRPPTNRAFIKKCAPRQAQGETPQQSGDGRQRAIDAPPPPPEPLSSSKKVGAWPTTRGRPTGDQVQSQ

SEQ ID NO: 171142 - protein, 98 aa, Glycine max
  Coding DNA Sequence Number=SeqID_79457
MPISPCRCISWDRAHKTPSGPEEVQQGPGVSSSGYGPLSVLQGARPPARSCHRDIGIAPTKTPSGPGEVQQGPGVSSSGYGPLSVLQGARPPGKVASS

SEQ ID NO: 171143 - protein, 122 aa, Glycine max
  Coding DNA Sequence Number=SeqID_79458
VGFEEVKDADAPIPVPTDEGAVSLAKPSDRSHPEVDDPLYLMTLTIPQLFLKSLQVMWDASLFRLFNSDFPLYIKHEDLSEIAHGGQWLSISIIQLWILHMIETNMRLGNFDVYGFLESQSI

SEQ ID NO: 171144 - protein, 38 aa, Glycine max
  Coding DNA Sequence Number=SeqID_79459
AGEAPAGALAEAPDEADEAREDEEMTDLLDFLGGSGAT

SEQ ID NO: 171145 - protein, 382 aa, Glycine max
  Coding DNA Sequence Number=SeqID_79460
  Gene Ontology: Mol. function=monooxygenase activity; Cellular component=plasma membrane; Biological process=biosynthetic process
  Homolog annotation: Hit_ID=A6T9L8; Match level="QueryCoverage=80%, HitCoverage=94%, E-value=1e-123, Identity=71%"; Hit description =Putative monooxygenase
  Pfam annotation: Domain name=Bac_luciferase; Domain location=50-376; Score=81.9; E_value=2.1e-21; Accession=PF00296.11; Description =Luciferase-like monooxygenase
  Pfam annotation: Domain name=oligo_HPY; Domain location=43-91; Score =24.7; E_value=1.8e-06; Accession=PF08352.3; Description =Oligopeptidedipeptide transporter, C-ter
  Pfam module annotation: Pfam domain module=Bac_luciferase::oligo_HPY; Domain location=50-376::43-91
RRSAIAATVTARAGPHYLFITHDLATVRRLAHSVTVLRAGEVVEQGDTVTLFNAPQHPYTRALIDAIPRYRLATEQIQHAERCGFDSAWIAQHHFHEKEGGLPSPLVFLAHVAAHTRHIRLGTGIITLPLENALRVAEDAAVLDLLSDGRLEVGLGSGGTPTSFLPFGLTSEQRAGVFADQLHTLLSAWRGDTLAHPDNHLYPPAPTLAQRVWIATFSVAGATRAGQAGHGLMLSRTQPRPAGQPDLSLQQLQNPMIDAYLAALPSGVAPRILASRTAFVADSNDYARRLAAPGLQRQAEQFRKAGHDITGSTLESHARQLDAHIGDADAVLASLLADSTLTRATDITFQVHSIDPPHADTLRSVALIAEHIAPTLRALGTA

SEQ ID NO: 171146 - protein, 89 aa, Glycine max
  Coding DNA Sequence Number=SeqID_79461
MTFMGIREKVENGELANSARQRHPWGSRLEDGGHMKSARQRHSWGSEKSGEWRIALEGPHLGNHEAYLQTRRWRTHEQHLAMTFAGLQT

SEQ ID NO: 171147 - protein, 223 aa, Glycine max
  Coding DNA Sequence Number=SeqID_79462
AEFDIPEASDLRTKKKILQTVGERWRQFKSDLTSKWALAADKDSVDDTVCKMYGISKEKWTQFCQSRRDPSWENVRKKAQAVQKQNTAPHVMSRGGYEYLEKKLMDEKRKKKLEKATQSGSTDTVIDPPSPIKRHVKWKLARTKKTGDMTSEAAKEIADKIEPYNHQTILWISFKDLLHCSRIPATVDATNQGPTRGFNHRKSHSTANVIPQPNAITGTRTAS

SEQ ID NO: 171148 - protein, 136 aa, Glycine max
  Coding DNA Sequence Number=SeqID_79463
MQYFTNVRPLEPERLKALRIQWAKYYLKEKFLRYRTSLANVCRCSQNQSQGIELNVQKDEGFVTRNGMSATEMVAGGWLCGKDGKGRGGSTDVEVGMVAMEDNHELSMKAPNATNAGTMGKNNLASRARNLHKREK

SEQ ID NO: 171149 - protein, 163 aa, Glycine max
  Coding DNA Sequence Number=SeqID_79464
METTTNFSAAIEENPKGHCKAIISTIECDAGSEKEEKVQESTMLEEEMKAQANPSTQGMQSSLNPPLFDFIMPSIHKQRDDERMVKFKKYMEMLQGKREEPPIEKTHMGCATSSTSCNLMPHSFLENIGHLNLKLANMTLQFADGSENKALWKSRRTTKFQSF

SEQ ID NO: 171150 - protein, 230 aa, Glycine max
  Coding DNA Sequence Number=SeqID_79465
MYGVDKKELLKANISRGYLLMKRNSSVYIFYMSAKAETYLTVQGTPSDMHLQLAQISMEVPLILEEEYMGFFLDSLHEDIRMEDGGPTLSATGSSMPTDKGPRYNSDQSTNLNSRGHTWDDPIDEIQPVSDDPPTFDDHEMECLTLNYRALDPRELTCYITIKLEGDLLVVADVHPRGLPSFTNQNWWVHHRGECICSRFVESQLGFGWLATCGLTTMDWTKKMVSFDDE

SEQ ID NO: 171151 - protein, 886 aa, Glycine max
  Coding DNA Sequence Number=SeqID_79466
  Gene Ontology: Mol. function=binding
  Homolog annotation: Hit_ID=A7PLS9; Match level="QueryCoverage=98%, HitCoverage=70%, E-value=0.0, Identity=75%"; Hit description =Chromosome chr14 scaffold_21, whole genome shotgun sequence
MDILFAQIQADLRSNDALRQSGALLQALQQSAAGRDIAVIAKTAVEEIVAAPASAVCKKLAFDLIRSTRLTPDLWDTVCGGIRTDLHFPDPDVAAAAVSILAAIPSYRLSKLISDCNKEISDCFDSPSDSLRFSATETLGCVLARDDLVTLCENNVNLLDRVSAWWARVGSNMLDRSDAVSKVAFESVGRLFQEFSSKRMSKLAGDKLVDSENSLAIRSNWVSSMVDFVWRKRRALMARSLILPVENFRATVFPVVYSVKAVASGGVEVIRKLSKASSTSASNADAEVDSHAEKLVGVSDVLTHLAPFLVSSLEPALIYEVGINMLYLADVPGGKPEWASQSIIAILTLWDRQEFASARESIVRAVVTNLHLLDLHMQVSLFKRLLLMVKNLRAESDRMYALACICRTALCVHLFAKESVRRGQKPLPGTDIASLFEDARVNDDLNSITSKSIFREELVASLVESCFQLSLPLPEQKNTGMESRVIGALAYGTGYGALNWTEPALEVVEVCRPCVKWDCDGRTYAIDCYLKLLVRLCYIYDTRGGVKRVKDGASQDQILNETRLQNLQRELVKDLREVNTPRILARLIWAIAEHIDIEGLDPLLADDPDDPLNVIISNIHKVLFNIDSTAETTNRVQDVQAVLISAQRLGSRHPRAGQLLTKELEEFRNNPLADSVSKHQCRLILQRIKYATSHQDSRPPIRKGMTTGNILLSQNWREGCIKMERVNEGWAGVTEARGDYPFSHHKLTVQFYEASAAQDRKLEGLVHKAILELWRPDPSELTLLLTKGVDSTLLKVPPNAITLTGSSDPCYVEGYHLADSSDGRITLHLKVLNLTELELNRVDVRVGLSGALYYMDGSSQAVRQLRGLVSQAGVKECLISWAYFDT

SEQ ID NO: 171152 - protein, 113 aa, Glycine max
  Coding DNA Sequence Number=SeqID_79467
MTISWNPFFNCLNLLRITIVEANLVGAMDSNFNELNELKIDSLIECVSKVKEAQCRVRCSIALSEPCPYRVGAMSEPKRMGFSIRTPVGHVQCALYGHCTSIDVGFVSDTRTR

SEQ ID NO: 171153 - protein, 94 aa, Glycine max
  Coding DNA Sequence Number=SeqID_79468
MRLNCLQAVNLGKCSVIKAELWAIHLTTTRAKSRGFLLVEIDTDSQLKVNMIQKGVSLYHPCHAIVSEILEVLIAFQNYGIRHIYREANFPAVC

SEQ ID NO: 171154 - protein, 68 aa, Glycine max
  Coding DNA Sequence Number=SeqID_79469
MANLLHINYNTKGKRKTYLVINANTDTSSPRRMAIESENTTGSECEWGTSFIRASASVGEKREELECR

SEQ ID NO: 171155 - protein, 88 aa, Glycine max
  Coding DNA Sequence Number=SeqID_79470
MGGGEGEVNARLMMKAIQEQFKASNTKLDDLQSMFRFRSPRENTYEEREENFLEEEKIELAISKFIDYASIWWDQFLSSRHRCGEKKS

SEQ ID NO: 171156 - protein, 88 aa, Glycine max
  Coding DNA Sequence Number=SeqID_79471
MAMVMGPLLGRIASTREGLRSQYYLKEAMKWRIGGIFSTKSLRRILRISLQLKCSSWCVGLAASNDSLRRPPVVVGGGEGGVRVWVAF

SEQ ID NO: 171157 - protein, 63 aa, Glycine max
  Coding DNA Sequence Number=SeqID_79472
MIQRTNCLGILCPNTLEVQVEGTSTWFFKENKGGYIPCGSLASKEFYKVERNLKNRRLLGDWM

SEQ ID NO: 171158 - protein, 79 aa, Glycine max
  Coding DNA Sequence Number=SeqID_79473
MASGLREIGFQRRRTRTRRKKDGIGNELNPHKGKNDDLGLIHCWIVVKFEYHVRNPILGILTVGNCKNMTELREIPFAP

SEQ ID NO: 171159 - protein, 112 aa, Glycine max
  Coding DNA Sequence Number=SeqID_79474
MAFEATISAICTSVRLIGTTIIGTIGNSIVDFSVLKKLYVSTSIGIESAFIAKIIASILAIEKVILGGIHHLLSFLRSLVDTQMSFLFKGSFSLASLGMVWPSQVFCSSFHQ

SEQ ID NO: 171160 - protein, 443 aa, Glycine max
  Coding DNA Sequence Number=SeqID_79475
  Homolog annotation: Hit_ID=A5B5V0; Match level="QueryCoverage=41%, HitCoverage=40%, E-value=4e-08, Identity=25%"; Hit description =Putative uncharacterized protein
  Subcellular localization annotation: CTP_CleavageSite=32; ConfidenceScore=5.22e-01
MAEPSKKRKGSSSQSQRHSGSQETPIPPSIPSGSLFSSEEQRIQYTNLFSSCSIVDPKFIDMEFFSNENFECFQAFENSNLIPFMSLKLPVYSELVKAFYSNLEIHEGILMSEIYGIKMVIDQSLFYDLTKLPSEGVPFEGALIDDWKFNFSVHDARRLVCTNQADMTGRLLGGSLAFESRILHYLIVRILLPRSSNLAQVSEEDLIVMWAFHKGLQIDWAHLEHDGSWVKKGARNVGEEGHEGEDSSLLSTIMDRFDGLQTFVGERFDTLELQVDMRFNEMESRTTKVEEDDGLRYSVAYTKHIKRKTGTVVAVVAALKRQRKVERAGHGVACCGMSAGRGGRVGMDVGVMRVSDGGGLIGGGNDGVSGGGNGVVSIGAATVEGRKMERSVVSGVVVVVEWFAEVLQPWWEDSMKAPNCYKQNFYSKALAKDATTETKGARM

SEQ ID NO: 171161 - protein, 85 aa, Glycine max
  Coding DNA Sequence Number=SeqID_79476
MEARKKKGFGSEEEERLRQERGLRIIGRFELVYTRVEVEAARFLDLAQFLTKLHKISSTSSNVDNRSKEQLCACKVYVAGHLALG

SEQ ID NO: 171162 - protein, 24 aa, Glycine max
  Coding DNA Sequence Number=SeqID_79477
MAPKTCSNPASAPDHASCIKQYVN

SEQ ID NO: 171163 - protein, 402 aa, Glycine max
  Coding DNA Sequence Number=SeqID_79478
  Gene Ontology: Mol. function=transcription factor activity; Cellular component=intracellular; Biological process=regulation of transcription, DNA-dependent
  Homolog annotation: Hit_ID=P31460; Match level="QueryCoverage=50%, HitCoverage=89%, E-value=1e-103, Identity=93%"; Hit description =Galactonate operon transcriptional repressor
  Pfam annotation: Domain name=DGOK; Domain location=297-402; Score= -20.8; E_value=2.7e-12; Accession=PF05035.3; Description=2-keto-3 -deoxy-galactonokinase
  Pfam annotation: Domain name=FCD; Domain location=169-291; Score =78.7; E_value=1.9e-20; Accession=PF07729.3; Description=FCD domain
  Pfam annotation: Domain name=GntR; Domain location=77-140; Score =60.0; E_value=7.9e-15; Accession=PF00392.12; Description=Bacterial regulatory proteins, gntR fam
  Pfam module annotation: Pfam domain module=DGOK::FCD::GntR; Domain location=297-402::169-291::77-140
IPPLGIKPDEIMALGDQENDIAMIEFAGMGVAMDNAIPSVKEVANFVTKSNLEDGVAYAIEKFVLSRAQGLSMTLNKTDRIVITLGTQIVGGKYVPGSPLPAEAELCEEFETSRNIIREVFRSLMAKRLIEMKRYRGAFVAPRNQWNYLDTDVLQWVLENDYDPRLIGAMSEVRNLVEPAIARWAAERATSGDLAQIESALNDMIANNQNREAFNEADIRYHEAVLQSVHNPVLQQLSVAISSLQRAVFERTWMGDEANMPKTLQEHKALAGSTHHDCQLDTKAEGNHMTSRYIAIDWGSTNLRAWLYQGEQCLESRQSEAGVTRLNGKSPEAVLAEVTQNWRDGATPVVMAGMVGSNVGWKVAPYLPVPVHFSAIGEQLTSVGDNIWIIPGLSVSRDDNHN

SEQ ID NO: 171164 - protein, 116 aa, Glycine max
  Coding DNA Sequence Number=SeqID_79479
HVATTTVEALDQETKRAQKEEWSSNKSRGALWGSNNELKLRMAERDESRVESMGKHVKVSALQMEREARERVIESLHGKAVKWMGRFALTLNGSQELPRLLARAKAMVDVYSAPDE

SEQ ID NO: 171165 - protein, 83 aa, Glycine max
  Coding DNA Sequence Number=SeqID_79480
MAVGYDVRMIHDLEGELQGEQEQKADVTIHDVGYNVQDILPKNTGIAKSIEAAGFTMSDTMSRTSCPKILEVLHNAQGQIKVK

SEQ ID NO: 171166 - protein, 124 aa, Glycine max
  Coding DNA Sequence Number=SeqID_79481
MNNMITLQHTEIKASFETSTHVVGHVFKVALYKRLLAMVSRRLSFLDQGLSEPQVTIKEEMKIISKRFEELDVCGKVTLKSKLQEIAYHDQKSMCPPPEKVNTKGAQKKPMNRNQRSTKRDSSY

SEQ ID NO: 171167 - protein, 114 aa, Glycine max
  Coding DNA Sequence Number=SeqID_79482
MQMKPLEDIKPQIKPPKQCKRNERKKTTNLTKSANPHNHENAGEGRANHKQLKNPTNRYILCGTSRGYIYLGLTENKRGYISCGSVLVEGTSTRFKENKGGYITCGSLLVNEFL

SEQ ID NO: 171168 - protein, 178 aa, Glycine max
  Coding DNA Sequence Number=SeqID_79483
  Homolog annotation: Hit_ID=A5C7Z4; Match level="QueryCoverage=64%, HitCoverage=40%, E-value=1e-07, Identity=28%"; Hit description =Putative uncharacterized protein
MFGVFNPDFPLYIKHEDLSEIAHGGQCLSISVLRLWILHLIETSMQAGNSDIYGFLEPQFIQSGHWQMVVIVPKEHLVVWFCSLHNRPDNYLKGIINSVLKGLHDAPQPKSKAPARWIVFKCNRQRGSTECDYYVMHCMSTIILGSFKNNWEAYFNDPRPLELERLKALRIQWPQYYL

SEQ ID NO: 171169 - protein, 198 aa, Glycine max
  Coding DNA Sequence Number=SeqID_79484
MAEVDEVQERMKANIEAMKEQMATMMEAMMSMKKIMEVNAAAVATVITFSGNKQVFPPYGLPPNYTPPNENVNNSSPILIESQQLQYDHAHVSQPMGETHEMPHHNLADFKPCLGYATEGKAVGGIPLQNTLEGPQYHPQPHLLHSAAGKNPHAMVEMGKLDHLEERLRDIEGGKHYAFANLEELFLVPNIITPPKFK

SEQ ID NO: 171170 - protein, 72 aa, Glycine max
  Coding DNA Sequence Number=SeqID_79485
MASKKRKAPSTPTQARFDKSRFTSQEAWERYTDIVVPRKLLPERNVVVYYTEFDEFKEELERRNWDDPDLHS

SEQ ID NO: 171171 - protein, 293 aa, Glycine max
  Coding DNA Sequence Number=SeqID_79486
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSIQAIDGDCVPSIEFRVFRVPFQSLFKAGLGPFIILSTTLRQGSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 171172 - protein, 64 aa, Glycine max
  Coding DNA Sequence Number=SeqID_79487
MLRLTNNRMLRMLKRSAKVVAKSVAKHYSQQNTKTEIGKALNRKAKTKQHTKQNNKTLNDTKQH

SEQ ID NO: 171173 - protein, 67 aa, Glycine max
  Coding DNA Sequence Number=SeqID_79488
  Subcellular localization annotation: CTP_CleavageSite=29; ConfidenceScore=5.18e-01
MYVGFSSSQDNVGSVGGFCGFQQGQCGFSGSVGGSVGSNEDNVGVEGAISGRFQAGGEREQRFQAGG

SEQ ID NO: 171174 - protein, 294 aa, Glycine max
  Coding DNA Sequence Number=SeqID_79489
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDQIKELQAKLERARQNVRTERQSAQRRVDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 171175 - protein, 132 aa, Glycine max
  Coding DNA Sequence Number=SeqID_79490
  Homolog annotation: Hit_ID=Q6WAY3; Match level="QueryCoverage=96%, HitCoverage=5%, E-value=6e-08, Identity=30%"; Hit description =Gag/pol polyprotein
EETKAKAPRSGQTSPKRFHRAHISRSFVSTGLRHKGQAAAICDEDSPRRSNLVQPCPPGFQLGNRQVEECPEVYTTSIISNNESREGTNTGDPAVDFEQEASQTKDEENEDVGLPPELESIIAQEDREIKPH

SEQ ID NO: 171176 - protein, 285 aa, Glycine max
  Coding DNA Sequence Number=SeqID_79491
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPGELELHRGGGRSRTSGSPGLQEFDEESPQVKGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 171177 - protein, 189 aa, Glycine max
  Coding DNA Sequence Number=SeqID_79492
  Subcellular localization annotation: CTP_CleavageSite=12; ConfidenceScore=5.08e-01
YNPDWRNHPNLRWASPPQQQQPVPPFQNAAGPSKPYVPPPKHWQQSQQRQQATEAPPQPSLEELVRQITIQNMQFQQEIRASIQSLTNQMGQMDTQLNQAQSHNYDKLPSQTVQNPKNVSAITLRSGNQIQVPPPVAAPVSEPVKLHSTPEKEDEIVAQKRKLPKKNFMQVDLLLVILTYRSHPSSIPT

SEQ ID NO: 171178 - protein, 31 aa, Glycine max
  Coding DNA Sequence Number=SeqID_79493
MHMTQMQFTKYGKPEKIVSFLDTTFGQRWHP

SEQ ID NO: 171179 - protein, 98 aa, Glycine max
  Coding DNA Sequence Number=SeqID_79494
MADTFLPRKSYGGSCYLCQYNVFGYDATTEHVQKGGMIFQRIRPKVERPGSSSGTSMTGKKMMTTDTLPVFYYEKMVSYTPSSFDDMVFIDERIDVGL

SEQ ID NO: 171180 - protein, 95 aa, Glycine max
  Coding DNA Sequence Number=SeqID_79495
  Homolog annotation: Hit_ID=Q2HW90; Match level="QueryCoverage=60%, HitCoverage=11%, E-value=8e-08, Identity=45%"; Hit description =Putative uncharacterized protein
MGPLQRQAFRKVYGKILDLTTAEVFTEAVVSLAQYYDQSLRCFTFGDFQMVPAVEEFEEILGCPLGGRKLYLFSGFLPSLSKIAAVIGDSARELD

SEQ ID NO: 171181 - protein, 172 aa, Glycine max
  Coding DNA Sequence Number=SeqID_79496
MPPTRHPLDPDKSNRALGFPELITGLCQLFGVPVTPSKVIRPPITRAFIEKYCTPRQVQGDAPQAADAPPPPHQADPAGSLGMEWYLQHLVRQQAANHRGQVQIHECLYQLSLSQQGCPTLDQFRAEVAWPGDWPEDQTEEAPTGAPDDAEDARMDEEMTELLGFLGGSGAT

SEQ ID NO: 171182 - protein, 86 aa, Glycine max
  Coding DNA Sequence Number=SeqID_79497
MGEPIIGCPYHASQELLPVCLSDEDMTKSKGKDPLEGLGGPMIRARARKAKEALQQVLSILFEYKPKFQGEKSKVVSCIMAQMGED

SEQ ID NO: 171183 - protein, 114 aa, Glycine max
  Coding DNA Sequence Number=SeqID_79498
MVMGDPISRLSFPACLHFSGENTETFSSLTSYPELRRSEFLIGGYVGARASLLSTTPPFVAITQEPVARGDTFTVIRTPLLGRHSCVRWHAETKFGHSAHMIRGDTLRLSAPLC

SEQ ID NO: 171184 - protein, 136 aa, Glycine max; identical to SEQ ID NO: 130398
  Coding DNA Sequence Number=SeqID_79499
  Homolog annotation: Hit_ID=Q84VI1; Match level="QueryCoverage=70%, HitCoverage=14%, E-value=7e-35, Identity=81%"; Hit description =Envelope-like protein

SEQ ID NO: 171185 - protein, 197 aa, Glycine max
  Coding DNA Sequence Number=SeqID_79500
  Homolog annotation: Hit_ID=A7UQU7; Match level="QueryCoverage=58%, HitCoverage=18%, E-value=2e-13, Identity=32%"; Hit description=IMP dehydrogenase/GMP reductase, putative
GAATLVHMYDQLNEACQTPTRQMTRYLTLSQCWIYEHFPSVYQCVTDDAYAETTPCASWWLTTKAHMRGVTGASYRARLDALTITNVCWMPYAGHRGVRGFDLIFCFQGQLRWVLLWSLFDQRGWYDNSAPAGEICVVPGQVSADYMDWFFQISHPFVTLTQAGDQPRHPPTPHDEEYVEPHIPEVLVAFDLPRHSV

SEQ ID NO: 171186 - protein, 242 aa, Glycine max
  Coding DNA Sequence Number=SeqID_79501
  Homolog annotation: Hit_ID=A5AZG1; Match level="QueryCoverage=43%, HitCoverage=33%, E-value=2e-07, Identity=33%"; Hit description =Putative uncharacterized protein
  Pfam annotation: Domain name=zf-CCHC; Domain location=169-186; Score =19.0; E_value=0.002; Accession=PF00098.14; Description=Zinc knuckle
MVEEEEGEKQREGEGERELSEIGLTTKSEKNLTFETLKSCLGLRAISLIPVPRVSLRPSGPVFERCHSSHTKHHSKRRENERKPQEVNIKLPYFHRKDNVEAYLDWEIRVEQKLKRKPTLKSYGYHSFPKKDQGLGILGAAPSKPNDDKGKTIEKQPPKASMQEKTSSIKCFKCLGRGHITSQCSTKKTMIMRSQDIYSSQDEATTSPSSSESEEAKGEESNEEIYPQEEGKPLMVKEECKE

SEQ ID NO: 171187 - protein, 29 aa, Glycine max
  Coding DNA Sequence Number=SeqID_79502
MTQENINIGGTYIDIGDPVWECPHCKAMM

SEQ ID NO: 171188 - protein, 149 aa, Glycine max
  Coding DNA Sequence Number=SeqID_79503
  Gene Ontology: Mol. function=protein tyrosine/serine/threonine phosphatase activity; Biological process=protein amino acid dephosphorylation
  Homolog annotation: Hit_ID=A7P490; Match level="QueryCoverage=65%, HitCoverage=11%, E-value=7e-16, Identity=45%"; Hit description =Chromosome chr1 scaffold_5, whole genome shotgun sequence
MAAEGMICDIGWKVLRVADNNKVSGERIVRRPLAIHKHNVLEWPSVGCDDLGDWYLPPTPRGSSKTPDSGSGQVFQFKKEYYAFYDMECLRIMEHVYLGSDTVAKSVELLRRCRRPFSFSFSFSISLKNPFFIFCAWLFLKLIYTQMNN

SEQ ID NO: 171189 - protein, 136 aa, Glycine max
  Coding DNA Sequence Number=SeqID_79504
MAERIVVLTSTTDADNAPSTVDAGSWFVAPLHGNTAPLHGGSWFVAARASSFMAEEEEEESNGEEEEGSARKKKNGSGEEGSARKKKNDSVRGRRKELLGERRERVAGEREGIKDFSSKVLGTPAKMLGAPSSTLI

SEQ ID NO: 171190 - protein, 135 aa, Glycine max
  Coding DNA Sequence Number=SeqID_79505
QVIKVTSSEEDPEELPPEPVVDALDFLGGDEDPLPEVDSPEDVMSASEADSTEESGPGGIATSGGDSLKEVLWRHEWRVHGKEKDGEGWLVVSGGTDGGVPSGGGTGGASDASLARILLGPGKIMERSAGFQQFS

SEQ ID NO: 171191 - protein, 188 aa, Glycine max
  Coding DNA Sequence Number=SeqID_79506
MNSLSEHVVLTEFIGTYCIEAFSEELTKRAYRAKRVHPLRMNTHPLAELPVAKRARFVAASAELSELLSLSSQYLVKFLEELVPLSAAFKELSAYPYGRCQLSGPCLAKRPVKIYHSELDEFKAELERRNFHKRLTNLVDGSIDLALVKEFYVNLYSSEDHPPKQSRVRGHLVKIDVDSLNTFLETPM

SEQ ID NO: 171192 - protein, 65 aa, Glycine max
  Coding DNA Sequence Number=SeqID_79507
MLNGVLNRVEKGEIAKAVMALKNAEIDEGYTIDVVAARQVLWSLITPTGRKAKAEYTTVSRYNTL

SEQ ID NO: 171193 - protein, 550 aa, Glycine max
  Coding DNA Sequence Number=SeqID_79508
  Gene Ontology: Mol. function=4-(cytidine 5'-diphospho)-2-C-methyl-D -erythritol kinase activity; Cellular component=chromoplast; Biological process=isoprenoid biosynthetic process
  Homolog annotation: Hit_ID=A7Q2G5; Match level="QueryCoverage=48%, HitCoverage=73%, E-value=7e-53, Identity=46%"; Hit description =Chromosome chr1 scaffold_46, whole genome shotgun sequence
  Pfam annotation: Domain name=GHMP_kinases_N; Domain location=167-225; Score=57.6; E_value=4.2e-14; Accession=PF00288.17; Description=GHMP kinases N terminal domain
MVGRHVEGAGAGASKKSFLNYMPQNFLYCSNSGCGSGLSGETISENGHHWIGLDILASMLNVAVEREIEGDLLLGDMGQGLGICPEVMDGAINISVVQALQTVGNSLNFNPSKGRITNKREDGYHDLASLFHVISLGDIIKFSLSPSKTKDSLSTNVSGVPLDDRNLIHLDKWVPTGAGLGGGSSNAATALWAANQFSGCPASEKELQEWSSEIGSDIPFFFSQGAAYYTGRGEVVQNIPPPVSLDVPMVLIKPPEAFVLIVLVIALYPAKGSKAVAESGRATPGYCSPILATAMSDLIPAFTFILAIVFRIKKLDWKTNSTWAKSIGTLVSIAGALIITLYKGQAVIKNHPSNKLFPKKHVSSEQFDWVLGAVLLAGHSFVLSLLFIVQTWIIRNYPTELVIVLTRSTLVAMLSIPPSLISVTDPKALRLGFDVNLIAIAFQAIFGVSLRSIVHIWVMSKKGPLYVAMVKSIGIIFAVIMGIAFLGDSIYLGRHTFLSCLNHMKNWSVLGAAIIWGKSQEQAKEECEVYDDSESYSPVVPLLKNKRMEE

SEQ ID NO: 171194 - protein, 113 aa, Glycine max
  Coding DNA Sequence Number=SeqID_79509
MSQNFTDYPTIPSLAFGMLRNFRDCTIMFPFDSRHVAELNKLLNDGCQVPRSGQAKVASQQTDGPRTKLGNRLGKQQKLYFPLTGGSVLDNGGRTNNARQSIRGALDLMVEDA

SEQ ID NO: 171195 - protein, 77 aa, Glycine max
  Coding DNA Sequence Number=SeqID_79510
  Gene Ontology: Mol. function=protein serine/threonine kinase activity; Cellular component=integral to membrane; Biological process=protein amino acid phosphorylation
  Homolog annotation: Hit_ID=Q9SJT0; Match level="QueryCoverage=68%, HitCoverage=6%, E-value=4e-14, Identity=77%"; Hit description =Putative uncharacterized protein At2g21480
MVGLERFTRVLLIMGSKWLSKDRIRNQVHVSTPLKGSFGYLDPEYFRRHQLTKKSDVYSFGVVLSEALYLRKVALDT

SEQ ID NO: 171196 - protein, 212 aa, Glycine max
  Coding DNA Sequence Number=SeqID_79511
  Homolog annotation: Hit_ID=A5B612; Match level="QueryCoverage=50%, HitCoverage=38%, E-value=3e-16, Identity=41%"; Hit description =Putative uncharacterized protein
MGIFIQSIDPGAWNAIVKGPFVPTKEVNGELVPKEWDEMKDDETRKVQDDEKAKNIFTCGLSSDEFFHTPRCKSEKEIWKMLEVSCEGTTDVRRERKHTLVFKYEAFRMKNGKQGHVKSDCPIYLRKQLVEKKGNKDRKSKRAYISWEDNVSTSSDSSSEEEVANVCLMDDSKDDSSTIEETEVNSEFEEVLEVFNEMHEEAQRLIVSKNKS

SEQ ID NO: 171197 - protein, 114 aa, Glycine max
  Coding DNA Sequence Number=SeqID_79512
MELKGLVAARAEMIRLKVESVGLVLNDDISVMQRGLEEELVGHGEGEVSAIEAEEDGGDKGVAEEGGLGGMGVEGGGEEGEVEDSAGLVEGKGEEVRIEGEEGGVHVAEDEKGF

SEQ ID NO: 171198 - protein, 42 aa, Glycine max
  Coding DNA Sequence Number=SeqID_79513
MGGGGSKWVMVDWCFVHGCFAIAIAVGGVVSLLWEKEKRHHF

SEQ ID NO: 171199 - protein, 101 aa, Glycine max
  Coding DNA Sequence Number=SeqID_79514
MHNSSFFHILPRAQPRRVLLSGWLGKPEDWLSEKSDPTKFKLYDEDLLTLVERVNKAILEQLSASLEMWTIFSLPSVSDPLVALNGKTARKLHFKQNLEES

SEQ ID NO: 171200 - protein, 61 aa, Glycine max
  Coding DNA Sequence Number=SeqID_79515
MFAYRPFAKRKTRAKCIFGHALSRESLALSTQPLHLRLTWSTKLPKAELSPSQFGLNWAKR

SEQ ID NO: 171201 - protein, 162 aa, Glycine max
  Coding DNA Sequence Number=SeqID_79516
MVKRKVIHTRRPNQLALLCLLGNFYYLTNTEHAYTNPLKNLRIARHGKFGENSARSSVLAWVYRPTKPRPNDFGRKPIELVQPSRPNSIQARLIPLVQPNSVSSTEFGSVISAEGSSANTAEFSASRTFLDGSANMIQASQALQVQPNFTQHVPYSHSWPNQ

SEQ ID NO: 171202 - protein, 38 aa, Glycine max
  Coding DNA Sequence Number=SeqID_79517
MSASRKLNTGKKTVLSWMIETGTILQHEKEDYEDGDEL

SEQ ID NO: 171203 - protein, 64 aa, Glycine max
  Coding DNA Sequence Number=SeqID_79518
MTKVNKDPFLGLGRIDGDPVLRETMIWATWEYVSSVGGGQQGMVGLCAIYGCGKLVVHHRPTAI

SEQ ID NO: 171204 - protein, 52 aa, Glycine max
  Coding DNA Sequence Number=SeqID_79519
MREGNVFCTQNFPPSFKRARLTGLTVFAPPSHLWLHFAIIFGTPTHSNKGWP

SEQ ID NO: 171205 - protein, 227 aa, Glycine max
  Coding DNA Sequence Number=SeqID_79520
  Homolog annotation: Hit_ID=A5C9E2; Match level="QueryCoverage=81%, HitCoverage=24%, E-value=3e-49, Identity=54%"; Hit description =Putative uncharacterized protein
RHVLVDGKVRTDKTYPAGFMVQALQELTDIETQRKQEANEFSFKLESTMRKWKEAIEEIDESKELEMKLAMRISDVDFLQNELKSVKEMDKRVQGDGSAKQLEGRFKKGEESEDSIVLQTITEESKAARKELALVREEGLQFMASLDVIRNELKHVTAETDKLKKKEGKVESTVQNLNFKILRAKSKLQVVFAAEEKDRSIVMSLSHTLEKLKTETKEAKKENEDVS

SEQ ID NO: 171206 - protein, 156 aa, Glycine max
  Coding DNA Sequence Number=SeqID_79521
  Subcellular localization annotation: CTP_CleavageSite=39; ConfidenceScore=5.69e-01
MASPPASPPPPSDTSASQSGMKQTQKASRLRSLSTRPASAERLVVHVDLVTGKTDGPHKKKLRTYLGIVVRDKVDVTFENWKEADFEILEASDSRTKKKLLKTVGERWRQFKSDLTRKWAIAADQDGVDDTVCEKYGISKEKWVQFCQTRRDPSWE

SEQ ID NO: 171207 - protein, 265 aa, Glycine max
  Coding DNA Sequence Number=SeqID_79522
  Homolog annotation: Hit_ID=Q6WAY6; Match level="QueryCoverage=69%, HitCoverage=30%, E-value=3e-15, Identity=32%"; Hit description =Putative uncharacterized protein
MLADLYDTFDRRCEKRSKRILYCTPALYVWLVSHLFRQEVRHACPLESHRSCTEKGRANWDQLLANREGASVNWFPRWKEGRTGVFISCGGFPNVPLMGTRGCINYNPILAIRQLGYPKRKAPLEEDLAPVISRGFSKTNVETLRKVRKAWEVVQKKDKELRGSNNGPIGGYREWLKAHVQGLDWLPSLRTAKREEVKASEEEEEVQALRTELEQAQTVKERFKSVALRIRKENAELRDEYVATTKALEQETKRPRREEHGRNKL

SEQ ID NO: 171208 - protein, 95 aa, Glycine max
  Coding DNA Sequence Number=SeqID_79523
MFFVFNTALEGLDDTPQPKSKAGARWIVVKCNRQKGSTECSYYAMHWMSTIILGTFRNNWEAKIYLNDVRPLEAERLKALRTQWAKFYLVVRNES

SEQ ID NO: 171209 - protein, 313 aa, Glycine max
  Coding DNA Sequence Number=SeqID_79524
  Gene Ontology: Mol. function=uridylate kinase activity; Cellular component=cytoplasm; Biological process=pyrimidine nucleotide biosynthetic process
  Homolog annotation: Hit_ID=A1JP80; Match level="QueryCoverage=67%, HitCoverage=85%, E-value=1e-101, Identity=89%"; Hit description =Uridylate kinase
  Pfam annotation: Domain name=AA_kinase; Domain location=1-202; Score =192.2; E_value=1.3e-54; Accession=PF00696.19; Description=Amino acid kinase family
  Pfam annotation: Domain name=RRF; Domain location=258-313; Score= -43.3; E_value=0.00029; Accession=PF01765.10; Description=Ribosome recycling factor
  Pfam module annotation: Pfam domain module=AA_kinase::RRF; Domain location=1-202::258-313
GEALQGAEGFGIDASVLDRMAQEVKELVELGIQVGVVIGGGNLFRGAGLAQAGMNRVVGDHMGMLATVMNGLAMRDALHRAYVNARLMSAIPLNGVCDNYSWAEAISLLRNNRVVIFSAGTGNPFFTTDSAACLRGIEIEADVVLKATKVDGVYSADPVKNPDATLYEQLTYGEVLEKELKVMDLAAFTLARDHQLPIRVFNMNKPGALRRVDDRCLSIPFPFRCVRKWPGQTESKGFNVINDIKKDAETRMDKCVEAFKNTISKVRTGRASPSLLDGIVVEYYGTPTPLRQLASVTVEDSRTLKINVFDRSM

SEQ ID NO: 171210 - protein, 258 aa, Glycine max
  Coding DNA Sequence Number=SeqID_79525
  Gene Ontology: Mol. function=chitin binding; Cellular component =extracellular region; Biological process=chitin metabolic process
  Homolog annotation: Hit_ID=O44238; Match level="QueryCoverage=29%, HitCoverage=24%, E-value=2e-08, Identity=36%"; Hit description=mRNA, endostyle-specific
MELTSVCSAHPSSRFFLGLSRKSGALGRWLAKPACSECHTLISSRDHLFGGMQPSLDRFESKGSIVVQSVKLHNIPEVKEGMVAGVQIATKPTWTFQGVPTEGDVSVSDFVKIFHRSSFVLLRSSVFFSVSDLVRMKRTHLFAAARVKSCPVGPPPISGGGPGTIKRKLLVWMWSTLKMRTRSPLKVRTCSPLKVRACSPLLARTCSPFKVRACSPLLARTCSPFKVRACSPLLARMCSPLKVRACSPLMARTCSPLK

SEQ ID NO: 171211 - protein, 182 aa, Glycine max
  Coding DNA Sequence Number=SeqID_79526
  Gene Ontology: Mol. function=hydrolase activity, acting on acid anhydrides, catalyzing transmembrane movement of substances; Cellular component=proton-transporting ATP synthase complex, coupling factor F(o); Biological ...
  Gene Ontology: Cellular component=process=ATP synthesis coupled proton transport
  Homolog annotation: Hit_ID=A1G064; Match level="QueryCoverage=100%, HitCoverage=100%, E-value=2e-92, Identity=97%"; Hit description=ATP synthase B chain
  Pfam annotation: Domain name=ATP-synt_B; Domain location=32-163; Score=117.5; E_value=3.8e-32; Accession=PF00430.9; Description=ATP synthase BB' CF(0)
MHPVSDEGRMRRYGGASTPKPAIELTMNINFTLLAQALAFAGLIWIIATKIWPPLMNAIEERQQKIAEGLAAADRSQKDLAQAQEKVNEALKEARTKANEIIDQAHARANQIVDAARNEAITEATRQKELAQAEIDAAANRAREDLRKQVSALAVTGAEKLLKREIDADAHKALLDELASEI

SEQ ID NO: 171212 - protein, 93 aa, Glycine max
  Coding DNA Sequence Number=SeqID_79527
MGQIHYISAQLQDNDDLRGAMETILQNPQLNFVEFYDVTDLIPQPQPSSPQPSCPQQQLPPPQQLPYNNIDLNNPVSSYNNLETQDPFDIYTS

SEQ ID NO: 171213 - protein, 31 aa, Glycine max
  Coding DNA Sequence Number=SeqID_79528
MGVQIAPRPIWALQKIPPEGGEEGKKEGVQP

SEQ ID NO: 171214 - protein, 86 aa, Glycine max
  Coding DNA Sequence Number=SeqID_79529
MSAIEFSFQSLNEICMMSVRKCDEDMTKSKGKDPLEGLGGPIDEDMTKSKGKDPLEGLGGPMTRARARKAKEALQQVLSILFEYKP

SEQ ID NO: 171215 - protein, 129 aa, Glycine max
  Coding DNA Sequence Number=SeqID_79530
MAGGSLSIAKCPPKCLARVCHQTLAPQWNIRGEARSRLKGGLGVLHVSPPWVKGPVPDQIGVLALNEYGSPKCLARVCHQTHAPQWNIRGEARSRLEGGLGVLHVSPPWVEGAELSTFSSGACATLGGV

SEQ ID NO: 171216 - protein, 183 aa, Glycine max
  Coding DNA Sequence Number=SeqID_79531
  Homolog annotation: Hit_ID=Q6UUU1; Match level="QueryCoverage=46%, HitCoverage=55%, E-value=1e-18, Identity=61%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPGVSPWRLPRALSFRSKLDCMHEPPVQSDRCALSGNYRLESNPERHAKAPLAAATGTSVQRVGSSENLRKTALQG

SEQ ID NO: 171217 - protein, 209 aa, Glycine max
  Coding DNA Sequence Number=SeqID_79532
  Gene Ontology: Cellular component=integral to membrane
  Homolog annotation: Hit_ID=Q6AED0; Match level="QueryCoverage=100%, HitCoverage=48%, E-value=5e-34, Identity=42%"; Hit description=ABC transporter, permease protein
  Pfam annotation: Domain name=FtsX; Domain location=36-202; Score =88.7; E_value=1.9e-23; Accession=PF02687.12; Description=Predicted permease
MFGSSATARLAAENALRYPERSSRMAIGVVMGVTLVTMFAVALESAKRLMMSQVTGEVPEEFFAPMDAFAGVMMVLVAVSAVIAAVGLVNLLTIGVVQRRRELGLLRSIGLSNRQVRRMVLLEATHITVAATLTGLVLGVVYGWIAAQSLLGSVPTLPDFVPAGLVAPQIPWVPVAIIVVATGILTLVAAATPTRLATRVAPVEALAAD

SEQ ID NO: 171218 - protein, 404 aa, Glycine max
  Coding DNA Sequence Number=SeqID_79533
  Gene Ontology: Mol. function=phosphoenolpyruvate carboxylase activity; Cellular component=cytoplasm; Biological process=carbon utilization by fixation of carbon dioxide
  Homolog annotation: Hit_ID=Q1CBV8; Match level="QueryCoverage=100%, HitCoverage=46%, E-value=0.0, Identity=89%"; Hit description =Phosphoenolpyruvate carboxylase
MARTPSDVLAVHLLLKEAGCPFALPVAPLFETLDDLNNADDVMTQLLNIDWYRGFIQGKQMVMIGYSDSAKDAGVMAASWAQYRAQDALIKTCEKAGVALTLFHGRGGSIGRGGAPAHAALLSQPPGSLKGGLRVTEQGEMIRFKFGLPEVTISSLALYAGAILEANLLPPPEPKKEWRALMDDLSDTSCRMYRGYVRENPDFVPYFRAATPELELGKLPLGSRPAKRKPNGGVESLRAIPWIFAWTQNRLMLPAWLGAGAGLQEAVKAGKQAELEAMCRDWPFFSTRIAMLEMVFAKADLWLAEYYDQRLVDKSLWPLGQQLRDQLESDIKVVLTIANDAHLMEDLPWIAESIALRNVYTDPLNVLQAELLHRSRQQEQPDARVEQALMVTIAGVAAGMRNTG

SEQ ID NO: 171219 - protein, 82 aa, Glycine max
  Coding DNA Sequence Number=SeqID_79534
  Subcellular localization annotation: CTP_CleavageSite=49; ConfidenceScore=5.34e-01
MWQTNTSFPSTYLDNRNNPMYTGCSPTTGRMHLLCNGTWLRSTTTLKIKVSSGHGISFSRKMTSIMETRYHSTTSHTKEFGK

SEQ ID NO: 171220 - protein, 51 aa, Glycine max
  Coding DNA Sequence Number=SeqID_79535
MAGVNILKPSFISCMIKSEDQVADILTKSLKPIKFKELRDKLGVTSLTNLN

SEQ ID NO: 171221 - protein, 106 aa, Glycine max
  Coding DNA Sequence Number=SeqID_79536
MVRTRGLGRALGQRRRPTASAQRQQVAVIAAHNEPVVPAPDVEPDVFPDDPMEAPADSEDIVADIPADTGAEAAEDEHEGFSGGPSDPSVLTQYADHVACSVWTGE

SEQ ID NO: 171222 - protein, 102 aa, Glycine max
  Coding DNA Sequence Number=SeqID_79537
MSGGFCGTHLQIMVRTRGLGRALGHVTGRGHTMSPAPDVQADVFPDDPMASADVEDIVADILANTGVEAAEDEHEGFLGGPSDPSVLTQYADHVACSVWTGE

SEQ ID NO: 171223 - protein, 40 aa, Glycine max
  Coding DNA Sequence Number=SeqID_79538
MSDRIEPVSRTEALIPDEVTESHDATSKMEDKSGVEATRV

SEQ ID NO: 171224 - protein, 61 aa, Glycine max
  Coding DNA Sequence Number=SeqID_79539
MVGTRLRHGDGAPDTTLDIAGDDFGPLDDCGILEIASLSLDEPELDGVFFNDDDHLEGERP

SEQ ID NO: 171225 - protein, 44 aa, Glycine max
  Coding DNA Sequence Number=SeqID_79540
MSQSRIASFGSATGSVEIDNMKQEFAIMKTKLTFLEKNIYHVRY

SEQ ID NO: 171226 - protein, 50 aa, Glycine max
  Coding DNA Sequence Number=SeqID_79541
MRSNPLQGRGDDPILPRKIPVTRAMSKRLQEDWSRAVEEGPRVLMNLGAR

SEQ ID NO: 171227 - protein, 284 aa, Glycine max
  Coding DNA Sequence Number=SeqID_79542
  Gene Ontology: Mol. function=catalytic activity; Biological process =cell redox homeostasis
  Homolog annotation: Hit_ID=A7PGU5; Match level="QueryCoverage=23%, HitCoverage=8%, E-value=5e-16, Identity=60%"; Hit description =Chromosome chr17 scaffold_16, whole genome shotgun sequence
MILCVDVVTWQRKNLRVTEYREKFELLSKAATSNPKHAGLNQRELHFVFFRKPNSFQQSKRAGHVSDVHFEKTVLQGAGEFEDIKCKWAYGMNVFDLAEWKRQNITEVYHKWQNMFFLHYYSLILSRIKIIDSNNTRLSLFSTSMAVFAVYYRFSWQMEGGDVPWFEMLGIFSLSVCAAVVKKTKVALPTTSTTTILSGINHLNLMRMMCKCKFGRTGDGSIKVEWIPLEGVSSGELKLKIEAIKVEDQEGSRGSTNGWIELVVIEARDLIVADLRGTSDPYVR

SEQ ID NO: 171228 - protein, 160 aa, Glycine max
  Coding DNA Sequence Number=SeqID_79543
MAVSMKVCCFFSTSNPLVYRLKMAHEIKDINKRGFLLSITTAKRPYNDGSKPTSLKVKTFDDGSINNRLKKSVAPNALKFFTRDSLASRKKTKIVSHGDEDKASNKGKEPLEGLGGPMARARTKKAKEALQQVLTMLFEFRPKLQVKKLQIVNCTMFQEE

SEQ ID NO: 171229 - protein, 142 aa, Glycine max
  Coding DNA Sequence Number=SeqID_79544
MHKALRLNAPLPYPHLVTLFLQHFNIPLDSEPYVPIKISFLIGAAMVVSFGYRKERDGSWVKKGAQPNDDEGHLPVEGDSSLLQSILDRFNGLQTYVGERFDSLEHQVDTRFEEMNSRIPKVEKDVTIIHDCLDLPPPPPSV

SEQ ID NO: 171230 - protein, 232 aa, Glycine max
  Coding DNA Sequence Number=SeqID_79545
  Gene Ontology: Mol. function=drug transporter activity; Cellular component=membrane; Biological process=multidrug transport
  Homolog annotation: Hit_ID=A7PWC6; Match level="QueryCoverage=92%, HitCoverage=44%, E-value=2e-60, Identity=58%"; Hit description =Chromosome chr8 scaffold_34, whole genome shotgun sequence
  Pfam annotation: Domain name=MatE; Domain location=30-230; Score =18.9; E_value=0.00019; Accession=PF01554.9; Description=MatE
MLPLLMLFSSIRNAFSSDELGLEILNISLPTTLALAADPIASLIDTAFIGHIGPVELAAVGVSIAIFNQISKITIIPLVSVTTSLVAEEDAVDEQNQQSEREMLMKVSNEDVKLDVHDHAEKAGNSSSANVGRVAKLDHDKSYIPSASSGIVIGGLLGVLQALFLIFTAKPMLSYMGVDSNSPMFKPAQQYLTLRSFGAPAVIISMAIQGVFRGIKDTKTPLYATVESLLKE

SEQ ID NO: 171231 - protein, 128 aa, Glycine max
  Coding DNA Sequence Number=SeqID_79546
MGPNHRSKGLPISGEDGECWVGELVSEELQESQAWRDDLEWIRVFRSWWSGLVTGFGLPPQGAQWPTNEYCAPASSVSRFVVTEYGRVVVILNRLKRLHKVLQVDRFVDHPFGPGIPGKIAIRTPPNF

SEQ ID NO: 171232 - protein, 132 aa, Glycine max
  Coding DNA Sequence Number=SeqID_79547
  Homolog annotation: Hit_ID=A7NZQ4; Match level="QueryCoverage=70%, HitCoverage=71%, E-value=3e-08, Identity=40%"; Hit description =Chromosome chr6 scaffold_3, whole genome shotgun sequence
MAPVSARTRMKCKKLEERKQKKKKSSMVYAATTPTSSTGTKEIQGDHSEEDICSSVCSTPKGKRFRIPEVLKCPPAPKKRKITTTTTITSSCSSKTKRSSIAFFASPDIELFFFSAIKSSVPAASSFTPSGV

SEQ ID NO: 171233 - protein, 64 aa, Glycine max
  Coding DNA Sequence Number=SeqID_79548
MNVLSGATLFCKVTRTPNIFMVCVHRDPLGVEGRSPEYEKPQDLRSNPFQGGGNDAILPRKGIG

SEQ ID NO: 171234 - protein, 62 aa, Glycine max
  Coding DNA Sequence Number=SeqID_79549
MEEEKKKEKMVEDDKQLKKREKKRREKARVSVLERKRKKHLQLKGRKYHILWYLLGRTKKDI

SEQ ID NO: 171235 - protein, 301 aa, Glycine max
  Coding DNA Sequence Number=SeqID_79550
RHILPERKVEICHTKLEKFKAELERCNIHKRLTNLVDNNIDLALLKEFYANLYSSEDLSPKQVRVRGHLVKIDADNLNTFLETLVILVEGETLPAYSRYYRLPTDYKEIEVALCILGRGFVLNSEGHPGKILRKDLTTLAQVWSILSYSNLAPTLHTSDLIVDRARLIFGLVSQMDMNVGAFISGQITSIAQSNSSRLRFPALITALCKAREVNSDSLVFERLRSVINLAYIRKNCWNPDDLIVSIRGAKWARTRPAEPPSTSTTHIPARISAAPSVPASADFQHLEAMLQSIYQGQIILL

SEQ ID NO: 171236 - protein, 235 aa, Glycine max
  Coding DNA Sequence Number=SeqID_79551
  Homolog annotation: Hit_ID=A2Q6G0; Match level="QueryCoverage=51%, HitCoverage=47%, E-value=1e-14, Identity=36%"; Hit description=IMP dehydrogenase/GMP reductase, putative
  Pfam annotation: Domain name=DUF1723; Domain location=152-201; Score =57.2; E_value=5.6e-14; Accession=PF08330.1; Description=Protein of unknown function (DUF1723)
MGRVRIEAEAWLENEHHADDVPRWRRPTASARRHRAHVAVAKDVPQVIEDVLHMTKDAPQMTTEDVAAVVAEGLDGDDAEGSPADDAEGFPGGPRDLSILTSFVDHVSHSIWSGELVSHGRKVDKFRRPAPEIEDLVTTTELSPLIGCSVVTDDPGLISAFVERWHRETNTFHLLVGELTITLDDVASLLHLSIISAFHSFEPLLVDDAVFLLMELFEVFDEEARSETVRADAAY

SEQ ID NO: 171237 - protein, 92 aa, Glycine max
  Coding DNA Sequence Number=SeqID_79552
MASRKLSAKRSRRDAAVEGTSAAPEFDSHRFRSAEHQQPFEAIKGWSFPRERRVQLRDDEYTDFQEEIARRRWTSLVTPMAKFDPEIVLEFY

SEQ ID NO: 171238 - protein, 226 aa, Glycine max
  Coding DNA Sequence Number=SeqID_79553
  Pfam annotation: Domain name=Peptidase_C5; Domain location=65-186; Score=-121.2; E_value=0.093; Accession=PF00770.9; Description =Adenovirus endoprotease
PSILHGWVRSYPCLSLLPFSHCRFLSPLVSSLIDEAPSLGPHGRLSSPTPGKSHIFVLFTLRLIRFLLEIDDRFPGGHGRTRSDPFGKSSSHIATTWPSCLSLTLIKLLLMWQGWFCRRCFCLNPFRARNHSPTSPGPPSLSYRQARSPRERIYRGNAYYLKRLEGNDSHRVDPRASQKTAISRVNIHYLEGNLTGMGAYLYREVDLSPNLSAGAVEGTNHHGTWL

SEQ ID NO: 171239 - protein, 88 aa, Glycine max
  Coding DNA Sequence Number=SeqID_79554
  Homolog annotation: Hit_ID=Q2QRK7; Match level="QueryCoverage=80%, HitCoverage=8%, E-value=5e-08, Identity=35%"; Hit description =Transposon protein, putative, CACTA, En/Spm sub-class
MDMAWGSAEHANSLSSLAEMRNCPIGGVSWYRANHGEYSVDAIINNSRPTKAIDSLYPDFGDKPRNLRLALASDGMNPFGNLSTNHSS

SEQ ID NO: 171240 - protein, 116 aa, Glycine max
  Coding DNA Sequence Number=SeqID_79555
MPLKGKQLVVYPCKTLWRALSFAHNHNPHVPQWLKTLMTMAEMGKLDHLEERLRAIEGGEDYAFANPKELFLEPNIITPPKFKVLDLDKYKGTTCPKNHLKMYCQKWGHMQKMRNC

SEQ ID NO: 171241 - protein, 51 aa, Glycine max
  Coding DNA Sequence Number=SeqID_79556
WPLGRENQPPPDLKNPTTRRDLFPRQPDRRINVALFKEFYANLYDPEDKSP

SEQ ID NO: 171242 - protein, 294 aa, Glycine max
  Coding DNA Sequence Number=SeqID_79557
  Homolog annotation: Hit_ID=UPI00006A2D9E; Match level="QueryCoverage =63%, HitCoverage=85%, E-value=1e-12, Identity=16%"; Hit description =UPI00006A2D9E related cluster
HVLAIRGLHALNFGGLHVLAIKGLHALSFRGLHVLAIGRLHALTFRGLHVLVIRGLHVLAYSGLHVLAIRELYALTFRGQHVLAIRGLHDLTFRGLHILAIRGLHALTFRGLHVLAIRGLHALIFKGLHVLAIEGLHALTFRGLHVLAIRGLHVLALEDYTSSPSEGCTTLTFRGLHVLAIRGLHALTLGLHPQGAARLTFRGLHVLACFRGLRMSSTLKRLTETCAPGYGVNRFLLSVLGLPPDIGGRPTVRAQPEREAIMQLLCIPRQDFTRAAVKRRVRIMRTNMTTLTQI

SEQ ID NO: 171243 - protein, 50 aa, Glycine max
  Coding DNA Sequence Number=SeqID_79558
MENWRTALRKMTSWGSRLEVENGELANNARQLHSRGSRLEGGGHMNSARQ

SEQ ID NO: 171244 - protein, 119 aa, Glycine max
  Coding DNA Sequence Number=SeqID_79559
THHLLEVASLFIFLLLHSTAIKPQEAKESIDEEDPRPTSSTWSYIRVFTLNDTEASKSKDLIQVSKDMMFNSTNKVVTSLKEDAQVYMILSNLEMEIKVSMCDLPVVREFPEVFPEDIS

SEQ ID NO: 171245 - protein, 249 aa, Glycine max
  Coding DNA Sequence Number=SeqID_79560
  Homolog annotation: Hit_ID=Q6WAY6; Match level="QueryCoverage=72%, HitCoverage=31%, E-value=5e-14, Identity=32%"; Hit description =Putative uncharacterized protein
KESPVVVVLADVYEAFDRRCEKSSARVVCCTPALNVWLVSHIFRHESKPICPLKGYRMCVENGKANWVGASVNWFPRWKEGGEEVLSSCEGFPSVPLMGMMGCINYNLVLSIRQLGYSMRGAPSEESTTSFIARGFSDPNAKTLQRVRKACNAVQRKDKELRGSSNGIISSYYKWLKARTQEMNWLLRLKISSKEEVETLEESEEVQALKANLERTQVVKEKFKTKAIKVRKECDELRDVNMATTEALE

SEQ ID NO: 171246 - protein, 243 aa, Glycine max
  Coding DNA Sequence Number=SeqID_79561
  Homolog annotation: Hit_ID=Q6Z8F0; Match level="QueryCoverage=28%, HitCoverage=61%, E-value=2e-17, Identity=68%"; Hit description =Putative uncharacterized protein P0459B01.18
PFHLSLAGLFAIGLSPVFSLGWNLPPDWGCIPKQPDSPTAPRGATGSGHDGALTLSGAPFQGTWARSATEDASPDYNSDAEGDRFSWWAFPGSLAVTKGILRACTQRVVDGSRTDRLARDWSRAWLIHHFITAKSAMNPDFNQPRGGCSREVSIHPAQQHCYMFAVGETMCDTQGRRALGLMASGATCVQRLDGSRDSAIHTKYRISLRSSSMQEPRYPLPRVIDEEAGRTGRRGHPLPPDGR

SEQ ID NO: 171247 - protein, 66 aa, Glycine max
  Coding DNA Sequence Number=SeqID_79562
MQGLRSLRDLTQHLTTRADDSHAAPVYAPIPKYGSLPFRVSTTYMSNPGGMLIALTAAQMPYDTHT

SEQ ID NO: 171248 - protein, 123 aa, Glycine max
  Coding DNA Sequence Number=SeqID_79563
  Homolog annotation: Hit_ID=A6TEG6; Match level="QueryCoverage=100%, HitCoverage=18%, E-value=2e-59, Identity=91%"; Hit description =Putative enzyme
MRNGSQSNVTLYASSRSAQGTSGPDFRLEMEGLQYSEIPMLAASNPALMQQALSAVRNDYSLARLYAMGADAWSLANHFAQMRQSPGYELNGNTGDLTATPDCVINRKLSWLKYQQGQIVAAN

SEQ ID NO: 171249 - protein, 165 aa, Glycine max
  Coding DNA Sequence Number=SeqID_79564
  Gene Ontology: Mol. function=D-sedoheptulose 7-phosphate isomerase activity; Cellular component=cytoplasm; Biological process =lipopolysaccharide core region biosynthetic process
  Homolog annotation: Hit_ID=P66818; Match level="QueryCoverage=100%, HitCoverage=84%, E-value=4e-87, Identity=97%"; Hit description=DnaA initiator-associating protein diaA
MTLVQSLLNGNKILCCGNGTSAANAQHFAASMINRFETERPGLPAIALNTDNVVLTAIANDRLHDEIYAKQVRALGHAGDVLLAISTRGNSRDIVKAVEAAVTRDMTIVALTGYDGGELAGLLGQQDVEIRIPSHRSARIQEMHMLTVNCLCDLIDNTLFPHQDE

SEQ ID NO: 171250 - protein, 126 aa, Glycine max
  Coding DNA Sequence Number=SeqID_79565
MSRGSGDLRDVRRAPGSQQIKGTKTTKQGGLCGGWPAEARGASGNRLPGDVIDYQASKENWKTVETSEGWVTGNRLPGFHVLKLCNSNLASGNRLPRLCNRLPEMKRLKIPLLLACSGYETNCVAA

SEQ ID NO: 171251 - protein, 195 aa, Glycine max
  Coding DNA Sequence Number=SeqID_79566
MKLCLKLKNSRRGLLVMALVLHSAPVSFDTWWPGEFAAGSSQLSSKDAFLSKVEAKTISEINNISEFNGKPDEKSWYRFEVMVNHKEESTKFLLWGHECTELIGQSANEVNKLKIEEGDVDLNVSPQAIDKLLGYVLAFKVNVQPKFNNVVVLRYSNDLDLVNAVVDMLPDAEACSKVHAPILDSDNPFQLESIS

SEQ ID NO: 171252 - protein, 90 aa, Glycine max
  Coding DNA Sequence Number=SeqID_79567
  Homolog annotation: Hit_ID=A5AV98; Match level="QueryCoverage=51%, HitCoverage=6%, E-value=4e-10, Identity=69%"; Hit description =Putative uncharacterized protein
MSVLIFNGLKFSYWSEQVQFHLGVLDLDLALQVEKPAATTDASSNEEQNVKLVPYNPTINPNDEFVFMGNRVKVLVEAVGYRLILDTSFI

SEQ ID NO: 171253 - protein, 183 aa, Glycine max
  Coding DNA Sequence Number=SeqID_79568
MASRKRKSIGRHILPKRKVEIYHIELDEFKAELERRNFHKRLTNLVDNSIDLALVKEFYASLYSPEGPSPKQVRVRGHVVKIDADNLNTFLETPVVLAEGETLPTYSRYYRLPADIREIEASLCIPGRGFVLNAEGHPRKILRKDLTTLSQVLSVLSYSNLAPTSHTSDLTVDRARLNFGLVS

SEQ ID NO: 171254 - protein, 71 aa, Glycine max
  Coding DNA Sequence Number=SeqID_79569
MNPSFPNKGSPPIDVEASFMMMNQTILMMPKAQVIDSRLVQDFKIKHQESNSRFKIQDKKSRSNKSRLHIG

SEQ ID NO: 171255 - protein, 394 aa, Glycine max
  Coding DNA Sequence Number=SeqID_79570
  Gene Ontology: Mol. function=protein kinase activity; Cellular component=plastoglobule; Biological process=protein amino acid phosphorylation
  Homolog annotation: Hit_ID=A7P4Z2; Match level="QueryCoverage=96%, HitCoverage=57%, E-value=0.0, Identity=91%"; Hit description =Chromosome chr4 scaffold_6, whole genome shotgun sequence
  Pfam annotation: Domain name=ABC1; Domain location=118-238; Score =155.2; E_value=1.8e-43; Accession=PF03109.7; Description=ABC1 family
MGLIIPVGRRMVRNKVLESRGSILSLMLRGVEIVWNLGLYWSNLVYDFLVGRDEEVVPYRARQLRNLLCDLGPSFIKAGQVLANRPDIIREDYMNELCILQDDVPSFPNQIAFRIIEEDLGQPLEAVFSKISSGTIAAASLGQVYRATLRATGEDVAIKVQRPGIEPIIYRDLFLFRTLASFLNGISIQKLGCNAELIVDEFGEKLLEELDYTLEARNLEDFLENFKNDPTVKIPQVYKQFSGQRVLVMEWIDGIRCTNPQAIKEAGIDVDGFLTIGVSAALRQLLEFGLFHGDPHPGNIFAMRDGRIAYVDFGNVAVLSQQNKQILIDAVVHAVNEDYAEMANDFTRLGFLSPGTDVTPIIPALEAIWQNSAGKGLSDFNFRSVTGRHFPLIV

SEQ ID NO: 171256 - protein, 184 aa, Glycine max
  Coding DNA Sequence Number=SeqID_79571
  Homolog annotation: Hit_ID=A7P1Q3; Match level="QueryCoverage=92%, HitCoverage=35%, E-value=7e-45, Identity=56%"; Hit description =Chromosome chr19 scaffold_4, whole genome shotgun sequence
MAPTLPVWAHALISIDPARARDDPVIVKNVPYYKAKKALETEVMKIDPPPRPPNCGDDPCEVHSVIRPWLLLSNVLSFNIKGRPELDLPLNASSWSEEDLKDPDKFYEMIALLNAQREISDKILDAQWETKWRQDKLNEMLEAKVKPYIQDIDNVVLPEPILLKPQNQEKGFIASALNYGLITW

SEQ ID NO: 171257 - protein, 227 aa, Glycine max
  Coding DNA Sequence Number=SeqID_79572
MDVAARFNVAVGMTAITAERHGIWTGFLRRYTEAVEILKTLARCCSAHLRGCDPGDATTSASAATSSTPRSTLQVCNTIRTFLSQIWDMLGAPSNIAGAPSNSMKASSLLSSPTSFFSASFSDSPWTHLLSRSLPEDPLGVLPEVPEERFPEIFRKKCSSGSNQTASGRTLLPEDFRKTSSGNFPEEVVHPEEFRKTRTSGRSFKLPEDLSGRTLLPECFRKNHFFR

SEQ ID NO: 171258 - protein, 246 aa, Glycine max
  Coding DNA Sequence Number=SeqID_79573
ALGGVLGRALGRQANADEVHEQPQEPVTNDVHSDTQGFRGGPEDTLVFDGLYLSCGNQSWGRTIKLASREKKVEKFERHAPEIEGIVTATGLSSLITYSLDTGAFHTFDALDVDQVVDLLVELLEHFPTIASIVADEDYHERKPCACRWKSGKALPVSMYRKNLDTLRSDVTIPPHLVAPSLSIEEIDNRWLQFSKYLIPVGQICSALGQCAKNYMKVVIDAAAIPEPPAPTPTAADVDLSRHAVA

SEQ ID NO: 171259 - protein, 263 aa, Glycine max
  Coding DNA Sequence Number=SeqID_79574
  Gene Ontology: Mol. function=nucleic acid binding; Cellular component= nucleus; Biological process=DNA replication
  Homolog annotation: Hit_ID=Q7XZT4; Match level="QueryCoverage=98%, HitCoverage=100%, E-value=1e-93, Identity=65%"; Hit description=RPA 32kDa
  Pfam annotation: Domain name=RPA_C; Domain location=149-258; Score =49.1; E_value=1.5e-11; Accession=PF08784.2; Description=Replication protein A C terminal
  Pfam annotation: Domain name=tRNA_anti; Domain location=76-150; Score= 43.7; E_value=6.4e-10; Accession=PF01336.16; Description=OB-fold nucleic acid binding domain
  Pfam module annotation: Pfam domain module=RPA_C::tRNA_anti; Domain location=149-258::76-150
  Subcellular localization annotation: CTP_CleavageSite=54; ConfidenceScore=5.71e-01
VSKMFSGSQFDATTAFSGGGFTSSQPSTLNDSSPAPSNSRETPGLVPVTVKQISEASQSGDEKSNFVINGVDLNNVTLVGMMFEKVERNTDVSFVLDDGTGRIKCRRWINEAFDTKEMEAVMNDMYVRVYGHLKSFQGVKQLVAFSVRHVEGITSANPSSGSSLETPVKSAPNRSQASNPVCAQHSVDGLKGIDKLVMDYLEQHSDRRVTHPTFYLSDGRGIHVDELSRELKLPIEKIKLSLKTLADDGEIYSTIDDDHYKKA

SEQ ID NO: 171260 - protein, 240 aa, Glycine max
  Coding DNA Sequence Number=SeqID_79575
  Pfam annotation: Domain name=Transposase_23; Domain location=144-208; Score=-17.7; E_value=0.1; Accession=PF03017.5; Description=TNP1ENSPM transposase
SGSTEGVINPPSPIRRHVKWKMARTKKTGHMTSKAAKEIVEKIDSLEEQASQEHPGRVRAAKVGVTIKQYFGSTPRSSRSSSSILPEELEQLTQQIKDQLEESITEKMQSEGIALPPEPEVGPSATRVSTKGNCVDPSPTDPKMGDLDKCGLYIEENSSQLVALGRVYEGSITVHNIPLLHGQVRVGVEEVKDAEAPVPVPTDEAVVSPAKPVDRVHPEVNDLLYLMTLVIPQLFLRPLQ

SEQ ID NO: 171261 - protein, 71 aa, Glycine max
  Coding DNA Sequence Number=SeqID_79576
MDTENDRGYNCNGSSKTREEEIQKEDENDVEVEKKLVQIKQSRTYHGPRNAIGWAVEDDLKIIVSRSLEEG

SEQ ID NO: 171262 - protein, 70 aa, Glycine max
  Coding DNA Sequence Number=SeqID_79577
MSAVVGLVVNRDMSEMDEDQWMYDSIMYEEVDMNEQNEDEGGVSEEHVDCSDAFNTSQVFTTRDDVLHWA

SEQ ID NO: 171263 - protein, 136 aa, Glycine max
  Coding DNA Sequence Number=SeqID_79578
METISKRFKELDVCGKVTQKSKLQEIVYPDLNSMCPPPEKINTKGAQKKSMTKYQKDQQSVIRLTGSMGEDSWSLVHNHLLKELAKWSDEYINLLGGIVRFDELKRSLLVDGLSMVIMDKWMNIIDMGYVIASRFI

SEQ ID NO: 171264 - protein, 105 aa, Glycine max
  Coding DNA Sequence Number=SeqID_79579
MRYTNFKCPPAAIKINQKAYLDDKNGTKVVEKTLTVAMDTEDDGDAAQNAERMKKSESDWAAQCTRQDKMSNEELKLQDPRCRIQCPGHPARKYWTHKSVISLTD

SEQ ID NO: 171265 - protein, 259 aa, Glycine max
  Coding DNA Sequence Number=SeqID_79580
MDRSKLVYGLVTGMDMNIGALISRVTFDSLTYESLSPTINLAFIKKNCWNMDDLTVNFRGARKVRARPADIPSSSAPPAPPTYATPTPAPPISSTHTPAAQDSQRFEAMLQSIHQGQILLLQSLHVVAPPGSILSIEQFIEKDGSSEATIPGAFDFSGVGVEMRPDEVVLLEPIVPVIHEVVEAGESQLRQEAATPERTPQTPEDSLSPGMDLSFAQQVEDPPTLVHERQPNPPTPIIEMLEDSTTPILRLSSTPPATP

SEQ ID NO: 171266 - protein, 101 aa, Glycine max
  Coding DNA Sequence Number=SeqID_79581
SKLDGRDLVRQSVVVVVAEIEPERVREIKVQRTGLLGHVGGEEMTTKLGKGYGNVGGDCRLRWLKDYNGTVIRLDQRFGALWLWLELVAFSWFEVEVGTVG

SEQ ID NO: 171267 - protein, 238 aa, Glycine max
  Coding DNA Sequence Number=SeqID_79582
  Gene Ontology: Mol. function=zinc ion binding; Cellular component =intracellular; Biological process=regulation of transcription
  Homolog annotation: Hit_ID=A5ASM4; Match level="QueryCoverage=71%, HitCoverage=45%, E-value=2e-32, Identity=46%"; Hit description =Putative uncharacterized protein
MAIDKSNKKSQKTQYHMINNNTYLIKSFKYVYAWLMDVALASNPDVGSSMNFIEGLATTSTAIVSLLRYLVERPLTPEALFLARQSVLAQEKNKLSETPMLYSCGLCGKDYKSSKAHAEHLKSRGHMMRASEGTSHADEKAIIKPLPQRVVNRPPPRREVDNSENEECEDEWEEVDPEEDLVDEARAAKSLTDLNVNEHGENVDMEEDADDFEELDPSCCFMCDQEHKTIEDCMAQAS

SEQ ID NO: 171268 - protein, 172 aa, Glycine max
  Coding DNA Sequence Number=SeqID_79583
YIQKAKPVGLPESRHDDRVGGKGSRGLHVITPSVEDLLQAHSKGERKDIELVEEEEPKITADCSSETSNKSEIYKEEAGNAAQKHKPKRVESVDADAKAFGYHSKNKTGDSTVLKIGDSGKVVIKQDMKGGEHKYGFNNNKREKSEKVFMSFLHHSMSSCHSFPDILKYYSE

SEQ ID NO: 171269 - protein, 90 aa, Glycine max
  Coding DNA Sequence Number=SeqID_79584
GQGDAPQAAGAPPPPHQAGQAGAFDMEQYLRHWFASRQPTTEHMAEVAWPGDWPEAQAGEAPPEAPGDGEEAHEDEEMADLLDFLGGSGD

SEQ ID NO: 171270 - protein, 246 aa, Glycine max
  Coding DNA Sequence Number=SeqID_79585
  Homolog annotation: Hit_ID=Q2HW90; Match level="QueryCoverage=93%, HitCoverage=55%, E-value=2e-16, Identity=25%"; Hit description =Putative uncharacterized protein
MGTNQTGKRFYQVKVKSLDTTSIKELGRLMEPLQMQAFRKTYGKILELTIAEVSIEAIASLTQYYDQPLRCFTFADFQLVPNIEEFEEILGCPLGGRKPYLSSGCLPSLSRIATVVKDSARDLAAIDAFLAYHHSKESPVVVVLADLFDTFDRRCEKSSARIICCLPALCVWLVSHLFQQDTRHPCPLLSHHSCTEKRRMDWDQLLAGIGGRTISWFPRWKEGKEGVLFSCGRYPNIPLVGNEGLY

SEQ ID NO: 171271 - protein, 147 aa, Glycine max
  Coding DNA Sequence Number=SeqID_79586
MALRKLPAKRSRKDKAAEGTSAAPEYDSHRFRSAEHQQRFEPIKGWSFHRERRVQLRDDEYTNFQEEIVRRRWASLVSPMAKFDPDIVFEFYANAWPTQEGVRDMRSWVRGQWIPFDADALSQFLGYPLVLEEGQECEYGQRRNRAD

SEQ ID NO: 171272 - protein, 170 aa, Glycine max
  Coding DNA Sequence Number=SeqID_79587
MLATGNRLLPSGNRLLESKTLWQRVAITAEHDEPVVLVIEAVGALVEAVVYADEPMVGGDVHDTRADTPTNIGAQAAEDEPEGFLGGPSDLSMLTEYADHVADSVWTREERPELKLSSHGRKVHSLGRPVPAIEGLVVGTGLSPLIMCLVDTGDRGTFVFVCRAVAPGDV

SEQ ID NO: 171273 - protein, 71 aa, Glycine max
  Coding DNA Sequence Number=SeqID_79588
MGGACHPARPGEPGCFLQKQPPSGGRIWKAHVMQSYSVRALGRRLQVDWARDPREGPRVLMSLRVDFEPMG

SEQ ID NO: 171274 - protein, 145 aa, Glycine max
  Coding DNA Sequence Number=SeqID_79589
MSISPCESIGWSVPSRHRDRAHKAPSGPGGVRQGPGVFGSGYGPLVTPTRHPVDPEKFNRTLGFPVLVTGLYQSYRVPVLPGKVMPSRHRDRARKTPSGPGEVQQGPGVSSSDYGPLSSGPLLIELSSRGTASPGRRKAKMNYEP

SEQ ID NO: 171275 - protein, 112 aa, Glycine max
  Coding DNA Sequence Number=SeqID_79590
VYTDDHSGISARQRDSKVSMTDLVSTEDDAFRLTDSKKVYTDDHSGISARQRDSKVSMTDFVSAEDDINLRVSTGLSAAIDEGRRRRLSMTDLVKVADKSEALAPTYPPMRN

SEQ ID NO: 171276 - protein, 125 aa, Glycine max
  Coding DNA Sequence Number=SeqID_79591
MVITHVLSSKGGEPDDMWRQIMVIHRPFQHPETIESEGTQRQIMVILQLLSSRGGEPDDMWRQIMVIRTPFRHPEAIESGGTQRQIMVILHLLSSRGGEPDDMRKQIMEIRTPFLNPETIESNGT

SEQ ID NO: 171277 - protein, 161 aa, Glycine max
  Coding DNA Sequence Number=SeqID_79592
MAKGARKNIICLRISSGSPPLHDKRCRRSIICLCVTSGSIVSRWRKGVRMTIICLRMSSGLPPLDDKRFEMTINCLCVQITIICLRMSSGSPPPDDKMCRMPIICLCVPLDSIVSRWDKGSIVSGWQKGVRMTKICLCVSSGSPSLDDKRCRMAIICLCVP

SEQ ID NO: 171278 - protein, 51 aa, Glycine max
  Coding DNA Sequence Number=SeqID_79593
MVTMDKWMNITDMRYVIASRYNVIVVSLSRQQSMTFFLLEVSRHQILLCIA

SEQ ID NO: 171279 - protein, 222 aa, Glycine max
  Coding DNA Sequence Number=SeqID_79594
MTTLTQIWMTLLLSNILPSDHNSDLPLPKCQLVYAILTRMSVHVAQLIADAIYIFAGMAPTRHPLDPDKSNRALGFPSLITGLYQSFGVPVAPTKVIRPPITRAFIEKYCTQRQAQGLARLGHLTWSSIYGHLVRQQAANHRAHVQTHDCLYQMSLSMQSQGFASFSCPTPDQFRAEVAWPGDWPEAQAGEAPPEAPGGREEAHEEEEMADLLDFLGGSGDT

SEQ ID NO: 171280 - protein, 47 aa, Glycine max
  Coding DNA Sequence Number=SeqID_79595
MVFHRSSSFFVLLRSSTVLKELCRSDFLITIEEYVGARETPLSTTKT

SEQ ID NO: 171281 - protein, 97 aa, Glycine max
  Coding DNA Sequence Number=SeqID_79596
MSYALIFSLFLWQEKQKGGYTPLKAIASRLGKNKALDHFYGLLRKTPTHGYNEPMQLNISTDGLRPQSKQLLDAFVGKNQDEGTRGGNEADREHGGQ

SEQ ID NO: 171282 - protein, 53 aa, Glycine max
  Coding DNA Sequence Number=SeqID_79597
STMRRGAKRKKKQAQKPNTTHPKITSSKIRLELNEPRPPSINPNLSTSKTSAT

SEQ ID NO: 171283 - protein, 107 aa, Glycine max
  Coding DNA Sequence Number=SeqID_79598
MSARKDDRSKSKKKNLMRIMKQAKYSLKAQVEKDEGPSGEGQCPRVEKDEGPNLSSFTGSGVYPDLSSFTRSGVYPDLSSFTGSGVYPDLSSFTGSGVIQIFIACIK

SEQ ID NO: 171284 - protein, 179 aa, Glycine max
  Coding DNA Sequence Number=SeqID_79599
GKIKLKTPEEAMELIENIAASDHAILCDRTHYPTKKSLLELSSQDALLVHNKLLSKQLETLTKTLSKLPTQLHGGPSNRPPPQGPNLYERITKLEETLAQFMQVSMSNHKSTESAIKNLEIQVGQLAKQIADNSSLKFGTNTETNPKEKCKAVMTHGKMQTMAEEEKDEKIVDGDKQQL

SEQ ID NO: 171285 - protein, 146 aa, Glycine max
  Coding DNA Sequence Number=SeqID_79600
  Homolog annotation: Hit_ID=UPI00006A2D9E; Match level="QueryCoverage =81%, HitCoverage=73%, E-value=2e-09, Identity=18%"; Hit description =UPI00006A2D9E related cluster
LHALTFKGLHVLAFRGQHARTFRGLHVLTITGLHALTFIGLHVLAFRGLHFLAFRGLHVLAIRGLHALTFRGQHVLAFRGLHTLTFRGLHVLSFRGLHVLTFRGLHVLASKYFRNASVSDSVEILHRSSSFLTVLHPFFVRSSFFN

SEQ ID NO: 171286 - protein, 90 aa, Glycine max
  Coding DNA Sequence Number=SeqID_79601
  Subcellular localization annotation: CTP_CleavageSite=68; ConfidenceScore=5.60e-01
FVPSKRKGGVSPVLWTRPKLTQAVSPAVWVSPTWTIPPVVMAAPAGDNTPLSPALPQLAMAGSAMAPVAMAVSSAKQTPSVISFGTDPIP

SEQ ID NO: 171287 - protein, 345 aa, Glycine max
  Coding DNA Sequence Number=SeqID_79602
  Gene Ontology: Mol. function=RNA-directed DNA polymerase activity; Biological process=regulation of transcription, DNA-dependent
  Homolog annotation: Hit_ID=A7QWU8; Match level="QueryCoverage=94%, HitCoverage=49%, E-value=2e-33, Identity=26%"; Hit description =Chromosome chr13 scaffold_210, whole genome shotgun sequence
  Pfam annotation: Domain name=zf-CCHC; Domain location=12-29; Score =21.0; E_value=0.001; Accession=PF00098.14; Description=Zinc knuckle
MPKPVMKPRTKVVCYNYGKQGHISKYCRLKKKLRNLNRDPSIEDQINNLLIETSEEETGEVSSEENLNQIQQDDQVSSTEEEDIQEVNTLTKEHDLLFEAINSIPNPQEKKVFLNKLKKSLETKPKPKEFITNNKFDVSNILKRLENTSVKPTTIQDLQTKINNLKQEVKELKQQQEIHQIILSHFEEHNDSENEVKEDKDEDDEMFMGLINKIKIQKFYINIRIIINDFVLDTMALFDTRADSNCILEGLIPTKFFEKTSEKLSTVSGSRLKINYKLSSETIENQGLRIETNFLLVKNLKNEVILRTSFIRSLFPLHISKEGITTWHLGRKITFDFSTKPIART

SEQ ID NO: 171288 - protein, 50 aa, Glycine max
  Coding DNA Sequence Number=SeqID_79603
MIRLLKSLTARPARGEGSHERVRGRVGGRERDMKWSEGKGRKEGEALALN

SEQ ID NO: 171289 - protein, 88 aa, Glycine max
  Coding DNA Sequence Number=SeqID_79604
MSLVVLAEPLDAAAGPGEIGSAQQHNNGGEELHARSLEGGGHTHVRALHDDASDNWDWWRGEGGVVVLVLAKNWVNKNVGGHGDWVRR

SEQ ID NO: 171290 - protein, 84 aa, Glycine max
  Coding DNA Sequence Number=SeqID_79605
MDEEEAIGIGGLEGGKIKDCALVKGTRMKLLLVLGDFGEKRLGKGNCSPCDFQNSPKIDILQTLAVTLTDYMVSDTKSKHNQKL

SEQ ID NO: 171291 - protein, 52 aa, Glycine max
  Coding DNA Sequence Number=SeqID_79606
MEREENKKKHTGKPGSTTTTKNNCGWAVACEIELGYGIYEGLPREAEYREEE

SEQ ID NO: 171292 - protein, 48 aa, Glycine max
  Coding DNA Sequence Number=SeqID_79607
MVQGWLDPGRWGRFYARDLDVEDGVLVQDVMVENNSQMEVLGFWSRLL

SEQ ID NO: 171293 - protein, 167 aa, Glycine max
  Coding DNA Sequence Number=SeqID_79608
  Subcellular localization annotation: CTP_CleavageSite=33; ConfidenceScore=5.56e-01
MVSTLTCCNNKANYVGPSDPKTDSYSSDNSRVRSTRPTTRRNKLSGSPRTLETDRVESSVDLIARGGETISYSPRAMETEMCCGQGENTTLGIPRAMETKMIDSSEDLTVGNTTLSTPRAMKIGMVLKWGLDCWKYNIMHHSKSNGDGIGGRRCRFNCRTERGSWTR

SEQ ID NO: 171294 - protein, 316 aa, Glycine max
  Coding DNA Sequence Number=SeqID_79609
  Gene Ontology: Mol. function=catalytic activity; Cellular component =mitochondrion; Biological process=metabolic process
  Homolog annotation: Hit_ID=Q6H7I3; Match level="QueryCoverage=85%, HitCoverage=87%, E-value=3e-85, Identity=59%"; Hit description =Putative enoyl-CoA hydratase
  Pfam annotation: Domain name=ECH; Domain location=63-240; Score =141.9; E_value=1.7e-39; Accession=PF00378.11; Description=Enoyl-CoA hydrataseisomerase family
MCALRALTRSVCNSSSYVKTSKPYLILNLITHQHQTRRNLILESSASEFVKLHKLTGPDSGIVEISLDRPQAKNAIGKEMLRGLSHAFELINQKSYANVAMISSSVPGVFCAGADLKERRTMSQSETKIFVNYLRSTFSSLEAVNVPTIAVIEGVALGGGLEMALALLDFFFTCFFFDGIGENALMGLPETGLAIIPGAGGTQRLPRLVGKAIAKDIIFTGRKIDGKEALSLGLVNYCVPAGEAYSKALAIAQDINQKGPVALRMAKRAINEGVETDLRSALELEEDCYDQVLNSKDRLEGLAAFAEKRKPRYVGE

SEQ ID NO: 171295 - protein, 251 aa, Glycine max
  Coding DNA Sequence Number=SeqID_79610
  Gene Ontology: Mol. function=aspartic-type endopeptidase activity; Biological process=DNA integration
  Homolog annotation: Hit_ID=Q2QYR7; Match level="QueryCoverage=83%, HitCoverage=17%, E-value=3e-11, Identity=25%"; Hit description =Retrotransposon protein, putative, Ty1-copia subclass
MVMGEDLYDHINKSFKTLVQTLLVGRSTLDLDDVIAVLRENERMMRTENVDEEHNAITVVELERGRNHLRRHDGTRGRSKWQSHPQRDTSNMQCYYCSENGYVQVRCKQMKEDLEKLKDMNKDGINSQTNVVKNVEDEDDVLLATNIRSVRMKLHDGAIRTFSNVRCVPSVVVNMISMREMTSQEYKYVGSKRGCKVYKGRYLVLQRQKNKGNICYLDDQVLKRNHDSKMKKKVKFSNVVEVLGDTSVGGG

SEQ ID NO: 171296 - protein, 31 aa, Glycine max
  Coding DNA Sequence Number=SeqID_79611
MEEKKEFPKGESQVVGVDLGLHTCTKTALLA

SEQ ID NO: 171297 - protein, 172 aa, Glycine max
  Coding DNA Sequence Number=SeqID_79612
  Homolog annotation: Hit_ID=A7QSQ4; Match level="QueryCoverage=36%, HitCoverage=8%, E-value=2e-08, Identity=51%"; Hit description =Chromosome chr4 scaffold_162, whole genome shotgun sequence
MGRTIGLRGSVVAVVLSQGFNSGVGGGGVRLGFGMCKVRWICASYQEYFGAKTVLGAHPAPRVATFSSKGPNALNLKIMKDSILSVNMASAIIPYFIKKHLVLKVGACDCPTYGPEWLAVPPLDCCPMKLVEEIALKLWDPGGVLVWSSGRQGGFWPLVVRPIDKLLCLLNS

SEQ ID NO: 171298 - protein, 80 aa, Glycine max
  Coding DNA Sequence Number=SeqID_79613
MLVSALESITDDNNSNVRSVSDGDSFCVDSKVNGGGVNGGGDDNPDDKGDGVMPAVMLVPMTMVIVIIVIMMMVTVIVQY

SEQ ID NO: 171299 - protein, 74 aa, Glycine max
  Coding DNA Sequence Number=SeqID_79614
MVICIFCQPGANAPMGAQKLTSSSAPVVILTHGVGWQAEIPYGHLHLSSTEGNEFDGSASGDIDRPNDVSLEQN

SEQ ID NO: 171300 - protein, 135 aa, Glycine max
  Coding DNA Sequence Number=SeqID_79615
  Homolog annotation: Hit_ID=Q6L477; Match level="QueryCoverage=52%, HitCoverage=11%, E-value=1e-09, Identity=35%"; Hit description =Putative uncharacterized protein OSJNBa0009L15.8
  Subcellular localization annotation: CTP_CleavageSite=21; ConfidenceScore=5.21e-01
MASPPASLPPPPPPPPPAPSNASALPPLGAKRPIVHVDPATGKADGPHRKKLRTYLGIVVRDKVDVTYENWKEVPTAQKDLIWEDIQVEFEILEASDSRTKRKLLQTVGERWRQFKSDLMRKWALAADQDGVEDI

SEQ ID NO: 171301 - protein, 119 aa, Glycine max
  Coding DNA Sequence Number=SeqID_79616
MFSKKEGMMRIMKLAKYRLKAQVEKDEGPSGEGQSPRVEKDEGPSNPCGVYPDLSSFTGSGVYPDLSSFSGSGVYPDLSSFIGSGVYPDLSSFTGSGVNQKLYGLYQAICPVRFTSNQN

SEQ ID NO: 171302 - protein, 333 aa, Glycine max
  Coding DNA Sequence Number=SeqID_79617
  Gene Ontology: Mol. function=inorganic phosphate transmembrane transporter activity; Cellular component=membrane; Biological process=phosphate transport
  Homolog annotation: Hit_ID=A8GKZ2; Match level="QueryCoverage=100%, HitCoverage=66%, E-value=1e-174, Identity=91%"; Hit description =Phosphate transporter
  Pfam annotation: Domain name=PHO4; Domain location=1-322; Score=38.2; E_value=2.6e-13; Accession=PF01384.11; Description=Phosphate transporter family
MVAGVMVFALRRYWSGTKKRQRIHMTPAEREKVDGKRKPPFWTRIALILSAIGVSFSHGANDGQKGIGLIMLVLIGVAPAGFVVNMNATGYDITRTRDAVTHLQQYYQQHGDALSHAVSLTPLVPSPDDEAAPNKPAEFHCDSSRAMPAIELAQGMLTNLQSYDQLTVEQRSHLRRLLMCVTDTADKVAKLPETSSADQRFLKNLRQDLLQTVEYAPMWIIVAVALALSLGTMVGWKRVATTIGEKIGKKGMTYAQGVSAQMTAALSIGVASYTGMPVSTTHVLSSAVAGTMIVDGGGVQSKTVKNILLAWVLTLPISILLSGALYWVALKLI

SEQ ID NO: 171303 - protein, 261 aa, Glycine max
  Coding DNA Sequence Number=SeqID_79618
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGIRSQSWLTANYASLSQAPSSHPLTSASIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 171304 - protein, 239 aa, Glycine max
  Coding DNA Sequence Number=SeqID_79619
AVAWLRETTGAVAKASLHRAIVTAYGPEPGGEMPLEPRASWFSPKCVEAQQLTRHLGGQGRPVRRWGISFIVERGNSPDHQLRPLNDRSVIKEGRTRASSAGRSGSENVGLSNANVGENPMPRKPKGSSARPKGVVDGQQGNIPVLPFVGPRGTEEARRYSAEVIHAILPGKARTTFNKWVPVPETDTGVPPHKGGRSDQARATVYQKHRSPQSREPTTEAPVNGGRNYNGPKVAKFLV

SEQ ID NO: 171305 - protein, 62 aa, Glycine max
  Coding DNA Sequence Number=SeqID_79620
MKVMPSKLTRTGRKWVHKDAQAKVEYVKKLHEQEKAQIAKKNEGYAKQANKDKKEVVLETGD

SEQ ID NO: 171306 - protein, 72 aa, Glycine max
  Coding DNA Sequence Number=SeqID_79621
MPIGWTSQKSGADIEEDESTDLRSNPLQGRGNDAILPKKGLVTRAMSKMLQEDWARAVEEGLRVLMNLRVDF

SEQ ID NO: 171307 - protein, 122 aa, Glycine max
  Coding DNA Sequence Number=SeqID_79622
  Gene Ontology: Mol. function=aspartic-type endopeptidase activity; Biological process=RNA-dependent DNA replication
  Homolog annotation: Hit_ID=Q6WAY3; Match level="QueryCoverage=55%, HitCoverage=2%, E-value=9e-09, Identity=44%"; Hit description =Gag/pol polyprotein
MNCREKKPVECTPIPMPYADLLPYLLDNAMTIISLAKISQPPFPRGYNPNVTCAYHGGVPGHSIEHYITLKHKVESLIDADTSEPYTGAMRGTMHEPQANLGADQKFSPSRLKTLKGGLGKN

SEQ ID NO: 171308 - protein, 80 aa, Glycine max
  Coding DNA Sequence Number=SeqID_79623
MVNKSGMETLLKKLLSLVDVYIELIDGEHESNSREKPEETTTIRDDALQWLTILRLGGIDGNPVLRGTRRRTTYAYMSSN

SEQ ID NO: 171309 - protein, 84 aa, Glycine max
  Coding DNA Sequence Number=SeqID_79624
MVGYTPSSFKDLVFASKRIEVGLKRGKFGHPALIKTGANEEGEKEGETHAVTAIPIRPSFPPTQQCHYPTLLLTYRPFIHQGHP

SEQ ID NO: 171310 - protein, 227 aa, Glycine max
  Coding DNA Sequence Number=SeqID_79625
  Homolog annotation: Hit_ID=A5AP21; Match level="QueryCoverage=71%, HitCoverage=11%, E-value=4e-12, Identity=32%"; Hit description =Putative uncharacterized protein
RKFDIPEGENAKKKQISDPTVKYGLDPETWAEFAKSRKTPNWQGIRKKAQEIQKFNDCPHVLSRGGYELLDKKLMEEKSKRGHEEHSCTESPTLNVDPPSLVARHLKWKIARTKRHGQMTSEVAQEIADKIDSLQEQATQGSFVLHGRQDILNTALDRPEHPGRVRVAGTGVTISQYFGQASRASSTSSPSINQQQLADIIGVIKDDIRKQLQDEIRKEVQDEIRKE

SEQ ID NO: 171311 - protein, 94 aa, Glycine max
  Coding DNA Sequence Number=SeqID_79626
MSHGPRRMRRKAIKKEDPRRHILLGMAMIHQMVRRRRSTFYPRTMKVMRTSLMKFNGRQRRRGEGRHHPLGNKPRKKELHHQELPWIRSLKKML

SEQ ID NO: 171312 - protein, 158 aa, Glycine max
  Coding DNA Sequence Number=SeqID_79627
LGFPALITVLCKDRGVTSDSLVFERLSPVINLAYIKKNNWNPDDLTVSIRGARQARMRPAEPPSTSTTPIPARTSVVAPPGSIPSVKQFTELVAWPGTLSSLCKEDEGPTAQVPQHVEDDSSEATILEPFVRGMVAEETQEVAATLERSLEAASEPPA

SEQ ID NO: 171313 - protein, 106 aa, Glycine max
  Coding DNA Sequence Number=SeqID_79628
  Subcellular localization annotation: CTP_CleavageSite=59; ConfidenceScore=5.01e-01
AQGDAPQAADAPPPHQAGPAGLFDTKQYLRHLVRQQAANHRAHSLGFTSFPCPTPDQFRAEVAWPGDWPEARAGEAPAEAPDEADEACEDEEMTDLLDFLGGSGAT

SEQ ID NO: 171314 - protein, 78 aa, Glycine max
  Coding DNA Sequence Number=SeqID_79629
MVITGTISIAQVDVMDEFIQFEDQDMSQVGKEDEDVEMEKAQATSNIESFVVGDVSYSKASTKEPSAKISKTKYKAEM

SEQ ID NO: 171315 - protein, 109 aa, Glycine max
  Coding DNA Sequence Number=SeqID_79630
MRQANDVKEALPGKQPNFNLCYFWFFMHLIIGNLLYNLNIGAYQPPFECPFAKRLLLAKRIIVHALSQKFQALSAQPWYLRLIISAKLAEVKLSQNQFELNSAKLQPNR

SEQ ID NO: 171316 - protein, 575 aa, Glycine max
  Coding DNA Sequence Number=SeqID_79631
  Gene Ontology: Mol. function=transporter activity; Cellular component= membrane; Biological process=transport
  Homolog annotation: Hit_ID=A5B8A6; Match level="QueryCoverage=97%, HitCoverage=91%, E-value=0.0, Identity=70%"; Hit description =Putative uncharacterized protein
  Pfam annotation: Domain name=Sulfate_transp; Domain location=296-575; Score=-166.1; E_value=0.061; Accession=PF00916.11; Description =Sulfate transporter family
  Pfam annotation: Domain name=Xan_ur_permease; Domain location=95-562; Score=-44.5; E_value=2e-06; Accession=PF00860.11; Description =Permease family
  Pfam module annotation: Pfam domain module=Sulfate_transp::Xan_ur _permease; Domain location=296-575::95-562
  Subcellular localization annotation: CTP_CleavageSite=64; ConfidenceScore=5.04e-01
MEAERPPLPQHNSHTKPLSRLNEYVAKTRVGKWFKLSQRNSTFTTELRAGTATFLTMAYILAVNASILSDSGGTCSVSDCVPLCSDPSIPLSACSGLSLRVIQPDASCKFSPVNPGYAACLENTRKDLIVATIASSLIGCFIMGTFANLPLGLAPGMGSNAYFAYTVVGFHGSGNVSYQSALAAVFIEGAIFLLVSAIGLRAKLAKLVPKPVRISSSAGIGLFLAFIGLQSNQGIGLIGYSASTLVTLGACPTSSRASLAPVLTAANGTVSLLPGGTVSGDILCLKDRMESPTLWLGLVGFIIIAYCLAKNIKGAMIYGIVFVTVVSWFRGTKVTAFPNTDAGNSAHEYFKKVVDVHTIKTTAGALSFKNIGKGYFWEAVVTFLYVDILDTTGTLYSMARFAGFTDDKGGFEGQYFAFMSDATSIVVGNHGVDGAGFTDDKGGFEGQYFAFMSDATSIVVGSLLGTSPVTAFIESSTGIREGGRTGITALTVAAYFFLAFFFTPLLASIPAWAVGPPLILVGVLMMRSVVEIDWEDMREAIPAFVTLILMPLTYSIAYGLIGGIGTYIVLNLWDW

SEQ ID NO: 171317 - protein, 421 aa, Glycine max
  Coding DNA Sequence Number=SeqID_79632
  Gene Ontology: Mol. function=transporter activity; Cellular component= membrane; Biological process=oligopeptide transport
  Homolog annotation: Hit_ID=O22305; Match level="QueryCoverage=99%, HitCoverage=71%, E-value=1e-145, Identity=61%"; Hit description =Peptide transporter
  Pfam annotation: Domain name=PTR2; Domain location=1-336; Score =267.9; E_value=2.1e-77; Accession=PF00854.12; Description=POT family
MSTFGADQFDDFRPKEKVLKVSYFNWWSFNTAFGTLAATLFVVYIQERFGWGLGYGISAIGFLVASVTFFMGVPIYRHKSRKGKSHAKEFFSVPVVAFRNRKLQLPSSPSELHECEMQHYIDRGRRQIYHTPRFRFLDKAAIKQEKTDASNPPCTVTQVERNKLVLGMLGIWLLIIIPSNFWAVEVTAFVKQGTTMERNLGPNFQIPAASLWSFVVVTILICVPIYECYFVPFMRRRTGLHRGIKMLHRIAIGVAIQIMAAAVMFAVEIRRMKVIREKHITGAKEVVPMSIFWLLPQHVLLGLANTFLMAGLLEFFYDQSPEEMKVLGTAFYTSTIAVGKYSNSLLVFMIDKFSRKMSGKSWIGNNLNDCHLDYYYALLFVISAFNFAVFLWVQRGYIYKKENTTEVNEFEIVRAEKTESQ

SEQ ID NO: 171318 - protein, 258 aa, Glycine max
  Coding DNA Sequence Number=SeqID_79633
  Gene Ontology: Mol. function=histone-lysine N-methyltransferase activity; Cellular component=nucleus; Biological process =multicellular organismal development
  Homolog annotation: Hit_ID=A7Q3T1; Match level="QueryCoverage=76%, HitCoverage=100%, E-value=5e-66, Identity=67%"; Hit description =Chromosome chr13 scaffold_48, whole genome shotgun sequence
  Pfam annotation: Domain name=DUF260; Domain location=78-178; Score =238.3; E_value=1.7e-68; Accession=PF03195.5; Description=Protein of unknown function DUF260
GVVVEDYYNGVSDRVCTVMFKGQLAVSTRPAKFLHAYYYCRERFDEIGKKIKRERDVSSQMGRRHMLGPPGTLNTITPCAACKLLRRRCAQECPFSPYFSPHEPQKFASVHKVFGASNVSKMLMEVPECQRADAANSLVYEANVRLRDPVYGCMGAISALQQQVQSLQAELNAVRGEILKYKLREANMIPSSHHVGMLPSSGAVSIAAPPPPPPPPPPPPPPPSLPLPLTSPSSSIYIQHRDPTTYTTISSDNISYFG

SEQ ID NO: 171319 - protein, 361 aa, Glycine max
  Coding DNA Sequence Number=SeqID_79634
  Homolog annotation: Hit_ID=A5AWQ9; Match level="QueryCoverage=45%, HitCoverage=15%, E-value=5e-17, Identity=32%"; Hit description =Putative uncharacterized protein
  Pfam annotation: Domain name=GRP; Domain location=183-234; Score= -26.8; E_value=0.044; Accession=PF07172.2; Description=Glycine rich protein family
MENMCITTFGIIRAMKVKPVVCCCSSALLRGQLYCVNVNSCLPPLCTLYICLIESNEKCGESVTFHTKFKLQVSIKAGNRSDCHPPPPSLATIFSGEAKVGCASRSATHPCKSRVELWFLGQGYHDHLEKGVGAVPNDKKSEWEKLDFRKLDKFYIVLILRSLHSDFDHVRDQVLVGDQVPSMDSLITRLLRVSHVLKDENLVEVVKTSAMVAPRGKGGGRNNRGGRGGRSGRPQCTYCKRMGYTQENCYSLHGFPDKQVLPVPSPGPLGNSNQSVSGIPSPPPSSTKVAPPPLITYQRRTRQVGSTVPESSPRDSHPPPIDPQTMDPSSSTSSHHSDSDWPIAFRKGTRSTRNPHPIYNF

SEQ ID NO: 171320 - protein, 179 aa, Glycine max
  Coding DNA Sequence Number=SeqID_79635
  Gene Ontology: Mol. function=protein kinase activity; Cellular component=integral to membrane; Biological process=protein amino acid phosphorylation
  Homolog annotation: Hit_ID=A7PL29; Match level="QueryCoverage=89%, HitCoverage=21%, E-value=6e-81, Identity=91%"; Hit description =Chromosome chr7 scaffold_20, whole genome shotgun sequence
  Pfam annotation: Domain name=ABC1; Domain location=71-174; Score =88.8; E_value=1.7e-23; Accession=PF03109.7; Description=ABC1 family
MTEEKQTLRRKVLAKWLKENILRLGPTFIKIGQQFSTRVDILPQEYVDQLSELQDQVPPFPSETSVAIVEEELGAPLGDIFDQFDYEPIAAASLGQVHRARLNGQEVVIKVQRPGLKDLFDIDLKNLRVIAEYLQKIDPKSDGAKRDWVAIYDECASVLYQVMISGSYYIVMLLEITEQ

SEQ ID NO: 171321 - protein, 600 aa, Glycine max
  Coding DNA Sequence Number=SeqID_79636
  Gene Ontology: Mol. function=transferase activity, transferring glycosyl groups; Cellular component=chloroplast; Biological process =carbohydrate metabolic process
  Homolog annotation: Hit_ID=A7PL18; Match level="QueryCoverage=92%, HitCoverage=88%, E-value=0.0, Identity=75%"; Hit description =Chromosome chr7 scaffold_20, whole genome shotgun sequence
  Pfam annotation: Domain name=Glyco_hydro_77; Domain location=76-597; Score=746.5; E_value=1.8e-221; Accession=PF02446.8; Description=4 -alpha-glucanotransferase
  Subcellular localization annotation: CTP_CleavageSite=35; ConfidenceScore=5.52e-01
MALLALNISVCCFQQQRSPTLFKPTITKQTLSLPTASAFSSSSLTQLSVGQYLPANYGDWVPNPDPELRRRCGILLHPTSFRGPYGIGDLGDEAFRFIDWLHHSGCSVWQVLPLVPPGRKANEEGSPYSGQDANCGNTLLISLQGLVEDGLLEKHELPQPIDAERVNFSLVADVKDPLITKAAERLISSEGELKTQLENFRRDPDISSETLVYGDSLGILGLRVIEVGRKEILAYVEVISWLEDAAYFAAIDDSLNTISWYNWPEPLRNRHLVALEDIYQQKRDFINVFIAQQFLFQRQWQKVHSYAQSKGISIMGDMPIYVGYHSADVWANKKQFLLNRKGFPLLVSGVPPDAFSETGQLWGSPLYDWKAMEKDGYSWWVRRIRRAQNLFDEFRIDHFRGFAGYWAVPSEAKVAMLGKWKVGPGISLFDTIFRAVGRINIIAEDLGVITEDVVQLRRSIGAPGMAVLQFGFGGDANNPHLPHNHECNQVVYTGTHDNDTIGGWWEVLNQEEKSNVLRYLSLNEGDDIPWALIQRVLASVAQTAIIPMQDVLGLGNSARMNIPATQFGNWGWRIASSVSFDGLEREADRLREMLSMYGRL

SEQ ID NO: 171322 - protein, 214 aa, Glycine max
  Coding DNA Sequence Number=SeqID_79637
  Homolog annotation: Hit_ID=A7PL29; Match level="QueryCoverage=92%, HitCoverage=26%, E-value=2e-42, Identity=50%"; Hit description =Chromosome chr7 scaffold_20, whole genome shotgun sequence
  Subcellular localization annotation: CTP_CleavageSite=53; ConfidenceScore=5.69e-01
MATSSPLPLPELHFLSPQTTPKRRISFSKLPSSPYSVSRHVTSNVSLRTSRIRATREESALAERLNDVEWTGNGAAAAAADGNGASVGGYVNGATNGSLVKYGYENGNGVSAEVLEVEASNKLSEDGRKKRLEEIGKEDAWFKQSGNEQVEVAVAPGGRWNRFKTYSTIQRTFEIWGFFATFIFKAWLNNQKFSYKGSSSIEDFSKLEEALVLL

SEQ ID NO: 171323 - protein, 291 aa, Glycine max
  Coding DNA Sequence Number=SeqID_79638
  Gene Ontology: Mol. function=transmembrane receptor activity; Cellular component=intrinsic to membrane; Biological process=innate immune response
  Homolog annotation: Hit_ID=Q9FVK2; Match level="QueryCoverage=69%, HitCoverage=57%, E-value=9e-63, Identity=63%"; Hit description =Resistance protein MG13
  Pfam annotation: Domain name=TIR; Domain location=14-142; Score =105.4; E_value=1.7e-28; Accession=PF01582.11; Description=TIR domain
MALRSGFSSFTYDVFLSFRGSDTRHGFTGNLYKALADRGIYTFIDDEELQSGKEITPTLLKAIQESRIAINALSINYASSSFCLDELATILGCAERKTLLVLPVFSHVRHREDSYGEALVKHEERFEHNTEKLQKWKMTLYQVALLSGYHFKYGYPPYRSSLHYGYEYEFIGRIVERVCIKINLTHLHVAGYLVGLESQVPRAMKLLDVGSDDVEKSLIKVKTVTLHDLTEDMGKKFVTQGSARELGSKGSYNPSFGRQQSETIESATAGTVSGVQIAVVGIFSAASSSSY

SEQ ID NO: 171324 - protein, 264 aa, Glycine max
  Coding DNA Sequence Number=SeqID_79639
  Gene Ontology: Mol. function=binding; Cellular component=chloroplast envelope; Biological process=photosynthesis, light reaction
  Homolog annotation: Hit_ID=A7PKZ7; Match level="QueryCoverage=89%, HitCoverage=58%, E-value=7e-74, Identity=64%"; Hit description =Chromosome chr7 scaffold_20, whole genome shotgun sequence
  Pfam annotation: Domain name=TPR_1; Domain location=197-230; Score =8.4; E_value=0.52; Accession=PF00515.19; Description=Tetratricopeptid e repeat
  Pfam annotation: Domain name=TPR_1; Domain location=66-99; Score =14.0; E_value=0.11; Accession=PF00515.19; Description=Tetratricopepti de repeat
  Pfam annotation: Domain name=TPR_2; Domain location=163-196; Score =8.3; E_value=2.7; Accession=PF07719.8; Description=Tetratricopeptide repeat
  Pfam annotation: Domain name=TPR_2; Domain location=197-230; Score =13.8; E_value=0.58; Accession=PF07719.8; Description=Tetratricopeptid e repeat
  Pfam annotation: Domain name=TPR_2; Domain location=66-99; Score =18.5; E_value=0.025; Accession=PF07719.8; Description=Tetratricopepti de repeat
  Pfam module annotation: Pfam domain module=TPR_1::TPR_1::TPR_2::TPR _2::TPR_2; Domain location=197-230::66-99::163-196::197-230::66-99
MNPTEEKNEEEKSEEEVEEMWEGILEKDPKNVEALKVVLYGKIRRGKSKEAVKVVEDLIAAEPNEVEWRLLLALCYETMGQLSKAKRLFREILKKRPLLVRALHDLIRLVEFFIPTDMLHTLDLALEGLAMAMHKIHEGPAVFEMLNNAQELASRENRVTEERNIRILIAQMHVVQGNLEEGLKRFQELIDQNRRDFRPYICQGIIYSLLGKNEEAAQQFETYQTLVPEEFPQRRFLDDVAIAAKRSSLEQFKKEFRDQFSYRK

SEQ ID NO: 171325 - protein, 203 aa, Glycine max
  Coding DNA Sequence Number=SeqID_79640
  Gene Ontology: Cellular component=flagellum; Biological process =flagellum biogenesis
  Homolog annotation: Hit_ID=A8AF95; Match level="QueryCoverage=55%, HitCoverage=94%, E-value=2e-31, Identity=59%"; Hit description =Putative uncharacterized protein
  Pfam annotation: Domain name=FliS; Domain location=2-90; Score=-28.2; E_value=0.081; Accession=PF02561.5; Description=Flagellar protein FliS
  Pfam annotation: Domain name=FliT; Domain location=54-173; Score =111.1; E_value=3.3e-30; Accession=PF05400.4; Description=Flagellar protein FliT
  Pfam module annotation: Pfam domain module=FliS::FliT; Domain location=2-90::54-173
LNALVRARLFLDSGQIAQKGETLSKAIAIIDNGLKTGLNMEVQSELPGNLPALYDYMVPPLSHWQALHAQSIAMLNLAHSGQWDALIEQEMHYVQLVERISQTPIMSCPPAQVEQARALLEMILENENALKALLKVRMDELRSLIDQTGKQQSITSTYGKLSGNILYPESGELWREVTALAPNLNEIGINMIWLPPAYKGASG

SEQ ID NO: 171326 - protein, 204 aa, Glycine max
  Coding DNA Sequence Number=SeqID_79641
AEFEIPKASDSKTKKKLLQTIDERLMQFKSDLTRKWARAANQDGVDDTDVWKKAQAIQTQNTAPHVLSRGGYEYLEQKLLGEKTKKKLEEAEQSGSVDGVIDPLSPVRRQVRWKMARTKKIGEIMIEAAKEIAEKIDSFEEQARHRDPSSPMDVRMFSLLLLDVQSTLDMSVLLEPVSPSSSTSDQLHGRPAALPRCLLKNCSS

SEQ ID NO: 171327 - protein, 166 aa, Glycine max
  Coding DNA Sequence Number=SeqID_79642
  Gene Ontology: Mol. function=triacylglycerol lipase activity; Biological process=lipid metabolic process
  Homolog annotation: Hit_ID=A5C0D6; Match level="QueryCoverage=91%, HitCoverage=82%, E-value=5e-36, Identity=47%"; Hit description =Putative uncharacterized protein
MKHQTEGAVFHTPWLYGGTNYRRMVEPLYISEYYIEGKKDYVASGRSRHYEVLEEWLKEGKKDTSDSNANSTSRKNVELILTVDSCFWAYVEEALLLCKQLQNVQSSEKDKKEATEKLLEFVKYVYGSLKKYEVSPEIFLMESSYMTWWDKYKGISGILVLPSLVL

SEQ ID NO: 171328 - protein, 92 aa, Glycine max
  Coding DNA Sequence Number=SeqID_79643
MKGALHHLPIGALLLAATTSAQALKAPEVDLRDPKLWEEKKVNPLNDISAPCEVASGPDCPVWEDQKSDIQRERERREQRRWQTGYEHWRKY

SEQ ID NO: 171329 - protein, 124 aa, Glycine max
  Coding DNA Sequence Number=SeqID_79644
MQRLQQTVLRSCCGVGRRHTTTCRSLNGKHRVWLKVNLSMIWRFFTGAPYRLGLLALKGNGNGVASVLVGHVHGVQCIIEGVSHRGKHSYYAPCVNCRCWPRPLLPVPPCPGWVGSLGLWQMDG

SEQ ID NO: 171330 - protein, 57 aa, Glycine max
  Coding DNA Sequence Number=SeqID_79645
MEWRLHSSFSFSIPLPFIFKKQKNSIDEEDPRPISSIWSYMIKALVMTKSSKVKNTS

SEQ ID NO: 171331 - protein, 150 aa, Glycine max
  Coding DNA Sequence Number=SeqID_79646
MCAKARVMSEIEKVHEQMKADMEAMKEQMTTMMEAMMSMRKMMEVNTDTVVAASIATEVDLTHPYGLNQVNRPVSDTVGQGGEALGSIGGPHFVQVQSKHSFPPYGLPPNYTPPNVAHAPNENVDNNPNLVMHRSLNPWGRHMKYLETTL

SEQ ID NO: 171332 - protein, 76 aa, Glycine max
  Coding DNA Sequence Number=SeqID_79647
  Subcellular localization annotation: CTP_CleavageSite=45; ConfidenceScore=5.16e-01
MTLHLAQMHNSSFFQIPPCAQSRSVALSGWLAKPAYWLSERFCLSSSKYRTAHWSPSDNNMQSLCTKVYAQKLLYG

SEQ ID NO: 171333 - protein, 623 aa, Glycine max
  Coding DNA Sequence Number=SeqID_79648
RAQIVRPVFGNDQQVALRAVAHVIRPLFEEPGGNVFGGVQAEAVARQAFQQPARPVFELLRHGGIAELHVGAHQIVVVALFVVDLIVPAVVAIVVGDFEHPFVVRLLNVVDAAEAFVIPDKLGMHALAAGKGEAGVGQRVEALVVDVVAVVGVHLEHVYLFFLVRAELVVEHHVVEHPHAVFAQRIGGVFERRLVAVFGGHAAFLVKLAEIEQIVSIVADGVAAGSALAGGRQPQIGDAQFGEVRRALGGLLPQFAAVGVVPVEELQQGGFFRHEPASRLARRRGAVAVKAWATFGKRDKMARSDLSPIARRGVGDGANIKSFVADGIGDLRNRGADHHAQQATGVVVAFVTGCGGGTGPQLFAVAQIDQASGYGNAGFAADHHVAGAVLRDIQEGFLHYSDRQHIVTGLGQRQGGAGEHAVAGFDVRRLVNRRQDQDRLRLALMERRIVIRRLLGTAAKQQGGGNGEERNSLNGADSGNSVFSVLNSFMACPSLPIFAVQQPQLRMQTWRYGFILGAGFLDDLFQRGDLLLRALPPPAGSIDREKSGSHPNCKAFSARRSRPAGAPCAVFDTGDQVIDGFTHGQIQHLAVEGGVVAGGAPETDDFAIGQFVFTGTLSGIDDF

SEQ ID NO: 171334 - protein, 542 aa, Glycine max
  Coding DNA Sequence Number=SeqID_79649
  Gene Ontology: Mol. function=oxidoreductase activity; Cellular component=integral to membrane; Biological process=electron transport
  Homolog annotation: Hit_ID=A9BMH6; Match level="QueryCoverage=26%, HitCoverage=19%, E-value=4e-41, Identity=55%"; Hit description =Aldehyde oxidase and xanthine dehydrogenase molybdopterin binding
MSCNIWLGRNNAFTTYVGLVVEIAIQEGRLRVLRAVCAIDCGKVINPNLVRANVEGGIGFALTTCLHSELHFERGGVVEGNFDRYPLLAIAEMPKVEVVVLDSARAPQGCGEVSTAVVAPAIASALHKATGKTYRTMPFPREFSSRQQLRFAFLRQPVDGQLDDVGAGNAHDAAARRLHDHFIDGFNVAVRQADGNRLIGAFAAGRFGFRRGCRDRQRVRGGAVDEFVFRHAAFNFALRLFVVRLMHGDGFAPGVAVNLAVAQAVTHQRKLRVFAQHLRRFVGFVDKDIGRAHVQHDVAFDLLVVFLRGGEHLRQIADGVEIHLRRAQRREEQIGGQQPGAQFGAVAAGGVDDYVVVMAIQLQQRFLDFARRGHHRNVRQPLDVLTVVVPGHDRFLVVGIDDDRRLALLKNQIPGDIHRFRRFADAAFLRANQNNHAAISQVNKNNSRTICTNCGGLPSQYVLSVALLLHHRLQVGERVMGGDADIFLRVFTGHHRRTVLIGLGVFRVLVVVAVQAQHFPIAAVFGVVAVIVIDVVHRQFAQ

SEQ ID NO: 171335 - protein, 66 aa, Glycine max
  Coding DNA Sequence Number=SeqID_79650
MAEDQPQRVTLEDYSSSTMPQFFTSITRPEVQAHNITYPHSLIQLIQGNLFHGLTNEDPYAYLATY

SEQ ID NO: 171336 - protein, 124 aa, Glycine max
  Coding DNA Sequence Number=SeqID_79651
  Homolog annotation: Hit_ID=A5BP18; Match level="QueryCoverage=68%, HitCoverage=10%, E-value=3e-08, Identity=33%"; Hit description =Putative uncharacterized protein
MEITMQFGEALQQMPLYTKFMKHILTKKGKPINHKIVWGSRRCPCQSPPFNFPVEFVIMDIKEDAEIPLILDRPFMLTANCVVNMGNDNLEMSIDDQKGKIGGASRWRRSIKKTLVLFKPHRLH

SEQ ID NO: 171337 - protein, 136 aa, Glycine max
  Coding DNA Sequence Number=SeqID_79652
FYGVPVAPNKVIRPPTNRAFIKKYCAPRQAQGETPQLPGDGRQRATDALPPPPEPLSSSIEAGALPRTRGRPAGDQVQSQRSSPRNGPGKAPLKRIPVWPHKPTQALTNTDSRVWNINSISRPSKDDHSSNTDRGS

SEQ ID NO: 171338 - protein, 111 aa, Glycine max
  Coding DNA Sequence Number=SeqID_79653
MEYTNLGIHDHVAPHAPKLLGHGNKWWGGRQKQGFCSYILDVSISFLNDHLEETLGPTKIGENHSKCINLTQVKVYDKLGFWLKACRTTGHDICQGLASGSGIKGMIHMQQ

SEQ ID NO: 171339 - protein, 91 aa, Glycine max
  Coding DNA Sequence Number=SeqID_79654
MVSFDESNAILPRKDILDDIKDFLEEMDIHGKDSKGKGEGSNEDSQVDETKTNDDLPREWKASRDNPLDNIIGDISKGVMSQPTLRREGDV

SEQ ID NO: 171340 - protein, 29 aa, Glycine max
  Coding DNA Sequence Number=SeqID_79655
VVAAQLAQASQVASSRSNSLLEEYSGGIF

SEQ ID NO: 171341 - protein, 73 aa, Glycine max
  Coding DNA Sequence Number=SeqID_79656
MEEPRGIPLSIDFSSLCHYCKPQLTMLNEMDKVDIFVPHPLTNACLLIQLSLEYGCKPLVCLLKRPALLSVDF

SEQ ID NO: 171342 - protein, 224 aa, Glycine max
  Coding DNA Sequence Number=SeqID_79657
  Pfam annotation: Domain name=Transposase_23; Domain location=30-100; Score=-9.9; E_value=0.015; Accession=PF03017.5; Description =TNP1ENSPM transposase
MQSQRQSQGTCTASRAFGWSLRSSRNDLETGDSDRCGLYIEADPARLVALGIVYEGSTVVHNTPLLSGQVKVGVEQVTDADAPVLVPTNEVSLLGQTIHTFLTWPTHLVKSLSHQATVSSAKPPQKPHPEVDDPLYLMTLTIPELFLRPYQVTWDATMFRVFNPDFPLYIKHEDLSEIAHDGQCLSISVLQLWIMHLTETSMRAGNSNIYGFLEPQSIQRSGQS

SEQ ID NO: 171343 - protein, 90 aa, Glycine max
  Coding DNA Sequence Number=SeqID_79658
MIGTSKPYTRAMRGTMHEPQANLGADPKFSPVDGGPLGTSNLTLQKDYTSSPSEDCTCPHLHRTTRPHLQRAITPFTFRGLHALTFRGLL

SEQ ID NO: 171344 - protein, 63 aa, Glycine max
  Coding DNA Sequence Number=SeqID_79659
MGAKHLTRTKEWSHVIEQRSPDEIRGVVWDGPRPMLHSGVMGHATLPPFSCYSCQNMRPPSAR

SEQ ID NO: 171345 - protein, 139 aa, Glycine max
  Coding DNA Sequence Number=SeqID_79660
FYQVKIKSLGVTSLKELGQLMGQLQRKAFHKAYCKIWDLTMAEVSTEAISSLTQYYDQPLRKPYLFSGFYPSLARISKIVKISAQELDQGKQVENEVVGVPRKCLEAKARTLASQDEWAPFMDVLALLIFGVSSFQIWD

SEQ ID NO: 171346 - protein, 97 aa, Glycine max
  Coding DNA Sequence Number=SeqID_79661
MDCKSIIALRIDNLYRLYVLKKNDRCKKKIPHFKSLKISQNEQHSENMTRRKKSNKNAMANAPGNDDFLRDTMIGGFMTFDFFLHVCVLPYNIIPFM

SEQ ID NO: 171347 - protein, 89 aa, Glycine max
  Coding DNA Sequence Number=SeqID_79662
MSEFTSDSPQISASPLELDFVPYTSGPYNAQWSAPELLHDKNMLCSSRMIEKTKSGTWRYVAGVRRPWGRQVGCYCPKPSLTNPDPTRA

SEQ ID NO: 171348 - protein, 95 aa, Glycine max
  Coding DNA Sequence Number=SeqID_79663
MMITKDDDKGDDKKLKDQSKNNSSESKINQRSIKNNSRVQDKNQEEFKTQEESLESRIKIQGSRSQESRSRFKTQDSRIKRRLNQDKYEKVFLKN

SEQ ID NO: 171349 - protein, 196 aa, Glycine max
  Coding DNA Sequence Number=SeqID_79664
MEASLFIPRKGFVLNAEGQPWKLLRKDLTTLAQTWSIFCYSNLAPTSHTSDLNMDRARLVYGLVTGMDMNIGDLISGQITIMAQSNSSRLGFPALITTLCRSRGVGFDALTSYKKSLRLFINLAYIKKKCWNVNNQTLNFPGARKTRSKAVGVPSSFAPTADIPSPSTPTPPPPSTAPSAQSSQTSHAKLQSLFEG

SEQ ID NO: 171350 - protein, 34 aa, Glycine max
  Coding DNA Sequence Number=SeqID_79665
HVATTSIENIADAKGGTISDEETQFSDHDDKDQK

SEQ ID NO: 171351 - protein, 56 aa, Glycine max
  Coding DNA Sequence Number=SeqID_79666
MKSNDTTCKIIGRPVRITVFCENAPTIWDQHRLKGALKSGDPQGLHSKESVRASPC

SEQ ID NO: 171352 - protein, 80 aa, Glycine max
  Coding DNA Sequence Number=SeqID_79667
MDPNVIEIPPPTANNNNTCNSIKQKETHLLLEVASPLPLPSPFRCQSSSKKQRNPLMKKILGLQAPMELASCGIRASSSR

SEQ ID NO: 171353 - protein, 216 aa, Glycine max
  Coding DNA Sequence Number=SeqID_79668
MAFGTMAARLSELMLHPEVTGSPRQAGPDQEARSPQRKKSITFAKSPSSSSPGASAAGKGWGPGTAAAMYTDRSYRSTAPGPYGLLLAGQPNATCRAPSSACELRWTLEIVATVEVEVVRLRPTTTGPAPVSRRCDTYKLVDGIRDKLGYMNTNLGQDSVDQLTYRQREIKIMITGKDLVEEKRHLDLGQGGHGSAHDPHLPPCHVPCKILSQGAQ

SEQ ID NO: 171354 - protein, 177 aa, Glycine max
  Coding DNA Sequence Number=SeqID_79669
MTASGGHWWSLVVVGGEGGGMGKKRGEKRKILFAWARWPNSDSLRRVLSEFYSNIFHCFCAKQETLLYALYHKRNIPRFTALEVPNKYKTPYPLPTRDPLSLSRMWRPHFTTLRVIKNFDSMTLEELVRILKVHEQELDQDEGTKKGMYLAFMIQQTKCNYASKESSSKALAINDAS

SEQ ID NO: 171355 - protein, 203 aa, Glycine max
  Coding DNA Sequence Number=SeqID_79670
MVLELVREFWRTAKVYRNEDIGGYFGGKVPGIQVKLTAEMIVQAIGYERHRTKFMNNWENELKNHIGYSMMFLYETFVDVQDKIYLDEKFGLKTGWDDQLDTICEKVAPVQQRPPPTLVAPKATIVITNFTKRPIEKKKKEEEKMRPKRYRIATVIDFYIVLRSVFFVRHPVSICFKNLDTIYAPLGVLFVALHIFISFFYHQ

SEQ ID NO: 171356 - protein, 71 aa, Glycine max
  Coding DNA Sequence Number=SeqID_79671
MVLHIRASPAIVWLQPVFASPSVGSLVCLVSSEVQLPFLDLEPKGSDQERIFKVLVQVKDKPRATRRNIMD

SEQ ID NO: 171357 - protein, 140 aa, Glycine max
  Coding DNA Sequence Number=SeqID_79672
MAGLHSILGLEGFNMSSHMAPKKLAAKRARKATAREGSSAAPQAEIEFDGCRFRSEEHQHYFEMIKDWSLFKERRLTEPMVKYDLEVVMEFYANAWPIEERIVDKRSWMQGQWIPYDTDAINECLGASIDLRRGTMMQIH

SEQ ID NO: 171358 - protein, 183 aa, Glycine max
  Coding DNA Sequence Number=SeqID_79673
MVCVENDDMTGCLLVGSFTFECRIMHYILCRVLLPRSTNLVQASEEDLILLWALKTGRQIDWAHLVRYRMHKALRANAPLPYPHLVKCSFAIGAVAVVPFGYRKDLDGQWVFKQDLPANAPDERTPSPPPRDPSSTLLNDVLNELQDLHAFVGERFDSLDSRISHLEDDMGFIHHFFDPLTNS

SEQ ID NO: 171359 - protein, 302 aa, Glycine max
  Coding DNA Sequence Number=SeqID_79674
  Subcellular localization annotation: CTP_CleavageSite=11; ConfidenceScore=5.34e-01
MTLFRCACHSSASSAVNTTCPTEGFFRSFLSVAPPPIPAPPLVPLPPPTPVPHVARAPLLGPVLPRAPNPLPPPAPLPLQAPAASAVPRRGATVRGFWSAARTTAFHGSRLLICFWRKSFLIIEFEKLKLKPKMFQVFAADIFTSKLCNDVSNQQAGMQFKNKGNQSGSRCFARMLQPYEISIGLKEHSNPVTPKAYTPKSPSGPLPPDSDISGFLRERKRLQCEGCFSQFRHNIEIPNGENARNCVVNVVLIFHDDPTVNKSEIVVLLRQVWWPAGKERVLREKRKNEIVRQRRLRSQSQN

SEQ ID NO: 171360 - protein, 487 aa, Glycine max
  Coding DNA Sequence Number=SeqID_79675
  Homolog annotation: Hit_ID=Q6WAY6; Match level="QueryCoverage=49%, HitCoverage=50%, E-value=1e-25, Identity=29%"; Hit description =Putative uncharacterized protein
MMITKDDDKGDDKKLKDQSKNNSSESKINQRTTQVNQEQFKTQEESLGSRIKIQGSRSQELRSRFKTQDSRIKRRLNQDKGYIYLDLTENERGYISGGSFLVEGTSTRFKENKGGPLDPTEVFVEAIASLTQYYDQPLRCFRFEDFQLPSMARVEKVVKISLQELDRVKQNRNGVVEIPRKHLEGKAKSLANQGEWVPFIDTFALLIFGVVFFPNVEGLVDLVAIDAFLAYHHNKESPTISILADLYDTFDRRCEKSSERIICCTPALYVWLDQLLASMERASINWFPRWMEGRTRVLSACEGFPNVPLMGTRGCINYNLVLAIRQLGYPMRGAPSEESIMPFIAQGFSDPNARDKELRGSSNQVIGGYHKCLKVRTQGLDWLLKLKAAREKEAKAPKESEKAQALKAKLEKARAIKEKSTAIKVRKEYDELKDTNMAAAEALERETKMARKEELSVNKFRGALWGNNSELKLRRDERDQSWVEGMI

SEQ ID NO: 171361 - protein, 77 aa, Glycine max
  Coding DNA Sequence Number=SeqID_79676
MVKLERFPLTEEVLPYKGNSSNGRSSSVSSYGRRFFRMKNFLYMEELLQLAENAPTSPFSQRDSQRNEVINPTAKKA

SEQ ID NO: 171362 - protein, 274 aa, Glycine max
  Coding DNA Sequence Number=SeqID_79677
  Homolog annotation: Hit_ID=Q5XM22; Match level="QueryCoverage=27%, HitCoverage=57%, E-value=2e-13, Identity=45%"; Hit description =Resistance-like protein HAAS-2
MGLLQTFFFFFTFVAFLLNGFRDLGQSRGYAWGVVVLVHMYDQLNEASQTPTRQMGGYLTLLQCWIYEYFPSVHQCVTDDGYAEKTPRASRWLTMKAHMKGIKGAPYRARLDALTITDGQLRWGHVVVYVRPERVVQQFGYMHTIPPLPVTSLLSYEDISDRWMHFGDHLAPAGEICVVPSQEGDEPRHPPAPDVDAYVEPHIPEVPVPANLPRPSVVAYEGCEAIAKRLERVLNLRMVTARTELHEIMEDCLRIARGDTSDGSLRARRRQRID

SEQ ID NO: 171363 - protein, 103 aa, Glycine max
  Coding DNA Sequence Number=SeqID_79678
MYFNGSDPEDDNNDNDSDNTNDDDSSVDAGSGGNAVGSGDKIVGGCTNDDDDSVDGSNNDNNNSTNEYYKISITYGRSSSLVNFLRKKFFRNRKRLVTEEVIP

SEQ ID NO: 171364 - protein, 196 aa, Glycine max
  Coding DNA Sequence Number=SeqID_79679
CDGNPEGLAETRDQCWKPKALLDLSRSRGCLDGIHQLTLRQREVGVMIAGQDVAEQQHHPHLSQGGHAGVHDPHPPPGSGSGKILTWNWLRASASKGIHWPLTYDRMSCTPSSRCPTPANYLFLKICVLIVPELDASLSVELPSFDGLKTLLVLCAPETMAVKLRSSASSFGRSVPPRSLCGELPRRHSCEDNIWK

SEQ ID NO: 171365 - protein, 121 aa, Glycine max
  Coding DNA Sequence Number=SeqID_79680
  Homolog annotation: Hit_ID=Q1RU80; Match level="QueryCoverage=75%, HitCoverage=77%, E-value=3e-08, Identity=36%"; Hit description =Putative uncharacterized protein
KFDRPTPEIEGLVAATGLSPLITCLVDTGEVTISLDDVASLLHLPITGAFHSFEALHVDDVVFLLVELLEVNSEEARAKTVQFHGSGSYAWGAAALVHLYENLNDASKSNARQLAGYITLI

SEQ ID NO: 171366 - protein, 142 aa, Glycine max
  Coding DNA Sequence Number=SeqID_79681
MWTFHTSRQIDWAHLVRYRMHKALRLNAPLPYPHLVTLFLQYFNIPLDSEPYVPIKRSFLIGSAMVASFGYRKECDGSWVKKGAQPNDDEGHLPVEGDSSLLQSILDSDTRFEEMNSRIAKVEEDVTIIRDYFDLPPPPPSV

SEQ ID NO: 171367 - protein, 155 aa, Glycine max
  Coding DNA Sequence Number=SeqID_79682
MGRNVSALIGKFVPHILEKCKDPDVVIHLANRSVVYLTGLIEDVLVRSQNVTGSTYTSDLLYEVQAGEPSSSPTMVPSTVQPPPTPELKPLPATLKYAYLEDEEKFPVIISASLAAEQEEKLLLILKKHKKAIGSKSLIWRSVIGVVHKTSWMTI

SEQ ID NO: 171368 - protein, 99 aa, Glycine max
  Coding DNA Sequence Number=SeqID_79683
MDENTKKRPEEATQTGSTMGIIDPPSPIRRHVKWKMARTKKTGQMTYEAAKEIIDKIGSFVTHGCQDLLTTSIGRPEHPGCVRVAGANVTIKQYFGSAP

SEQ ID NO: 171369 - protein, 110 aa, Glycine max
  Coding DNA Sequence Number=SeqID_79684
  Subcellular localization annotation: CTP_CleavageSite=44; ConfidenceScore=5.05e-01
MFVLTGKWLRESFLQRDPGRPKRLKGPVPLLSMTAIASGALNISSVSRPSKDGHSIGRDVSSSGTMSIPTSQEEIVRRRWASLSVPGIPFSAGGGPRVRVWPEEEPGRWV

SEQ ID NO: 171370 - protein, 48 aa, Glycine max
  Coding DNA Sequence Number=SeqID_79685
MVAQWRFGDIRKGWRWRFKEECIPASDDNVESQRECAKAPEHARPTTN

SEQ ID NO: 171371 - protein, 72 aa, Glycine max
  Coding DNA Sequence Number=SeqID_79686
MAHIVDKIKTIDGSKETLKLAIRITELWFVGTPGRSEQAEMVIVDSDGNQIHVVCKQDQLKAWKMDLKVVLM

SEQ ID NO: 171372 - protein, 180 aa, Glycine max
  Coding DNA Sequence Number=SeqID_79687
MQIIRTSMTTLTRTWMTLLLSNVLPSDHNSDFPLPKCQLVYAILTWMSAHVAQVIADAIYLFARMAPTRHPLDQDKSNRALEFPTLITGLYQSYGVPVTPSKAANHRGQVQIHECLYQFSLSQQGQVSAPFVCPTPEQFRAKVAWPGDWPDAQAGEEPARSPGEADESHMDEDMTDLLNF

SEQ ID NO: 171373 - protein, 95 aa, Glycine max
  Coding DNA Sequence Number=SeqID_79688
MVMGDFISRLSFPACLHFSGENTETFSSLTSYPELRRSEFLIGGYVGARASLLSTIPPFVPMTKSCTHDTRRYLTVIRTLLSSRGGGPDDKQRPS

SEQ ID NO: 171374 - protein, 103 aa, Glycine max
  Coding DNA Sequence Number=SeqID_79689
METCLAVEDLLQRMIDQGRLEIDDEGDEEQHICMQSADEGGLGKPKPLVIYFTRDAAPQMPRYPSVVKPIPFPYQNSHPIPWRYVPPSERKEEATDISSLSAK

SEQ ID NO: 171375 - protein, 179 aa, Glycine max
  Coding DNA Sequence Number=SeqID_79690
MGTRGCINYNPVLAIRQLGYPMRGAPSEEGLIPFIITRVHKAWEMLQRKDKERRGSSNRPVDSYRRWLKAYTQDLDWLLSLRTTKGVEVETLEEDEEVQALKTEREKAQTIKEKFKSAAVRIRKENAELRGINIATVKALEQETRGPVGKNMAGTNSEGLCGVVTASLSSEERKGTNRE

SEQ ID NO: 171376 - protein, 176 aa, Glycine max
  Coding DNA Sequence Number=SeqID_79691
  Gene Ontology: Mol. function=helicase activity; Biological process =viral genome replication
  Homolog annotation: Hit_ID=Q9C8B0; Match level="QueryCoverage=99%, HitCoverage=10%, E-value=2e-44, Identity=49%"; Hit description =Putative uncharacterized protein F10O5.11
MIESQKLNYVRQHQQQLRVDKYINLTGSNDHPETLGRDRGKRIILPSSFVGGQRYMEQLYFDGMEICGHLGFPDLFLTMTCNPTWPEIQRKVTQSNLTSNNCPDIITRVFKIKLNQLMNDLKHGNIFGNIIGYIYTIEWQKRGLPHAHILIFLHPSNKLPNPHDIDQMISAEIPDK

SEQ ID NO: 171377 - protein, 25 aa, Glycine max
  Coding DNA Sequence Number=SeqID_79692
MVYELYVKGSGVVFTHGEDKWSQIS

SEQ ID NO: 171378 - protein, 83 aa, Glycine max
  Coding DNA Sequence Number=SeqID_79693
MQRLKCLYTRCSRERKLLAHSRHLLKDPNGQIMDKCLLKSQRKFREDPTVKEGWAAFLPRQLHVVFSRSFIKRLPPEASSWLL

SEQ ID NO: 171379 - protein, 77 aa, Glycine max
  Coding DNA Sequence Number=SeqID_79694
MDCHHQKRGDCGSNVFQGYFDDAKESRVKQSFKQRFKNQVSSFKIQDSRKIKIKIQESREDTFKISTKKFFKTLSST

SEQ ID NO: 171380 - protein, 49 aa, Glycine max
  Coding DNA Sequence Number=SeqID_79695
MDSGRFQVSVQGNSYPLGVILRAFRSVFKGYTTNCLPFSGISEPRLEVG

SEQ ID NO: 171381 - protein, 126 aa, Glycine max
  Coding DNA Sequence Number=SeqID_79696
  Homolog annotation: Hit_ID=A5BEC4; Match level="QueryCoverage=57%, HitCoverage=14%, E-value=5e-08, Identity=41%"; Hit description =Putative uncharacterized protein
MTRGNPYDLQPFDPDIDRTFHRLVRHHLVSFEHPKHSVIGDFEHYSFKHSDFVHSENTTQSPPRERTLREMAAPDFTYESLCIQYPDEDVPYVLKTGLIHLLPKFHGLAGEDPYKHLKEFHIVCFT

SEQ ID NO: 171382 - protein, 181 aa, Glycine max
  Coding DNA Sequence Number=SeqID_79697
MTPAEARNLIEKMASNSKQFSARNDAIVIRGVHEVATNSSTSSETKKLEDSVVYAPLPTNIQTFFLLCNNLEQLNSLKHMLQTSTIDLLKLSSKISHNRTIMTSPATGTIPGGGIIPTLDGRVLHNSSSSNNNNLIFRMLLAQADHTFLHQSSSNNNNSNRNSPKNRKQLRPLRNLPLKNL

SEQ ID NO: 171383 - protein, 169 aa, Glycine max
  Coding DNA Sequence Number=SeqID_79698
  Gene Ontology: Mol. function=ATPase activity, coupled to transmembrane movement of substances; Cellular component=integral to membrane; Biological process=transport
  Homolog annotation: Hit_ID=Q94IH6; Match level="QueryCoverage=98%, HitCoverage=66%, E-value=8e-42, Identity=45%"; Hit description=CjMDR1
MVIEEGYTGGEVVTIIMAILNGSLEVASPSFTAFAAGQAAAFKMFETIKRKAEIDAYDITSRQLDDICGDIEVRVVCFSYPTRLDELIFNGFSLSIPSGTTTTLVGESGSGKSTVVSLVDRFYDGAIVEENIAYGKDGAFVEEIKDGAELANLSKIIDKLPQVYPQISI

SEQ ID NO: 171384 - protein, 65 aa, Glycine max
  Coding DNA Sequence Number=SeqID_79699
MTVVGVCDCREVEHPPLESDINTSFCKPFSPDCSVSTPPFTGGTMIGRQLSVAVSIVCVPQTLFT

SEQ ID NO: 171385 - protein, 85 aa, Glycine max
  Coding DNA Sequence Number=SeqID_79700
EEVGNAAQKHKAKRVESVNDDVEAFGDHRESSDCSMHSKAEALEHMKKRDTGHQSVSLENITGDSTVLRIGDSAKVVIKQDMKGG

SEQ ID NO: 171386 - protein, 168 aa, Glycine max
  Coding DNA Sequence Number=SeqID_79701
MGELICAIARSPPSTTYDGGTWRYVAGVRRPWGRQGDMASGNRLPRGDGALIAMAAQLIHDRVVMECLEGVWETLEGNERCRFRGTIQFTATSLPVQVLELSSSEEDLEEDPKELPPEPAMDALDLPEDDEDPLPDVDPPEDIMSASEADSTEESGPRGITNSDDSSS

SEQ ID NO: 171387 - protein, 191 aa, Glycine max
  Coding DNA Sequence Number=SeqID_79702
MALREQTKEGVQNVRPESKSILSPLIPQTKTDEEHVPSPNDSLPMNVYHNVMAQFQSCPSRSLQVLPYDSSSRSSHQQFPRYLPFQMTRINPQGIPPAMMPQYNKGHLWPHPPTLTDFPKFVHAWERSWPSKPVFKPVPINFGAFIDMPDSSTTSRSFDKLKDALICLTHQQLSLGDSMNSMTTKIDELLH

SEQ ID NO: 171388 - protein, 277 aa, Glycine max
  Coding DNA Sequence Number=SeqID_79703
MVCSKVCFGNIGRVDADLMVSLQQYWQRKGACARLNQAFLKHHLDLELNIMLLKVEISIRAHIDWHRLRKQENLEFPMKDCRYKASQCESNTHPLVSDINDEIAGLIASGPVVVVEWGQEEVVPAVVEDLVARGKGWGSSRRKPEAEPPDDGLEISPPGVARGLLLGLGSRADDAVCQVLELRQNDAMVKRSCAGVPWYSKSWLILKIQPSGSMPSNQGTSNFILCVDVVVGGGGGQMRASLSLSKDLDVVLESGMSMKAPKLIGTGLKTGFEGQDL

SEQ ID NO: 171389 - protein, 294 aa, Glycine max
  Coding DNA Sequence Number=SeqID_79704
  Pfam annotation: Domain name=G-patch; Domain location=61-105; Score =10.6; E_value=0.01; Accession=PF01585.14; Description=G-patch domain
FAVGGLLVIVSGEEDMLVSCPSSAPYVEAAEESLEIAFQSFEVVSCASVEPSSSLPSLSKAAIMVARVMLRNGFEPIMGLGKDCLGNADVVDIKGNPYKYGLGYEPGMLGRRNVPSRFRADRVWPGRISQCFTSAGMVSEEEVAAIEEEFPQDPPSFVQPCHPDSQVGNWRVISQSEVYTTDSITCEMSFFHICNLVIAMNPSGLESTELGLSECSNSAIEDCNMFKEYWHLSFVNSKENSADDFLETWDQPQIFFINGVICFLKMNGSRIEKEERLLETPLQGEDESRRSSPP

SEQ ID NO: 171390 - protein, 90 aa, Glycine max
  Coding DNA Sequence Number=SeqID_79705
MLLGIMFRLEPLSMSTLAITCSMHLTDTSFYGHVLGYVSFIQDFYQQISVRLRAHEKLQKGDSSRGLIELFNDFDLALLDNTEELASLLE

SEQ ID NO: 171391 - protein, 352 aa, Glycine max
  Coding DNA Sequence Number=SeqID_79706
  Pfam annotation: Domain name=Transposase_23; Domain location=112-184; Score=-14.0; E_value=0.04; Accession=PF03017.5; Description=TNP1ENSPM transposase
METSRKRHGSTSTWIFFTAKIFLTNFERFLNTRRAKLICSILLPLFIGEKREVVAAQLAQASWVASTKRHRLLLEHSRRPKTLQITQRCLFFLLECCETLWIMQQCLFRGFRREKTRFKDQTQVLPDEIRFVALGKIYERGSTIHSVAYTDDVIRVSVEKVIDSDAEVSLPTSKIQYVSQVLHTFITWPTPIVTLDSVITPNKVTKVVKQLNDAVVGDPLRELIKSLYDIYEKPIQFVWDVTKFGIPTVDASLFLTHADVNELISGDKCLNIAILHLWIIGYTMQKIYMGNVKITSKDGLRNPNRSAFKTLKTTFDGKIDQTTPRWIEVKWFGDGTPQDIKTMTTLWKKWVL

SEQ ID NO: 171392 - protein, 112 aa, Glycine max
  Coding DNA Sequence Number=SeqID_79707
KRSFSIGANVVSSFVYRKKRDGSWVKKDAPAQAAEECSPSPPPQRDDSSSLMHNILDRLDGLHTFIGERFDSLDNRIDAIDARFAGMDTRITQLEEDMSYIHQCFDLPPPSS

SEQ ID NO: 171393 - protein, 198 aa, Glycine max
  Coding DNA Sequence Number=SeqID_79708
  Subcellular localization annotation: CTP_CleavageSite=23; ConfidenceScore=5.40e-01
ARPRLQRAALPPLQRAAHPRLQRAARPSHQRAARPRLQRVGFAPSPSEDCTPSPSEGFRPRLQRATCTRLQRDSRPCLRRAARPRLQRAARPRLQRATRPRRQRVVRPRLLRATCPHLQRAIGPCFQRATRPRLQRVVRPHLQRASCPRLQRASHPRLQTAIRPRLSRASRPLLSRASCPHLQRVVPPHLQRATRPRL

SEQ ID NO: 171394 - protein, 177 aa, Glycine max
  Coding DNA Sequence Number=SeqID_79709
  Pfam annotation: Domain name=G-patch; Domain location=10-49; Score =28.5; E_value=2.4e-05; Accession=PF01585.14; Description=G-patch domain
CLSDAAVMMARVMLGSGYEPGMGLGKDNGGITSLINAEGNRGKYGLGYKPTQADIKRSIAGRKSGSQGSRLKQEGKGNPPCHISRSFISAGLGDEGQVVAIYGDDVPSALNLVRPFPPDFRLGNWQVEERPDIYATSIISNTESLEGTNTWDPPTTSSKKRVKRRMNKTRMWDFPRS

SEQ ID NO: 171395 - protein, 412 aa, Glycine max
  Coding DNA Sequence Number=SeqID_79710
  Gene Ontology: Mol. function=lactaldehyde dehydrogenase activity; Cellular component=mitochondrial matrix; Biological process =metabolic process
  Homolog annotation: Hit_ID=Q6DAY4; Match level="QueryCoverage=58%, HitCoverage=50%, E-value=9e-97, Identity=72%"; Hit description =Aldehyde dehydrogenase A
  Pfam annotation: Domain name=Aldedh; Domain location=181-411; Score= -4.0; E_value=3.3e-13; Accession=PF00171.13; Description=Aldehyde dehydrogenase family
MALTQSCANHFPRRSLIRITWEKSSEPGIEMKSKRLTLVLSQAVSRVMLDDIRAIVPPEALNVFINGLDSLPLRHAGLRAERRELRAAGVSHCAIQYDENPPRANPARLTLRMHMKIGLLFPIAIIVAGVSFLVWFIASGAMMPGRQRSSASLFLHISLTKPSVEPLHMTLHHQHYINGAFVEAHNDSWIEVINPATETLLSRVPQGSKQQAAAAITAAEAAQPGWEALPAVARGDWLHRIATAIRQREPELSTTLVAEGGKTQALAQTEVLFTADYFDYMAEWARRYEGEIVNSDRPNENIFVFKKAIGVTTGILPWNFPFFLIARKAAPALITGNTIVLKPSEITPNNAALFAAIIDDLGLPPGVINIVYGYGPEVGQELAANPKVGLVSLTGSVNAGIATMAAAAPNVT

SEQ ID NO: 171396 - protein, 70 aa, Glycine max
  Coding DNA Sequence Number=SeqID_79711
MQSLSVEQFIEKVSWPGTLPSVVRDGEGPSTQVPQQAGKAQVRQEAATPERSPQISQDPPSLVVDQSSLQ

SEQ ID NO: 171397 - protein, 265 aa, Glycine max
  Coding DNA Sequence Number=SeqID_79712
  Gene Ontology: Mol. function=unspecific monooxygenase activity
  Homolog annotation: Hit_ID=Q5CEG7; Match level="QueryCoverage=38%, HitCoverage=97%, E-value=4e-43, Identity=84%"; Hit description =Senescence-associated protein
AESQRIGAARPLCHLQYPVAYLSRLQRILPAARWELRFKASRRANPPHEGHQRHVPLGGRGPLLLVGKRTAGARVASSPDSDLEAFSHNPTHGRADIEGSKSNVAMNAWLPQASYPCGNFSDTSSFKFRRTKGSIGHAFTVRIRTGNQNQTSFYPFVPHEISVLVELILGHLRYLLTDVPPQPNSPPDNVFRPDRPAEADLGSKKRGSAPLPIHGITPTYPTPLKSFHKVGLESSSTGSSFPADSAKPVPLAVVSLDSRQGQWES

SEQ ID NO: 171398 - protein, 30 aa, Glycine max
  Coding DNA Sequence Number=SeqID_79713
MARKPRQDLSVSKRSDFSLLVAEYESHQEK

SEQ ID NO: 171399 - protein, 85 aa, Glycine max
  Coding DNA Sequence Number=SeqID_79714
MNSRNQSRYLGTDASGDGVTTDRSLPLLCAKQAENVAQGSPALIGKTLTHKEGGDMVNVPLKKKVQVSSPGRAELAWATNPCTKI

SEQ ID NO: 171400 - protein, 356 aa, Glycine max
  Coding DNA Sequence Number=SeqID_79715
  Gene Ontology: Mol. function=sugar:hydrogen symporter activity; Cellular component=integral to membrane; Biological process =carbohydrate transport
  Homolog annotation: Hit_ID=A8GKW7; Match level="QueryCoverage=98%, HitCoverage=73%, E-value=1e-174, Identity=85%"; Hit description =Sugar transporter
  Pfam annotation: Domain name=Sugar_tr; Domain location=1-334; Score =99.2; E_value=1.3e-26; Accession=PF00083.15; Description=Sugar (and other) transporter
MYMSEVSPKDMRGRALSMQQFAIVFGQIVIFYVNFKIASLASEAWLVEMGWRWMFASGVIPCILFCILVFVIPESPRWNVMMGRDDQALAMLTKVSNAAHAQNLLKEIKDSLQQDQQQRHRKLNYGDVRVRFILFVGCMIAMLQQVTGVNVMMYYAPVVLKTVTENAQEALFQTIWIGVLQLVGSVIGAMLMDRMGRIPLMRYGTLGAIAGLLLTSYALYTQATGYFALFGMLFFMVFYALSWGVGAWVLVSEIFPNRMRAQGMSIAVGCMWVANFAVSQSFPMINDHPYLFSHFHGAFPMWIFAACCLFSYWFIGRYIPETKGVSLEKMEQVVLAKRHRHPLPDGKPLPLENGKS

SEQ ID NO: 171401 - protein, 139 aa, Glycine max
  Coding DNA Sequence Number=SeqID_79716
  Homolog annotation: Hit_ID=Q84VH5; Match level="QueryCoverage=68%, HitCoverage=13%, E-value=6e-35, Identity=80%"; Hit description =Envelope-like protein
MLSQHPNILNYTDSVMKRESPLSLHYKLFEGTHVPDIVSTSGKAAASGAVSKDALIAELKDTCKMLEATIKATTEKKMELERLINRLSESGINDGEAAEQEDEAAEEEVEAAEEEEEAAEEEEDAAEDTESDDDSEATP

SEQ ID NO: 171402 - protein, 74 aa, Glycine max
  Coding DNA Sequence Number=SeqID_79717
MSQRALCGRAKARLTGALSKGGKMRGVATNVYLWKTSEKPKETGRNENSKFGSCRQKRGFCSYVPSVEEEIRPT

SEQ ID NO: 171403 - protein, 245 aa, Glycine max
  Coding DNA Sequence Number=SeqID_79718
  Homolog annotation: Hit_ID=A5ZQM3; Match level="QueryCoverage=22%, HitCoverage=51%, E-value=2e-20, Identity=82%"; Hit description =Putative uncharacterized protein
MVIGSRTQGAPAFSGRYSAEVIHAILPGKARTTFNKWVPVPETDTGVPPHKGGRSDQARATVYQKHRSPQSREPTTEAPVNGGRNYNGPKVAKFLVGLGEIDMSVKMRTTCTWTERPYEASLFPGIGFGLFLRSLGGGQRRPPSGGARAISLPKGNGGVQRFPRARRRLALECKGRRELDCKTHPSSRDETHIDGKVWHLDVGSSPPGAVVCSKGWAVRPLKRYVSWVQNVVRQFGPYPVWALEH

SEQ ID NO: 171404 - protein, 73 aa, Glycine max
  Coding DNA Sequence Number=SeqID_79719
  Subcellular localization annotation: CTP_CleavageSite=68; ConfidenceScore=5.15e-01
MDTSEPYTGAMRGTMHKPQSIFFFSKNNTKNNKNKIETPSQPPLNRGKSNANYTCMKFDNNERKKEIKSAKGE

SEQ ID NO: 171405 - protein, 130 aa, Glycine max
  Coding DNA Sequence Number=SeqID_79720
MLVRMIRTRLFVVARVKSCPGMHSCCMIASISGCVRTVGALQYRGEAQELIKENYWPLNRECKSCPPKSRKCHPLKTTASRPQKATACRPLKARTCSPLMARACSPLKVRTYSPLKVRMYSPLKRGRATL

SEQ ID NO: 171406 - protein, 113 aa, Glycine max
  Coding DNA Sequence Number=SeqID_79721
MFDQQAVVSPAKPPQWPDPKVDDPLYSITLTILELFLKPFQVNWDATVFGVFNLDFPLYINAHDGQFSISVIHLWILHLTETSMRAGIPMCMNSSSHSLFRDLSNRSLNWKAT

SEQ ID NO: 171407 - protein, 100 aa, Glycine max
  Coding DNA Sequence Number=SeqID_79722
MLPDAEVLFYGVVPLHYCINQHLTQTCSKIEVATPFDSNDPVHDECQSISITANHDPLIGLPLTPTKRQSFNECDDEARSSQISPTQLSSNKLAKHGKIE

SEQ ID NO: 171408 - protein, 148 aa, Glycine max
  Coding DNA Sequence Number=SeqID_79723
  Homolog annotation: Hit_ID=Q6UUU1; Match level="QueryCoverage=58%, HitCoverage=55%, E-value=7e-19, Identity=61%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPGVSPWRLPRALSVPAFRFTGVIPLLWPRLSHSTPDTQFR

SEQ ID NO: 171409 - protein, 134 aa, Glycine max
  Coding DNA Sequence Number=SeqID_79724
MSLATLFGKLQQHEMELMRLHHHEENDIKRKGITLRTSSSFIQEESDKEDLTETEEDDDDFRLFVKRFNKFLRNKRNKRKSNINTKKKEEDSSLAPSCYESNQPWHMRSDYLVFERRIEKSDKRNLKEKKEKKA

SEQ ID NO: 171410 - protein, 152 aa, Glycine max
  Coding DNA Sequence Number=SeqID_79725
MIYRSWLGGLGRAIGRLIGRDRHDEHDAADVPERRRPTGQWVHQMTTAEDVADMAEDVPDVIEEAPEMRADDWRDRCAAIRNSEKRAWQIEDGVAIVVDEIADVEAVSLLPLARYIVSFLLHIAILLPPNGPMNKFRCGKFTVNEATSYQTQ

SEQ ID NO: 171411 - protein, 595 aa, Glycine max
  Coding DNA Sequence Number=SeqID_79726
  Gene Ontology: Mol. function=glycerone kinase activity; Cellular component=cytoplasm; Biological process=glycerol metabolic process
  Homolog annotation: Hit_ID=O04059; Match level="QueryCoverage=100%, HitCoverage=99%, E-value=0.0, Identity=67%"; Hit description =Putative 3,4-dihydroxy-2-butanone kinase
  Pfam annotation: Domain name=Dak1; Domain location=22-340; Score =553.3; E_value=2.6e-163; Accession=PF02733.8; Description=Dak1 domain
  Pfam annotation: Domain name=Dak2; Domain location=402-587; Score =153.1; E_value=7.6e-43; Accession=PF02734.8; Description=DAK2 domain
  Pfam module annotation: Pfam domain module=Dak1::Dak2; Domain location=22-340::402-587
MAFPNKKLIDDPNDVVTEFIEGLVETYSGLQYLDGFPLVKVVLRADVSAATYDKVAIVSGGGSGHEPAHAGFVGEGMLTAAICGDIFSSPPVDSILAGIRAVTGPKGCLLIVKNYTGDRLNFGLAAEIAKSEGYKVETVIVGDDCALPPPRGIAGRRGLAGTILVHKVAGAAAAGGLSLADVAAEAKHASEIVGTMGVALTVCSIPGQVASDRLGPGKMELGLGIHGEPGAAVADIQPVNVVVSHVLQQILSTVCCMPQYCMKALDGLGATPTMELMIIAGKTVPKLQLEHGLAVDRVYTGSFMTSLDMAGFSISIMKADPVILQRLDAPTKAPYWPVAADGNHPPAKIPVPIPASRSAKTDEPRSQPLQLNEQGQILEVAIEAAANAIINLKDNLNEWDGKVGDGDCGSTMYRGAKAILEDIKNYPLNDAAETVGEIGSSIGRSMGGTSGIMYDAIPMPPLNTFGAKSKFPFWCHFKTIPFVDSGAEALAVSIAAVSKYGGASAGYRTLLDALIPASLVLEEKLNSGVDPCIAFVLSSEAALAGAQSTVDMQAQAGRSTYFSGEILSTVPDPGAMAAATWYRAAALAVKAKYQS

SEQ ID NO: 171412 - protein, 152 aa, Glycine max
  Coding DNA Sequence Number=SeqID_79727
  Gene Ontology: Mol. function=binding
  Homolog annotation: Hit_ID=Q3E9D4; Match level="QueryCoverage=28%, HitCoverage=12%, E-value=4e-13, Identity=86%"; Hit description =Uncharacterized protein At5g18940.2
MHFFHEIHGLTYPLILATPINQYTITPNIKCHAPLNQLVKQHNRQVKMLPLAQTIQQETLIKGVWLPIELTTDPCRYSFVLFFKFVELLNFDVASDAFSTFKDLLTKHVSVVSEFLTAYYDETRYIREQEWVCAPVPLAVANRKVEITGPVD

SEQ ID NO: 171413 - protein, 77 aa, Glycine max
  Coding DNA Sequence Number=SeqID_79728
MSIEAYTMRTLLVENFVDILEMRIKRRLLIDIVLVMDDVGTYIQEHAWEVLWVLHMIDVGDDQDNIVIQIYKVRNNN

SEQ ID NO: 171414 - protein, 817 aa, Glycine max
  Coding DNA Sequence Number=SeqID_79729
  Gene Ontology: Mol. function=hydrolase activity, acting on glycosyl bonds; Cellular component=beta-galactosidase complex; Biological process=carbohydrate metabolic process
  Homolog annotation: Hit_ID=A7PDT0; Match level="QueryCoverage=97%, HitCoverage=97%, E-value=0.0, Identity=57%"; Hit description=Beta -galactosidase
  Pfam annotation: Domain name=Gal_Lectin; Domain location=728-806; Score=72.7; E_value=1.2e-18; Accession=PF02140.9; Description =Galactose binding lectin domain
  Pfam annotation: Domain name=Glyco_hydro_35; Domain location=34-311; Score=423.6; E_value=2.9e-124; Accession=PF01301.10; Description =Glycosyl hydrolases family 35
  Pfam module annotation: Pfam domain module=Gal_Lectin::Glyco_hydro _35; Domain location=728-806::34-311
MTGRKCSLSAMFLLCLSLISIAINALEVSYDERALTIDGKRRILFSGSIHYPRSTPEMWPYLIRKAKEGGLDVIETYVFWNAHEPQRRQVSHWDKNFRGLPVWLHNIPNMEFRTHNRAFMEEMKTFTRKIVDMMQDETLFAVQGGPIIIAQIENEYGNVMHAYGNNGTQYLKWCAQLADSFETGVPWVMSQQSNAPQFMIDSCDGYYCDQFQPNDNHKPKIWTENWTGGYKNWGTQNPHRPAEDVAYAVARFFQFGGTFQNYYMYHGGTNFKRTAGGPYVTTSYDYDAPLDEYGNLNQPKWGHLRQLHNLLKSKENILTQGSSQHTDYGNMVTATVYTYDGKSTCFIGNAHQSKDATINFRNNEYTIPAWSVSILPNCSSEAYNTAKVNTQTTIMVKKDNEDLEYALRWQWRQEPFVQMKDGQITGIIDLTAPKLLDQKVVTNDFSDYLWYITSIDIKGDDDPSWTKEFRLRVHTSGHVLHVFVNGKHVGTQHAKNGQFKFVHESKIKLTTGKNEISLLSTTVGLPNYGPFFDNIEVGVLGPVQLVAAVGDYDYDDDEIVKDLSKNQWSYKVGLHGEHEMHYSYENSLKTWYTDAVPTDRILVWYKTTFKSPIGDDPVVVDLSGLGKGHAWVNGNSIGRYWSSYLADENGCSPKCDYRGPYTSNKCLSMCAQPSQRWYHVPRSFLRDDDQNTLVLFEELGGQPYYVNFLTVTVGKVCANAYEGNTLELACNKNQVISEIKFASFGLPKGECGSFQKGNCESSEALSAIKAQCIGKDKCSIQVSERALGPTRCRVAEDRRLAVEAVCDIRVSGEGRKH

SEQ ID NO: 171415 - protein, 118 aa, Glycine max
  Coding DNA Sequence Number=SeqID_79730
MMKNQETTTPNERGPMLQNNRAPKRAMFCKESENEKTKEIRNSRFADTSGGFRGDSGERKLADGDRSAIVGGQANDLDLVATYADGEEVEVIVGGNRVDAILRFGANGEGAVARGERK

SEQ ID NO: 171416 - protein, 209 aa, Glycine max
  Coding DNA Sequence Number=SeqID_79731
  Gene Ontology: Mol. function=phosphoprotein phosphatase activity; Cellular component=ribonucleoprotein complex; Biological process =mRNA processing
  Homolog annotation: Hit_ID=A7PG19; Match level="QueryCoverage=100%, HitCoverage=100%, E-value=2e-84, Identity=74%"; Hit description =Chromosome chr6 scaffold_15, whole genome shotgun sequence
  Pfam annotation: Domain name=Ssu72; Domain location=1-209; Score =407.5; E_value=1.9e-119; Accession=PF04722.4; Description=Ssu72-like protein
MKFRYAMVCSSNQNRSMEAHFLLKRQGFDVSSYGTGAHVKLPGPSLREPNVYDFGTPYKHMIEDLRRKDPDLYPLLSFSLWNLDLECSYKRNGIFPMLKRNSTVKLAPQRWQENAADGSFDVVVTFEEKVFDMVIEDLHNRDHALLKTVLVINLEVKDNHDEAAVGARLTLDLCREIEAAESWEESIDEIIAGFENKHRRKLLYSISFY

SEQ ID NO: 171417 - protein, 69 aa, Glycine max
  Coding DNA Sequence Number=SeqID_79732
MQGYLMVTRTFRQPGANEPVDSQRLTLSPAPFVVLTREVRDSKSGGRQRYLKVIRAFRQPRGTNSAVSG

SEQ ID NO: 171418 - protein, 45 aa, Glycine max
  Coding DNA Sequence Number=SeqID_79733
MATRKLSAKRSRKDAVAEGTSAAPEFDNHRFRSAEHQQCFEAIKG

SEQ ID NO: 171419 - protein, 66 aa, Glycine max
  Coding DNA Sequence Number=SeqID_79734
MGAVLGEKTCFREENLSRGAAVTLPRHFCEQICEDFPSFFILSSFVLRSSTGKCSNPRLPIHFFRF

SEQ ID NO: 171420 - protein, 89 aa, Glycine max
  Coding DNA Sequence Number=SeqID_79735
  Subcellular localization annotation: CTP_CleavageSite=20; ConfidenceScore=5.33e-01
MPLNSPMISPAPSAAGMVSPANAGSSDTTIATTAVVPSIEPTDRSMPPHNVDGGLTRDIQQVSFGKKVRGDKAKYRHDQDQNRPDAHGL

SEQ ID NO: 171421 - protein, 145 aa, Glycine max
  Coding DNA Sequence Number=SeqID_79736
  Pfam annotation: Domain name=Retrotrans_gag; Domain location=8-83; Score=-2.4; E_value=0.093; Accession=PF03732.8; Description =Retrotransposon gag protein
MADEHQQRVTLEDYSSSSVPLKTWEEVVDKFLKKYFPESETTEGKAAISSFHQFPDESLSEALERWAESTNQATVRCFSRGKIKLKTPEEATELIENMSASNHAILRDRVHQLAKKSLLELSSHDALLAQNKLLSKQLEILTETL

SEQ ID NO: 171422 - protein, 65 aa, Glycine max
  Coding DNA Sequence Number=SeqID_79737
IERTLSLVREDREGRTSGVPVIVPTVNAGASGSTAETAMGSLPQRGWSERSFENSREGHGETSRF

SEQ ID NO: 171423 - protein, 49 aa, Glycine max
  Coding DNA Sequence Number=SeqID_79738
MMAHQGHTLTSACSRPFHSSSRDARGPDYTSPDEEDVQTQDTQDQSQEF

SEQ ID NO: 171424 - protein, 137 aa, Glycine max
  Coding DNA Sequence Number=SeqID_79739
  Homolog annotation: Hit_ID=A2Q1D6; Match level="QueryCoverage=70%, HitCoverage=15%, E-value=6e-11, Identity=41%"; Hit description =Ovarian tumour, otubain, related
MDEDQCIYDNIMFEEVDMDYENKQECGVNEPHVDCSDAFNTSQVFGTRDDVLQWARSIAHENRFVVVTIRSDTHIGSRERSLFVLIGRERSGQYRCRKKEFVRRDTGSRKCNCPFKLRGKLVIGGQGWIIKLICGYS

SEQ ID NO: 171425 - protein, 133 aa, Glycine max
  Coding DNA Sequence Number=SeqID_79740
MTLLLATFCPATTMPISPCGSISWSMSSRHKDCTHKDTQWIRRSPTGALGFPALITGLCHFNGVPVTPSNVIRPPTNRAFIKKYCAPRQAEGKTPQQPGDGQQQATNAPSPPPEPLSSSTKRLEYCLRHMADK

SEQ ID NO: 171426 - protein, 74 aa, Glycine max
  Coding DNA Sequence Number=SeqID_79741
MASGASGTSVKFLKTLGSNPARLGEQGGNLLPPFPIYRRREAVPNIPNLLGYAFQLFLVKKIVSVKKIKAEVLP

SEQ ID NO: 171427 - protein, 45 aa, Glycine max
  Coding DNA Sequence Number=SeqID_79742
MNEIKKAKEHHPDEDSLMPHNMAPCRACRPWIFFINGNGMEKKER

SEQ ID NO: 171428 - protein, 58 aa, Glycine max
  Coding DNA Sequence Number=SeqID_79743
MTRTQHVHVVGEPWGIPLSTDLQVQAIGQATCAPEFGLPRPFNQRLLVLHVGGVAVKQ

SEQ ID NO: 171429 - protein, 29 aa, Glycine max
  Coding DNA Sequence Number=SeqID_79744
MTLRVMAARPSELELAQASYCFNLNLLKA

SEQ ID NO: 171430 - protein, 175 aa, Glycine max
  Coding DNA Sequence Number=SeqID_79745
MFDKQATVSPTKPPYWSDPEADDPLYLMTLTIPQLFLKPLQVMWDATMFRVFNSDFPLYIKHKDLFKIAHGGQCLSIFVIQLWILHLTETSMRVGNFDVYGFLEPQSIQRSRQSQFESESYIKSWMQSSKRDVYLGAYLNGGNWQMVAILPKENLVVWFCSLHNRPDNYLKGVIN

SEQ ID NO: 171431 - protein, 192 aa, Glycine max
  Coding DNA Sequence Number=SeqID_79746
TLVVVEQGESLPSYSRFTRLRPDPQELVSLGGDLYLMPKGPKNPGLEDLRPHLLQLPLLPLLLLPLLLLSLHHQHLQFFQSLHQGQLLIMQSSQDVVQQRPVMSLEEFVQKVAWPGVQPSPLGGGEASVAQEPQPDQKDDILKASKPIPQEDVAAATLQVTPQPPPESTTSALDLSSPQLEPSTPVPNLPLS

SEQ ID NO: 171432 - protein, 146 aa, Glycine max
  Coding DNA Sequence Number=SeqID_79747
MARTKKTGQMMSKAAKEIVKKTDVLTASIGRPEHPGRVRVVRAGVTIKQYFGSELALPLEPEVGPLVSRVCTKESCVDPSGNDLETDDSDKYGLYIEENPSCLVALGRVYEGSITVHNIPLLHGQVKVGVEVVKDVEASVPVPTNE

SEQ ID NO: 171433 - protein, 186 aa, Glycine max
  Coding DNA Sequence Number=SeqID_79748
  Homolog annotation: Hit_ID=A5BEV8; Match level="QueryCoverage=73%, HitCoverage=12%, E-value=3e-08, Identity=30%"; Hit description =Putative uncharacterized protein
NSSVKRSASCSEPPQPTRIIPMLDQFAPFIQGFILDTVDVKVDSNCGYRSIATLLGMGEDSWPLVHNELIKEFGRWSHEYINLFGGTERFEQLKLSLLRWPLVHNELIKEFGRWSHEYVNLFGGTERFEQLKLSLLVDGFSKVSVDKWMDITKMGYVIASRLFERHCPLPPLALLWSSNFYSQAKQ

SEQ ID NO: 171434 - protein, 124 aa, Glycine max
  Coding DNA Sequence Number=SeqID_79749
MMESFSQMQSQFQSQRQSQGIALPPEPEVGPSGPRVSTKESCVAPSGNNPGMGDSDKCGLYIEENPSRLVALGRLYEGSTTVHNIPLLHGQVKVGVEEVKDTEAMSQNKAQPYSGCLIKTSRCI

SEQ ID NO: 171435 - protein, 202 aa, Glycine max
  Coding DNA Sequence Number=SeqID_79750
MTLLLSNILPTDHNSDLPMPKCQLVYAILTRMSIHVAQLIADAIYIFAGMAPARHPLDPDKSNRALGFPALITGLCQSFGVPVAPTKAAGVPPPPHRAGQAGAFDMEQYLRHLVRQQAANHRAHVRTHDCLYQMSLSMQSQGFAPFSCPTPDQFRAEVAWPGDWPEAQAGEAPPEAPGDGEEAHEDEEMADLLDFLGGSGDT

SEQ ID NO: 171436 - protein, 91 aa, Glycine max
  Coding DNA Sequence Number=SeqID_79751
MVVILPKEHLVVWFCSLHNRPDNYLKGIINRQKGSTECGYYVMHWMSTIILGTFRNNWEAYFNDPRPLEPERLKALRIQWAQFYLRVRDQA

SEQ ID NO: 171437 - protein, 178 aa, Glycine max
  Coding DNA Sequence Number=SeqID_79752
  Gene Ontology: Cellular component=cell projection; Biological process= cell adhesion
  Homolog annotation: Hit_ID=A8GJF1; Match level="QueryCoverage=83%, HitCoverage=82%, E-value=1e-24, Identity=42%"; Hit description =Fimbrial protein precursor
  Pfam annotation: Domain name=Fimbrial; Domain location=29-178; Score =51.1; E_value=3.9e-12; Accession=PF00419.11; Description=Fimbrial protein
MSRFMPAAIVSASVLFINDCRAEQLIDRGRVALRGAIHQGACAIKVDDAEQTIAMGVLPLARLQRDGKGPGFPFSIQLVNCPVEYSASGGVARTFSITFDHDGPPGQQRFAVYGDAKGVELMITDTQGNTIAPGEAQPIDQHLTQQHDLRYRLTLVSNQQQLHSGSYAAAIRFHINYN

SEQ ID NO: 171438 - protein, 119 aa, Glycine max
  Coding DNA Sequence Number=SeqID_79753
  Homolog annotation: Hit_ID=A5C2S4; Match level="QueryCoverage=62%, HitCoverage=16%, E-value=2e-11, Identity=38%"; Hit description =Putative uncharacterized protein
MDLNGKVITNDDNKEIGDVVNTLIFTIAQHFIDFRWYRDTFLTRVYTREDSQQPSWKEKFLVSLPRSFGDKKVALKICQDVQNPKTISQREGPDKERFRISAATIWTTRLSKAKEETKP

SEQ ID NO: 171439 - protein, 104 aa, Glycine max
  Coding DNA Sequence Number=SeqID_79754
MVKARQKGNDEERRRTFTKSLTETSRKRYGSASAWIFFTETIFLTNFKRILNTRRAERNYSALFPLFIGEKREVVAAQLAQASWVASIRRHRLLLEPPRRPKWA

SEQ ID NO: 171440 - protein, 137 aa, Glycine max
  Coding DNA Sequence Number=SeqID_79755
MTETVCTDNRLGISVRHLTSLVRMTESAEDDVNLCVLTGISACHQTSRVTIAKGGAVDKSGAFAPTYPQFVMRNSNLHSSCKNGVDNRKVSLHATGLSGRWTAKGGVVDKSGAFAPTHPQFVMRNSDLHSSCSRETK

SEQ ID NO: 171441 - protein, 109 aa, Glycine max
  Coding DNA Sequence Number=SeqID_79756
MARKKVLPQSMLQLWKNLLPCDLTEEPYSSVASCRRSSSVRWHGRRFFHNYNGGRTFFRGNVKEYFGNSKKLLGAPAILLGAPSNSLSTATYLWAFAPKTLLIMAGRVQ

SEQ ID NO: 171442 - protein, 82 aa, Glycine max
  Coding DNA Sequence Number=SeqID_79757
  Subcellular localization annotation: CTP_CleavageSite=42; ConfidenceScore=5.02e-01
MEKAWVSISLPSPFPPPLSGCGSKWMQESQKIRLQQGVMVVRCHGGKVSQWRVITMAAERDRVTKYSLDGEEESARKIGLVF

SEQ ID NO: 171443 - protein, 177 aa, Glycine max
  Coding DNA Sequence Number=SeqID_79758
MTHFDGLYLFSSYVLVGKHKPKRVESVNADAEAFGDHWESSDCSMHSEAETLKHMKKRDTGHQSVSLENKTGDSTMLKIGDSAKVVIKQDMKGGEHKYGFHNNKREKPEKVRVVNDETGDKHELYEVLRIPSRTKNRCLKFFTEGRRGIINIVFYIYQTPNPMHVKYNQYFDYPSPL

SEQ ID NO: 171444 - protein, 77 aa, Glycine max
  Coding DNA Sequence Number=SeqID_79759
  Gene Ontology: Mol. function=carboxylesterase activity; Biological process=metabolic process
  Homolog annotation: Hit_ID=Q0ZPW4; Match level="QueryCoverage=68%, HitCoverage=18%, E-value=6e-11, Identity=55%"; Hit description=CXE carboxylesterase
MPLWVYVYSDPGAHLSVKFPSKSENDLLKDTGWYYKELLEKYGWNDVVEVIEAMGEGDVFHLLNPDCDNVVSFINHS

SEQ ID NO: 171445 - protein, 118 aa, Glycine max
  Coding DNA Sequence Number=SeqID_79760
EEEAHIGVDSSSATSNKSENYKEEARNAAQKHKAKRVESVNADAEAFGDHWKNKTGDSTVLKIGDSAKVVIKQDMKGGEYKYGFNNNKREKAEKVRVVDDETGEHELYEVLRMPSRCV

SEQ ID NO: 171446 - protein, 187 aa, Glycine max
  Coding DNA Sequence Number=SeqID_79761
MMMGGDLQALDGPISKIMLSSVCECIISRTVLFEYNELLMSIFVCNPNLHFNDVYKIMASPPTSPPPSPPPPPPPPISDASASPSAVKWTRKASRLRSLSARPAGAKRPVVHIDPATGKANSPHRKKLRTYLGIVARDKVDITYENWKEIPTAQKDLIWEDIQAEFEIPEASDSRTKRKLLQTVGER

SEQ ID NO: 171447 - protein, 427 aa, Glycine max
  Coding DNA Sequence Number=SeqID_79762
  Gene Ontology: Mol. function=4 iron, 4 sulfur cluster binding; Cellular component=cytoplasm; Biological process=metabolic process
  Homolog annotation: Hit_ID=Q42669; Match level="QueryCoverage=29%, HitCoverage=16%, E-value=1e-57, Identity=91%"; Hit description =Aconitate hydratase
  Pfam annotation: Domain name=Aconitase; Domain location=197-427; Score=-204.6; E_value=0.00039; Accession=PF00330.11; Description =Aconitase family (aconitate hydratase
TFDPNGRDDILSIAIGRPEHGGHVRAVGFGVTISQYYGRASRGSSSSSTSVSQQQLVDIIGTFKEKWRNKIIGNLKEKMRNEIEEEKKWGLQYTSLGEPDIQVLGARVSTKGSNIENAINPAGEEDGTHVIPSMGFVAYADDVVWVSVEKIYDGDAQVPFLMSEIQYVRQILYTFIAWPTHLVKLVLHEDIVVWFCSLRKKPDIHIIDAINNSAIKTLKTILDGKIDQVASQWIEVKRHVQSEGYECGYYVMHWMWNIVTGGLKNDWTMAKSLFCCEATHFAGHCQGQDLDSADHSPIHINQLKVNLEYLGRVVFNINGVLYPDSVVGTDSHITMIDGLGVARWGVGGIEAEAAMLGQPMSMVLPGVVGFKLLCKLRDGVTATNLVLTVTQMLRKHGVVGKFVEFYGEGMSELSLADRATIANMSPE

SEQ ID NO: 171448 - protein, 195 aa, Glycine max
  Coding DNA Sequence Number=SeqID_79763
MYEYKVLMMPKEKSNKVASTNIRRLNIASRLIQGYFNKHSKVLGLAKRTPAVMLVFSLFNVKTLTPDAVSTLLANPSLGVVGEAGAPRFGGKAGNAAVVDEDEVVGVGEGDGVDLNEFNGGNERRISDEAVEAEIEGGGGVGERGEEVAISAFVGNGISPRSALVEDDGGGECDVEGGRTELGIHKRANQLHFIP

SEQ ID NO: 171449 - protein, 1070 aa, Glycine max
  Coding DNA Sequence Number=SeqID_79764
  Homolog annotation: Hit_ID=O22792; Match level="QueryCoverage=90%, HitCoverage=97%, E-value=0.0, Identity=60%"; Hit description =Putative uncharacterized protein At2g33420
  Pfam annotation: Domain name=DUF810; Domain location=62-1017; Score =1604.0; E_value=0; Accession=PF05664.2; Description=Protein of unknown function (DUF810)
MGQQTRRESYSGPLPSSAHRKDYNYNYYHYRCHHYHSEPRLFEFTSKDETSDLILPFDKLERLSQDDVRECAYEIFFTACRSSPGFGGRQAHSFSSWNNDMKSSNVVMSPTSKVKQALGLKMLKRSPSRRMVSGGSGGPSSPVGGSSPFHQSGSPLRPRRPMTSAEIMRQQMRVTEHSDNLLRKTIMRTLVGQAGRRAETIILPLELLRHVKPSEFSDSNEYHMWQKRQLRVLEVGLLTHPSIPLDKATTFAMRLRDIIRSGESKIIDTSKNSDTLRTLSNSVVSLAWRSSNSTPTDVCHWADGFPLNIHLYSSLLQAIFDNRDDTLVLDEVDELLELMKKTWSILGITRPIHNVCFTWVLFQQYVATGQIEPDLLCATQAMLSEVAIDAKRERESFYVKLLTSVLSSIQRWAEKRLIDYHEHFQRGNIGQIENVLPVVLSVTMILGEDLVISDGGEGVEKRDITIVDSSGYRIDYYIRSTIKNAFEKVIEAANAKAGELEIKGEFSEFLLQLAQETEELAMKERENFTPMLKKWHPAPGAVAALMLHSCYGHVLRQYLGDVTSLTHETVEVLHRAEKVEKVLLQMVVEEDCGEGEDNDKTVMREMVPYEVDSIILNLMRKWINEALSNGKECLQRAKETETWNPKSKSEQYAPSAAELVQLAKTTVEEFFQIPVGKTEDIVQELADGLESLFQDYMMFVAACGTKQSYIPSLPPLTRCNRDSKLIKLWKKASPCGANISELEHIHEGHNPRPSTSRGTQRLYVRLNTLHYLLSNINTLEKSLSHTPGVVPSSSRKHSGPYLEIVNSSIPAACQHVSEVAAYRLIFLDSNSVFYGSLYVGDVANSRIRPALRILKQNITLMTTLVADRAQALAMKEVMKASFDAFLMVLLAGGSSRVFNRSDHVMIQEDFESLNRVFCTCGEGLIAENLVEREAAVVEGVIALMGQYTEQLVEDFSIATCETSGIGVMGNGLKLPMPPTTGRWNRSDPNTILRVLCSRNDRAANHFLKRTFQLAKRRDILLAMMHIVALQFLPCDTEGEQGSIFESTQSGCQMEKYGTKKAMLMSLSIET

SEQ ID NO: 171450 - protein, 30 aa, Glycine max
  Coding DNA Sequence Number=SeqID_79765
MNFPVSNIDVKRLTPNLVPSLSPTRLMVYI

SEQ ID NO: 171451 - protein, 48 aa, Glycine max
  Coding DNA Sequence Number=SeqID_79766
MGAKYLEVVKRGSHPNNGWSADEIRKMLSAIAALSPKCLWDFTTSIWA

SEQ ID NO: 171452 - protein, 65 aa, Glycine max
  Coding DNA Sequence Number=SeqID_79767
MIRAPSDVAPCGACKPWIFFINGVLCFLKIMAVEWRRKKDDWRRHFKEKMSQEEAHHHRKSWIRA

SEQ ID NO: 171453 - protein, 98 aa, Glycine max
  Coding DNA Sequence Number=SeqID_79768
  Homolog annotation: Hit_ID=O22789; Match level="QueryCoverage=87%, HitCoverage=82%, E-value=6e-14, Identity=46%"; Hit description =Putative uncharacterized protein At2g33390
MDSKDINGCLMDKHKPVVTSSLVCEKVEDHVNGEDDSDSNSLLPPRRGGMSRNCEKTRRKVQWNDRNGNKLAEVLEYEPRKRKEEVDMFLLFLIWVMS

SEQ ID NO: 171454 - protein, 70 aa, Glycine max
  Coding DNA Sequence Number=SeqID_79769
MPHQKRKTLYEASLSSSEPKIQHDHRSTSTPYGSHRPEYRAQYLKVCAKCVGVVCEQSNLRITQPHLQNN

SEQ ID NO: 171455 - protein, 133 aa, Glycine max
  Coding DNA Sequence Number=SeqID_79770
  Gene Ontology: Mol. function=aspartic-type endopeptidase activity; Biological process=RNA-dependent DNA replication
  Homolog annotation: Hit_ID=Q69F85; Match level="QueryCoverage=93%, HitCoverage=8%, E-value=7e-17, Identity=31%"; Hit description=Gag -pol polyprotein
MEAYIPLGWKPLNLERYDETKNPNEHLDAFLTQANLYTNDNAILCRVLHMFLKGVALTWYNGLPARSIDNFDTLFERFSVQYTTNRSHHMIAVALATLHSMFLALHPDKFADSLCKKPPGSMDELCKQAKGNI

SEQ ID NO: 171456 - protein, 151 aa, Glycine max
  Coding DNA Sequence Number=SeqID_79771
MVEKFLKKYFLESKTAKGKVEISSFHQFPDESLSKALDHFRGLLWKTPTHGFTSNHAILRDRAYTLAKKILLELTSQDALQAQNKLLAKQIETLMKTQNKLPQQLHVMQPTSSSVMQVRGCNICGGTHELVMCMAQDDASKEVNYIANLNR

SEQ ID NO: 171457 - protein, 858 aa, Glycine max
  Coding DNA Sequence Number=SeqID_79772
  Gene Ontology: Mol. function=protein transporter activity; Cellular component=nuclear pore; Biological process=intracellular protein transport
  Homolog annotation: Hit_ID=Q2PEZ3; Match level="QueryCoverage=61%, HitCoverage=98%, E-value=0.0, Identity=93%"; Hit description =Putative importin alpha
  Pfam annotation: Domain name=Arm; Domain location=106-147; Score =44.3; E_value=4.4e-10; Accession=PF00514.14; Description =Armadillobeta-catenin-like repeat
  Pfam annotation: Domain name=Arm; Domain location=149-189; Score =57.2; E_value=5.6e-14; Accession=PF00514.14; Description =Armadillobeta-catenin-like repeat
  Pfam annotation: Domain name=Arm; Domain location=191-232; Score =38.5; E_value=2.4e-08; Accession=PF00514.14; Description =Armadillobeta-catenin-like repeat
  Pfam annotation: Domain name=Arm; Domain location=234-273; Score =38.6; E_value=2.2e-08; Accession=PF00514.14; Description =Armadillobeta-catenin-like repeat
  Pfam annotation: Domain name=Arm; Domain location=275-315; Score =47.5; E_value=4.7e-11; Accession=PF00514.14; Description =Armadillobeta-catenin-like repeat
  Pfam annotation: Domain name=Arm; Domain location=317-358; Score =45.2; E_value=2.2e-10; Accession=PF00514.14; Description =Armadillobeta-catenin-like repeat
  Pfam annotation: Domain name=Arm; Domain location=360-400; Score =53.9; E_value=5.6e-13; Accession=PF00514.14; Description =Armadillobeta-catenin-like repeat
  Pfam annotation: Domain name=Arm; Domain location=403-443; Score =34.8; E_value=3.1e-07; Accession=PF00514.14; Description =Armadillobeta-catenin-like repeat
  Pfam annotation: Domain name=Exonuc_X-T; Domain location=680-849; Score=101.4; E_value=2.8e-27; Accession=PF00929.15; Description =Exonuclease
  Pfam annotation: Domain name=HEAT; Domain location=112-149; Score =3.4; E_value=8.5; Accession=PF02985.13; Description=HEAT repeat
  Pfam annotation: Domain name=HEAT; Domain location=155-191; Score =27.1; E_value=6.3e-05; Accession=PF02985.13; Description=HEAT repeat
  Pfam annotation: Domain name=HEAT; Domain location=240-275; Score =10.7; E_value=0.69; Accession=PF02985.13; Description=HEAT repeat
  Pfam annotation: Domain name=HEAT; Domain location=281-317; Score =10.4; E_value=0.75; Accession=PF02985.13; Description=HEAT repeat
  Pfam annotation: Domain name=HEAT; Domain location=323-360; Score =8.1; E_value=1.7; Accession=PF02985.13; Description=HEAT repeat
  Pfam annotation: Domain name=HEAT; Domain location=366-402; Score =8.8; E_value=1.3; Accession=PF02985.13; Description=HEAT repeat
  Pfam annotation: Domain name=HEAT; Domain location=409-445; Score =0.8; E_value=20; Accession=PF02985.13; Description=HEAT repeat
  Pfam annotation: Domain name=HEAT_PBS; Domain location=134-171; Score= 6.0; E_value=13; Accession=PF03130.7; Description=PBS lyase HEAT-like repeat
  Pfam annotation: Domain name=HEAT_PBS; Domain location=176-213; Score= 8.5; E_value=5.5; Accession=PF03130.7; Description=PBS lyase HEAT -like repeat
  Pfam annotation: Domain name=HEAT_PBS; Domain location=219-255; Score= 0.4; E_value=89; Accession=PF03130.7; Description=PBS lyase HEAT-like repeat
  Pfam annotation: Domain name=HEAT_PBS; Domain location=387-425; Score= 1.9; E_value=54; Accession=PF03130.7; Description=PBS lyase HEAT-like repeat
  Pfam annotation: Domain name=IBB; Domain location=6-97; Score=124.2; E_value=3.8e-34; Accession=PF01749.11; Description=Importin beta binding domain
  Pfam module annotation: Pfam domain module=Arm::Arm::Arm::Arm::Arm::Ar m::Arm::Arm::Exonuc_X-T::HEAT::HEAT::HEAT::HEAT::HEAT::HEAT::HEAT::HEA T_PBS::HEAT_PBS::HEAT_PBS::HEAT_PBS::IBB; Domain location=106 -147::149-189::...
  Pfam module annotation: Domain location=191-232::234-273::275 -315::317-358::360-400::403-443::680-849::112-149::155-191::240 -275::281-317::323-360::366-402::409-445::134-171::176-213::219 -255::387-425::6-97
MSYRPSGNSRTEVRRNRYKVAVDAEEGRRRREDTMVEIRKNRREESLQKKRREGLQPQQMPASVHSSLVEKKLEHLPSMVTGVWTDDNNLQLEATTQFRKLLSIERSPPIEEVIQTGVVSRFVEFLMREDFPQLQFEAAWALTNIASGTSENTKVVIDHGAVPIFVKLLASPSDDVREQAVWALGNVAGDSPRCRDLVLSHGALLPLLAQLNEHAKLSMLRNATWTLSNFCRGKPQPPFDQVKPALPALARLIHSNDEEVLTDACWALSYLSDGTNDKIQAVIEAGVCPRLVELLLHPSPSVLIPALRTVGNIVTGDDMQTQVIINHQALPCLLNLLTNNYKKSIKKEACWTISNITAGNKQQIQAVIEANLIAPLVNLLQNAEFDIKKEAAWAISNATSGGSHEQIKFLVSQGCIKPLCDLLICPDPRIVTVCLEGLENILKVGEADKNIGNTGDVNLYAQMIDEAEGLEKIENLQSHDNTEIYEKAVKILETYWLEEEDETMPPGDASQSGFNFGSSDAPTVPSGVLGGLSVKSSIMTRQQLGDKSTSCHCPNVLGSYEVQQVNTWLLDWLGFFAMPALHGFSKAYGNNNSSIRLLGPRIYGLERGLNTKLIQRLIATRAEGSKQTTCNTKSKINKDEILASATAKVNRTRLDQSQKILYPDVQEIAQYENLSDLVTIIVFDLETTGYSKVNDRIIEIALRDLKGGENSTFQTLVNPQCHVPNSRIHGISTKMVNIPDVPRMEDLIPILLQYIKSREKQGGYVLWIAHNGRAFDAPFLIHEFFRCCAELPRNSLFLDTLPLGRELIKSEGRNLSSASLVALREFYKVKVDGSAHRAMVDVNTLSQILPMGLNSETS

SEQ ID NO: 171458 - protein, 349 aa, Glycine max
  Coding DNA Sequence Number=SeqID_79773
  Pfam annotation: Domain name=DUF1723; Domain location=95-138; Score =10.5; E_value=0.03; Accession=PF08330.1; Description=Protein of unknown function (DUF1723)
MVRIRGLGQTLGRVIGRALGREDVHVDHADDKIHQQTEEAVVDDVANDVEGFPSGPHDTLVLQDYVYHVAAKVWNEEEHLEMKLSSYGRKVEKFGRLAPEIKGLETNSFHLSVGEVNITLDDVVSLLHLPITSVFHSFEPFYVDDVVFLLVELLECWIYEHFSSVGSVIAVDDYDERKPCVCCWKFGKTLSISMYHKHLDRLTFDAMCWIPYDDHRAFMEFEIIPPYPVGPSLCIEDIDDRWIQFSEYIAPPGDPPKHSLVQHDDTFFEPNVAQHPVTAMAMDEAPKDAPADACQAIAERLKRLLSQRIVIEGTEAYTITKECLRIARGVTVQWNVYVRSRRRWRMKDA

SEQ ID NO: 171459 - protein, 219 aa, Glycine max
  Coding DNA Sequence Number=SeqID_79774
MAGEVLIELRTLPGFRSELQLDELFDRFWASVKNVFAPIYIEFIGQACLVDVPSTAMGVRLDRLPGKTIGCYLQALYITLSCLLLICLDDYNISGQDIDGAALIDENLGHHKVCNDNGDNHGVIMVDGVNSLEVPIHERRVPVLVEVVTCVVTAGVFVYLDLLYLFFCMHRDSSAGVLWVLLLFGGCLYLVAYNTGLGGFIGGSLMGTSKLKASSRIVV

SEQ ID NO: 171460 - protein, 75 aa, Glycine max
  Coding DNA Sequence Number=SeqID_79775
MAHDKDIKYYSLASSPAQVQEDAPAVFIRGTFNGKYKDGVLSGGFGEGGNELESVPKGTGCKIGSKIPPEKFTHG

SEQ ID NO: 171461 - protein, 166 aa, Glycine max
  Coding DNA Sequence Number=SeqID_79776
  Gene Ontology: Mol. function=translation initiation factor activity; Cellular component=cytoplasm; Biological process=translational initiation
  Homolog annotation: Hit_ID=B0F816; Match level="QueryCoverage=75%, HitCoverage=68%, E-value=6e-57, Identity=74%"; Hit description =Eukaryotic initiation factor iso4E
  Pfam annotation: Domain name=IF4E; Domain location=1-166; Score =178.7; E_value=1.5e-50; Accession=PF01652.9; Description=Eukaryotic initiation factor 4E
MATSEEVVAAAPEAAAPEAGLKHKLERKWTFWCDNQSKPKQGAAWGTSLRKVFKPSKLQINADFHLFKTGIDPKWEDPECANGGKWSITSNSGRKANLDNMWLETMMALIGEQFEDAEDICGVVASVRQWQDKLSLWTKTAANEAAQLMAEGGMDHSPQKMLQQHI

SEQ ID NO: 171462 - protein, 528 aa, Glycine max
  Coding DNA Sequence Number=SeqID_79777
  Homolog annotation: Hit_ID=A5AWV0; Match level="QueryCoverage=80%, HitCoverage=30%, E-value=2e-21, Identity=23%"; Hit description =Putative uncharacterized protein
  Pfam annotation: Domain name=Transposase_23; Domain location=196-266; Score=15.0; E_value=2.7e-05; Accession=PF03017.5; Description =TNP1ENSPM transposase
MDPILPDSQRPFLGGCAQKGTSHPETEHCPPRFVSWGYEYLEQKLLAEKMKKKLEEAAQSGSVDGVIDPPSPVRRHVKWKMARTKKTGEMTTEATKEIAEKIDVLTAAIGRPEHPGHVRAAGVGVTIRHYFGSAPRTSRTSSSLPPEELHQMQSQIQSQMQSQGLALPPEPLVGPSAARVSTKGNCVDPSGNDPEAGDSDRCGLYIATDHARLVALGRVYEGSTVVHNTPLFPGQVKVSVEEVTDADAPVPVPTDEVSLVGQALHTFLTWPTHLVKSLSRQVAVSLEKPPPKPNPEVDDPLYLMTLTIPELFLRPYQVTWDATVFEVFNPDFPLYIKHKDLSEIAQGGQCLSISVLQLWILHLTETSMRVGNSDIYGFLEPQSIQRSGQSQFEYESCIKTWMQSSKRDVYLGAYLNGGHWQMVVILPKEHLVVWFCSLHNRPNNYLKGIINSALKGLDDAPHSKSKAPARWIVVKCNRQKGSTECGYYVMHWMSTIILGTFRNIWEATIGAREIQGVADPVDTLLSPS

SEQ ID NO: 171463 - protein, 168 aa, Glycine max
  Coding DNA Sequence Number=SeqID_79778
  Gene Ontology: Mol. function=receptor activity; Cellular component =mitochondrion; Biological process=defense response to fungus
  Homolog annotation: Hit_ID=A7QBL6; Match level="QueryCoverage=81%, HitCoverage=17%, E-value=2e-27, Identity=50%"; Hit description =Chromosome chr1 scaffold_75, whole genome shotgun sequence
  Pfam annotation: Domain name=LRRNT_2; Domain location=35-77; Score =56.9; E_value=6.9e-14; Accession=PF08263.3; Description=Leucine rich repeat N-terminal domain
  Pfam annotation: Domain name=LRR_1; Domain location=114-136; Score =4.9; E_value=39; Accession=PF00560.24; Description=Leucine Rich Repeat
  Pfam annotation: Domain name=LRR_1; Domain location=138-160; Score =15.9; E_value=0.15; Accession=PF00560.24; Description=Leucine Rich Repeat
  Pfam module annotation: Pfam domain module=LRRNT_2::LRR_1::LRR_1; Domain location=35-77::114-136::138-160
MGSYFLKILFAVLVCFSHTKLFILGFISPLHVKCIEKERQALLNFKQGLQDYSGMLSRWSDDDNSRDCCKWKGIECNNETVHVQMLDLRASDVHFFTDLSFVGGIPSQLGNLSKLEYLDLKRIFVGGAIPSQLGNLSKLRYVDLAGNSLSGEIPFQVGNLPILQALRL

SEQ ID NO: 171464 - protein, 188 aa, Glycine max
  Coding DNA Sequence Number=SeqID_79779
QGAPFEGTIVDDWKFDYSSHDTRRMVCNDQAEMTGRLLAGSLTFDNRIMHYIIIDWAHLVQYRMHKALRANAPLPYPQLITLFLCHFQIPLDDEPFVQVKRSFAISAGAVTSFGYRKDRNDQWLKKDALPPQDERTPSPPPQRDDSALMTEVLSELRGLRTYVGERFDSSDNRFVGMDIRLTQLEEDV

SEQ ID NO: 171465 - protein, 69 aa, Glycine max
  Coding DNA Sequence Number=SeqID_79780
MSEFTSNFPPRILASLHQLDFAPYVSGSHNAQWNAPELLHDKHLLHSSYIIGKMEVEESLLGLWLPLHY

SEQ ID NO: 171466 - protein, 226 aa, Glycine max
  Coding DNA Sequence Number=SeqID_79781
MTTYLTLPLAGFGVTISQYYGRASRASSNSSISISQQQLAEMIGSLKEQWRNKIIGTLKEEMRSQVEEKNRRSLEKMKQELKDTTKIEFSQRGSQYSPPNEADIQQLGARISTKGSNAETGVNLSVEDVADVIPRLWMSGVQASVMVPCMHSLSHSPCTIHLQTEGYECRYYVMHWMWNIVSGELKTDWTMWFGDDTPLDKETMTTIHKKWATYFLKHKETRCKKA

SEQ ID NO: 171467 - protein, 352 aa, Glycine max
  Coding DNA Sequence Number=SeqID_79782
  Gene Ontology: Mol. function=hydrolase activity, acting on glycosyl bonds; Biological process=cell wall organization and biogenesis
  Homolog annotation: Hit_ID=Q2HUV5; Match level="QueryCoverage=15%, HitCoverage=11%, E-value=3e-17, Identity=80%"; Hit description =Glycoside hydrolase, family 28
MATSLWIMNRAGCRVVRWAATKSGDDEFTAKSGYLFELSATKADSLGNTRYQKSQPYARGSLCSWLATWCKPASHSGSGSVSATSILSWTAPGQCFRLHNALALGMNYVFAESWAPQYGNTVLSKWPIKRWKLQKIFDHHDYRVANGLDCFEYPAISCRKHSAVLTDFGGVGDGKTSNTKAFQYAISNLSHYAFDGGALLVVPPGKCSSLSQTDLRFRDCNHIVEFVFVEFVFATYRLRVLPGRSSSFSFCLSSSLSQTGLRFRDCNHIVEFVFVDFVFATYRLRVGIDFGSPLCLALRLPGKPSKCGALSDKECGGLSYDDAWNACSNQNRDHFHHLVGFLNLSHNAKHPW

SEQ ID NO: 171468 - protein, 134 aa, Glycine max
  Coding DNA Sequence Number=SeqID_79783
MDYAAMVVKRLKVINQGLYTDNNCPRTKLGVQIAVRCLCVSSDLPSSDDEDDHIGLCMSSYFPSPDDEGADNREGADDHIGLYVPSDMPSPDDESADNREGQGKSSNPGSRFMVEGLRFWLKWACGRSDVTYVR

SEQ ID NO: 171469 - protein, 203 aa, Glycine max
  Coding DNA Sequence Number=SeqID_79784
  Gene Ontology: Mol. function=phosphoprotein phosphatase activity
  Homolog annotation: Hit_ID=A7PHV0; Match level="QueryCoverage=32%, HitCoverage=19%, E-value=5e-16, Identity=53%"; Hit description =Chromosome chr13 scaffold_17, whole genome shotgun sequence
MVTYYGCKLSMFQNMFGMEKKTGNYTSDELSPQRCAAPPITKLNQSEFLWEPYTTNVMSVLPPICLVGSVTWCAAVPLICFHVVEWHQPDRVLRQFGMQQPIPKRKTKMFVDPKNANTATLAEVVETLQYMVSPQGRNTWTVDDLVPYVEKITILSEEQERITEPVAHGLASERRFPPQEFHMLQSSVETRGFDRRREAVEAQ

SEQ ID NO: 171470 - protein, 20 aa, Glycine max
  Coding DNA Sequence Number=SeqID_79785
MDLRSTAQRCMHLTQHSDAM

SEQ ID NO: 171471 - protein, 459 aa, Glycine max
  Coding DNA Sequence Number=SeqID_79786
  Gene Ontology: Mol. function=3'-5' exonuclease activity; Cellular component=intracellular; Biological process=nucleobase, nucleoside, nucleotide and nucleic acid metabolic process
  Homolog annotation: Hit_ID=A7PRU7; Match level="QueryCoverage=96%, HitCoverage=82%, E-value=1e-148, Identity=59%"; Hit description =Chromosome chr14 scaffold_27, whole genome shotgun sequence
  Pfam annotation: Domain name=3_5_exonuc; Domain location=275-428; Score=-1.8; E_value=9.8e-05; Accession=PF01612.11; Description=3'-5' exonuclease
HSQGFTHLIISALRRFLKRSTTTTEDSLEVKDLVAHLLVDIIWGQIDHDEKIVLKLLEIFDVKLTNVEKAMCQIKEKHDLSCGTAKEFVEQYIVELVKSQLYMTAVTLIEQFSVYQYGQSFLLDMIQSNQFKAAEKWATFMGKQMLSTLVEEFIERNMLKNAHEIIKKNNLKQDFPDVYKRCKESSLKNLAEKGCWEVAEARINNDRQLMEYLVYLAMEAGYMEKVDELCDRYSLSRFLDINDDKHKTALFPAVPETSNLQGHYLNLDELLVESIIWVDEVEGLLDATRHIEGFKVIGLDCEWKPNYIKGSKPNKVSIMQIASEDSAFIFDLIKLHKEVPDILDNCLSRILLSPRILKLGYNFQCDAKQLAYSYEELRCFKNYEMLLDIQNVFKEPRGGLAGLTELEYAALDAVVLVHIFRHLPCQGHNKDKSEWKSCIVSLTENAKKFKKCVPKIVDT

SEQ ID NO: 171472 - protein, 91 aa, Glycine max
  Coding DNA Sequence Number=SeqID_79787
MACACVEGVSQEAMAALLTWKPSYPWEQRDNLLASGSSETASTSTVSLSTMAAPSSILHVTKLLATADGAFANKFCLGKRVTTYNDQQIKV

SEQ ID NO: 171473 - protein, 187 aa, Glycine max
  Coding DNA Sequence Number=SeqID_79788
  Pfam annotation: Domain name=Transposase_23; Domain location=14-84; Score=1.8; E_value=0.00074; Accession=PF03017.5; Description =TNP1ENSPM transposase
GSPYVAPSGNDPGTGDSDKCGLYIEENSSRLVALGRRYEGSTTVHNIPLLHGQVKVGVEEVKDTEALVLVPTDEVTLVGQALNTFLAWPTHLVKRLSEQAAVSPAKPPESPDEKVDDPLYLMTLTIPQLFLKPLQVMWDATIFGQYDDPILIAEGYYESVTKEVEVTLLWSWCKLPSKLGMLISSEY

SEQ ID NO: 171474 - protein, 233 aa, Glycine max
  Coding DNA Sequence Number=SeqID_79789
  Gene Ontology: Mol. function=nucleoside-triphosphatase activity; Cellular component=mitochondrial matrix; Biological process=ATP -dependent proteolysis
  Homolog annotation: Hit_ID=P93655; Match level="QueryCoverage=70%, HitCoverage=17%, E-value=3e-66, Identity=77%"; Hit description=Lon protease homolog 2, mitochondrial precursor
  Pfam annotation: Domain name=LON; Domain location=52-227; Score=18.0; E_value=1.5e-07; Accession=PF02190.7; Description=ATP-dependent protease La (LON) domain
  Subcellular localization annotation: CTP_CleavageSite=49; ConfidenceScore=5.28e-01
MLKLIASSRIHRVHPTVLRPAHHSASPLLRVLSSLGGLSWRNANVGGSVAKTVLALPLIHRPLFPGFYMPVFVKDPKLLAALQESRERQAPYAGAFLLKDEPEADPSVVSSSDADKNVYDLKGKELFNRLHEVGTLAQISSIHGDQVILIGHRRLRITEMVSEDPLTVKVDHLKDKTYNKDDDIIKATSFEVISTLRDVLKTSSLWRDHVQTYTKVWTLLCMCLLEHGIGVRD

SEQ ID NO: 171475 - protein, 39 aa, Glycine max
  Coding DNA Sequence Number=SeqID_79790
MAHLLICQLLEHKRHGGKPCEGVVVRQEILLTPDRYYKT

SEQ ID NO: 171476 - protein, 961 aa, Glycine max
  Coding DNA Sequence Number=SeqID_79791
  Gene Ontology: Mol. function=binding; Cellular component=nucleus
  Homolog annotation: Hit_ID=A7PRR3; Match level="QueryCoverage=98%, HitCoverage=95%, E-value=0.0, Identity=61%"; Hit description =Chromosome chr14 scaffold_27, whole genome shotgun sequence
MPSFHVLIYSSQDEPPSERKIIKLCEYAAKNPFRIPKIAKYLEERCYKELRSEHIKLVNIIAESFNKLLSICKVQIAYFAVDVLNVILELLSYSKDETIQTLGCQCLSRFIYCQVDATYTHSIEKLVRKVCMLSQEHGEAREKRCLRASSLQCLSAMVWFMAEFSHIFVDFDEIVHSALDNFDWSRQNEEADAREEAHHNWVDEVIRCEGRGGSVIGNDNRSSCLIIQPRPEVKDPSLLTREEIENPEIWAQICIQRMVELAKESTTMRRVLDPMFVYFDSRQHWAPQKGLAMIVLSRMAYFMENSGNQRLILASVIHHLDHKNVMNDPQLKTCVVQVATSLAMQIRSGSGLAEIVFVGVLCRHLRKSLQASSEFVGEQELNLNISLQNSIDDCLQEIANGVIDAQPLFDLMAITLENIPSGVVGRATIGSLIILARALTLALSRLHSQQGFPEALLVQLLKVMLHLDVEARVGAHLIFSILLFPSSFHTHEISSLRSRYLGQHNKRHSHAASVSASASITALLEKLRRNRDSTKAENHGNIVHDQERDIVAEDWNQGCGLKNSPNFYKFTSIIDRATGSPSLTDTEPYVMKLTEDQMAQLLSAFWIQANLPDNLPSNIEAMAHSFILTLIVLRMKNLKDRDNLVIRFFQLPLSLWTMLLDQRIMPPACQRSVYVLSAGMLAFACKIYQIHDLNDVFASLPMSDVDPFLSVSDDYHVYAKIHVDVREYGTAADNQLACSMLSELQNKIRECQSIIRDALVHNLANVTELDADELAMLLSEKFKPDEEFVFGPQSMLDQNQIIFHSQESLSFDGDFPSNSAGGEDDTISEASVSDLSRFIPKMPISPSAPQVISIGQLMESALEVAGQVAGTAISTSPLPYNAMASQCESLGTCARKKLSNWLAFENHYSQAPDKSFLAIADIRNSALEKVANGVGHAQLPRDPMKLPPASPFDNFLKAAGC

SEQ ID NO: 171477 - protein, 89 aa, Glycine max
  Coding DNA Sequence Number=SeqID_79792
METKEERKMILPSPSETQLMNLVNVSITNASAGESHAQNAAAMYSASVVDNATTGCFLEDYETAPEPSKNAKPEVLLRSSKSPTKSLLV

SEQ ID NO: 171478 - protein, 175 aa, Glycine max
  Coding DNA Sequence Number=SeqID_79793
  Homolog annotation: Hit_ID=A7PRP8; Match level="QueryCoverage=40%, HitCoverage=72%, E-value=6e-25, Identity=77%"; Hit description =Chromosome chr14 scaffold_27, whole genome shotgun sequence
  Pfam annotation: Domain name=IGR; Domain location=112-162; Score =43.7; E_value=6.5e-10; Accession=PF09597.1; Description=IGR protein motif
MFRINLIQKTLKDHLIRKLLQASLLRHQWRKQRTVALTSTVDADDAPSTMDGVKTLHPKAEASGRGSKKRKRGMAWLQLQRIITNTKGGANLISPLPRFFSKCSPYVLKVGIPEFLNGIGKGVESHVPKLESEIGDFQKLLVIRTLKLKKLGIPCKHVKKNDGEREIAEHWHLRE

SEQ ID NO: 171479 - protein, 256 aa, Glycine max
  Coding DNA Sequence Number=SeqID_79794
MTPESFYLKLAELLESSGLSLIKGDVVNMKVMNNALFSNSAWQFQCQRNIAGLVPVLLGGDQKRRISPGPLQKKRNSTASLPYIMDIKDGMKVTEISKDYSCHMTRTGYVEQPVLLPPPSNALDGQKILRLAIDTWRNMSEIEKQPYVEESKKKKEEIKEAMNDHNKQQITQDTIREEKWHSLSGDYLVTSQPETDNSLFNKATVGLALKMTEKAPTDPSYLMDWNAFLFTGFSQLGNPSNSTSLVIGKLFFAQRP

SEQ ID NO: 171480 - protein, 106 aa, Glycine max
  Coding DNA Sequence Number=SeqID_79795
MQTIPAPPVDSWMSYDDIHDRWMHYSDHIVPAGEMCAVPGQCASDYMDWFFRISHLFMTPGHALDPLPDGHAPHPRVVPLAPQTDILHVSELGASSTSVEESRHAV

SEQ ID NO: 171481 - protein, 90 aa, Glycine max
  Coding DNA Sequence Number=SeqID_79796
MVQVDGTSTWVVVTENKRGCISCGSVQVEGTSTWLFKENKRGYISCGSLLVKDFIRLKRNLKHRRSPGLAKVTVIPLLIYEMYHVVKVED

SEQ ID NO: 171482 - protein, 334 aa, Glycine max
  Coding DNA Sequence Number=SeqID_79797
  Gene Ontology: Mol. function=binding; Cellular component=nucleus; Biological process=protein amino acid phosphorylation
  Homolog annotation: Hit_ID=A7PRN9; Match level="QueryCoverage=91%, HitCoverage=68%, E-value=2e-95, Identity=37%"; Hit description =Chromosome chr14 scaffold_27, whole genome shotgun sequence
  Pfam annotation: Domain name=PPR; Domain location=128-162; Score=3.5; E_value=3; Accession=PF01535.11; Description=PPR repeat
  Pfam annotation: Domain name=PPR; Domain location=208-242; Score =41.2; E_value=3.6e-09; Accession=PF01535.11; Description=PPR repeat
  Pfam annotation: Domain name=PPR; Domain location=243-277; Score=6.3; E_value=1.4; Accession=PF01535.11; Description=PPR repeat
  Pfam annotation: Domain name=PPR; Domain location=279-313; Score=9.1; E_value=0.64; Accession=PF01535.11; Description=PPR repeat
  Pfam module annotation: Pfam domain module=PPR::PPR::PPR::PPR; Domain location=128-162::208-242::243-277::279-313
MECVSSNAQRWGEPHCFHHIIFFEGLCKGLKALPCGQLVHALAFKIGVQGSSIYIDNALMDMYATCCNRMDHARMVFDDITTKTDVTRTTFITGFSIAAKACASIGSGILGKQVNAAVVKHGFESNLPVMNSILDMYCKCHCASEEKQLFSEMTHKDTITWNTLIAGFEALDSRESLCIFSAVGACANLAVLYCGQQLHGQNAMHKFVSWTSMMIEYGDHGYGKEAVELFNEIVRSGIKPDKMVFMAVLSACSHTGLVDEGMRYFILMTSYYDVTPDIEVYECVVDLLGRAGRVKEAYQLIESMPFNPNESIWAALLGACKVHKQPSVAKLAEL

SEQ ID NO: 171483 - protein, 103 aa, Glycine max
  Coding DNA Sequence Number=SeqID_79798
  Homolog annotation: Hit_ID=Q6L3N8; Match level="QueryCoverage=82%, HitCoverage=6%, E-value=8e-07, Identity=34%"; Hit description =Putative gag-pol polyprotein, identical
MTTNYNIVWFGPKLDGKLDFYYWEALMRTHLRAHNLWSFVEMGLAKGTDDIARRKDPLVLPQIQQRVDFSIFGKIVNAKTAKEACDILKLSYKGVEKAQKLKL

SEQ ID NO: 171484 - protein, 64 aa, Glycine max
  Coding DNA Sequence Number=SeqID_79799
MEPAEEGVLPQAPAEETKKVLPRMPAEEGQEEELRLQPPAPNNNNVIYPKAINAILTDIQSQWS

SEQ ID NO: 171485 - protein, 38 aa, Glycine max
  Coding DNA Sequence Number=SeqID_79800
MAFLGRLRPLDDRELEVDIHFSKWNRHSQRVWEQQMQF

SEQ ID NO: 171486 - protein, 88 aa, Glycine max
  Coding DNA Sequence Number=SeqID_79801
MKRVLLSYEPNQILWTRDKHFMVKKMKAIKNFIPPCEHEAQSGSDLGQISKAEKQIEKGLGLSEEVRLGVSEPGGFGVMTNSKATAGI

SEQ ID NO: 171487 - protein, 617 aa, Glycine max
  Coding DNA Sequence Number=SeqID_79802
  Gene Ontology: Mol. function=nucleic acid binding; Cellular component= intracellular; Biological process=polar nucleus fusion
  Homolog annotation: Hit_ID=A7PRI7; Match level="QueryCoverage=97%, HitCoverage=96%, E-value=0.0, Identity=63%"; Hit description =Chromosome chr14 scaffold_27, whole genome shotgun sequence
  Pfam annotation: Domain name=DUF537; Domain location=19-164; Score =281.3; E_value=1.9e-81; Accession=PF04396.5; Description=Protein of unknown function, DUF537
MGGGGGAATAQAEAQYSTAKTSVWWDIENCHVPKGCDPHAIAQNISSALVRTNYCGPVSISAYGDTTRITAVVQHALSSTGISLNHVPAGVKDASDKKILVDMLFWAVDNPAPANYLLISGDRDFSNALHQLRLRKYNILLAQPQKASAPLVAAAKSVWLWTSLLAGGPPLMNGESQQLGNNNIQSSSDTLPIPVSNAVQIPQHMGSFSEVHAGNQKFPNTGRQLDSRHHGKTNGRNPSKTNGPKALNPAPENYSNINSSQTGNYTHNVPPSGSTPNFICGNPDQMRGKNGNLHSQPLRSNSFPLQPPFIPNNSFSPNPQTFATSVVPPRTGGPSFSAAPLLNVPNISNRKISGYPSNAHDPRPVKQWNGDLKQSSNNNAPSPVKSIGEQTGHMVQNTQQLYNGHPHGPEYQPTSLTTMGNNNLPGNGIWGSPGCPKPSEYVQGLIGVVLLALNTLKIEKIMPTEANITDCIRCGDPKHRNTDVKKALENAIEQQMVVKQNVGALQLFIGKNDKVWKCVSPVGGNPKKHSKETWNEIKKFLSTPSGRLVIMGTQCKYEAGIVIRNMCLKNHALGDVLQILNMLITIKKWIVHQQSGWQPLNITLTEVNSDSEDIACP

SEQ ID NO: 171488 - protein, 128 aa, Glycine max
  Coding DNA Sequence Number=SeqID_79803
  Homolog annotation: Hit_ID=A7PRI6; Match level="QueryCoverage=72%, HitCoverage=13%, E-value=2e-12, Identity=33%"; Hit description =Chromosome chr14 scaffold_27, whole genome shotgun sequence
MVKDRCPGAEEALMALVNTFESRDFQNALFVYKEMVKASNQIELALDQFRRMENKGYNPNSKTFEILVKGLIESGRVNEAATKHIIRFGREVEGLKTLIQCVIRVQCDAVAGSTPLAQKSHMKKLDIT

SEQ ID NO: 171489 - protein, 53 aa, Glycine max
  Coding DNA Sequence Number=SeqID_79804
MPDGKNAPGIVTRATKEEKENQGCQSPSEDELYCMGIGKHASQLLFDPAKSHE

SEQ ID NO: 171490 - protein, 195 aa, Glycine max
  Coding DNA Sequence Number=SeqID_79805
  Homolog annotation: Hit_ID=A2Q1Y8; Match level="QueryCoverage=33%, HitCoverage=28%, E-value=1e-19, Identity=68%"; Hit description=Cupin, RmlC-type
MENGNGLSPASLASTDLDIDGERQRRLEVGVVAVENGGDMVPIEAPLHTLRPRLLPLPRVDLTRPPMFDASKVAKDKHGWIFDPIALALAFGISSGAVTCGSLHMGEIRVGNKRANQRHHICNETFLIWGATTKFRPLKVYILFFTSQYLIIMGRVDGHNPHIRKDLPLTWTNVYEEATNSSVSLSKRKLAFAFS

SEQ ID NO: 171491 - protein, 95 aa, Glycine max
  Coding DNA Sequence Number=SeqID_79806
MVWITYSSGAGKLNIKEGGVLDWCILSSLGAEGTNCSCMEWTMYRLSSSQEYINDGGFKKDVPSLEEVVVLKGICTLQQSHLCAGFPGISMLERE

SEQ ID NO: 171492 - protein, 155 aa, Glycine max
  Coding DNA Sequence Number=SeqID_79807
  Gene Ontology: Mol. function=binding
  Homolog annotation: Hit_ID=Q2HW44; Match level="QueryCoverage=100%, HitCoverage=65%, E-value=1e-52, Identity=66%"; Hit description=TPR repeat
  Pfam annotation: Domain name=TPR_1; Domain location=71-104; Score =20.2; E_value=0.0078; Accession=PF00515.19; Description =Tetratricopeptide repeat
  Pfam annotation: Domain name=TPR_2; Domain location=71-104; Score =26.0; E_value=0.00014; Accession=PF07719.8; Description =Tetratricopeptide repeat
  Pfam module annotation: Pfam domain module=TPR_1::TPR_2; Domain location=71-104::71-104
  Subcellular localization annotation: CTP_CleavageSite=52; ConfidenceScore=5.68e-01
MSAFISHNLKPGGIMVSPSLHHRSSFPLQLSLKAPFSASHPLVLTRRLFLPSVSGIWDALTGGNNNNAREAVLAIRRGMLLFRQGDVSGSLAEFDKAIQLDPRQKACRFEEAAEQFRLDVAQNPNDTEESIWCFLCEAQLFGVDEARKRYLEASP

SEQ ID NO: 171493 - protein, 189 aa, Glycine max
  Coding DNA Sequence Number=SeqID_79808
  Homolog annotation: Hit_ID=Q2HRR1; Match level="QueryCoverage=93%, HitCoverage=90%, E-value=6e-11, Identity=47%"; Hit description =Putative uncharacterized protein
MAGGNRQKKSSSGFFSIFSIFSSRKSKGGYSDAPDSWRRVYPSDYDKGNWGVAEPNIDMKAEAFIAKYKKRVSESALYQLDPAAENAYQSLFLPNVIYRIICPLAFGQKKSSSGFFSMFNIFSSRKPRGGYYDAPDSWRRVWPSDDDKGNWGVAEPNIDMKAEAFIAKYKKRVSESALYQLDPAAAENA

SEQ ID NO: 171494 - protein, 87 aa, Glycine max
  Coding DNA Sequence Number=SeqID_79809
MKIGSNCWPQLSVSGIIELSFGSTQWDVPGAIPDMGDLLGVDLRHEFSVEAEQQGWRQRARRNPDRQARRWDRPCGTSSRHHGHHND

SEQ ID NO: 171495 - protein, 74 aa, Glycine max
  Coding DNA Sequence Number=SeqID_79810
MATSHAGKRPNLPTTSPCSPRSRRGDDHSDWDRLPSWGSRERLRQPVNVCIHDFDDVKEESNKAASNDKHLLQE

SEQ ID NO: 171496 - protein, 286 aa, Glycine max
  Coding DNA Sequence Number=SeqID_79811
MVKESGITVLSEQACLADGQSLNWRPFLYFHDLSAFSHYGVRLGKLPGGRIRCHIQFFFCVALSCLFLIFLDGHNLLRQGGEIHLQMQWGNSISCQSKQSKSGDVLVDEDLGHPEVVDYDGDNHGVVLVDRVDTLEVSIHEIDVDVPDGVELVLVGLAELSFVGESACNGVDHPSYLLGGFMFLWPSSVLCCDRYRDGIYSIWSHLTPTRENFLEDGSAIGRQEYVTLVSRPFWERLTLFSNLSDLVLKFGHFFHLDVALGSFMQLVHATRNFFCIDCMQTCQASK

SEQ ID NO: 171497 - protein, 52 aa, Glycine max
  Coding DNA Sequence Number=SeqID_79812
MIVMVTTTVDMTYKNGKTELLKIWALDRRLQEDWAKDAREGPRVLMSLRVDF

SEQ ID NO: 171498 - protein, 109 aa, Glycine max
  Coding DNA Sequence Number=SeqID_79813
MEPTRGPFCDESDGQKFPAKLVVGLGMKAMREQSYFVNVQSVHYIFLWLAKSNQANLIILKTKKCARINQPKSGKDNLTLPLTLGKITYSSSTKREKKIRLCPNAFLNI

SEQ ID NO: 171499 - protein, 562 aa, Glycine max
  Coding DNA Sequence Number=SeqID_79814
  Homolog annotation: Hit_ID=Q9C6V0; Match level="QueryCoverage=57%, HitCoverage=22%, E-value=1e-11, Identity=22%"; Hit description =En/Spm-like transposon protein, putative
  Pfam annotation: Domain name=Transposase_23; Domain location=322-385; Score=-14.1; E_value=0.042; Accession=PF03017.5; Description =TNP1ENSPM transposase
  Subcellular localization annotation: CTP_CleavageSite=41; ConfidenceScore=5.46e-01
MTRVYGRTFLLNCVSTKLMASPLGSPPHSENPLEVTSRRTRQSTRLRSLTTRSLDNPRPIVNVNPTTSRGSGPHKEKFHSYLGVVAREKIPIVHSNWSVVPDDLKTLIWEDILSSLTSRFVYADNEGQQITDPIVKYGLDPAIWAEFAKSCQTPNWQGIQKMAQEIQKYNDCPHSLSRGVYNLLDKKLMDKKRKQREHYAKFTKNPSLSHDPPSQVSRLLKWKMARTKRYGQMTSAAAQEISDKIVDLNIQAMFMLKGQDEIQKEVEEENKQLQEAWQRAVEDEHIRNLERMKQDTKGSCADPKAKGLPIEPSDVVVDLMGLYVVHDQSTMLVALGIVYDNSSTIHNVPYADDVLRVNVVTVYHREALVPYPTLEVRFVSQAVGTFVAWPTHLVKKVSDELIPWENWLRVRMTFIKRLSSCRGTGTSIGFAPAYGFLEPQSIHHAKDRCEECEQYIESWVKESHREVYLGPYLNHVVWFCSLRKKPDLHIKAAVNSHVQAGGYECGYYVMHWMWCIVSGGLKNELHKWFYDGTPLDSDTMTTLRKKWAAYFLQVQKKDVTQV

SEQ ID NO: 171500 - protein, 169 aa, Glycine max
  Coding DNA Sequence Number=SeqID_79815
  Gene Ontology: Mol. function=phospholipase C activity; Cellular component=anchored to membrane; Biological process=intracellular signaling cascade
  Homolog annotation: Hit_ID=Q93XX5; Match level="QueryCoverage=39%, HitCoverage=15%, E-value=7e-14, Identity=60%"; Hit description=PI -PLC X domain-containing protein At5g67130 precursor
MNPKPVEAVPAWSNQIIFNASKEAEEGIAYQWSYMAENECKCNDLLDPGVEGGCCPHRKESKPLNCSSASLFLHNYFATVSKSAKKLIRESKMFLNMIVANTFGAFAIITVDAFGGFILSKKKQCKQVLLISMHLNVHATFDKPQETITEDESSNEGTIADIELPCIGI

SEQ ID NO: 171501 - protein, 78 aa, Glycine max
  Coding DNA Sequence Number=SeqID_79816
MSEEVEMNVENEEDAGVKVDCSDVFNTSEPVSGGDDWMVKLICGIHNHEMAKSLVEHPYASRLTKDEKIVVANMTKST

SEQ ID NO: 171502 - protein, 48 aa, Glycine max
  Coding DNA Sequence Number=SeqID_79817
MVGAFLQNRVTLAGHRMILLSESDMMTRWMTLKNLGLEDAGTQCSDRM

SEQ ID NO: 171503 - protein, 130 aa, Glycine max
  Coding DNA Sequence Number=SeqID_79818
MRRACRKIWRSVPCTSRKSLRTDSRKDMEEILRAKLSTIKEEPELCDENFASPRHVRLAKKQGKKVKGKDKTGRCLVPHVNLKQSYVLFITGFASKDLANFCIINNSNSFLYALCQPTLEETERKQVRAL

SEQ ID NO: 171504 - protein, 1132 aa, Glycine max
  Coding DNA Sequence Number=SeqID_79819
  Gene Ontology: Mol. function=glutamate-tRNA ligase activity; Cellular component=cytoplasm; Biological process=tRNA aminoacylation for protein translation
  Homolog annotation: Hit_ID=A2WNB8; Match level="QueryCoverage=99%, HitCoverage=99%, E-value=0.0, Identity=65%"; Hit description =Putative uncharacterized protein
  Pfam annotation: Domain name=PK; Domain location=695-940; Score= -83.2; E_value=1.1e-14; Accession=PF00224.12; Description=Pyruvate kinase, barrel domain
  Pfam annotation: Domain name=tRNA-synt_1c; Domain location=224-540; Score=428.1; E_value=1.3e-125; Accession=PF00749.12; Description =tRNA synthetases class I (E and Q), catalytic domain
  Pfam annotation: Domain name=tRNA-synt_1c_C; Domain location=542-714; Score=71.3; E_value=3.3e-18; Accession=PF03950.9; Description=tRNA synthetases class I (E and Q), anti-codon binding domain
  Pfam module annotation: Pfam domain module=PK::tRNA-synt_1c::tRNA -synt_1c_C; Domain location=695-940::224-540::542-714
MDIKTFAFAPSSPPLPVIAAAKLAGISPSIDTSLSPDSPPAFIFSDGLKLHGAYALLRYIGRVASLPNFYGQNALESSQIDEWLDYAPILSSGPAFENACKYIDEYLEKCTFLVGYSLSIADLAIWAGLAGSGKRWESLRKSKKYPNLARWFNSIVAEHGTVLNEVTSVYAGKKGLGEPTATKSKDQSVNTDKVKKVNGDVSENNKGGSKPSAEIDLPDAEVGKVRLRFAPEPSGYLHIGHSKAALLNKYFAERYKGQVIVRFDDTNPAKESNEFVDNLIKDIDTLGIKYEQITYTSDYFPELMEMAEKLIRQGKAYVDDTPREQMQKERMDGIDSKCRNNSVEENLKLWKEMIAGTERGLQCCVRGKLDMQDPNKSLRDPVYYRCNPMPHHRIGSKYKVYPTYDFACPYVDSIEGITHALRSSEYHDRNAQYYWIQEDMGLRKVLIYEFSRLNMVYTLLSKRKLLWFVQNGKVDGWDDARFPTVQGIVRRGLKIEALIQFIVEQNVDDSSLILVQGASKNLNLMEWDKLWTINKKIIDPVCPRHTAVIADRRVLLTLTDGPEKPFVRIIPRHKKYEAAGDKATTYTKRIWLDLADAVSLSAGEEVTLMDWGNAIVKEIEKDQDGNIIGLSGVLHLEGSVKTTKLKLTWLPEIDELVSLTLVEFDYLITKKKSTMDHIEEAIAKLTSNQLNLIATQNTMSTKLDKFLQKMAHLETSQHSAMAFTVGWVADATLVRPFIKWFCSGGIRSKNLAHAQPNPHEMLPHAILFCATWNCVLFGKGGMMSMVVKSKTEDSMKCEVVDGGELKSRRLLNFRGKSATLPSITEKDWDDDIMFGVDNKVDFYAVSFVKNAEVVHELKNYLKSCGDLGTELHIEEGPLLQEEIINLCCSMGKAVIVTTNMLDSMIVHPTPTRTEFPLKAVQVMHTVALRTEATIPGGKMPPNIGQVLKNHMCEMFAYHATMMSNTLGTSIIVSTGTGFHGSSENGLPPHKATPLFDKLAFEKTQQALGGHVPIVLLGDLWKKFISHIQELTTVSCISSVVAVLDHNYHLEDKVFFNGIGDLEEGEDFIDVVNPCTKKETLAYGDSNMRNLQRGDLLQLERKGYFRCDLPFIRPSQPIVLYAIPDGRQQTSLK

SEQ ID NO: 171505 - protein, 200 aa, Glycine max
  Coding DNA Sequence Number=SeqID_79820
  Homolog annotation: Hit_ID=Q2HUZ5; Match level="QueryCoverage=100%, HitCoverage=48%, E-value=3e-69, Identity=67%"; Hit description =Putative uncharacterized protein
MTYVLGVLVFLAAKSEFVKDADEAALLQDFFICVEMLVAAVGHFYAFPYKEYAGANIGGSRGLTASLAHALNLIFFFRQFAPTYHDYVLYNHGGEGEEGTRKYRSRTFVPIGPEMDTVRRNKHLFGNKTDDVQLSNFPSNSSSPSNSDPISDVPHSGAMKSSLLVDVSNSLSVPYDMTLIDLDASSYPEKVPAADKAGSR

SEQ ID NO: 171506 - protein, 92 aa, Glycine max
  Coding DNA Sequence Number=SeqID_79821
IDLNVALTNGDEARLSETQTIVVFKSEEALAPNEVEEAIPLAWAPTWDPNEDDEAFDDGGILMMLTKLSMTWKVKNRRNLMKYLWHQVKHLF

SEQ ID NO: 171507 - protein, 547 aa, Glycine max
  Coding DNA Sequence Number=SeqID_79822
  Gene Ontology: Mol. function=phosphoinositide phospholipase C activity; Biological process=intracellular signaling cascade
  Homolog annotation: Hit_ID=A7UQU7; Match level="QueryCoverage=58%, HitCoverage=64%, E-value=1e-30, Identity=28%"; Hit description=IMP dehydrogenase/GMP reductase, putative
  Pfam annotation: Domain name=DUF1723; Domain location=171-220; Score =52.9; E_value=1.1e-12; Accession=PF08330.1; Description=Protein of unknown function (DUF1723)
MSFKIMVRTRGLGHALGHVTGRGVGRGDRDDSDDALQRRWPTASAQRQRVPVTAAHDEPVVPMPDVEADVFPDDPIAPANVEDTGADIPADTRAQAVEDKHEEFSGGPSDPSVLTQYVDHVACSVWAGERPELTLSSHGRKVHSLGRPVPAIEGLVAGTGLSPLIVCSVDIGDRGLLSSFVERWHRETSSFHLPMGELTITLDDISSLLHLPVVGDLHAFQPLHVDDAIQMLVDLLMVYAEAVKAETGQCRGLYVRLQWYVISTSADARQALRDLSQTERYVWGVAALVHMYDQLSDASISSSRQLGGDITLLQCWIYEHFPLVVESTADQDYEENSPCACRWIATKKIVKSIRTPVYRERLNRLWILDVCYRVVRKFGYTQTIPAPLVDSWVSYDDIHDKWMHYSDHMVPAGEVCAVLGQCASDYMDWFFRISHPFMTLGHASDPIPDGHAPQPRVVPQTPQIDIPQVPEPGAPSTSASPAVEEPRHAEVCHGIAERLERYLSLRVVTPGSSTHEVIEEYLRMARSVTQDQLVYVRSRRRRRTDQA

SEQ ID NO: 171508 - protein, 327 aa, Glycine max
  Coding DNA Sequence Number=SeqID_79823
  Homolog annotation: Hit_ID=A7Q2K5; Match level="QueryCoverage=65%, HitCoverage=44%, E-value=4e-32, Identity=40%"; Hit description =Chromosome chr1 scaffold_46, whole genome shotgun sequence
MGETIASNPTLQVSVSFGRFENDSLSWEKWSAFSPNKYLEEKAYFEAHYKNVAARKAELLAQAKQKEKDSPRSQHQNGEDLSCNTCWTDAECDDTQGFMEGVKFKQETNSIGEIVRTDESNLEEDVAISRDYQGSSIEGEKENEELESRSGSSQIEKLEEVVYVEQGGSKEENPNVEAEDVKEIPHNVNKEPAQALEIEAKYVTLDHPKVSKKLWVLRIKLIRKHFTASFGSTWTVTCLRINLIRNTHNSTFRSAFYTIAGNNGGNDRVTTLTSTVDGDEAPSTVDDGVALRGSLLDAPQQPPIHGNNGGKLLNEKEEEEPLPTTSS

SEQ ID NO: 171509 - protein, 175 aa, Glycine max
  Coding DNA Sequence Number=SeqID_79824
MHSRMLVPGWIYEHFVTIGARNNVLGYKEKSPCVSRWSNKSSLSVIHYKKLIDELTIKGVRWTPYETQRNHRSFENISLFFRVSHPFVQPIYFAPPLDATMDQAHLAIETCYRIGRLLQRTDAYSVTEEALALARGVTDDGPMNTSRAWGGTRGGHGRGEHMPILFVYLFPLCLC

SEQ ID NO: 171510 - protein, 491 aa, Glycine max
  Coding DNA Sequence Number=SeqID_79825
  Gene Ontology: Mol. function=hydrolase activity; Cellular component =cellulose and pectin-containing cell wall; Biological process =negative regulation of Wnt receptor signaling pathway
  Homolog annotation: Hit_ID=A7PRH0; Match level="QueryCoverage=57%, HitCoverage=66%, E-value=1e-131, Identity=77%"; Hit description =Chromosome chr14 scaffold_27, whole genome shotgun sequence
  Pfam annotation: Domain name=PAE; Domain location=45-395; Score =662.0; E_value=5e-196; Accession=PF03283.4; Description =Pectinacetylesterase
MTMKLVLVVVVEVACLVSGILSFGSETLSELSFLENDVVSTTRPSSSSQLQPQPQPQPLMVDLTLIHEADSKGAVCLDGTVPGYHLDRGFGSGADSWLIHLEGGGWCNTIRNCVYRKNTRRGSSKYMENQIPFTGILSNKPEENPDFFNWNRVKLRYCDGASFSGDSEDESAQLQFRGQKIWLAAMEELMSKGMQKADQALLSGCSAGGLASIIHCDEFGSLFGKSSKVKCLSDGGFFLDAMDVSGGRTLRTLFGGVVQLQDVQKNLPKSCLDQLDPTSCFFPQNMIEHVETPLFLLNAAYDVWQVQASLAPPSADRLGSWNECKSNHANCSSSQMQFLQGFYIWSVEPKVPSLSLYPNNKLNIQKSLPSTCPLSTVVGLSSSFLDFDHIRDQVLTGQEVPSLENLITRLLRVPSPIIGGNSVDSIKTYVMLSNRRDEMVMEIEEDELEEEITLNVLTECGTRRMIGVGHESHGLYYLKPNLSLVCSAATS

SEQ ID NO: 171511 - protein, 105 aa, Glycine max
  Coding DNA Sequence Number=SeqID_79826
MPSTNVFSNKKKGNHIIETNVFVADVGSKALLAVLDSEVLGVLRKPCREGTKRLSNRIKLEARNEGAAWARLGLKKNLEVLRLKKKLEARFQRERARGKQQVLTG

SEQ ID NO: 171512 - protein, 25 aa, Glycine max
  Coding DNA Sequence Number=SeqID_79827
MLLCQGSITLHTEFDHPLPPPLGLS

SEQ ID NO: 171513 - protein, 332 aa, Glycine max
  Coding DNA Sequence Number=SeqID_79828
  Gene Ontology: Mol. function=hydrolase activity; Cellular component =nucleus; Biological process=metabolic process
  Homolog annotation: Hit_ID=Q2HU53; Match level="QueryCoverage=99%, HitCoverage=62%, E-value=1e-52, Identity=29%"; Hit description =Tetratricopeptide-like helical
  Pfam annotation: Domain name=PPR; Domain location=122-156; Score =16.6; E_value=0.083; Accession=PF01535.11; Description=PPR repeat
  Pfam annotation: Domain name=PPR; Domain location=192-226; Score =13.8; E_value=0.18; Accession=PF01535.11; Description=PPR repeat
  Pfam annotation: Domain name=PPR; Domain location=21-55; Score=25.6; E_value=0.00018; Accession=PF01535.11; Description=PPR repeat
  Pfam annotation: Domain name=PPR; Domain location=244-278; Score =39.9; E_value=9e-09; Accession=PF01535.11; Description=PPR repeat
  Pfam module annotation: Pfam domain module=PPR::PPR::PPR::PPR; Domain location=122-156::192-226::21-55::244-278
MGCYIEDARRMFDEMSDRDLALWSALICGNMWNYEWLEALLLFGKMREQGLMPDSVIVTSVLPVCGRLEAVKLGMALQGCAVRSGFESDLYFSFAMIDMYCKCGDPFDAHRVFSRMVYKDVVSWSTSIVGYSQNRLYQESYELYTGMVNVGLATNAIVVASVLPTFGKLKLLKQRKDMHNFVLIEGLMPNVVVGSALIDMYANCGSIKEVESIFECMSNKDIMVWNSVIIRVKIFKQMMVRNVITYSTMISASGAHGLGEKGLAFYEQMEEEGIRPNKQDMKHYLCMVDLIGTTGDLDGAYKFITRMHMTPDANVLGSLLGACRLHNKVKLA

SEQ ID NO: 171514 - protein, 215 aa, Glycine max
  Coding DNA Sequence Number=SeqID_79829
MYWSHHRDMLLHSCPSPCVAHAGVVMLEKELTKDEPWMSRIKNPPSQNPRFCIFGTKDLSREKSTILGSECRSTEVELQLVRSVIEVSCDPEGTFPIGAKLSHLGIFSGFTFDSLYEVASSLLVNDSLTSTRIMAFVSYSIATSKYVTAPRAFGSGPNMSIPHMEKGQGELRLKVIRWSMWHICKLLTSFASLGEVKGVCPQCWLVVACSHHFGG

SEQ ID NO: 171515 - protein, 790 aa, Glycine max
  Coding DNA Sequence Number=SeqID_79830
MVNLEVTKYSKATGIGKGGSGGKKRKAKSIRKHYFAMQRRLRQCRHFDAKNATEGCEVKENLSLNSNVMSNNLVSDVPMWKTIEGVSLFDIQLILKVMYDCMQRGSMKPVFIEDERGKADVEGGHVSLSVISLSVDERCLVSSVVALKNVRVASRCGLLSPRAWTCVVRAAFAKLSMMDMCQPIRDREAISIGGPSFEDTCRGVSDSKSSSSEKSILVTMIISLSAFVGVRRVGGSRDVRDDVLKYRSSLTSVVSIVVLQSQVKMVNAEDSYKLVVQACKSDDFPFLRADPFFKVLAIDVEVDGMPLMFNRDGELRFLLYWQYDHTRFKLYDEDLLTLMKRVDKEILKQLSASLDARSILSLPLASDPLVALDGIMGDFAWRPLMKQVELAGGIVPPSFVALSTGEGRRETILLGRLAQDVPPTAPTVEVHAVAIEATPVIPAHSPPTVDCRCNDHWCYGMPHSSTSMALLAVILVAMVSPSSSLCPHISLDHLYTSMLIHYGNATDFSKVFLQRSLMILEENELRHQEAVQKIASLEVEVVGATVAFAEVVRMNRQLSFKVGSALAKLLRAWLDAGLGCKVESMATEKDELAKRITELEVRLTDSESKLVESELRVAKEREADKELEEELLLYKKEVVEQHEKGFEKAVRQGSLFAKDLDLGQDVKDDILLDEEVIATKEEEEAADEGQGVTEQGDDPIDRGGLVKSVAESSQVLPNQCGGRSLDLLSVSSDVLPNSGATVRLVDLRPLTVIVLAAPWWTLSFGTKGRPWVLDKLAFMHGGPWVCRALD

SEQ ID NO: 171516 - protein, 481 aa, Glycine max
  Coding DNA Sequence Number=SeqID_79831
  Gene Ontology: Mol. function=sequence-specific DNA binding; Cellular component=nucleus; Biological process=regulation of transcription, DNA-dependent
  Homolog annotation: Hit_ID=A9PJI8; Match level="QueryCoverage=92%, HitCoverage=94%, E-value=2e-93, Identity=47%"; Hit description =Putative uncharacterized protein
  Pfam annotation: Domain name=WRKY; Domain location=255-315; Score =138.2; E_value=2.4e-38; Accession=PF03106.6; Description=WRKY DNA -binding domain
MENHHQMQQPNREFTILRSTDFLRQNLNLYPTTVNTGEHADPSIKEVDFFSSRSPTKNSDTDNSSPEEPHDHRHTNMAKDDGSPTLFNDQLVNTALNLSPSAGLSRSAANDENIETLLTTLQRESLRLKEENCKLRTMLDQITKNYNQLQLFIALQKQKQCQMETNLNGMMFGQHLLDPRGPFTKLDAQVAPFPDDKSGQRGHPETDPVEDVLEQSTSQSWGSSKSPKFEESNSSELPLKKTRVSVRARSEAPLISDGCQWRKYGQKIAKGNPCPRAYYRCTMAVGCPVRKQVQRCMDDKTVLITTYEGNHNHPLPPSAIVMANSTSAAASMFLSSSCSTSNNNEALSNTVGVFSSMPYIPMATLSTSAPFPTITLDMTTNPSALTSPLPLHATTFPQLLGHPVIFPHKMPHPLLGQQQPLFTTETMSAAIASNPNFTIALAAAISSIIGAPRGNDGINNNSSNGGSDLPLNGTSMLPGST

SEQ ID NO: 171517 - protein, 185 aa, Glycine max
  Coding DNA Sequence Number=SeqID_79832
  Subcellular localization annotation: CTP_CleavageSite=33; ConfidenceScore=5.19e-01
MIHIRLTNGTFSNYPKSSGCASILFPLHFKTSCASSISSGKTMDNVPKIKTEPGFEDENGPSHHDRAMLHQHHYRQLSTGQLTRVQALRLVPNSVTFNMLLNEYKATCNSLDVPSSMYNFMKEKRFTQLNIAYCAEMPLCLQLVAKDDKNWIWMERFFQIPKLQSWNLFEFPDPNVNYAFIWPCL

SEQ ID NO: 171518 - protein, 568 aa, Glycine max
  Coding DNA Sequence Number=SeqID_79833
  Gene Ontology: Mol. function=helicase activity; Cellular component =chromatin; Biological process=protein amino acid phosphorylation
  Homolog annotation: Hit_ID=Q2A9E0; Match level="QueryCoverage=77%, HitCoverage=40%, E-value=2e-79, Identity=43%"; Hit description =Putative uncharacterized protein
  Pfam annotation: Domain name=DUF889; Domain location=371-568; Score =216.3; E_value=7.1e-62; Accession=PF05970.5; Description=Eukaryotic protein of unknown function (DUF889)
MNNMCSLHNNLYNDFEDASSTSTRVANSEMHDNSLVREHANDPLQQTDEGYLDDNTEIGGNVDSLLHDDNHLGDDGDECAHDISTGDPSKTCPYCHTAMWYEERTRKDKNQANAKYSLYCDMGRNDDGTTKQVVDEIKHYLDGRLYFHFPGQNSIIFVDDDDIDVLLSKPTIKESMFTSWLQANSIYHEAKDLTYLHFVSKFTYIAKSRCWRPRKGGNTIGRLNWVPPSTSEIYYLRMMLVVVKGLTTYEKICTVNGTGKTFMWKTLSDTLRSKGDIVLTVASSGIASLLLPNGRTAHSKFVILVPTLENSTCNIHQGIEQARLLKATKLIIWDEAPMAHKYCFEALDKTLNDFMLMSNSDSVPFGGKVVVFGGDFKQIFPIITRGSRSDIVNATINASYLWDYCTVLKLTKKMHLQSNLTITNAQEIKRFSQWLIDVGEGKLEISNELLIKNFNDHIELIVGHTYPYIQHNYKDEEFLKSRAILASTNEIVDQINDYILNIISGDEKEYLSCDSIDITDVASSESHEAVTPEFLHSFKTSGMPNHKIRIKIGTPIMLIQNLDQVEGL

SEQ ID NO: 171519 - protein, 100 aa, Glycine max
  Coding DNA Sequence Number=SeqID_79834
IQQYSGAFGTSMEERLSKVVRALRGGAPELWLEWKWMRNRKTGCKKTREKMKVLVLGCKKIKGKMKDDQCTGSLEPWRLQTDIKEVIQVGETKTFDPRLK

SEQ ID NO: 171520 - protein, 213 aa, Glycine max
  Coding DNA Sequence Number=SeqID_79835
MVVQSLDDVVHQQLMVSATAEKSSESKIAVTANGGNGAKSAEKKLRELSEEGSTMPPRRSSARIQALQKAEEELLARKRAEGVEEKDNCNDEVKAGKAKKRNRKSSSDGEESVVVEVEVVSPPMKKGVAYRKGKVVDGVNGNVKVGEVNGKEGLENAGGGLGEKSDLLKVKETIRLFNKYYLHLVQEEEKRCGKAEAERKAAKKASKSKIVQW

SEQ ID NO: 171521 - protein, 323 aa, Glycine max
  Coding DNA Sequence Number=SeqID_79836
  Gene Ontology: Mol. function=histone-lysine N-methyltransferase activity; Cellular component=chromosome, pericentric region; Biological process=chromatin modification
  Homolog annotation: Hit_ID=A7PA35; Match level="QueryCoverage=84%, HitCoverage=46%, E-value=7e-97, Identity=65%"; Hit description =Chromosome chr14 scaffold_9, whole genome shotgun sequence
  Pfam annotation: Domain name=YDG_SRA; Domain location=44-251; Score =113.8; E_value=5.2e-31; Accession=PF02182.8; Description=YDGSRA domain
MRMRMRSNLFKVTLGKGAPPEESKTTAKRPDLKAMMENNEILYPEKRIGNIPGIDVGYQFYSRAEMVAVGFHSHWLNGIDYMGQSYAKAYSYELPVAVAIVISGMYEDDLDNAEDVVYTGQGGHNLTGDKRQFRDQKLERGNLALKNYGFVPWKGYAIVGKLSAVLWYLVEGIQNTNLSLLPFPTKPTLYLLNCSEQCVPVRVIRGHESSSSYTGKVYTYDGLYKVVNYWAGKGISGFTVYKFRLRRLEGQPTLTTNQVYFTYGRVPQSLTEIQGLVCEDITGGQEDMPIPATNLVDDPPVPPTGKFNKGRKKTLNRECKSVF

SEQ ID NO: 171522 - protein, 288 aa, Glycine max
  Coding DNA Sequence Number=SeqID_79837
  Gene Ontology: Mol. function=histone-lysine N-methyltransferase activity; Cellular component=chromosome, pericentric region; Biological process=chromatin modification
  Homolog annotation: Hit_ID=Q8GZB6; Match level="QueryCoverage=95%, HitCoverage=44%, E-value=1e-95, Identity=60%"; Hit description =Histone-lysine N-methyltransferase, H3 lysine-9 specific SUVH4 (EC 2.1.1.43) (Histone ...
  Homolog annotation: Hit description=H3-K9 methyltransferase 4) (H3-K9- HMTase 4) (Suppressor of variegation 3-9 homolog protein 4) (Su(var)3- 9 homolog protein 4)
  Pfam annotation: Domain name=Pre-SET; Domain location=2-101; Score =56.2; E_value=1.1e-13; Accession=PF05033.7; Description=Pre-SET motif
  Pfam annotation: Domain name=SET; Domain location=103-265; Score =143.6; E_value=5.3e-40; Accession=PF00856.19; Description=SET domain
  Pfam module annotation: Pfam domain module=Pre-SET::SET; Domain location=2-101::103-265
MRRTEFSEQIYVMFSRRSDYGPIDFTYCKSLKVAKNVKLPMNATGCKCEGICNDPTSCACALRNGSDFPYVSRDGGRLIEAKDVVFECGPKCGCGPGCVNRTSQRGLRYRLEVFRTAKKGWAVRSWDFIPSGAPVCEYTGILARAEDMDSVLENNYIFEIDCLQTIKGLGGRERRSQDGEIPANLLDKYHDQCSESVPEFCIDAGSTGNIARFINHCCEPNLFVQCVLSTHDDLRLARIMLFAADNIPPLQELTYDYGYVLDSVLDSDGKIKQMPCYCGASVCRKRLF

SEQ ID NO: 171523 - protein, 296 aa, Glycine max
  Coding DNA Sequence Number=SeqID_79838
  Gene Ontology: Mol. function=sodium:dicarboxylate symporter activity; Cellular component=membrane; Biological process=dicarboxylic acid transport
  Homolog annotation: Hit_ID=A5BSY1; Match level="QueryCoverage=53%, HitCoverage=57%, E-value=7e-71, Identity=86%"; Hit description =Putative uncharacterized protein
MAHLQEIDRVKNEVIRLERESVIPILKPRLIMTLANLIEHSSDRAEFLKLSKRIEYTIRAWYLLQFEDLMQLYSLFDPVHGAQKLEQQKLSSEEIDVLEQNFLTYLFQVMEKSNFKIVTDDEIDVAHSGQYLLNLPITVDESKLDKILLKKYFEEHHHDDLPDFSDKPEKKNPGLTPMDWVKFLGSAVVGLVAVVSSLEMPSADWWVIIAVVSTVIGYIAKTYFTFQQNMAQYQNLITQSMYDKQLDSGKGTLLHLCDDVIQQENCLESRIGLAVLMVPETGQLFSAQPLLYLALV

SEQ ID NO: 171524 - protein, 137 aa, Glycine max
  Coding DNA Sequence Number=SeqID_79839
MVLPSTPHENIEIESLETNEVPNLMDEIQGLQNMFKYLLEAESQVGTDKNDENVAGYSVGAGHNIQGLQNMFKYLLEAESQMGTDKNDENVVGYSVGVGHSVPVAAGVGDNRFLHPNPKCNLHLKLVILKYKKFHFG

SEQ ID NO: 171525 - protein, 106 aa, Glycine max
  Coding DNA Sequence Number=SeqID_79840
  Subcellular localization annotation: CTP_CleavageSite=52; ConfidenceScore=5.07e-01
MTHNPTIEELINKIQLSPKIMSTSSRRLDSSSPEFYSLHPAVVILLPQQCSRSSQSSSRPPSRARNCPPPLGDQPGAHRSSLPGDEPPHYKVHSATIILFLVSYEV

SEQ ID NO: 171526 - protein, 83 aa, Glycine max
  Coding DNA Sequence Number=SeqID_79841
MDPKRIKVIPKWPTPPSVEERIHEFQEPLDLRSNTFQGGGNDAILTPPPPKALDRRLQEDWAKHAREGPRVLMSLGVDFGLMG

SEQ ID NO: 171527 - protein, 79 aa, Glycine max
  Coding DNA Sequence Number=SeqID_79842
  Subcellular localization annotation: CTP_CleavageSite=46; ConfidenceScore=5.17e-01
MDTSEPYTGAIKGTMREPQANLGASQNTYRLKRAACPGLQRTARPRLQRATRPCLKRISRPRLKRATRPRLQRTTRPRL

SEQ ID NO: 171528 - protein, 39 aa, Glycine max
  Coding DNA Sequence Number=SeqID_79843
GLILMQSYPPRALDRRLQEDWAKDAREGPRVLISLRVDF

SEQ ID NO: 171529 - protein, 57 aa, Glycine max
  Coding DNA Sequence Number=SeqID_79844
MTKARQKGVWKTEERRRTNERWQKIFTELPTETFWTRYGSASAWIFFTETIFFTNFK

SEQ ID NO: 171530 - protein, 118 aa, Glycine max
  Coding DNA Sequence Number=SeqID_79845
MQSSQRDVYLGAYLNGFHCSGHWQMVVILPKEHLVVWFCSLHNRPDNYLKGIINSLNQRLLLGGMSSRQKGSTECGYYVMHWMSTIILGTFRNNWEATIGLREIKSIADPVGTVLSSS

SEQ ID NO: 171531 - protein, 223 aa, Glycine max
  Coding DNA Sequence Number=SeqID_79846
  Homolog annotation: Hit_ID=A5B5V0; Match level="QueryCoverage=78%, HitCoverage=38%, E-value=2e-07, Identity=25%"; Hit description =Putative uncharacterized protein
  Subcellular localization annotation: CTP_CleavageSite=27; ConfidenceScore=5.13e-01
MVEPSKKRKGSSSRSQRHSEAQDTPIPSSISSSSLFLSKEQCIRYTNLFSSRSIIDPNFIDMDFFSNESFECIQAFQNLNLIPFISLKLSVYFELVKAFYSNLEIQESTLISEVYGIKMVIDQSLFYDLTQLSSDGVPFEGALDDDWKFDFFVHDVRRLVCTNQADMTGRLLAGSLALESRILHYLIVRILLPRSSNLAQVSEADLIVMWAFHTGRQIDWAHL

SEQ ID NO: 171532 - protein, 109 aa, Glycine max
  Coding DNA Sequence Number=SeqID_79847
MGFQTLPYSNIPNITDIYVFIVTTRLVTTELITKHNSPKITPTSSRRLGGSSPESYSLHPATVIMLPRTRCNVVRTNNNKISGNSLSMSTRHSHLGNCAEFVETTRLCT

SEQ ID NO: 171533 - protein, 104 aa, Glycine max
  Coding DNA Sequence Number=SeqID_79848
MGGANSNFEILNLSLSEYFRSRIASGGSNPARLGKLGGNLLPLFPKNRQKGVVLNIHQPPGYVFQLFWVEKIVPSSKSKPRFSVVLHRSSFVLRSFFVRSSFFN

SEQ ID NO: 171534 - protein, 150 aa, Glycine max
  Coding DNA Sequence Number=SeqID_79849
SFGVPVAPSKVIRPPITRAFIEKYCTQRQAQGDAPQAADASPPHQASLAGSFDTEQYLRHLVRQQAANHRAYVQTHDCLYQLTLILQSQGFTSFSCPTPDQFRAEVAWPGDWPEAQVGEAPAEAPDEADEARKDEEMTDLLDFLGGSGAT

SEQ ID NO: 171535 - protein, 150 aa, Glycine max
  Coding DNA Sequence Number=SeqID_79850
  Homolog annotation: Hit_ID=Q5ARI7; Match level="QueryCoverage=36%, HitCoverage=25%, E-value=5e-07, Identity=41%"; Hit description =Putative uncharacterized protein
  Pfam annotation: Domain name=zf-CCHC; Domain location=18-35; Score =27.0; E_value=6.9e-05; Accession=PF00098.14; Description=Zinc knuckle
  Pfam annotation: Domain name=zf-CCHC; Domain location=38-55; Score =21.7; E_value=0.00079; Accession=PF00098.14; Description=Zinc knuckle
  Pfam module annotation: Pfam domain module=zf-CCHC::zf-CCHC; Domain location=18-35::38-55
MGFAGGSGSKPNTFPTQITCYKCGKPRHISSNCADKGMTCFNYRQRGHIQRDCPYPKKEQNGRGLNDQTGHSKAIRRVFTFNGAEASKSKDLIQVSKDMMFISANQVVTSLKEDAQVYMILSILEIEKNVSMCDLIVVREFPKVFPDVIP

SEQ ID NO: 171536 - protein, 234 aa, Glycine max
  Coding DNA Sequence Number=SeqID_79851
MASRKHKSIGSRPIVQYETRRFSSLDAWTRYTDNVLGRNILPERKVEIYHTELDEFKAELERHNFHKGLTNLVDRSIDLALVKEFCANLYSSEDRPPNQSRVKDYREIEVALCTPGRGFILNSEGHPGKILRKDLTTLAQVWSVLLYSNLAPTSHTSDLTVDRARLIFGLVSRMDMNIGALISGQMTSIAQSNTSRLGFPALITALCRARRVTSDSLTFERLSPIINMAYIKKN

SEQ ID NO: 171537 - protein, 73 aa, Glycine max
  Coding DNA Sequence Number=SeqID_79852
MELQRLNQNEETDKSKRSIALNASSSMQEEEEEEEESNDEEDFSLIVKKFHKFVKNRRIERCHNFNNGKRSQE

SEQ ID NO: 171538 - protein, 83 aa, Glycine max
  Coding DNA Sequence Number=SeqID_79853
MELIENMVASDHAILRDRTHYPTKKSLLELSSQDALLAQNKLLSKQLETLTETLSCTLCGGAHESGCCIPTEELTHEVNYMGN

SEQ ID NO: 171539 - protein, 85 aa, Glycine max
  Coding DNA Sequence Number=SeqID_79854
MTMKKRLSFEVQKVAVGLSVHPPLSAASVCLAPRRIWQSGTMPRAQNSTIHHSVYFEKRALEVARGAAFAEIPRFCKLIIVRLSL

SEQ ID NO: 171540 - protein, 139 aa, Glycine max
  Coding DNA Sequence Number=SeqID_79855
  Gene Ontology: Mol. function=transferase activity, transferring glycosyl groups; Biological process=metabolic process
  Homolog annotation: Hit_ID=Q2HT79; Match level="QueryCoverage=53%, HitCoverage=16%, E-value=4e-21, Identity=66%"; Hit description=UDP -glucuronosyl/UDP-glucosyltransferase
MTNANCPQESLHPVSNGNLRYIYKEWEIGIEIDTNVKREEVEKLVNDFTEGEKGNKMRKKIVELKKKAGEATTPSGCSFMNLDKFIKEEPIKAVEKSHVHHTVGDITTTAFLSASTVVRHAQPTRDKLQWKSRPPHAAK

SEQ ID NO: 171541 - protein, 477 aa, Glycine max
  Coding DNA Sequence Number=SeqID_79856
  Gene Ontology: Mol. function=transporter activity; Cellular component= integral to membrane; Biological process=transport
  Homolog annotation: Hit_ID=Q7WSD5; Match level="QueryCoverage=97%, HitCoverage=43%, E-value=0.0, Identity=92%"; Hit description =Multidrug efflux pump SdeY
  Pfam annotation: Domain name=ACR_tran; Domain location=1-477; Score =152.0; E_value=1.6e-42; Accession=PF00873.10; Description =AcrBAcrDAcrF family
  Pfam annotation: Domain name=SecD_SecF; Domain location=295-473; Score=-104.5; E_value=0.097; Accession=PF02355.7; Description =Protein export membrane protein
  Pfam module annotation: Pfam domain module=ACR_tran::SecD_SecF; Domain location=1-477::295-473
MGLLFLRLPSSFLPDEDQGILLTMVQLPAGATESRTNKVLEEVSDYFLNKEKDNVVSVFTVAGFGFNGNGQNNGLAFVSLKDWGERPGSENKVEAIAGRAMGAFSQIKEGLVFPFNLPAIIELGTATGFDFELIDQGGLGHEKLTEARNQLLGMVAQHPDVLVGVRPNGLEDTPQFKLIVDQEKAKALGVSITTINSTLSTALGGSYVNDFIDRGRVKKVYVQADAPFRMLPEDINKWYVRGTSGQMVPFSAFSSAKWEYGSPRLERYNGLPSMEILGQAAPGKSTGEAMNLMEQLASKLPSGIGYDWTGMSYQERLSGNQAPALYAISILVVFLCLAALYESWSVPFSVMLVLPLGVIGALLAATMRGMNNDVYFQVGLLTTIGLSAKNAILIVEFAKDLMEKEGKGLIEATLEAVRMRLRPILMTSLAFILGVLPLVISSGAGSGAQNAVGTGVMGGMITATVLAIFFVPVFFVV

SEQ ID NO: 171542 - protein, 122 aa, Glycine max
  Coding DNA Sequence Number=SeqID_79857
KTPAPFPYKSDKAVPWRYDIQGSDERQDASVMRVGTGMPAAKIMNISGTSGMTRSGRIFAPPELPAKLKDKGKAKADIGEREKTGLTANNEALVGKFEEEKDDLSKREISAEEATKFLRIIQ

SEQ ID NO: 171543 - protein, 169 aa, Glycine max
  Coding DNA Sequence Number=SeqID_79858
MDMDDVAIWQHSAQRPQCQSPPTDVSVGLCRHDIGIAPTRHPLGFQLWLRASVSPTGCPFPQQGMAPTKTPSGPEKSNRALGFPALVTGLCSPTGCPFHPARSRHHDIGIAPARHPVDPKKSNRVLELPSSNYGQAQGETPQQPGDGRQRATDVPPSPLEFTSAHPQKG

SEQ ID NO: 171544 - protein, 279 aa, Glycine max
  Coding DNA Sequence Number=SeqID_79859
  Subcellular localization annotation: CTP_CleavageSite=71; ConfidenceScore=5.23e-01
MVPLSANLEKLSANPCGNGQLSGPCLAKSPMASRKCKSIGSRPTSQYDTRRFHSFDAWNQYTDNVLGRNILPERKVELYYTELEILRWNWRDLALVKELYANLYSSEGPSPKQARVRGHLVKIDADCLNTFLETPVVLAKDYREIEAALCIPGRGFILNVEGHPGRILRKDLTTLAQVWSVLSYSNLAPTSHTYDLTVDRSRLIFGLVSRIDMNIGALISGQMTSIAQSNTSRLGFPALITALCRAKGVVSDNLTFERLSLIINLAYFRKNCWNPEDLT

SEQ ID NO: 171545 - protein, 86 aa, Glycine max
  Coding DNA Sequence Number=SeqID_79860
MDEDDDNDAGNDLVFEDDDALNWATVKQKAVQENNEDLEFEDIELESEEEEIMINFEASDGEKGEGDTPLPYDNNEEDYVGIEEDD

SEQ ID NO: 171546 - protein, 132 aa, Glycine max
  Coding DNA Sequence Number=SeqID_79861
  Subcellular localization annotation: CTP_CleavageSite=64; ConfidenceScore=5.49e-01
MVLQAIFNGAFLTMSSSSTTLFIGSSASTLVVVDSRHHQFPSLLFLVCGVKAHLLRICGSGIATCSKVTDAYLVDLRRVCEEAENILKSKNVPLPTDKRTPTPPTLPPKRRKSSNIESAFNIEDKNHLRAEI

SEQ ID NO: 171547 - protein, 283 aa, Glycine max
  Coding DNA Sequence Number=SeqID_79862
  Homolog annotation: Hit_ID=A5BNV4; Match level="QueryCoverage=40%, HitCoverage=56%, E-value=2e-17, Identity=42%"; Hit description =Putative uncharacterized protein
  Subcellular localization annotation: CTP_CleavageSite=22; ConfidenceScore=5.16e-01
MASVCTHLTLGMCSCTPSFACSSSTKKRKLCNKANVGSRNKKLKNEDDEVWKIKKVLKESDVGSMSRLILTREMAEKFVLPVLGDDADQIDSGVSVQIWDADTNSMHSLVFKRWVSSRSYVFIGNWIKDFVARRGLRKGDEIGFQWNPFKNGFEFSVLQDGVFSDENSMLVAFSVNLVSVNLCLWVLSPRNKLYYLLSYKSSEFLHGMPTIQIAVPGKRYLRNFRALRVYKIFDNHFSGPIPGSIFSPGKLEVRILTQNNSSGDLPEEIRNWQTLFCVQISSS

SEQ ID NO: 171548 - protein, 196 aa, Glycine max
  Coding DNA Sequence Number=SeqID_79863
  Gene Ontology: Mol. function=binding
  Homolog annotation: Hit_ID=A7QI90; Match level="QueryCoverage=56%, HitCoverage=13%, E-value=7e-20, Identity=46%"; Hit description =Chromosome chr17 scaffold_101, whole genome shotgun sequence
  Pfam annotation: Domain name=PPR; Domain location=81-115; Score=30.1; E_value=8.2e-06; Accession=PF01535.11; Description=PPR repeat
MGGAVEVVATHDSGFDVVLFGSGDGQSSAKNTKTLHAHLLITRDLQSNIFLMNSLLDLYCKSTDMVVSRKLFDTTALPNLVSWNIMISGFDHNQMFEKSLKMFCRMHLLGVEPMSLVIGVFFRPLVLCELQYFANKVDQGFGGGDHGEEEFWEDHDSVLHHAIPNSEKGRRESTEKVNGSRLMGGTSDKILQILRI

SEQ ID NO: 171549 - protein, 84 aa, Glycine max
  Coding DNA Sequence Number=SeqID_79864
MVVSFFETHLLLEVASPLSLPFSIPLPFIFQEAKESIDEEDPRPTSSNGACIILVEGTSTRLFKENKGGYIPCGSLLVKGFLQG

SEQ ID NO: 171550 - protein, 289 aa, Glycine max
  Coding DNA Sequence Number=SeqID_79865
MYLHDQAMIYPPGLHIFRATNVKMVANRVCFHLLVWDASKKKGFKLYYKAQMPSRTFWSQIVWIDSQKTSTSGYDGSDTIVYHDIVQVLQHTRKYHFDDVYVCFIRDDDNYSFIQCLLMLPIIQYEGTYKLKKMTEAQMIAYVTQLYEAQQKQRAEDATAMIAKQEAAEKELTKNGVMDETGKASNAAMIDEIELIILDPTSKQPTILNEAISRDKGDHDAVIVYSTSFSPTPLNYAQPATIIHDQVQDMIGQVIESFAERQWQENKNFYLSMQNAITTHFCNLGVILV

SEQ ID NO: 171551 - protein, 239 aa, Glycine max
  Coding DNA Sequence Number=SeqID_79866
MASTNTLVTKAILTMEITTIHTENEPSIQTISSKVVGVKVVLLSDTIAKATRCLREGITYQEGWENMLLQLSTETMLTRLDLGLDNFDITRKIKKIMVEQQKKKKTMKQSQRDEEENEMLEKRPKESMSLASILPSTIQQWVKTRATKANPKIGDKEWVVSFTGNKEDPSFTSSYGESTDDTPITPLHKTWIFFINGVLCFLKFNGSGMEKEEGDWRCRFKEKMSQEQAHHHRKPWIRA

SEQ ID NO: 171552 - protein, 111 aa, Glycine max
  Coding DNA Sequence Number=SeqID_79867
  Subcellular localization annotation: CTP_CleavageSite=42; ConfidenceScore=5.02e-01
ASSKKGKCAELPPTFIRGKRQKNQKRRGLRTLSVKGEKREVVAAQLAQASWVASTRRHCLLLEHLGRPKEIKCSARSGLKSTCCSQKWHREYLVVIKDLISGTLQGLKENR

SEQ ID NO: 171553 - protein, 541 aa, Glycine max
  Coding DNA Sequence Number=SeqID_79868
  Homolog annotation: Hit_ID=Q2HVW1; Match level="QueryCoverage=22%, HitCoverage=51%, E-value=4e-10, Identity=29%"; Hit description =Putative uncharacterized protein
  Pfam annotation: Domain name=RRM_1; Domain location=29-94; Score =34.0; E_value=5.3e-07; Accession=PF00076.13; Description=RNA recognition motif. (a.k.a. RRM, RB
MGGRGQGQSYGRANWRSRKNITSFYFTCFPDDATEEELWYHFKAFGAVREIFIAKNRNKNGRRFGFVRFEGVKDAQKLEWTLDNTVFGGLKMHVNIPIFGRNKVAKPISNTNKARHDVHKEEAIPRHVQSISTTDHGSYAEVVARNNATSGSRRTAGTTRGNNGTSWSSVYLDIPKSLMKRANETWVGRLKNLAMFDRVEDDLYWDISADISSKYMGADMVLLQGLSDEGAKHMMQEEEEGGLTPFHSLEKWSPKLRIGYRLTWVYCWGLPITAWDMHQIGNIVAAIGDMMDVDDAVELVKRMDRVRVLVKTLWQPYIQHTVNVHIHGEVYIVHIVEENGSNSDTCYGRKGSAYGSSKELESADSDVGTLNGITSNAWMTGEEVEVMVAEPNAELQNPYSTTSTVGPELHMQVQGFSDNTVVSAPTVVTTMAGVQASPPGTQNPVDALLSSGQKNNVNPKGKDVIRCANTPTDNGQSSHSGTCPMDSAATNLACERRDFHEIGIADTIGILIPDARVDHEPERGKLEGEGQHENMKTHISN

SEQ ID NO: 171554 - protein, 1134 aa, Glycine max
  Coding DNA Sequence Number=SeqID_79869
  Gene Ontology: Mol. function=oxidoreductase activity; Cellular component=mitochondrion
  Homolog annotation: Hit_ID=Q0ZHB8; Match level="QueryCoverage=19%, HitCoverage=37%, E-value=9e-78, Identity=64%"; Hit description =Mitochondrial L-galactono-1,4-lactone dehydrogenase
  Pfam annotation: Domain name=ALO; Domain location=236-452; Score= -113.7; E_value=0.013; Accession=PF04030.5; Description=D-arabinono-1, 4-lactone oxidase
MEGSGLESSEAKASSWTRNLELPTFDGSIEGETDSKGNNFECDDDPLQFLKSENRSKEVSVIKNHTLCGGEETKNNEAILVRETKIEKVMMEEEVDPSMKREKHKENKVKNVGCEDHFLDNPIPKMIKKEVEAGDAVKPHSFQDSDFHKKIVMMKQNSLLDPNSIMKVDRTSMMLESWNVNLLDVPLALNFVASMADSSAVELKGEGIGSFPVKLQGVQLSSNNWRKLEEVSVCNSSFQIPTLRTRAEGSRGKSAEDGEQNIDELSFTELRDKLIALDPLNKKHIISINKAEAEFWRKSEGYRVGWSDEILGFDCGGQQWVSEACFPAGKLANPSMKDLEYIEELKLLIEKEDIPAPAPIEQRWTASSRSSLSPASSPSGDDIFSWVGIIMYLPTMDGRQRKDITEEFFHYRHLTQAKLWDRYSAYEHWAKIEKDTERESKRKGVNEYEREPVRERGRSSARDLKESLNGRARYRKSKEDRRRRGHAIHERDFYRPAANHRCINNKHQEDPWIQVGESVNETYLWKLFQEWGKVWEVFIPKSKNKQGQRYGFVRFKGVEDEGGDVVRAWKDSMNPMEPKQPRLNNMPFTSMKSYAEAVKHDHTMKGKEIEVPLSGKNGSEAPVASVTLQTAKWKTNWLDHLWVGRLKNRGMFERAVDEVQEVVGMEVKVSYWGDDMIILHDMDEAKADKINLREQSNGETPLYSIQKWTPELKPEFRLIWIHIWGVPLEIWDAEHFATLLSTFGEIIELDEETADRSRLDVARVLIRTKEKPIFSKSMVAMVNETEHHLFLREEVSRAMGKRQRWSELEAFPPSPFTTTMEDSDEDLTTRIPDGASSEYLGDGCRRRWTKAINLWRAESEAFSDDDVSSHHGELLPAVDLPSCSVRQEDHNGPLIGSLHASGREVRRFTFPGQKQTMIEEKGDEGPKDVDTVKGAVLRAFQHGPEDITSELCPAVKPNSNLSIKEICGSNNNTQNRGMEGVMQDLGLNTNGPVSKGEETAYNLKVYSREKVGAGRKSLGHTNRISKTRRDDNKPSPLDLANSGPIHMEDDLLGGVDAADVVPIPPQTCLSPIPSSSFINVLAEAEEDFHHEVARHLGLTFDEHKASFDNMKTVKDISETVVASPAMMGRDNLAS

SEQ ID NO: 171555 - protein, 207 aa, Glycine max
  Coding DNA Sequence Number=SeqID_79870
  Homolog annotation: Hit_ID=Q1SN17; Match level="QueryCoverage=62%, HitCoverage=28%, E-value=1e-12, Identity=30%"; Hit description =Transposase, putative
MDEDQWMHDNIMSEEIDMNEQNEDEDGMKSEHVDCFDAFNTSQVFATCDDVLNWARAVVYEISFEYRSRKKDFVRRDTNSRKCECPFKLCGKSMVGGQGWMMKLTCGSHNHEMTKSLVGHPYVGRLTKDEKIIIVDMTKSMVFLRDYCPLPPLALLWSRHYHPQAKLMRIMKLAKYRLKAQVEKDEGPSGEGQSPRVEKDEGPSGEG

SEQ ID NO: 171556 - protein, 252 aa, Glycine max
  Coding DNA Sequence Number=SeqID_79871
  Homolog annotation: Hit_ID=Q2HSI5; Match level="QueryCoverage=45%, HitCoverage=31%, E-value=1e-13, Identity=39%"; Hit description=IMP dehydrogenase/GMP reductase, putative
MVRTRSLSRALGKCWIYEHFSFVAEAITAKDYHERKPCAYCWTSGKALPMSTYRKRLDRLIFDGVCWMAYDDHHEVREFELVSLFSEHIRWGPIVVIHWPERVVRQFRYVQTIPPYSPDLGCAWTVCSYIDWLYMISHPFMRSAQPGDPVRHPSIMQDDTYVEPDIPQYSMVAATMEEALADAHSHVERPRHAVDGCQAIVERLERLMNLRIVTEDTKAYSVMEDCLRIVRGVTAKHNVYVQSRRRQRMKDA

SEQ ID NO: 171557 - protein, 79 aa, Glycine max
  Coding DNA Sequence Number=SeqID_79872
MEVLMIQAKIEEDEEEFVEMEDLLHKTIRVEQQLKRKGVAKRSSTNYGSSSWKDKGKGVSISNATPIPSKTPPRFQEQS

SEQ ID NO: 171558 - protein, 77 aa, Glycine max
  Coding DNA Sequence Number=SeqID_79873
MHIECMSGRNSHIDQGSLIGLPKWMGDEDKASNKDKEPLEGLGGPMARARTKKAKEVLQQVLTMLFEFRPKLQVEKL

SEQ ID NO: 171559 - protein, 278 aa, Glycine max
  Coding DNA Sequence Number=SeqID_79874
  Homolog annotation: Hit_ID=A4DID9; Match level="QueryCoverage=19%, HitCoverage=49%, E-value=7e-19, Identity=80%"; Hit description =Putative uncharacterized protein
MVIGSRTQGAPAFSGRYSAEVIHAILPGKARTTFNKWVPVPETDTGVPPHKGGRSDQARATVYQKHRSPQSREPTTEAPVNGGRNYNGPKVAKFLVGLGEIDMSVKMRTTCTWTERPYEASLFPGIGFGLFLRSLGGGQRRPPSGGARAISNGRRAKGFLGPRRRLALECKDRRELDCKTHPSSRDETHIDGKVWHLDVGSSPPGAVVCSKGWAVRPLKRYVSWVQNVVRQFGPYPDREGRTSGVPVIVPTVNAGASGSTAETAMGSLPQRGWSGGIL

SEQ ID NO: 171560 - protein, 124 aa, Glycine max
  Coding DNA Sequence Number=SeqID_79875
AFASFASNHHDHHQNTKVICFYSFDLQSIMSVDEFLSQVAWPGVQPSPSGGGKASAAQKPAPAEELVPIADDELVPPKLFIFETDPVAQEEAAAPRVSLHLSGPVFESRQYIYQNAQNETLSVV

SEQ ID NO: 171561 - protein, 95 aa, Glycine max
  Coding DNA Sequence Number=SeqID_79876
  Homolog annotation: Hit_ID=A5AYU6; Match level="QueryCoverage=70%, HitCoverage=12%, E-value=2e-09, Identity=40%"; Hit description =Putative uncharacterized protein
MASLNSLFFKSIFRNRLFQDHDEDQANFCLMTKSHENNKEEFVRNKWYIDSGCFKHMTGDVSKFTTISPKKNGHVTYDDNNISKISKEVTSKPSL

SEQ ID NO: 171562 - protein, 39 aa, Glycine max
  Coding DNA Sequence Number=SeqID_79877
VLVAPNKVIRPPTNRAFIKKYCTPRQAQGDTPQQPEDGR

SEQ ID NO: 171563 - protein, 165 aa, Glycine max
  Coding DNA Sequence Number=SeqID_79878
  Gene Ontology: Mol. function=RNA-directed DNA polymerase activity; Biological process=RNA-dependent DNA replication
  Homolog annotation: Hit_ID=A5BQD3; Match level="QueryCoverage=75%, HitCoverage=28%, E-value=3e-12, Identity=27%"; Hit description =Putative uncharacterized protein
MYQQGIALTWTIWKQRNDVIFSNGSFNTKRILDDAIFLLWTWLTHLEKDFGIHFNQWSSNIRAGFSNRKKIAWISWRQCCASRDLGGLGIKDIKILNNALLIKWKWLMFHQPDHLWNRILISKYKGWRGLDQRPQKQYFSPWWADLRAINQHQSMITASNQVCWK

SEQ ID NO: 171564 - protein, 80 aa, Glycine max
  Coding DNA Sequence Number=SeqID_79879
MRIQGTNRLRILCPNTLEGTSFVAQVEGTSTWVVILRTREGTSLVDQFKWRIHPLGCSKRTSEGTSLVDLWQLKNISGIL

SEQ ID NO: 171565 - protein, 179 aa, Glycine max
  Coding DNA Sequence Number=SeqID_79880
  Gene Ontology: Mol. function=phosphoprotein phosphatase activity
  Homolog annotation: Hit_ID=A7UQU7; Match level="QueryCoverage=83%, HitCoverage=26%, E-value=3e-20, Identity=38%"; Hit description=IMP dehydrogenase/GMP reductase, putative
  Pfam annotation: Domain name=DUF1723; Domain location=123-172; Score =61.1; E_value=3.7e-15; Accession=PF08330.1; Description=Protein of unknown function (DUF1723)
MEEDVPQVTEDVPHMADDVAQMSEDAPQMTADVDATVAEDLGHDGAEGSRADEGFPGGPRDPSVLTSFAKHVAHAIWTGQERLELKLVSHGRKVTLIGRPVPAIERLVVATGLSPLIECSVVTGDPGLISIFVERWHRETNTFHLPVGELTITLDDVSSLLHLPISGAFHSFPALSVDE

SEQ ID NO: 171566 - protein, 358 aa, Glycine max
  Coding DNA Sequence Number=SeqID_79881
  Homolog annotation: Hit_ID=Q84VI1; Match level="QueryCoverage=100%, HitCoverage=52%, E-value=1e-144, Identity=75%"; Hit description =Envelope-like protein
MATSPKETAAPGSPAVPSSPHQEQPEFNIQPIQIIPGQASVPEKLVPRRQQGVKIAVNPSLATSSREVDTEMDKKIRSMVSSILKEASVPEADEDVPTSSTLNVSMPDVEKDVPTSSGPNDEVLSSPSKERSTEEDDQAAEETPAPRAPEPAPGDLIDLEEVESDEEPIANRLAPGIAERLQSRKGKTPIKRSGRIKTMAQKKSTPVTPATSRRSKVAIPSKKRKEISSSESDDDVELDVSTSKRAKKSGRKVPGNVPDAPLDNISFHSIGNVEKWKYVYQRRLALERELGRAAMDCKEIVDLIKAAGLLKTVSKLGECYEGLVREFIVNIPSDISNRTSDDYHRVFVRGKCIRFSPA

SEQ ID NO: 171567 - protein, 153 aa, Glycine max
  Coding DNA Sequence Number=SeqID_79882
ITGLCQSFGVPIAPSKVIRPPITRAFIEKYCTPRQVQGGAPQASDAPPPPHQADPAGLFDTERYLRHLVRQQAANHRAHVQTHDCLYQLSLSLQSQGFAPFPCPTLDQFRAEVAWPEAQAGEAPAEAPDDGEEARMDEEMTDLLDFLGGSGAT

SEQ ID NO: 171568 - protein, 57 aa, Glycine max
  Coding DNA Sequence Number=SeqID_79883
MGFPLPAVTYLAENLSGLKAKVQQGLRLCLNGVFYRGNPNLDIWGETNLGVKVSISG

SEQ ID NO: 171569 - protein, 100 aa, Glycine max
  Coding DNA Sequence Number=SeqID_79884
MNKGKSDLSHLLSVKKHTIDKTGLEYNKKTDFSNRTKFASSKKLNPNKVSKMKNILHPKPNAKTCHYCMKRGQTSYKCYVRRFDVPRGVPKSNRLTMVLG

SEQ ID NO: 171570 - protein, 195 aa, Glycine max
  Coding DNA Sequence Number=SeqID_79885
  Homolog annotation: Hit_ID=UPI00006A2D9E; Match level="QueryCoverage =100%, HitCoverage=88%, E-value=1e-11, Identity=18%"; Hit description= UPI00006A2D9E related cluster
MTDRLNESISCFLIRRVHAFTFRGLHVLAIRGLHALAIVRLHTLTFRGLHVLTFRGLNAPAFVGLHALTFRGLHVLTFRGLHVLVIRGLHVLAIRGLHALTFRGLHTLAFVGLHALTFRGLHFLIFKGQHVLTFRGRHALSYTSSPSEGYTSLPSEDYTSSPSEGFTPSPLEDYTSSPLEGYMSSPSEGYTPSPS

SEQ ID NO: 171571 - protein, 71 aa, Glycine max
  Coding DNA Sequence Number=SeqID_79886
MLLELWVEENPTLLLEQTWVLKAQSFLCCQLTSLTRVTRRAKFPSVPEIKTVELVKATGWVYLSLSGADPR

SEQ ID NO: 171572 - protein, 141 aa, Glycine max
  Coding DNA Sequence Number=SeqID_79887
  Subcellular localization annotation: CTP_CleavageSite=59; ConfidenceScore=5.69e-01
MVKVGNLLTCRSTSHFPPKSWPRASPVSTGTPGILFISANCPSCSATDGVVRNGKSPPRTSALASVAVPLRVTTTPAALNAPLQGASHSPFRLRNCWEGRSVRASSLLRQLAKGGCAARRLSWVTPGFSQSRRCKTTASEL

SEQ ID NO: 171573 - protein, 603 aa, Glycine max
  Coding DNA Sequence Number=SeqID_79888
  Gene Ontology: Mol. function=transporter activity; Cellular component= membrane; Biological process=transport
  Homolog annotation: Hit_ID=A8GBB1; Match level="QueryCoverage=26%, HitCoverage=22%, E-value=3e-47, Identity=59%"; Hit description=TonB -dependent siderophore receptor precursor
  Pfam annotation: Domain name=Plug; Domain location=505-603; Score =59.3; E_value=1.3e-14; Accession=PF07715.6; Description=TonB -dependent Receptor Plug Domain
  Pfam annotation: Domain name=UPF0089; Domain location=268-533; Score=- 121.1; E_value=0.095; Accession=PF03007.7; Description=Uncharacterised protein family (UPF0089)
  Pfam module annotation: Pfam domain module=Plug::UPF0089; Domain location=505-603::268-533
PIEGFVEDQQVRLGHQRPAQQGFARFAGGEVFEAARQQGGDAELRGQPLTARGVLHLFLNDFRRGAAGVVLVRAEQIGVVTLPLVADHFLQLFEGDAHRVLKVAAALTAQQNQFVGQRARQGGFAAAVGADEGPAVAGLDFQRVQRQGAGVLQGDVNQQKRNVTLRLTQRGDNHAIGVEQGVYGGADAQLQALQLRRRQGGAQGFATRQRHQHLAVFGARLNAGHHARQRVIRAGMLRGRLDQRQHLFARRQLQPVGALLGDGRRQASGAVIQQNRQVLLHLLMIAFDDGTEELIARAGLQREARDGRQQAVERQIVLLQHVESFLLHLAQQVIQLDQPLAIVRQLCAAAAFTAGGAFHHRVFRQLVHLIDGVPGAFVADARQFGALADGAGVLHLFQQRDAARIGEQLLLEFESQKNFGLHSASWMLHMSTTRRRLVTPRKSLCLAAAWVGGALTAPLAFAADCDKSRNATGCEEQLTVEAAAPAGRYDALSAVSRSASQLGLTARETPRSVDIISARAIQQRGDRSLAAAVEHATGLSGVASPTLSNNFSARGFRPIAWLYNGVEMPGSTLQLGDPAHYDSIEILRGPGSALNGLSAAGGS

SEQ ID NO: 171574 - protein, 229 aa, Glycine max
  Coding DNA Sequence Number=SeqID_79889
SKPLGVFYPIPLGGRIASIHVRSEAIARVSIKKSRLGPTLGWDRRQNNQLVSSMEGRKGGSSLLMWGLPEHPVDRNEGGAPAEESLSPFLVRYFGAQSFKVIQRVHKAWESPLRKDKELRGIHNGIIGEEDEEVRALKTELGKARLAKEKIKLVATDIWKECAELREENAATARALEQETKRARKEEHGREKFRGALWGSNNELKLRREERDQSRAHSMVLKEELAACS

SEQ ID NO: 171575 - protein, 76 aa, Glycine max
  Coding DNA Sequence Number=SeqID_79890
MATEWRWKRERRHHFKDKMSLEEAHHHRRPWIRAWRKKEMNEGRGREEHEILCSKRALKSEPTNPRSSPRFSTKCA

SEQ ID NO: 171576 - protein, 252 aa, Glycine max
  Coding DNA Sequence Number=SeqID_79891
  Homolog annotation: Hit_ID=Q6WAY6; Match level="QueryCoverage=78%, HitCoverage=37%, E-value=6e-25, Identity=36%"; Hit description =Putative uncharacterized protein
ELDHKKQVENGEVGIPRKYLEAKARILAGKGEWAPFIDILALLIFGGVLFLNVDGLVDLAAIDAFLAYHNHKESPVVTMLVNLYDTFDRRCEKSNTRIVCCTPALYVWLVSHLFRQEEHLSTGSLDGRKEEPEFLSCGGFPNVPLMGMRGCISYNPVLAIRQLGYPMRGAPLEDELTPVISRDFNKTNIETVQKVRKAWEVLQKKDKELRGSNNGPIGVVKSPRARTAKREEVEAPEEDKEVQALRAELEQA

SEQ ID NO: 171577 - protein, 171 aa, Glycine max
  Coding DNA Sequence Number=SeqID_79892
MGDQEETQEQMKADMSALKEQMASMMEAMLGMRQLMEKNMVTAAAVSSVAEADPTLLATAHHPPPNTVGRGRSILGHNSNPHLGYNRVAYPYGFPPNYTPPVMQDDAGHVSSPILEGEPPRQPDEVHKDHQEYAQGDVEFYPPIPVKGPSPNTLPLPNLAMSSSPQNSGIL

SEQ ID NO: 171578 - protein, 151 aa, Glycine max
  Coding DNA Sequence Number=SeqID_79893
GKHFLRGFLLWATLPIRYGSNGGPGNVREWLRAQNGFRKGQRWHNLPDKRQGKSWEVWVRLQTHTGRYKEKRCGKENGSQGSRLRQEDEGNPPCHISRSFISAGLGDEGQVVAICEDNAPSGSDLVRPCLLDFRLGNWGVEERPDIYATSI

SEQ ID NO: 171579 - protein, 191 aa, Glycine max
  Coding DNA Sequence Number=SeqID_79894
ALKAELEKAQTVKEKFKSAAIRIQKENAELRDVNIATTKALEQETKRAHKEEHGRNKFRGALWGSNSELKLQREERDQSRVEGLILKDELKACLRSKRSLSQRLCETETNMLAIISKYQEELNLARVYTEKKARGRVINSLHQEATMWMDRFALTLNGSQELPLLLAKAKAMADAYSPPRRSTGSSAIVSI

SEQ ID NO: 171580 - protein, 116 aa, Glycine max
  Coding DNA Sequence Number=SeqID_79895
  Homolog annotation: Hit_ID=Q1SN16; Match level="QueryCoverage=68%, HitCoverage=32%, E-value=6e-07, Identity=40%"; Hit description =Transposase, putative
MPMLDQFHPCSHDSIENIVDVKADGNCGYCAITALLVMGEDSWSLVRSHLLKELAKWSDEYINVLGGIDRFEELKRSLLVDGLSMAKQCPTSYISRMQQYKNLLMLKTDFVDLSED

SEQ ID NO: 171581 - protein, 214 aa, Glycine max
  Coding DNA Sequence Number=SeqID_79896
MARIADKIKTIDGSKETLKLAVRITDLWFVGTPSRSEQAEMIIVDSDTSLVLLTRLSFVIFHLELVVFHLHWIQLMLSFLSGTGSYPCSVSNSLKASKLTINEPLAPIEEFNQKLSELGIEIRSILTHRSQWSSQPSGYAQLPSRETFISKSKAKSISEINNLCEEFVCVTVGTITRILMDNHSWCYPSCIQCYKKIDVYLEPFVCPCGKQGIL

SEQ ID NO: 171582 - protein, 68 aa, Glycine max
  Coding DNA Sequence Number=SeqID_79897
MVKHGVMEVVGVEGHGYVNGGGGRGAAVLTVAGGGLPEERELRGRTTDNNNLTVLNNFNGVDLLGIKW

SEQ ID NO: 171583 - protein, 35 aa, Glycine max
  Coding DNA Sequence Number=SeqID_79898
MVYIATHAKLERRDFSNEEEKEVELLAMEGRTVAG

SEQ ID NO: 171584 - protein, 97 aa, Glycine max
  Coding DNA Sequence Number=SeqID_79899
MKYGVKSLVRKSTPMKKIIYNGLDNEITLTYLGTKFVLHSQTPSQVAKDQVQIKLKWDKEKNRKRKEEQPLMVKEECKEISVSTKRLAKKESHFTMA

SEQ ID NO: 171585 - protein, 48 aa, Glycine max
  Coding DNA Sequence Number=SeqID_79900
MGDVQEAATNGISQSDVAPCRACRPQIFIINGVFYFLKINGSGMEKEE

SEQ ID NO: 171586 - protein, 244 aa, Glycine max
  Coding DNA Sequence Number=SeqID_79901
FYPMPLRGRIASLSLLTLKYELFNMEEGEDIQTMFGRFQNILNKLHSLAIKNLDSITLEELVGILKVHELELAQDEGTKKGKSLALTIQRPKHNSASKALVVNDASKEESDEEDDELRHFKSECPDIEKLKDKKKKFFKSKRKTLMSTWEDLGNSSSKEESREEANLCLMADASTSKAKPALDASSDDEDSQPDDTINSNDGSVYEEVKVLLDEKVSSGHKTLKNFQDLEERVKSLTTTLEDPK

SEQ ID NO: 171587 - protein, 182 aa, Glycine max
  Coding DNA Sequence Number=SeqID_79902
MECKLHPSKVAAKAVTLSIKPSTSGAIPKDHQELFFQRFKAILDWRLCLERSVIIIECIGYYSECARAKTNGHLKRWVYAHRWFYQLAGSRHSHVRGAWSICIRRWGLSANSLKKGYWKNLRLDYLKLGLMLHQVLLRDQSIRDAFTVLETLLMLINMEMRTSFSICKDLTVALKMLQRLTD

SEQ ID NO: 171588 - protein, 91 aa, Glycine max
  Coding DNA Sequence Number=SeqID_79903
MARKKVSERERERSLLPREKEKWKKKKKNEKTWDEDWKRRHLQQYVEQPREWEMKRLEKKTPGTIREATKGVGNEKVKRPKNQENGQLSQP

SEQ ID NO: 171589 - protein, 112 aa, Glycine max
  Coding DNA Sequence Number=SeqID_79904
MPSKVILMMPKNEELSKFQRFKNQVFKNQDQDSRIKRRLNQDKVHLLGDCYTESKKGYISCRSVQVEGTSTWFFKENKGGYFPCGSLACKGFYKVDQEPQVAWGLDVSTVCG

SEQ ID NO: 171590 - protein, 159 aa, Glycine max
  Coding DNA Sequence Number=SeqID_79905
LLGVGVQRQATAARGGHSWSWVVEKKVLGFGELVSPSGRPLFALSVTIRAECNSPCAKRDNSRSVQFPLGKMATPPNSHPPPPPTDSHSPSTMKRLRKETRLRSLATRPVGAKRPLVHVDPATEKADDPHRKKLRTYLGIFARDKVDVTYENWKEVPAT

SEQ ID NO: 171591 - protein, 332 aa, Glycine max
  Coding DNA Sequence Number=SeqID_79906
  Homolog annotation: Hit_ID=A5B5V0; Match level="QueryCoverage=76%, HitCoverage=56%, E-value=4e-07, Identity=21%"; Hit description =Putative uncharacterized protein
  Subcellular localization annotation: CTP_CleavageSite=12; ConfidenceScore=5.43e-01
MAESSKKHKGLSSSTTTTGQRRHGASGDFPAPPNPSLSSPCSLTLFSFDDQHQRYYSSFSNRAILDPKFLDFDFFEDETFDCYQVFQNSELVNFMTLKFPYYSELVQFFYNNLEICEGIIFSEVHKISIVVDQSLFYSLTKLSSQGVPFEGALVDDWKSIYSSHDARKIVCDENVDKTGCLLVGSFTFECRIMHYILCQVMFPRSTNLAQASEKVLILLWALQTGRQIDWAHLVHYRMHKALRKNTPLSYPHLVTLILQHFNIPLANEPFVKVQRSFAIGAAAVASFGYRKDLDGQWVHKQDLSTNAPDERTPSPPPRDPSSSLLNDVLSEL

SEQ ID NO: 171592 - protein, 238 aa, Glycine max
  Coding DNA Sequence Number=SeqID_79907
MEVFGIKMVIDQSLFHDLTQLSSDGVPFEGTLNGDWKFDFSAHDARQLVCTNHADMTGRLLAGSLAFESHILHYLIVRILLPRSSNLAQVSKEDLVIMWAFHTGHQLDWAHLVRYRMHKALQLNAPLPYPHLRSFLIGAAVIASFGYRKEHDGSWVKKGAQPADEEGNLPVEDNSTLLRRLMDKFDGFQTFVGDKFDAMELQVDMRFDAMESRITKVEEDVSFIRTCFDPPPPPPSSS

SEQ ID NO: 171593 - protein, 307 aa, Glycine max
  Coding DNA Sequence Number=SeqID_79908
  Homolog annotation: Hit_ID=A8GI63; Match level="QueryCoverage=61%, HitCoverage=99%, E-value=6e-89, Identity=85%"; Hit description=Smr protein/MutS2
  Pfam annotation: Domain name=Smr; Domain location=123-204; Score =98.2; E_value=2.6e-26; Accession=PF01713.12; Description=Smr domain
MPLTIPGLQPWQGVLQSTPFPAVKAAVQERWKMSEQEKDFFEQAMADVVPLASGRQTLYLKPQETVDKSARREAQRLRQENFLSTDFLEVIPCEQPLEFKGEGIQQGVLDKLRNGRYPPQASLNLLRQSVEASRQALFRFIVQAEAQNLRSLLIVHGRGRQNESHPNIVRSYVAKWLAQFEQVQAFCRALPRDGGEGACYVTLRKSAQARAENFERHAKRSLQRITAGAGHRQQQQAANDADVFKEVDFVAHHFHAGHFPERMADKRGAQNILGENDRDRASKQTENKRDAENKLHQHGNDRRQIMH

SEQ ID NO: 171594 - protein, 49 aa, Glycine max
  Coding DNA Sequence Number=SeqID_79909
VEEKSPEFQEPRDLRSNPFQGGGNDAILPRKGIGQKTPRRLGQRYKRRP

SEQ ID NO: 171595 - protein, 97 aa, Glycine max
  Coding DNA Sequence Number=SeqID_79910
MVPLSATSKELSANPCAVWFLYLQMSSRKRARTDDILSSSIPAPQSVAIELDVQHPQTLVPMLQSLFKGQLIIMHNLRELAQNRPIIPLEYFLEKVV

SEQ ID NO: 171596 - protein, 76 aa, Glycine max
  Coding DNA Sequence Number=SeqID_79911
AGRDTTTAWGWPATGNKCTAATSKAPQLIHKKVRALPMIHGRPIGDQVQGQRRPAQDVKEALLGGNLVTFKSLLVT

SEQ ID NO: 171597 - protein, 159 aa, Glycine max
  Coding DNA Sequence Number=SeqID_79912
  Homolog annotation: Hit_ID=A5AK77; Match level="QueryCoverage=55%, HitCoverage=11%, E-value=3e-09, Identity=37%"; Hit description =Putative uncharacterized protein
MTRDNPGDLQPFDPKIDRTFHRLLRHSVHPDHFVHFEHSEYSVAGDFEYSDFEHSTTNFHTENMAQPPPRERTLREMAAPNFTYESLCIQYPDEGVPYVLKTGLIHLLPKFHGLAGEDPHKHLKEFHIVYSTMKPPDVQEDHIFLKAFPHSLEGVGKDW

SEQ ID NO: 171598 - protein, 26 aa, Glycine max
  Coding DNA Sequence Number=SeqID_79913
MGTVTNVLLMKVFPVPPNSYRKNMPP

SEQ ID NO: 171599 - protein, 64 aa, Glycine max
  Coding DNA Sequence Number=SeqID_79914
ESNKAASKDKHCFKINTRLLQQTKSCFKIKPCLKTKGFKVIQGTGNRLPGNVIDYKKGSLKNNY

SEQ ID NO: 171600 - protein, 118 aa, Glycine max
  Coding DNA Sequence Number=SeqID_79915
MAPTRHPLDPDKSNRALGFPALIIGLCQSFEVPVAPSKAANHRAHVQTYDCLYQLSLSLQSQGFTSFPCPTSDQFRAEVAWPEDWPKAPAEAPDEADEAREEEEMTDLLDFLGGSRAT

SEQ ID NO: 171601 - protein, 68 aa, Glycine max
  Coding DNA Sequence Number=SeqID_79916
  Homolog annotation: Hit_ID=A0ST23; Match level="QueryCoverage=39%, HitCoverage=55%, E-value=2e-08, Identity=100%"; Hit description =Putative reverse transcriptase
MMKHNSNILIERDNIEGGPVGKPVVPAALMNRPTRGERRFAYWALAECILAYYVGTDEGVSEVLHVAG

SEQ ID NO: 171602 - protein, 211 aa, Glycine max
  Coding DNA Sequence Number=SeqID_79917
MAPRKLASKRSRKDKAAEGTSSAPEYDSHRFRSVVHQQRFEAIKGWSFLRERRVQLRDDEYTDFQEEIGRRRWAPLVTPMAKFDPEIVLEFYANAWPTEEGVRDMRSWVRGQWIPFDADAISQLLGYPMVLEEGQECEYGQRRNRSDGFDEEAIAQLLWRRVRIMRTNMTALTQIWMTLLLSNILPTDHNSDLPMPKCQLVYAILTRMSIH

SEQ ID NO: 171603 - protein, 257 aa, Glycine max
  Coding DNA Sequence Number=SeqID_79918
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLTWTVKCNPEYDGMILLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 171604 - protein, 297 aa, Glycine max
  Coding DNA Sequence Number=SeqID_79919
  Homolog annotation: Hit_ID=A5B5V0; Match level="QueryCoverage=81%, HitCoverage=54%, E-value=2e-11, Identity=24%"; Hit description =Putative uncharacterized protein
MDFFSNESFECIQAFENSNLIPFMSLKLSIYSDLVKAFYSNLEIQEGTLISKVYGIKMVIDQSLFYDLTQLPSEGVPFEGTLIDDWKFNFSVHDACRLVCTNQVDMTGRLLAGSLAFESRILHYLIARILLPRSSNLAQVSEEDLIVMWVFHKGLQIDWAHLVRYRMHKALRLNSTLPYPHLVTLFLQHFNIPFDSEPYVPIKRSFLIGASVIASFGYQKEHDGSWVKKGARHVGEEGRDGEDSSLLSKILDRFDGLQTFVGERFDTLELQVDMRFNEMESRITKVERRCLLYSFKL

SEQ ID NO: 171605 - protein, 374 aa, Glycine max
  Coding DNA Sequence Number=SeqID_79920
  Homolog annotation: Hit_ID=Q6WAY4; Match level="QueryCoverage=39%, HitCoverage=25%, E-value=2e-16, Identity=35%"; Hit description =Putative uncharacterized protein
EVFTEAVVSLAQYYDQPLRCFTFGDFQMVSTIEEFEEILGCPLGGRKPYLFSGFLPSLNKIAAVVGDSAKEMDRMKQTWNGVVGLPRKYLEGKARDMANQEKWGPFADILALLIFGVVLFPNVDGLVDLAAIDAFLAYHHSKESPVVAILADLFDTFDRSAGLSVVYPLFVCGWFHTYSNKTQDTRVHFKVIAHAPKKEESIGTNIWLDRRATQSIGFLMKEGKEGVSFLLGYPMRGAPNQNGKVSRLSFIERLKVIQRVQPQGVEKSVEEDKELRGIRNASSVENFEAPEEDEEVQALKLELGKARLAKEKFKSTATHIRKECTELQEENAATARALEQETKRARKEEYGREKFRGELWGSNNELKLRREERD

SEQ ID NO: 171606 - protein, 108 aa, Glycine max
  Coding DNA Sequence Number=SeqID_79921
MIGPLNESISCFLIRVDPWVLVPSPSEGYTPSPSEGYTLSPSEDYTSSPLEGYMATRPPLQRTTRPHLQRATCPPLQRTTRPRLQRATCPRLQRTTRPRLQRATGPRL

SEQ ID NO: 171607 - protein, 174 aa, Glycine max
  Coding DNA Sequence Number=SeqID_79922
MKFYCYVNRENDDTSALKRKVQSLIEVEWLTFQEDGPNIKTNPLANQGRGAFNAIEASSSRGPKPLKDVTTSRRFIYEALQKSGMIPRGGHKKDSCLMHPSTSHNMEACSAVGDLLQQMIYQGRLEVSSEGEEEQHICMQFADREGPKKPKPLVIHFTRDKAPQRPRLPSAISS

SEQ ID NO: 171608 - protein, 241 aa, Glycine max
  Coding DNA Sequence Number=SeqID_79923
  Homolog annotation: Hit_ID=A7UQU7; Match level="QueryCoverage=31%, HitCoverage=13%, E-value=7e-07, Identity=41%"; Hit description=IMP dehydrogenase/GMP reductase, putative
EKLATQLAQASKVASSRSNRLLEEESGRPKQQELVPIAEDAPDVTEDAHAQAEEVVDDAEGFPGGPRDPSVLTDYGDHVAIIVWNREECPELKLSSHGRKVQKFGRPAPEIEGLVVATRLSPLIACSVDTSDQGLISTFVEIYLKSPERKLELRQHNVMGHTYSYRGYEIFIRVNMRPDIGLLQLSGSYAWGAAVLVHMYDNLNDVCKSDNQQLAGYITLLQHFSSVAESLTDPDYDEMSP

SEQ ID NO: 171609 - protein, 155 aa, Glycine max
  Coding DNA Sequence Number=SeqID_79924
MQQQGAHFAKDYSFVDYHWESEWQPYYHNEAEGLSNLDDLLMQFKDPIDSMQQAFKRAETQIYKLVDDMTKVLVRREEEYAEIETHQESILQVNTIHHQLMTKEEKDEVFIIPEYPCMATTGYVVGKFQRIKELFNQESRFKKRIKRRLKICKNH

SEQ ID NO: 171610 - protein, 354 aa, Glycine max
  Coding DNA Sequence Number=SeqID_79925
  Gene Ontology: Mol. function=homocysteine S-methyltransferase activity; Cellular component=intracellular; Biological process=folic acid and derivative biosynthetic process
  Homolog annotation: Hit_ID=P37586; Match level="QueryCoverage=84%, HitCoverage=24%, E-value=1e-137, Identity=80%"; Hit description =Methionine synthase
  Pfam annotation: Domain name=S-methyl_trans; Domain location=63-352; Score=429.9; E_value=3.6e-126; Accession=PF02574.7; Description =Homocysteine S-methyltransferase
METIFVFNGMNANAGLLVGSAGRFAAGGRKRYDWLAFSQRNDVDGARVSNKTATLQQQLAQRIMILDGGMGTMIQSYKLDEQDFRGSRFADWPCDVKGNNDLLVLSKPDVIREIHDAYLAAGADILETNTFNATPIAMADYEMAALSAEINFEAAKLARACADAWTAKTPDRPRYVAGVLGPTNRTCSISPDVNDPAFRNITFNQLVDAYRESTHALISGGADIIMIETVFDTLNAKAAIYAVQSEMEAMGVTLPLMISGTITDASGRTLSGQTTEGFYNSLRHAEPLSFGLNCALGPDELRQYVQELSRIAEGYVSAHPNAGLPNAFGEYDLDAATMAAQIGEWRAPASSTLS

SEQ ID NO: 171611 - protein, 219 aa, Glycine max
  Coding DNA Sequence Number=SeqID_79926
MAPRKLASKRSRKDKAAEGTSSAPEYDSHRFRSAVHQQRFEAIKGERRIQLRDDEYTNFQEETGRRRWTSLVTPMAKFDPEIVLEFYANAWPTEEGVRDMRSWVRGQWIPFDADAIGQFLGYPLVLEEGQECEYGQRRNRSDGFDEEAIAQLLCIPGQDFAQTAAGRRVRIMRTNMTTLTQIWMTLLLNNILPTDHNSDLPLPKCQLVYATCQAPFRPG

SEQ ID NO: 171612 - protein, 153 aa, Glycine max
  Coding DNA Sequence Number=SeqID_79927
MVARVMLGGNRGKFELGYRPTQADIRKSISERKNKGQSPRLGQQAEGAPPCHISRSFIGAGFRHEGQVAAICEDDSPRRSDLVRPCPPGFRLGNWRVEERPDVYAISIISNDESLEGTNTRDPAVNFVQETGRMESEEDEDVGLPPEMERIIA

SEQ ID NO: 171613 - protein, 296 aa, Glycine max
  Coding DNA Sequence Number=SeqID_79928
  Gene Ontology: Mol. function=peptidase activity
  Homolog annotation: Hit_ID=Q2PEU4; Match level="QueryCoverage=100%, HitCoverage=98%, E-value=1e-106, Identity=64%"; Hit description =Putative uncharacterized protein
  Pfam annotation: Domain name=OTU; Domain location=160-288; Score =101.7; E_value=2.3e-27; Accession=PF02338.10; Description=OTU-like cysteine protease
  Subcellular localization annotation: CTP_CleavageSite=53; ConfidenceScore=5.31e-01
MLGVLCATRPKPWLLSLVHVHASLPRLPHSPLSPSASPPPRRRHSTACKLFLSGGAAASIWHAIMPRGDDGLRRGVVAVHDLKGEGSWNVAWDARPARWLHRPDSAWLLFGVCACLAPPPGCVDADTNSAGIAVDESCGLLDKEREEDEVSADYRVTGVPADGRCLFRAIAHGACLRNGEKAPDENRQRELADELRAKVVDELLKRREETEWFIEGDFDTYLQRIQQPYVWGGEPELLMASHVLKTPISVFMRDTGSVELVNIAKYGEEYRNDKDISINVLFHGYGHYDILETLRP

SEQ ID NO: 171614 - protein, 191 aa, Glycine max
  Coding DNA Sequence Number=SeqID_79929
  Gene Ontology: Mol. function=DNA binding; Cellular component=nucleus; Biological process=regulation of transcription
  Homolog annotation: Hit_ID=A7PPI6; Match level="QueryCoverage=79%, HitCoverage=25%, E-value=7e-14, Identity=38%"; Hit description =Chromosome chr8 scaffold_23, whole genome shotgun sequence
MTEPSETLFSSHPVSSVHFLFLFLSHYCLWGEDMGDPYGLPEDLRRLIPARSTHLNPSNTHLLEPLCLHHGLSSAVSSATTPHTSFDPNMVGDVFFPRGFTHHFAHHHDYSSSSGVNPVVTATAAATTTVSDHAFCSMESAEKGWFGFDSGNNRWPRQETLSLLEIRSRLDSKFRENNQKAPLWNEISRYI

SEQ ID NO: 171615 - protein, 74 aa, Glycine max
  Coding DNA Sequence Number=SeqID_79930
MFTMLRLDLEAIGKDLLAAFSGFEAVAPKMHAFLVDMRVEGESENGGVKGLRVIVSKREKDLKVMMVMIKIFEI

SEQ ID NO: 171616 - protein, 484 aa, Glycine max
  Coding DNA Sequence Number=SeqID_79931
  Gene Ontology: Mol. function=dihydrolipoyllysine-residue acetyltransferase activity; Cellular component=pyruvate dehydrogenase complex; Biological process=pyruvate metabolic process
  Homolog annotation: Hit_ID=A7QZS8; Match level="QueryCoverage=85%, HitCoverage=76%, E-value=1e-158, Identity=64%"; Hit description =Chromosome chr13 scaffold_286, whole genome shotgun sequence
  Pfam annotation: Domain name=2-oxoacid_dh; Domain location=311-472; Score=-5.3; E_value=5.9e-13; Accession=PF00198.14; Description=2 -oxoacid dehydrogenases acyltransferase (catalytic domain)
  Pfam annotation: Domain name=Biotin_lipoyl; Domain location=1-64; Score=54.3; E_value=4.1e-13; Accession=PF00364.13; Description =Biotin-requiring enzyme
  Pfam annotation: Domain name=Biotin_lipoyl; Domain location=116-190; Score=64.2; E_value=4.5e-16; Accession=PF00364.13; Description =Biotin-requiring enzyme
  Pfam annotation: Domain name=E3_binding; Domain location=233-271; Score=29.8; E_value=4.7e-06; Accession=PF02817.8; Description=e3 binding domain
  Pfam module annotation: Pfam domain module=2-oxoacid_dh::Biotin _lipoyl::Biotin_lipoyl::E3_binding; Domain location=311-472::1 -64::116-190::233-271
MTQGNIAKWRKKEGEKIEVGDVLCEIETDKATLEFESLEEGFLAKILVPEGSKDVPVGQPIAITVEDENDIQNVPASVGGETGVEEKKPTLGGVSDERKSESTSSVVNASELPPHLLLEMPALSPTMNQGNIAKWRKQEGDKIEVGDILCEIETDKATLEFESLEEGYLAKILAPEGSKEVAVGHSIAITLLFYKVEDASDIEAIKNSVSSSTNQQKAPQRGTKSEVKAQKNNITRISPAAKLLIAEYGLDAPTLNATGPYGTLLKGDVLSAIKSGKLSPKPASSKEKALSSQSHQQVAASQESKSDLKKSDAYEDFPNSQIRKVIAKRLLDSKQNTPHLYLSSDVILDPLLSLRKGLKEQYDVKVSVNDIIIKVVAAALRNVPEANAYWNVEKDEVILNDSIDISIAVATEKVSDEEQMNYRYFYKTSDCVFENLDKRAVGTGQWRVVEKGKDVELPTAPEVIGKRNVLVFWEAKGNRFTKTK

SEQ ID NO: 171617 - protein, 194 aa, Glycine max
  Coding DNA Sequence Number=SeqID_79932
  Homolog annotation: Hit_ID=Q41375; Match level="QueryCoverage=37%, HitCoverage=43%, E-value=2e-08, Identity=40%"; Hit description =Chloroplast outer envelope 24 kD protein
MEDGVAGDRVMYLRPFHYTMSRNSDEPAMTEEAPTKQSLANIFSLFRKINFQLPFLPPKPEEPKLEAQAQQEGPKPGRVQFPKSQVALIASSPLQAEPDADHSPAAKTTNPLILWQIYAIGAIAISSWVWARWNERKGRGGSPSDEREKFSLAVYSYEARTLQSLVVSGVRHASVYPRVRICVVSGVRVGVGAS

SEQ ID NO: 171618 - protein, 68 aa, Glycine max
  Coding DNA Sequence Number=SeqID_79933
YDIKIPNGENARNWIPNVVLKFHDDPTVSESKIVVFLRQVRWPAGKREGFGRREKKQYCEAEEAKESV

SEQ ID NO: 171619 - protein, 102 aa, Glycine max
  Coding DNA Sequence Number=SeqID_79934
MGDSLLWVYEGQTIEFLQPGGSTSSRAAATAVELQFALYWRNSEEARTDRPSQQLRSLNGEWDAPCSGALSAAGVVVTRSVTATLASADVRRCFCRYAPPRQ

SEQ ID NO: 171620 - protein, 131 aa, Glycine max
  Coding DNA Sequence Number=SeqID_79935
MNSAILISVIPENKLLATTFLNGKLHTTPEFQKNTIDNNEVNTNVTVQTTCMHKTKVNQNETNVSPSVKQKDSIQMINDGTYEFGDPTVMWLRMPPDSWVTVTKSGVVDKSRAFAPTYPQFVMRNSDLRSS

SEQ ID NO: 171621 - protein, 119 aa, Glycine max
  Coding DNA Sequence Number=SeqID_79936
APSGPRQVKQGLGVSGTDHGPLLVIRGSRHPQKSDLTTDHRGLHREVRQQAANHRGKGQGSAPFACPTPEQFGAEVAWPGDWPVAQAGEEPEGSPGEAEEARMDEDMTDLLGFLGGSGA

SEQ ID NO: 171622 - protein, 63 aa, Glycine max
  Coding DNA Sequence Number=SeqID_79937
ICFYSLTVGILKTITFDLLLSENGALSAIPTEGNCAEQPKAALSPIPIKGNYTERPQGALSEP

SEQ ID NO: 171623 - protein, 197 aa, Glycine max
  Coding DNA Sequence Number=SeqID_79938
  Homolog annotation: Hit_ID=Q6WAY4; Match level="QueryCoverage=85%, HitCoverage=30%, E-value=2e-20, Identity=36%"; Hit description =Putative uncharacterized protein
MGTNQNGKRFYQVKVKSLDVTSLKELGRLMGPLQRQAFRKVYGKILDLAAAEVFTEAVVSLAQYYDQPLRCFTFGDFQMVPTIEEFEEILGCPLGGRKTYLFSDFLPSLSKIAAVIGDSTKELDRMKQTRNGVVGLPQKYLEGKARDMASQEMWSPFADILALLIFGVVLFPNVDGLVDLATIDAFLAYHHSKESPV

SEQ ID NO: 171624 - protein, 299 aa, Glycine max
  Coding DNA Sequence Number=SeqID_79939
MDNILGRNIVPGRKVEIYHTELDDLKTKLERRNFHKRLSNLVDGSIDLALVKEFYANLYRSEGPSPKQVRVRGHLVKIDVDSLNTFLETPVVLADGETLPTYSKYCRLPIDYREIEAALCIPGRGFILNIEGHPGKILRKYLTTLAQVWSVLSYSNLAPTSHISDLTVDRARLIFGLVSRMDMNSLQVVAPPGSIPLVEQFREMVAWPRTQPSLHREDEGPTAQGRRQVRQVVVATSERSFEATSEPPALVEDLSSPQYAADPSTPILDIPEDSNTLVLTLNTSPPTTPMLHLKDEEDV

SEQ ID NO: 171625 - protein, 73 aa, Glycine max
  Coding DNA Sequence Number=SeqID_79940
MIDATNGGALGDMTPAETRNLIEKMASNSQQFSARNDVIVLRGVHEVPQIHFHLLKIKLEGFNILEVSIWSQD

SEQ ID NO: 171626 - protein, 59 aa, Glycine max
  Coding DNA Sequence Number=SeqID_79941
MGRRQRTNFFVDELRGFGGGNGASVARCQPSPGYCGVLPYACLGAQYFLMKARRDPCKQ

SEQ ID NO: 171627 - protein, 142 aa, Glycine max
  Coding DNA Sequence Number=SeqID_79942
LGPPPKIRGRPTVRPQPEREAIVQLLCLLGQDFNQPLQGDKCGSCTPPQLRSPPAEVSVGLCHHDIGLCQSYRVPVPPARSCHRDIGIAPARHLVDPKKSNKVLGFLALITGLCQFYGVPVAPNKVIRPPINHDFIKKYCAP

SEQ ID NO: 171628 - protein, 71 aa, Glycine max
  Coding DNA Sequence Number=SeqID_79943
MEATGNQIFELWFVGFSFSLPRNTYRGQPEATSDVGSHYPEMVPKSMVDKLVRLQRRFLWGGGPDQTDCMD

SEQ ID NO: 171629 - protein, 343 aa, Glycine max
  Coding DNA Sequence Number=SeqID_79944
  Homolog annotation: Hit_ID=Q6WAY6; Match level="QueryCoverage=68%, HitCoverage=40%, E-value=4e-24, Identity=32%"; Hit description =Putative uncharacterized protein
MVEEFEEILGCPLGGRKPYLFSGFYPSLARIPKIVQILAHELDRQKQVENGVVGIPRKCLEVKARILAGSSEWAPFIDILALLIFGGTLFPNMDGLVDLATINAFLAYHNHKESPVVTMLADLYDTFDRRCEKSSSRIVCCTPALYVRHACPLEGHRSCTEKGGANWDQLLSNKEGASVNWFPRWKEGRTGVLVSFGGFPNVPLMGTRGCISYNPVLTIRQLGYPMRGAALEEVLAPVISRGFSETNMETLERSAKHGKWYKRRTKSSEAATMGPLVATEDEEVQALRTGLEQAQTVKERFKSVALRIRKENIELRDVNIATTKALEQETKRAHREEHGRNKF

SEQ ID NO: 171630 - protein, 156 aa, Glycine max
  Coding DNA Sequence Number=SeqID_79945
  Gene Ontology: Mol. function=chitin binding; Cellular component =extracellular region; Biological process=chitin metabolic process
  Homolog annotation: Hit_ID=UPI00006A17C9; Match level="QueryCoverage =89%, HitCoverage=100%, E-value=7e-20, Identity=31%"; Hit description= UPI00006A17C9 related cluster
  Subcellular localization annotation: CTP_CleavageSite=44; ConfidenceScore=5.66e-01
MARACSPQKAMTCSPLKVRACSPLKARACSPLKVRTCSPLKARVCSPLKARTCMPLKARAYSPFKARTCSPLKVRACSPMKARACSPLKVKTCSLVKARACSPLKVRTFSPLKVRACCPLKEKTCSPLKARACNPLKVRTCSPLKGRVLVSKGPPF

SEQ ID NO: 171631 - protein, 41 aa, Glycine max
  Coding DNA Sequence Number=SeqID_79946
VEDRRTALGSQFAGSRLDGGGHMNNASNQFMGLRIRFEGGG

SEQ ID NO: 171632 - protein, 455 aa, Glycine max
  Coding DNA Sequence Number=SeqID_79947
  Gene Ontology: Mol. function=oxidoreductase activity; Cellular component=integral to membrane; Biological process=potassium ion transport
  Homolog annotation: Hit_ID=A7NXT0; Match level="QueryCoverage=63%, HitCoverage=88%, E-value=1e-157, Identity=92%"; Hit description =Chromosome chr5 scaffold_2, whole genome shotgun sequence
  Pfam annotation: Domain name=Aldo_ket_red; Domain location=146-445; Score=291.7; E_value=1.5e-84; Accession=PF00248.12; Description =Aldoketo reductase family
MESHRAEDLVFVHSNLRLLSRNTPQYHQEETKMWDVAGDDFGSLDDCGILEIASLSLDEPELEAVSVSYILNITGFFLPNDFVRRIKAIVRPSQAAGEYIKECGRVIGWIRRFPKCLPPPPPSSPLIGSKSKSKSSSKKMQYKNLGRSGLKVSQLSYGAWVSFGNQLDVKEAKALLQCCRDHGVNFFDNAEVYANGRAEEIMGQAIRELGWKRSDIVVSTKIFWGGQGPNDKGLSRKHVVEGTKASLKRLEMEYVDVLYCHRPDTSTPIEETVRAMNHVIDRGWAFYWGTSEWSAQQITEAWAVAQRLDLVGPIVEQPEYNLLSRHKVESEFLPLYTNYGTGLTTWSPLASGVLTGKYKKGVIPPDSRFALENYKNLASRSLVDDVLRKVDGLKPIADELGVPLSQLAIAWCAANPNVSSVICGATKESQAFGYEPLRRINSHAWTRKTPSSDIL

SEQ ID NO: 171633 - protein, 189 aa, Glycine max
  Coding DNA Sequence Number=SeqID_79948
MACEVLIEPRALLRFRSELQLDKFFDDPLSMLMTRVPLVIVRVGNFIFKWGVETMASSSLSVLLRVKAKELALTEGGHQVHVASSLYYLACKSEEWTGVRVDSVGGDFESLKSLPMLDISGIFLVDKNPGHHEVCNDDGDNNEVIMVDRVGTLEVPIHKGDRKETQFYRLTNWTKYRAYIGSSILSFKA

SEQ ID NO: 171634 - protein, 67 aa, Glycine max
  Coding DNA Sequence Number=SeqID_79949
MGVKCLKVINQGLFPELVVNPRTFFGFCCKDWGTRGDLRFVPVTHIQVSNPRNQIELPGRKLAVDPR

SEQ ID NO: 171635 - protein, 50 aa, Glycine max
  Coding DNA Sequence Number=SeqID_79950
MADGKLIEMKGRVNLGLEKFSASALFSLVLIVHEVWDVELLGCCGSLGIL

SEQ ID NO: 171636 - protein, 76 aa, Glycine max
  Coding DNA Sequence Number=SeqID_79951
  Subcellular localization annotation: CTP_CleavageSite=52; ConfidenceScore=5.78e-01
MKDCRNTSSGDVSSTSRTSQSLTNSSQALRTASSSSSGGFVRARALSTTLIRSAHISEYQLSACFSRSADGLKRCT

SEQ ID NO: 171637 - protein, 41 aa, Glycine max
  Coding DNA Sequence Number=SeqID_79952
MKTLKTTLDGKIDQPTSQGIEVKSYVQSRNYECGYYVMRWM

SEQ ID NO: 171638 - protein, 84 aa, Glycine max
  Coding DNA Sequence Number=SeqID_79953
MGWGGISHPMVSWEELQRAQKGKSSKPKLPIKNKYIQILSNLKVQYRLCLVTNNEGRKMQQKRIKCDFEYKPQNYLSNSIGRDE

SEQ ID NO: 171639 - protein, 73 aa, Glycine max
  Coding DNA Sequence Number=SeqID_79954
MRITKDDDKGDDKKLKVQSKNNSKFKIRIKKNSRLKKKVKSQESRFKVQDLKNQDQDSRIKIQDSRFKNQEKA

SEQ ID NO: 171640 - protein, 218 aa, Glycine max
  Coding DNA Sequence Number=SeqID_79955
  Gene Ontology: Mol. function=RNA-directed DNA polymerase activity; Cellular component=mitochondrion; Biological process=RNA-dependent DNA replication
  Homolog annotation: Hit_ID=Q2HRL4; Match level="QueryCoverage=77%, HitCoverage=78%, E-value=2e-13, Identity=27%"; Hit description=Non -LTR retroelement reverse transcriptase-like protein, related
MKNIEASNFQLGWSCSWTMKAIFKHKNLLTQSAAWGEMHDAGKYSMRKMYQVIRGVKPQVEWRKLLIGNHARPRAIFTLWMACNNHLLTKDRMKRFGMATDGLCVFCKMPETCQHLFNCSDIKPVWEKILNWIGFNHTPAMWDEELKWIVQNTKGKGCKRSLLKMAVAETTYMIWCVRNRIIFQDGRKEELQYDTIKNVILRRVETNTKLMIYCSMNI

SEQ ID NO: 171641 - protein, 213 aa, Glycine max
  Coding DNA Sequence Number=SeqID_79956
MKKGKMQVSTNEEGKNACPITLTDNVRPYIKPQSPEKLNEKLKTQLAFYYSSFLHSIDDTLNKYLMQSSITTHARVTKRFLVRDKGNGVNFVGFGFGEQSVAVVAKTEMEKKGEEEEYFLEAQQSDILVERYCSNPRSSVTYSLMKIFLWNQMKAKTLENVIIMSRLLRSFSRISFRSNSSSSSSSRNSNLLSDQDNLTQEVAPKHNLFDEEV

SEQ ID NO: 171642 - protein, 236 aa, Glycine max
  Coding DNA Sequence Number=SeqID_79957
  Homolog annotation: Hit_ID=UPI00016621D1; Match level="QueryCoverage =65%, HitCoverage=40%, E-value=1e-15, Identity=38%"; Hit description =UPI00016621D1 related cluster
MSSPSEGFTPSPSEGCTSLPSKDYTSSTLEDCTSSPSEDYMPSPASRPHHQRAVGPRHRGLHVLAFRGLHILTFRGMYVLAFRGLHVLTFKGFHVLPFRDYRSSPSEVQVLVFRGMHVLAYRGLHVLAFRGQYVLAFRGLHVLTFRGLHVLAFRGLHILTFRGLYVLAFRGLHVLAFRGLHILTFRGLYVLAFTGLHVPGFRELYVLTFRGLHTLAFRGLHTSSPSKGFTSSPSED

SEQ ID NO: 171643 - protein, 347 aa, Glycine max
  Coding DNA Sequence Number=SeqID_79958
  Gene Ontology: Mol. function=protein dimerization activity; Biological process=DNA integration
  Homolog annotation: Hit_ID=Q2R1C3; Match level="QueryCoverage=65%, HitCoverage=29%, E-value=3e-53, Identity=48%"; Hit description=HAT family dimerisation domain containing protein
  Pfam annotation: Domain name=zf-C2HC_plant; Domain location=125-183; Score=-3.0; E_value=0.097; Accession=PF07567.3; Description=Protein of unknown function, DUF1544
MKHEHAAEVPRPASEAHRTRKRVQLRCDAVFVASAVTGHGWMQEARDWMRPTKWTRAIGRGPTSYFIIYLKKAYQIRKWFLHVFSLSFSASEPPLLHVAASISPFAKMSTSSPNQAKEQDHDTKPLWNYVTKIKSVGGGGNYEIKCNIYDFTFNGSYTRVRAHLLKMTGKGVRVCQKVTIAKLIDLKKIDNEARLRVEKSKTKFVSLPSVSTQHQMDTNTLGVDPKKRKTSTVENAFNLQARETLDHEIARMFYSSGLPFHLARNPHYRKAFAYAANNQISGYQPPGYYKLRTTLLQNERRHVENLLQPIKKASSQKGVSIVSDGWSDPQRRSLINFMAITESGPMF

SEQ ID NO: 171644 - protein, 131 aa, Glycine max
  Coding DNA Sequence Number=SeqID_79959
MMTFKNEFKIESRTLQRSRGNLISRFKNQDSRIIKIKIQDSKIQESREDLIKMSIKKFFKTLSSTRSFHKIITKEFHSLRVHLLGLLTENKRGYISCGSVLMDDTSTRLFKENKGGYIPCGSLLVKGFLQG

SEQ ID NO: 171645 - protein, 57 aa, Glycine max
  Coding DNA Sequence Number=SeqID_79960
MTHANHNWEGYTCPCAFVAILTRKGPFTRAMSKRLQEDWARVAEEGPRVLMNLRVDF

SEQ ID NO: 171646 - protein, 199 aa, Glycine max
  Coding DNA Sequence Number=SeqID_79961
MSRGSGDLGDIRRAPGSQPIKEQKPQSKEACVVAGQLWNLSDIWNMASGNRLQRIAMAVQLIHDQVEMECLEGVWETLEGNARCRFRGTIRFTATSLVHPEEPARTLQRTVEWILPTPTPYRLVEPVQVIEVTSSEEDPEEDPEELPPEPVVDALDFPEGDEDPLPEVDSPEDVMSASEADSTEESGPGGIATSGGSSS

SEQ ID NO: 171647 - protein, 83 aa, Glycine max
  Coding DNA Sequence Number=SeqID_79962
MEEPPDAILAKTKLKLQDWTLAQSATKISSLGIVLLKFGIPSYAVLDRVVYFDWQNLMDLIEEMPVMDASEKGNPTNVVSPLR

SEQ ID NO: 171648 - protein, 259 aa, Glycine max
  Coding DNA Sequence Number=SeqID_79963
  Homolog annotation: Hit_ID=UPI00016621D1; Match level="QueryCoverage =92%, HitCoverage=40%, E-value=1e-10, Identity=26%"; Hit description =UPI00016621D1 related cluster
DCTPSPIEDYTYSPSEGTFRGQHVLAIRALHALSFRGLHVLAIRGLHTLAFRGLHVLTIRGLHALTTKGQHVLTMRGLQALSFRGLHVLGIGGLHALTFRGLHILTFRGLHAPTCRGLHVLTIKGLHALICRELHVLAIILLHALTFRRLHVIAIRGLHALAIRRLNALPFRGLHVLAIRGLDTLTFSGLHVLTIRGQNTLTFRGLHVLAIRGQHALTFRGLHDLNIKGLHALTCRGLHVLTTKGLRAFTCRGLHILAI

SEQ ID NO: 171649 - protein, 41 aa, Glycine max
  Coding DNA Sequence Number=SeqID_79964
MGHALDKARLRTVRIVAARGGGLGREEGAGLGGREAVAGQF

SEQ ID NO: 171650 - protein, 95 aa, Glycine max
  Coding DNA Sequence Number=SeqID_79965
MTQTNEHDYLTVSGKNSAGRSSVHYWKKLFWKLLPEAGTPYYGRTSSRISSITFQKNFFRKKFLLDNLPQHFTASVTDEHKKKPKKTIKCIPSTE

SEQ ID NO: 171651 - protein, 131 aa, Glycine max
  Coding DNA Sequence Number=SeqID_79966
LERIDGDPALRGTRIRATWEYVSSVGGGQHGMVGSYVICGCGELSCTIARPPPSTTCDGGTWRYVAGVRRPWGRQASSWQSTDKRTKTTKQGGLCGGWPAVNFECYMGYGLWLKNEIRKLRGLLVIDYQGV

SEQ ID NO: 171652 - protein, 29 aa, Glycine max
  Coding DNA Sequence Number=SeqID_79967
VLLSSSGNTQARRRARFFAAGQGRSSAMA

SEQ ID NO: 171653 - protein, 144 aa, Glycine max
  Coding DNA Sequence Number=SeqID_79968
MSQNLTDYAIVPSLASGLLRNFTDCALTLPSNSRHVAELHRLPNDGCQVPRSGQARVASQQTDGPWMKLGDSPPQISANLHRSDFAPYVSRSYNAQWNAPGWCLVLDVQQVDFVADLGVAIVDDWAFLVGRVVVRKMEIVKNIL

SEQ ID NO: 171654 - protein, 266 aa, Glycine max
  Coding DNA Sequence Number=SeqID_79969
  Homolog annotation: Hit_ID=UPI00006A2D9E; Match level="QueryCoverage =85%, HitCoverage=93%, E-value=6e-12, Identity=19%"; Hit description =UPI00006A2D9E related cluster
GLHVLAFTGVDALTSEYYTSSLSEYSTSSLSWGYTPSPSEDNMPSPSEDYTSPPSEGYTWLHAPAFTGLDALTLRGLHVLAFVGLDALPFRGLHVLTLKGLHALTFRGPHPLAFRGLHVLAFRGLHPLAFRGVHVVAFRGLHVLTFRGLHVLTLRGLHILAFRGLHTVTFRELHVLTLRATRAHLQRTTRPCLQRATCPHLKGLQVLAFRGLHTLAVRGVHALALRGLTCPHLQRTNVPDLQRATRPHLKRPTRPRLQRATHPHLQ

SEQ ID NO: 171655 - protein, 79 aa, Glycine max
  Coding DNA Sequence Number=SeqID_79970
AAIDLHFVGVDDFGGGEEGCKVDGETGLARAGGAHDHHHLVLAAVEGRRVDAGPALYPVGVGVGLQNGKSHNNRKKKKK

SEQ ID NO: 171656 - protein, 114 aa, Glycine max
  Coding DNA Sequence Number=SeqID_79971
MLGGSILQSKSSHHHCYCGGCIASLLLLLLVLLLTDLAYKGPTKEWPNIRILVGFVKPPPPLGFLGLIVLTFDKFILLERHLNLVIVHGLTAPQFKPGVVQPAQEFRSSGKLKQ

SEQ ID NO: 171657 - protein, 117 aa, Glycine max
  Coding DNA Sequence Number=SeqID_79972
MGYVGVRELSWRWATGDGGFMRALWIWKTCCAPSPDRHLVPHVMEWYLEICRGGQETLGTSGGVLLPKTKLDQSRPNPGIVAQLRTCDVPKQASSWQSTDKRNKDHKSRRLVVAGQL

SEQ ID NO: 171658 - protein, 54 aa, Glycine max
  Coding DNA Sequence Number=SeqID_79973
CFDDNKDDDKKPKRMISRESFIKKIQDSRFKNNQDQDSRLKDSRIKRILNQDKY

SEQ ID NO: 171659 - protein, 190 aa, Glycine max
  Coding DNA Sequence Number=SeqID_79974
MQRRSIAGDLISIDLEESRADQKVEGFKQQLADEPTLESVDDLVQLVEIVEEAEEKVIETEKKKGKSEANIEKKKEAPPIECKEKLEITLPFGEALQQMPFYAKFLKDMLTKKNLYIHSDIIVVEGNYSAIIQRILPPCYKLIRQALKSTIFHLHAKRTTHGLSARKTLEEDELYKHTASVHPLSEKGMR

SEQ ID NO: 171660 - protein, 61 aa, Glycine max
  Coding DNA Sequence Number=SeqID_79975
MENGELANSATQQLRRSLDSLAINSWGSEKSGEWRVGEQRYAITSRDSRLVGGGCMNKARQ

SEQ ID NO: 171661 - protein, 321 aa, Glycine max
  Coding DNA Sequence Number=SeqID_79976
AGDRGWVELCDQRVTQRVDRQLRRSGLYEGGENFARGLAASHHAGAVNQGVTADGAFHFAHFDAYTAYLHLVITAADENNVALFVPFGDVTGNELLCAQRLLMQVTVRQAAAGDAQFALKTDRQWIVVGIKDVTTVVFQRFANTVPGNTWTILAQRSGNRSLGRPVTVAQSGALGPPGDDVRWRCVSHDDHCPQSRPHFAGQQFQNCRCNSDMADIVSSQIIVQRADIGMQLRGRQIKRRTADQRAIDVPAEGVETQRGDGQHATALRQANEIAVVLRHVAQALTPYHDAFGFAGRPGGIADVGQCVSRLRELLRMDVQRT

SEQ ID NO: 171662 - protein, 277 aa, Glycine max
  Coding DNA Sequence Number=SeqID_79977
  Homolog annotation: Hit_ID=A5C922; Match level="QueryCoverage=37%, HitCoverage=37%, E-value=6e-07, Identity=34%"; Hit description =Putative uncharacterized protein
NPSDLQPFDPEIDRTFHRLVRHHFIPFDHSEHSITGESVHSVIGDFEHPDLEHYNFEHSDSEHSDFAHSENMAQPPPRERTLREMVAPDFTYESLCIQYPDEDVPYVLKTGLIHLLPKFHGLAGFSSFIRGVANDWLYYLAPRSISSWDDLKRVFLEKFSLLPGPQPSGRISQVLDNSVERACMRLSNMERSMIDDASGGALGDMTPAEARNLIEKMASNSQQFSARNDAIVIRGVHEVATNPSASSETKKLEGKLDALVNLVTQLALNQKSVPVAR

SEQ ID NO: 171663 - protein, 153 aa, Glycine max
  Coding DNA Sequence Number=SeqID_79978
  Homolog annotation: Hit_ID=A4DID9; Match level="QueryCoverage=41%, HitCoverage=88%, E-value=7e-19, Identity=53%"; Hit description =Putative uncharacterized protein
CRKVKEVGDLMTGEPTTEAPVNGGRNYNGPKVAKFLRGKEGLLLGGPEPSVRYHSGRARILTLCQDLRAEGQSQAEGSLTARPTRRAGTKVGLSDPTVPSGRAVAQRIKGWAVRPLKRYVSWVQNVVRQFGPYPDREGRTSGVPVIVPTVGIL

SEQ ID NO: 171664 - protein, 63 aa, Glycine max
  Coding DNA Sequence Number=SeqID_79979
MEISASTLFFFPRLGGVDGDPVDRGRTARKPHYKRNLKRVGLHPQKETTPENLAFHGFKQKRN

SEQ ID NO: 171665 - protein, 135 aa, Glycine max
  Coding DNA Sequence Number=SeqID_79980
MFIDGLRPQTKQLLDASAGGEIKLKTPEEEIELIKNMSASNHAILRNRVHQPTKKSLLELSSHDALLAQNKLLSRQLEILTETLGDVVATYPSAGGRRVTCGCVFQERNTCGVATNVYLRKTSEKPEKTWSTNFK

SEQ ID NO: 171666 - protein, 56 aa, Glycine max
  Coding DNA Sequence Number=SeqID_79981
MDCKSDGLPLVIHYIQHAQLVAFLCKSAKLVAKSVAKHYSQQNTKTETGEALNRKN

SEQ ID NO: 171667 - protein, 354 aa, Glycine max
  Coding DNA Sequence Number=SeqID_79982
  Gene Ontology: Mol. function=phosphoprotein phosphatase activity; Biological process=intracellular signaling cascade
  Homolog annotation: Hit_ID=Q2HTA0; Match level="QueryCoverage=81%, HitCoverage=48%, E-value=9e-29, Identity=29%"; Hit description=IMP dehydrogenase/GMP reductase, related
  Pfam annotation: Domain name=DUF1723; Domain location=2-55; Score =38.5; E_value=2.3e-08; Accession=PF08330.1; Description=Protein of unknown function (DUF1723)
VTVDPGVISAFVERWHKKTRNFYLPVGELTITLDDVASLLYLQSQVPSTASSLCMWTFIMLVELLEVSGKEARDETVQYHGAYSATHVHVVHLDTFRDLAQSGSYAWGAVVLVHMYDQLNEASQSTTRQIGGYLTLLQCWIYEHFPSEHDCVTDDGYDKTSPHACRWLTMKGLTASPYRTRIDALTITDMCWMPYGDHRGVRAFDLISCFLGQLRWGPIVVTLRPERVVRQFSYVQTIPPPPISATLSYDDIDNRWIHYSNHLAIAGQICLVPGQVSGDYMEWFFLISHPFITPTQAGDQPRHPLVPQHEAYVELDILEVPMAVEGGPSQAPDPPDMQWMLVKRSQKGWSLCST

SEQ ID NO: 171668 - protein, 102 aa, Glycine max
  Coding DNA Sequence Number=SeqID_79983
  Subcellular localization annotation: CTP_CleavageSite=62; ConfidenceScore=5.08e-01
TYQGNPCGVYPDLSSFTRSGVYPDLSSFTGSGVYPDLSSLTGSGVYPDLSSFIGSGVYPDLSSFTGSGVYPNLSSFTGSGVIQKLYSLYQAIRPVRFTSNTH

SEQ ID NO: 171669 - protein, 95 aa, Glycine max
  Coding DNA Sequence Number=SeqID_79984
MRGRHKSHLRPSHRREKERKPQKANINLPYFHGKDNVKTYLDWEIRVEQQLKRKPTSKSYGSHSYPKKDQGQGILGATPSMPKDEKGEDNRKVTL

SEQ ID NO: 171670 - protein, 160 aa, Glycine max
  Coding DNA Sequence Number=SeqID_79985
  Gene Ontology: Mol. function=sequence-specific DNA binding; Cellular component=cytoplasm; Biological process=regulation of transcription, DNA-dependent
  Homolog annotation: Hit_ID=A5BXD0; Match level="QueryCoverage=57%, HitCoverage=49%, E-value=5e-30, Identity=62%"; Hit description =Putative uncharacterized protein
  Pfam annotation: Domain name=HSF_DNA-bind; Domain location=80-159; Score=-36.1; E_value=6.2e-07; Accession=PF00447.8; Description=HSF -type DNA-binding
MEGEEVARVKVELFDDSESNRNDDDVLSESKDSRVTMEEVTMRTMAHAVKEEMDDDIVNWSLSSLTSPKPMEGLHKVGPPPFLKKTFEMVEDPHTNPIVSWSQTRNSFIVWDSHDFSKTLFPKYFKHNNFSSFVHQLKTYVSQFSYILAFSSLPHYFSLS

SEQ ID NO: 171671 - protein, 64 aa, Glycine max
  Coding DNA Sequence Number=SeqID_79986
MVAQHEFMFGKGLHQGDLLSPFLFLIATKGLNSLRKQMVDKDLFKGVKLRALLTQGKQGESLEL

SEQ ID NO: 171672 - protein, 512 aa, Glycine max
  Coding DNA Sequence Number=SeqID_79987
  Gene Ontology: Mol. function=aspartic-type endopeptidase activity; Cellular component=cellulose and pectin-containing cell wall; Biological process=proteolysis
  Homolog annotation: Hit_ID=A5B1P0; Match level="QueryCoverage=80%, HitCoverage=67%, E-value=1e-123, Identity=54%"; Hit description =Putative uncharacterized protein
  Pfam annotation: Domain name=Asp; Domain location=126-505; Score= -112.3; E_value=5.9e-07; Accession=PF00026.14; Description=Eukaryotic aspartyl protease
  Subcellular localization annotation: CTP_CleavageSite=41; ConfidenceScore=5.24e-01
MKTSISVINKQPKTKKTSSKPSHHLHTRRRFCVFSFPQNASSSHYSLPLLFPLHHITIHHHYFIHPHPQHHHHPPLFTHHPSSSNSHPFHTLQLAVSTSITRAHHLKNHNNPSSLKTLVHPKTYGGYSIDLKFGTPPQTFPFVLDTGSSLVWLPCYSHYLCSKCNSFSNNNTPKFIPKDSFSSKFVGCRNPKCAWVFGSDVTSHCCKLAKAAFSNNNNCSQTCPAYTVQYGLGSTAGFLLSENLNFPAKNVSDFLVGCSVVSVYQPGGIAGFGRGEESLPAQMNLTRFSYCLLSHQFDESPENSDLVMEATNSGEGKKTNGVSYTAFLKNPSTKKPAFGAYYYITLRKIVVGEKRVRVPRRMLEPDVNGDGGFIVDSGSTLTFMERPIFDLVAEEFVKQVNYTRARELEKQFGLSPCFVLAGGAETASFPEMRFEFRGGAKMRLPVANYFSRVGKGDVACLTIVSDDVAGQGGAVGPAVILGNYQQQNFYVECDLENERFGFRSQSCQKRVY

SEQ ID NO: 171673 - protein, 202 aa, Glycine max
  Coding DNA Sequence Number=SeqID_79988
MENGGIIETRSCTSKRKMEANNWKKLGERIHDFLFKISRGFQGIRFMGNLSTIGKKICDLVIVERRNRWDHMFGFLRFKGVENALKLERQLEQTVIRNVKMHVNLQEYKRRKYDDLGFYMKGKQYGGAYEGPQQRSDEQGEQKEGDDMVLVGGVDDGMREKINKGKIHGIWSLFLSLEKRNPTIVPGNRMAWIICMGIPLMV

SEQ ID NO: 171674 - protein, 762 aa, Glycine max
  Coding DNA Sequence Number=SeqID_79989
  Homolog annotation: Hit_ID=Q2HVW1; Match level="QueryCoverage=16%, HitCoverage=51%, E-value=2e-08, Identity=29%"; Hit description =Putative uncharacterized protein
  Pfam annotation: Domain name=RRM_1; Domain location=80-150; Score =36.1; E_value=1.3e-07; Accession=PF00076.13; Description=RNA recognition motif. (a.k.a. RRM, RB
MRESERERETEREQESGRDQESSREGENGWVRVKHRTQTKERNSEKVREDPHRRHAGNRQGQGQSYGRANWRSRKNITSFYFTRFPDDTTEEELWYHFKVFGAVREIFIAKNINKHGRRFGFVRFEGVENAQKLEWTLDNIVFGGLKMHVNIPKFGRNKVVKPISVTNKVRQDVHKEEAIPRYVQPISTTHHGSYVEVVARNNTGPGLRRIAGNASGHNGTSWSSVYLDIPEPLMKRAKEAWVGRLKNLAMFDRVEDDLYWDISADISPKYMGADMVLLQGLSDEGAELMMQEETEGGSTPFHSLEKWSPKLRIGYRLTWVYCWGLPLTAWDPHQIRKIVAAIGDMVDVDDAVELVRRMDRVRVLVKTPRQPYIQHAVNVHIHGEVYIVHVVEENGNSFDNCYGRKGSVYSSSEEVESDDSEVGTLNGISNIEWMAGKEVEVTAVEPNAEGQNPYSFTSTASPDFRMQGQGLHEDMMDGAPTAVTTTVGDQASLPGTQNPVGASLSSRQKKNVPPKDKAIIRCANSPTVNGQPSNSGTCPLDSVVTYLACERQGDFHEKGTAGTIGIPTSDAKDVLESGRGKLEEEGQHETLETHISNSNGSRDQEGDFADGLDHAIHTPHVTHPKQNLSPPATKWQVYSRKRSSKRKSISGLTHGLNLIDEMDPEPNNQTSSQPVEGVEDNHGPEQLVSTKNNDIRPTQIQHAETNFLPSNMQEAADMWELVKSLGVTSGSSQGDPATKIMDMETRDREEAHRLGCRRVSQ

SEQ ID NO: 171675 - protein, 126 aa, Glycine max
  Coding DNA Sequence Number=SeqID_79990
  Homolog annotation: Hit_ID=A7QMW7; Match level="QueryCoverage=61%, HitCoverage=34%, E-value=5e-09, Identity=39%"; Hit description =Chromosome undetermined scaffold_129, whole genome shotgun sequence
  Pfam annotation: Domain name=zf-CCHC; Domain location=80-97; Score =21.0; E_value=0.001; Accession=PF00098.14; Description=Zinc knuckle
MEKPDKKNFKDKKGKKAYITWEDNDMDSSSDLENKIVNLGLMAKDYESEEEVGLGYNPENQQKMYKNIFTSTQKTSSPFLTCFYCGKKGHSASTCYIRKNGNSIRKMVWVPKGSLVKTNIQEPKKI

SEQ ID NO: 171676 - protein, 56 aa, Glycine max
  Coding DNA Sequence Number=SeqID_79991
MAKIKRKHCYTICEEGANSNQAHLGLPGSSSRRHQGGAFSRKQPSSPGRAELAWAR

SEQ ID NO: 171677 - protein, 148 aa, Glycine max
  Coding DNA Sequence Number=SeqID_79992
  Gene Ontology: Mol. function=olfactory receptor binding; Cellular component=mitochondrial membrane; Biological process=protein insertion into membrane
  Homolog annotation: Hit_ID=A7PP64; Match level="QueryCoverage=98%, HitCoverage=86%, E-value=1e-49, Identity=57%"; Hit description =Chromosome chr8 scaffold_23, whole genome shotgun sequence
  Pfam annotation: Domain name=TB2_DP1_HVA22; Domain location=2-78; Score=-2.5; E_value=0.00097; Accession=PF03134.10; Description =TB2DP1, HVA22 family
MLGVFINRILILVLGYAYPGFECYKTVEKNRVDIEELRFWCKYWIIVALFTVLEKFTDIFVGWKGTGYVYETLLRPYVSKHENEIDRTILEWKARGWDYVIFYWQYCAKFGQTAFVQALQHLASQSTRFSANPTTQRGLEIPHQLIIW

SEQ ID NO: 171678 - protein, 291 aa, Glycine max
  Coding DNA Sequence Number=SeqID_79993
  Homolog annotation: Hit_ID=Q5XM22; Match level="QueryCoverage=14%, HitCoverage=23%, E-value=8e-08, Identity=65%"; Hit description =Resistance-like protein HAAS-2
MVRTRGLGCALSRVIGRALGRQDDHHADDVPQQRRPIASARRQRVAAPVAEDVPKMTEDVPEMSADVLAPGAEGLTGDGVKGSATDDAEQFPGGHERLELKLVSHRRKVEKFGRLAPEIEGLVVATGLTPLIACSVFTGDPGVIFSFVERRLPQLRASTCGRGGHHVGELLEVSGEEARAETVRCHGAYVRLPWLRDINQTKCEARQWIVAARAYLLHLSGSYAWGADEDMTKSKGKDPLEGLGGPMTRARARKAKEALQQVLSILFEYKPKFQGEKSKVVSCIMAQMEED

SEQ ID NO: 171679 - protein, 97 aa, Glycine max
  Coding DNA Sequence Number=SeqID_79994
MEHYLQHLVLQQAANHQGQVQIHECLYRFSLSQQGQGFAPFVCPTPEQFRAEVACPGDWPEAQAGEAPAGSPDDAEEARMDEEMTNLLDFLGGSGAT

SEQ ID NO: 171680 - protein, 120 aa, Glycine max
  Coding DNA Sequence Number=SeqID_79995
MRLFILNFENLNVLKTLVIDYCILVIDYQRVKLFGNDFVKTSCATCRNVPFCGLARRGSRVRFPKEERCAESPPTFICGKRRKNRRKPVKMKILSSGGLFTLEEGISTSHVCLKGQQPNF

SEQ ID NO: 171681 - protein, 203 aa, Glycine max
  Coding DNA Sequence Number=SeqID_79996
  Homolog annotation: Hit_ID=A2Q500; Match level="QueryCoverage=59%, HitCoverage=17%, E-value=1e-09, Identity=28%"; Hit description =Endonuclease/exonuclease/phosphatase
MSPTDSFNGVEPNAYELQDFVDCCSDLGLGSINSHGPLYTWTNDRAWFNSFGNSACEVMEFISISDHTPLFVTTELVVPRGNSPFKFNNAIVDHPNFSRIVADGWKQNIHGCSMFKADKCSKFFHALIKRNRHNRFIVAIRLDDGHNTSSQDKIALAFVNHFRNLFSTHELTQTPSISVCNRGPKVPIDCFAALLCPTSKQEV

SEQ ID NO: 171682 - protein, 38 aa, Glycine max
  Coding DNA Sequence Number=SeqID_79997
MPPHRILGCFAATFFACPALGRDDDLSVVTLSSICIRP

SEQ ID NO: 171683 - protein, 80 aa, Glycine max
  Coding DNA Sequence Number=SeqID_79998
DNNPSRCTLYLYLKGCTLQCVKAKNSQAVSPLNLCKGKQKISQAVSPLNSLGKREGRHKTIWAVSPSILLTKGEVNEEEE

SEQ ID NO: 171684 - protein, 93 aa, Glycine max
  Coding DNA Sequence Number=SeqID_79999
MCQKSKGSRLTRSVKFRNVAEIEKRSFLQKAVASGGSNLARLGELGGKLLPYFAINRGRSEEEKGSAFLAFRILLNLLRKIVSVKKIQAEALP

SEQ ID NO: 171685 - protein, 143 aa, Glycine max
  Coding DNA Sequence Number=SeqID_80000
IFSEVGKVYAVKWNDVLDNVWHLVDKEENYHNVVYNKDLDQPAIVAGRTTLQDFYQLTEDYPVSLTHYVPCPSHSQDDTLYTIKCQILSSSRTFQVACIIFLKTKVELICTWRMLQNAGSCSIIGGRHLKLEPDGNISARSCC

SEQ ID NO: 171686 - protein, 296 aa, Glycine max
  Coding DNA Sequence Number=SeqID_80001
  Gene Ontology: Mol. function=hydrolase activity, acting on acid anhydrides, in phosphorus-containing anhydrides; Cellular component =intracellular; Biological process=nucleobase, nucleoside, nucleotide and nucleic acid metabolic process
  Homolog annotation: Hit_ID=A8GFH4; Match level="QueryCoverage=34%, HitCoverage=16%, E-value=1e-49, Identity=92%"; Hit description =Helicase c2
  Pfam annotation: Domain name=Peptidase_M22; Domain location=141-290; Score=-14.9; E_value=3e-05; Accession=PF00814.16; Description =Glycoprotease family
FWEGVDVRGDALSLVIIDKLPFTSPEDPLLKARMEDCRLRGGDPFNDVQLPDAVITLKQGVGRLIRDTDDRGVLVICDQRLVSRPYGGLFLNSLPPTPRTRDLQRCYVRPNFSPGHRDRSLFCRAAESAADRCPLRNRPPRSYSTYSAAGAGSAAGAVAGAERAGRAGGLALGANLPMIGVSSLATMAQGAWRLTGATRVLAAIDARMGEVYWAEYQRDEQGEWQGAESEAVLKPEAAQARIAQLSGEWATVGTGWQAYPQLLAGASWGTTADHHGHAASCRRYAAAGAQRLAARR

SEQ ID NO: 171687 - protein, 155 aa, Glycine max
  Coding DNA Sequence Number=SeqID_80002
  Gene Ontology: Mol. function=chloramphenicol O-acetyltransferase activity; Biological process=response to antibiotic
  Homolog annotation: Hit_ID=P62577; Match level="QueryCoverage=100%, HitCoverage=100%, E-value=2e-42, Identity=98%"; Hit description =Chloramphenicol acetyltransferase
  Pfam annotation: Domain name=CAT; Domain location=6-145; Score=257.8; E_value=2.4e-74; Accession=PF00302.9; Description=Chloramphenicol acetyltransferase
MEKKITGYTTVDISQWHRKEHFEAFQSVAQCTYNQTVQLDITAFLKTVKKNKHKFYPAFIHILARLMNAHPEFRMAMKDGELPIPGVSFTSFDLNVANMDNFFAPVFTMGKYYTQGDKVLMPLAIQVHHAVCDGFHVGRMLNELQQYCDEWQGGA

SEQ ID NO: 171688 - protein, 79 aa, Glycine max
  Coding DNA Sequence Number=SeqID_80003
MGSVKVFFKICVFEMPPRKLSAMKSRRDTAVEGTSAAPEFESHRFRSASSVSRPSKDGHSTERDASSSGMMSTQIFRKR

SEQ ID NO: 171689 - protein, 64 aa, Glycine max
  Coding DNA Sequence Number=SeqID_80004
MADQQATKSKAKVITRPAQDIKEVLLGGNLELAMKKLPVKRSKKGIIEEGFGAAPQADIGFDKH

SEQ ID NO: 171690 - protein, 262 aa, Glycine max
  Coding DNA Sequence Number=SeqID_80005
MAQKMTLVYACYKAFRLQISKKNVCTDNHSGISAGQRDSNVSMTDLVSTEDDLNLQVSTGLSAAIDEGRRRRRLSPRAIRLFVLQTAKKNVYTDNHSGISARQHDSNVSMTDLMSAEDDVILRVSTGLSAAIDEGLVILQIAKKNVYTDNHSGISARQHDSNVSMTDLVSAEDDVNFCVSTGFSAAVDEGRRRRRLSPRAIRLFVIQTAKKNVYTDNHSGISDRQRDSNVSMTDLVSAEDDVNLRVQTGLSATIDEKRRRLR

SEQ ID NO: 171691 - protein, 175 aa, Glycine max
  Coding DNA Sequence Number=SeqID_80006
  Homolog annotation: Hit_ID=Q6WAY4; Match level="QueryCoverage=74%, HitCoverage=23%, E-value=6e-11, Identity=34%"; Hit description =Putative uncharacterized protein
MGTNQNGKRFDQVKVKSLDVTSLKELGRLMGPLKRQAFHKVYGKILDLTAAEVFTEAIVSLARYYDQLLRCFTFGDFQMVPTIEEFEEILGCPLGGRRPYLFSGFLPSLSKIAAVVGDSTKELDRMKQTRNGVVGLPRKILGRQSKGYGEPREVGPVCGYISFVDFWGCPLSERG

SEQ ID NO: 171692 - protein, 157 aa, Glycine max
  Coding DNA Sequence Number=SeqID_80007
DERDKDVKFIHFSIVTVVYNNGINFGNPDESLETPNNSLQNRPMCGVAWSYSAQWNAPGLLHDMHMLRSSRILRKMEAFRCKIHFLVGVLVCAKGMAFVDKWAVGWQSQHGFLLILTLFICPIFSSSKQDDLNFPLFRPTSILSSAKTKSAKLEGAT

SEQ ID NO: 171693 - protein, 747 aa, Glycine max
  Coding DNA Sequence Number=SeqID_80008
  Homolog annotation: Hit_ID=A2Q4W6; Match level="QueryCoverage=41%, HitCoverage=47%, E-value=5e-18, Identity=23%"; Hit description=RNA -binding region RNP-1
  Pfam annotation: Domain name=RRM_1; Domain location=65-135; Score =33.2; E_value=9.6e-07; Accession=PF00076.13; Description=RNA recognition motif. (a.k.a. RRM, RB
MRGRERVSGERNTGWGSDRLRGRTVGRDRASLGEVSRRRFAGNIGRTKLSSTVINWRDQKDITSFYFSRFADDITEQELWHHFKKWGDVREIFIPNRRNASGRRYGFVRFKGVQDIPYLAKQLDEIVIGGLKLFVNLPKYGRVTQRKTMVTFQSRRNTDRKNEEVFRYHHTKPTSYADALTRNIRRPVYQRTANTIANYRSSSSSVHIEVAPEDTLWLKDAWVGRLKNQALFERLEDEFRWGMGLEIVPRYMGDDQVLLLGLTDADADKLINGGTTGESMMFSYIERWNPSLRAGNRLTWIHCWGIPIQAWNQKYISQIVAVMGELMDLDDSAEEKRRMDRARVLIKTPWKPIIQHTVEVTIGEDKFMIQIVEECCGGCQDGFRSGRNERGSSEDINSDDSFLDSSSFANWGFGDDASIVPESDFRSAHTSTAATTANGAGNHGEQQPPLLHASELHIASPGAVAENDVGVEDQQSPTASNGPSDNGYPLDNVNNHRVDSGNQWVNTHGPNSNFMQATVTHNPEDSAKRRAMKWEPVPNIDDTLQSYTNSMDIAVGGDVERINDSLMTRGTGEYKEVEAIIVDTEARAILTDQNSNSTPSDKRSKLGLNPLTGGGATSCQVYSRQRRCKKKITSGLIPLGSGDETHKGLSQPPNTQPSSLHNEPYNDKLETPFQLQVYNGNMEATSDSDKTFNPDALQMWSMAKQLGLTGEGSKESVIQKFQNMEERDRAEATRRVSATAINENNLL

SEQ ID NO: 171694 - protein, 145 aa, Glycine max
  Coding DNA Sequence Number=SeqID_80009
  Gene Ontology: Mol. function=RNA-directed DNA polymerase activity; Biological process=RNA-dependent DNA replication
  Homolog annotation: Hit_ID=A5AYC5; Match level="QueryCoverage=88%, HitCoverage=24%, E-value=4e-16, Identity=29%"; Hit description =Putative uncharacterized protein
GLTGLMRTAISKNLYSSYQVGSLKEDINILQYADDTLFFGNALSANVRVLKQMDIPFMYLGIPVGSNPKSGTVWQPIINKFQTKIPKKVTQKIVAIQRNFLWGGDNGTSKIPWVKWDTVCLPKARGGLGIKDLNKFNELGLLGIS

SEQ ID NO: 171695 - protein, 196 aa, Glycine max
  Coding DNA Sequence Number=SeqID_80010
MTGRRVWIMRTSMTTLTQIWMTLLLSNILPSDHNSNLPLPKCQLVYAILTQISVHVAQLISDAIYQFVGIIPPRHPMDPKKSYRALGFSALITDAPPPPLQQPPSLESISAHMQRMDLCMQHLADQQAANHRGQVQLNDSFYQYTLHQQRQDPSPYPWPTLEQFRANVAWLRDRPNFQAGAGPIEAPGDEDEAEED

SEQ ID NO: 171696 - protein, 54 aa, Glycine max
  Coding DNA Sequence Number=SeqID_80011
MVFHLRLVMSIKTKKGEHRLKGAIKGINSSKKYQQESSQGYCASNQWGKTHRIK

SEQ ID NO: 171697 - protein, 52 aa, Glycine max
  Coding DNA Sequence Number=SeqID_80012
MGLRGRIVLGNGRMPGQIDRQRLIKVNGNAATVCCAMSFPAFRYLGTDATRG

SEQ ID NO: 171698 - protein, 45 aa, Glycine max
  Coding DNA Sequence Number=SeqID_80013
MWMTEEMKKREELVLVGLRRFHGGGGVTCNYWSLLVIDYNLAVLR

SEQ ID NO: 171699 - protein, 193 aa, Glycine max
  Coding DNA Sequence Number=SeqID_80014
MQRLLNRNKEKPYRRIAKSSSFTLKPLSPREVCDDQIRMGEKREQEKENKASEVRKVLLAHEPLNLQYCKDSIEHQVDLLPGASLPNRPTYKSNPQETQRKDAHAKVEYVKRLYDQVKVQIAKKNESYVKQAHKKRKEVVLEPGDDPEHLRTNVFQEGGNDENHETGQIQAKGPSGEGRRPKWRRTKPPSGEG

SEQ ID NO: 171700 - protein, 114 aa, Glycine max
  Coding DNA Sequence Number=SeqID_80015
  Homolog annotation: Hit_ID=UPI00006A17C9; Match level="QueryCoverage =78%, HitCoverage=69%, E-value=8e-08, Identity=37%"; Hit description =UPI00006A17C9 related cluster
  Subcellular localization annotation: CTP_CleavageSite=44; ConfidenceScore=5.02e-01
MHSSYMIASSSSCARTVDPRPGSGGGPGTDKRKLLAPHPGAQVSPSEVEDLSPFEGEGVQPSEGEGMQPSEVRACSPLKARACNTLKVRTCSPRKARTCSPLKARACSPLKPRA

SEQ ID NO: 171701 - protein, 49 aa, Glycine max
  Coding DNA Sequence Number=SeqID_80016
MVKCQDGSKGRNQSRDGRKWRLGSRSIDHHLMPNTGQAGSAAGGQPSIL

SEQ ID NO: 171702 - protein, 347 aa, Glycine max
  Coding DNA Sequence Number=SeqID_80017
MAPKKLSTKRSRRDVTAEGSSAAPEFDSHHFRSAVHQQRFEAIKGWSFHRERREEIARRHWTSLVTPMAKFDPEVVLDFYANAWPTEEGVRDMRSWCEFSQRRNRADGFDEEAIAQLLCTPGQDFTRTPAGRPVRIMRTSMTTLTQTWMTLLLSNVLPSDHNSDLPLPKCQLVYAILTRMSVHVAQVIADAIYLFAGMPPTRHPLDPDKSNRALGFSTLITGLCQSFGVLVTPTKVIRPPITRAFIEKYSTPRQAQGDAHQAADAQPPPHQADPAGSLGMERYLQHLVRQQAANHRGQVQIHECFYRFSLSQHGQGEEPTESPGEAEEARMDEEMTDLLGFLGGSGA

SEQ ID NO: 171703 - protein, 98 aa, Glycine max
  Coding DNA Sequence Number=SeqID_80018
MERQKMSVWRCMDDRMEPSVPNLNRSALSVPSAGSSPRLEVDDVDTEFVPPYEPRNPFHLVRLEGHPQPKLLLNESGDNLEPLLIAKIHGVDGESESE

SEQ ID NO: 171704 - protein, 87 aa, Glycine max
  Coding DNA Sequence Number=SeqID_80019
RIQGTNRLRILCPNTLEGTSFVAQVEGTSTWVVILRTREGTSLVEGTSTWLFKENKGGYIPCGSLACKGFYKVERNLKNHWLLRDWM

SEQ ID NO: 171705 - protein, 29 aa, Glycine max
  Coding DNA Sequence Number=SeqID_80020
MALSAQRCAKRDLQHSLNPGHIGVIGISK

SEQ ID NO: 171706 - protein, 58 aa, Glycine max
  Coding DNA Sequence Number=SeqID_80021
MSNGPKTNPSDEEPPGLELKPLPSSLKIPTSARHCAPLQPLGNLTITCQARDVKQALS

SEQ ID NO: 171707 - protein, 70 aa, Glycine max
  Coding DNA Sequence Number=SeqID_80022
MWFASRRPTTTDRCSCMSASTDSASAKQFGAAVAWLGDCPDAQTGAGPAGAPGAEDEAQEDEDMADLFDF

SEQ ID NO: 171708 - protein, 74 aa, Glycine max
  Coding DNA Sequence Number=SeqID_80023
MVREQELDVFLQGSIKACRRSNDDDGRWLTAEDGIERNEGYLEECRSRAPSIGGFDTNLKDNNLNIIVILSFKE

SEQ ID NO: 171709 - protein, 73 aa, Glycine max
  Coding DNA Sequence Number=SeqID_80024
MQIATKIDGDVWFKEMQICYGLLKGLEEGIGLVEVEAFRTAHMMEPGLEDLEGGSILIGAFKTSKERVFGRTR

SEQ ID NO: 171710 - protein, 56 aa, Glycine max
  Coding DNA Sequence Number=SeqID_80025
MVGERVMSLVLDIGHPIPLYCRHAALVDIIEVSSSSSSLSNRPISYPTNSKATPST

SEQ ID NO: 171711 - protein, 99 aa, Glycine max
  Coding DNA Sequence Number=SeqID_80026
MELQRKIKEKRCHEHERCDSSTWEASLRSLGSREENFLEKLEKNGSNLGPWAHKSTLRFMRTLRPSSAALVQCQNRLGFLGKEVAGIHLAWGGPSLDES

SEQ ID NO: 171712 - protein, 58 aa, Glycine max
  Coding DNA Sequence Number=SeqID_80027
MAQVGTQFDVFVFKNGFFKVENVGKGPVTRAMSKRLQEDWARAAEEGPRVLMNLRVDF

SEQ ID NO: 171713 - protein, 87 aa, Glycine max
  Coding DNA Sequence Number=SeqID_80028
MSSIVTSTGSVKCGSNAFQGYFDDAKESRVKQIPKIQESSFKNQDSRFKNFQRFQNQVSRIKNRDSRIIKIKIQDSRFKNQEKTQSR

SEQ ID NO: 171714 - protein, 115 aa, Glycine max
  Coding DNA Sequence Number=SeqID_80029
MKNIKKEHGEHKNTASRTLIAQFQHLQKCLPRLSMLLEVNNNMGSLQGTCHLSQMKMPTNLEHPIAYGFKICPLAGRRWQVKVAVWRWKRKVEVRRKKMKVKVKEDEPEGKAFLK

SEQ ID NO: 171715 - protein, 108 aa, Glycine max
  Coding DNA Sequence Number=SeqID_80030
  Subcellular localization annotation: CTP_CleavageSite=70; ConfidenceScore=5.03e-01
MDDFHGLSSVQIAIGMGDFHGLSRQTKWQLSPKPKKSTKSAALHPARPANHEVANTAGGTSFHVKSPAAVADHVENNTMAEIVQKRPHLGNKFAKGPQMGKFATIFSE

SEQ ID NO: 171716 - protein, 160 aa, Glycine max
  Coding DNA Sequence Number=SeqID_80031
  Subcellular localization annotation: CTP_CleavageSite=28; ConfidenceScore=5.47e-01
MASSNNLSPPLPHFQTPLLRSSKIPIFYAATTGGTSDQISSSSTIVQSDMKILRMKLGEAGSGAAHMAAVDSFKVNPFSSAWKHSLLSNKPMHEFLLKIKAISDSLASIGSPIFEGLLQDYYSVKASRLQRFQKHAFSDSPAVNNTQANPSFPSAHGYEG

SEQ ID NO: 171717 - protein, 392 aa, Glycine max
  Coding DNA Sequence Number=SeqID_80032
  Gene Ontology: Mol. function=nucleic acid binding; Cellular component= intracellular; Biological process=chromatin silencing at silent mating-type cassette
  Homolog annotation: Hit_ID=A7PKF4; Match level="QueryCoverage=93%, HitCoverage=41%, E-value=1e-112, Identity=60%"; Hit description =Chromosome chr15 scaffold_19, whole genome shotgun sequence
  Pfam annotation: Domain name=Helicase_C; Domain location=66-156; Score=76.4; E_value=9.4e-20; Accession=PF00271.22; Description =Helicase conserved C-terminal domain
MKLGGELLNQNIGGIESEPYEEGEHLVQASGKLLILDQLLQKLHYSGHRVLLFAQMTHTLDILQDFLELRKYSYERLDGSIRAEERFAAIRSFSSSSANMGLNSEADQNEAFVFIISTRAGGVGLNLVAADTVIFYEQDWNPQVDKQALQRAHRIGQMNHVLCINLVTERTVEEVIMRRAERKLLLSLNVIGDNILKDDNKEPSEVGSGDLKSIIFGLHMFDPTEINDGNHRNMNIPEICAMADRVLAMRDEQILDNDERKFEVNPTNILKGDAVKERDSASLSCDLGLDEASYLSWVKKFEEVSKSSCDSITDLRSRRNVDEEKSLKIESARKKAEEKKLARWEALGYQSLNVKDAISPTGNDIASASGSVHFVYGDSFALMHQAFAHLNQ

SEQ ID NO: 171718 - protein, 181 aa, Glycine max
  Coding DNA Sequence Number=SeqID_80033
  Homolog annotation: Hit_ID=Q5XM22; Match level="QueryCoverage=35%, HitCoverage=36%, E-value=8e-17, Identity=63%"; Hit description =Resistance-like protein HAAS-2
  Pfam annotation: Domain name=DUF1723; Domain location=42-91; Score =45.1; E_value=2.5e-10; Accession=PF08330.1; Description=Protein of unknown function (DUF1723)
RPELKLSSHGRNVQKLGRPSPKIEGLVASTGLSHLIACSVDTGNRGLISSFVKRWHTETSSFHLPVGEFSITLDDVASFLHLRIVGAFHTFQPLHVNEAMLMLVELLEVSGEAARAETTYCHGPYVRLSWLPDIYQSRCQAGHWTAAARVYLLHLLGCTLFANKSATHVHVVFLDALDDLS

SEQ ID NO: 171719 - protein, 85 aa, Glycine max
  Coding DNA Sequence Number=SeqID_80034
MLATGNRLLPSDTQLPERFYKDSGNLKRVAWGLDVGMGCGQTSLGSSSSMHSFASRKMNGSGIEKEEREEMPLQGEDESRRSSPP

SEQ ID NO: 171720 - protein, 42 aa, Glycine max
  Coding DNA Sequence Number=SeqID_80035
MGLNQFRFFNMVHDILVKVKLEVYDPNMVGSWYRIYATKNAS

SEQ ID NO: 171721 - protein, 154 aa, Glycine max
  Coding DNA Sequence Number=SeqID_80036
MASGNRLPRITMVVQLIHDRVVMECLEGVWETLEGNERCRFRGTIRLTATSLVHPEEPARTLQQLVEWILPTPTPYRLVEPVQVIEVSSSKVDPEEDPEELPPEPAMDDLDLPEDDEDPLPDVDSPEDIMSASEADSTEESGPGGTANCEDSSS

SEQ ID NO: 171722 - protein, 338 aa, Glycine max
  Coding DNA Sequence Number=SeqID_80037
  Pfam annotation: Domain name=Transposase_23; Domain location=104-169; Score=-13.8; E_value=0.039; Accession=PF03017.5; Description =TNP1ENSPM transposase
DVLVTAIGRPEHPGLVRAAGAGVTIKQYFGSTPRTSRNASSLPPDELQQLTQQIRDQLEESITEKVTRQGLAVPPEPLVGPGPSGPRVSTKGSCVDPSGNDPETGDSDRCGLYKEADPARLVAMGRVYEGSTVVHNTPLLPGQVKVSVEEVADADAPVPVPTDEVAVSPPKPPPKPDPEVNDPLYLMTLTIPELFLRPYQVRWDATVFGVVNPDFPLYIKHKDLSEIAHSGQCLSISVLQLWILHLTETCMRVGNSDIYGFLEPQSIQRSGQSQFESESYIKSWMQSSQHDVYLGAYLNGFHCSGHWQMVVILPKEHLVVWFCSLHNRPDNYLKGIIN

SEQ ID NO: 171723 - protein, 152 aa, Glycine max
  Coding DNA Sequence Number=SeqID_80038
EHEMELQRLNQNEETDKKKRSIALKASSSMQEANEEEDSDDEEDFSLFVKKFQKFVKRTRIERRQNFNNGKRSQEDSQVLRCYKCNQLGLIKANFPSNEEWPEKSDKERYNERRTKKAYIAWDDNDSSDDSEKEINLLTKDYESDENISQEG

SEQ ID NO: 171724 - protein, 134 aa, Glycine max
  Coding DNA Sequence Number=SeqID_80039
MLHWPYPHLVTLFLQHFNIPLDSEPYVPIKRSFLIGAFVIASFGYQKEHDGSWVKKGARHVGEEGHDGEDSSLLSKILDMFDGLQTFVGERFDTLELQVDMHFNEMESRITKVEEDVSYIRSSFDLPPPPPPSS

SEQ ID NO: 171725 - protein, 203 aa, Glycine max
  Coding DNA Sequence Number=SeqID_80040
MTEARQKGVQKLKTEENEERTMDVEERLKTFVKIGEELATQLAQASMVASSRSNSLLEEESGRPNFRRSYGNSRIAQQHLLLVSAALRNFTDRITLLPFKMTSGASRDLHIVQQRVPSILKRPIKGCMSSSNNPRMKLGYSLEIPNKGVWKQSLQAYFDDAKDSSQESRFKQVSRTKKSFNQDSSEDSREDSRYARTSRKASR

SEQ ID NO: 171726 - protein, 26 aa, Glycine max
  Coding DNA Sequence Number=SeqID_80041
MMLGFGVSIVGGVEGFGKSDGVDGVN

SEQ ID NO: 171727 - protein, 214 aa, Glycine max
  Coding DNA Sequence Number=SeqID_80042
MGDQEETQEQMKADMSALKEQMASMMEAMLGMRQLMEKNVATAAAVSSAAEADPTLLATAHHPPSNIVGRGRDTLGHDGSPHLGYNRAAYPYGLPPNYSPPVLQDDAGHIASPVLEREPPQQPEEVHKDPQDYARREVELYPPIPEGPAPSTLPQPNIATQPIVSSTEGPSPATEERRKLDLLEERLRAVEGFGDYPFADMTDLCLVPDVVIPR

SEQ ID NO: 171728 - protein, 173 aa, Glycine max
  Coding DNA Sequence Number=SeqID_80043
MDNKEGVQEQMKADLLALKDQMASITEAMLKLQKTIEDNATAAASNTAREAELVLQPAINLGRDKNATGFNRRYSPQAYPYGLPPDFTPRTAPDDLSQAPTFEGQLPPHADYPLQEDDEGDAHLGPLLPLKEPSPHELPQPNIVYHFPFHPHPLRNSFPLQKTRESLIYLKRG

SEQ ID NO: 171729 - protein, 51 aa, Glycine max
  Coding DNA Sequence Number=SeqID_80044
MAKINQGTDASGARVTTDRSLPLPGAKQVENVAARQPSILCVRSFFYYCLF

SEQ ID NO: 171730 - protein, 81 aa, Glycine max
  Coding DNA Sequence Number=SeqID_80045
MPKNQKNVDAQSVSFRDTPEIKWKHRCIIKRGSVTFPPRPVWALQKIPPEGGCFWRKQPCSPGRAELAWASWAATTSPILL

SEQ ID NO: 171731 - protein, 162 aa, Glycine max
  Coding DNA Sequence Number=SeqID_80046
MDAHPCQDGVHQLALRHGEVGIMIGGQDVAEEQRHPYLGQGGHIGAHDSHSLPAAVRAKSCPGIHSSWAMASSSNPSDRVGIERDPLTPNPGSHVTHALLCWPSIGIKLKDYFWIKLGHRSNQWCPPPAPYFLLEISILVVPELDASLPEKRPSLDGFEALL

SEQ ID NO: 171732 - protein, 198 aa, Glycine max
  Coding DNA Sequence Number=SeqID_80047
ELAMRTYRAKRVHLVRMNTHPPVEIHMSSRKRARAKDIPSSSTPAPPSATIGPDAQSSQTLVPMLQSLFRGQFIIMHSLRQLAHHRPIITMEHFLERVAWPEAQPPLVRPNEATPPEPTPARVEPVPTDPQSPVVNPPSSPKLEVVPPSPPLIIISDSPSGEAAAPPESPSGEAANLFYSLSGEAVALFDSPIFPSDR

SEQ ID NO: 171733 - protein, 65 aa, Glycine max
  Coding DNA Sequence Number=SeqID_80048
MACLDQQHFGKEGQAVVVMEGLPISDLDDSSNLDCIYCLKDHNYSVVVGFATEEVQMQISDSWQA

SEQ ID NO: 171734 - protein, 69 aa, Glycine max
  Coding DNA Sequence Number=SeqID_80049
  Homolog annotation: Hit_ID=A5BKR0; Match level="QueryCoverage=91%, HitCoverage=4%, E-value=7e-12, Identity=56%"; Hit description =Putative uncharacterized protein
MDYKQDNNEVLPQIPIQQPQKVSLRRSIREKRSSIPDDYIIFFQEHEDDIGLTEDDLINFCQAMHSSNS

SEQ ID NO: 171735 - protein, 333 aa, Glycine max
  Coding DNA Sequence Number=SeqID_80050
  Gene Ontology: Mol. function=two-component sensor activity; Cellular component=membrane; Biological process=two-component signal transduction system (phosphorelay)
  Homolog annotation: Hit_ID=A6VRK3; Match level="QueryCoverage=79%, HitCoverage=89%, E-value=2e-75, Identity=51%"; Hit description =Methyl-accepting chemotaxis sensory transducer
  Pfam annotation: Domain name=MCPsignal; Domain location=104-329; Score=51.0; E_value=4.3e-12; Accession=PF00015.12; Description =Methyl-accepting chemotaxis protein (MCP) signaling domain
  Pfam annotation: Domain name=PAS_3; Domain location=12-103; Score =56.9; E_value=6.9e-14; Accession=PF08447.2; Description=PAS fold
  Pfam annotation: Domain name=PAS_4; Domain location=1-105; Score =32.0; E_value=2.1e-06; Accession=PF08448.1; Description=PAS fold
  Pfam module annotation: Pfam domain module=MCPsignal::PAS_3::PAS_4; Domain location=104-329::12-103::1-105
MAVIEFTPDGHIITANANFLTHMGYTLPAIAGQHHRLFCFDNFYRENPDFWRKIGNGQHFVGRFERKTASGERIWLEASYNPVFDGDGKVYKVIKIASDITARVEAAKRVADIALTTSEQTSQITDNANEVLDETVRNSGLVAQQVNAAAEIGAQLTASARSISDVVETINLIASQTNILALNAAIESARAGEAGRGFSVVAGEVRRLAASTASATKQISVVVEQNADLIQQMYQQLDEVRQFVVTEQEKISVLSRSLREINSGVHDVRGSAGSRAITARCPPAARAAASTSAHYAAPIQGVTDKSDGGEKAQGKPALNLSGIKAGDKKQHHQ

SEQ ID NO: 171736 - protein, 108 aa, Glycine max
  Coding DNA Sequence Number=SeqID_80051
MGVQIVIFESGPTRGFWAISCLRWKQPSSPGRASWIASEGSNPARLGGLGGNLLPLFPKNRLKGAVLRIPDAPGEVFPPLFTVLHPFFVLQRNPLISVKMNSDRSVVP

SEQ ID NO: 171737 - protein, 244 aa, Glycine max
  Coding DNA Sequence Number=SeqID_80052
  Pfam annotation: Domain name=Transposase_23; Domain location=1-47; Score=-16.1; E_value=0.069; Accession=PF03017.5; Description =TNP1ENSPM transposase
MDRDSVIHTVAYADDVVRVSVDTVIDPDAKIPYATSEIKYVKQALHTFVAWPTDLVKLVFDETFIHYTSNTDPHSFAMLDEEIILHKVDAHGDKPANVDTDDPMCGLIKYSFDIYDKPVECKFDGTKFGIADAPPSIFLTYSDVSEIIAGDKSLNISVQQLWLMYMHEWTETLEQGSHYAFLEPQSLVVSKETRGECEGYLERWLKESDREVYVGPYFHHVMTKLKMSLSPESKAAAPKWIEVK

SEQ ID NO: 171738 - protein, 206 aa, Glycine max
  Coding DNA Sequence Number=SeqID_80053
MASRKCKSMGARPTAQYDTRRFHSLDAWNRYTDNVLGRSILPERKVDIYHTEFDDFKTELERRNLHKRLTNLADGTIYLALAKEFYANLYNSKDPSPKQARVRGHLVKIDIDSLNTFLETLVVLEEGETLPTYSRYCRLPLDYREIEAALCIPVAFRGARRARARPADIPSSSAAPAPTPTSTSAAPSVPAHVDSQRFEAMPQSIH

SEQ ID NO: 171739 - protein, 177 aa, Glycine max
  Coding DNA Sequence Number=SeqID_80054
  Homolog annotation: Hit_ID=Q6WAY4; Match level="QueryCoverage=98%, HitCoverage=32%, E-value=1e-18, Identity=35%"; Hit description =Putative uncharacterized protein
MGTNPNEKRFYQVKVKGLDVTSLKELGRLMGPLQRQAFRKVYGKILDLTAAEVFTESVVSLAQYYDQSLRCFMLGDFQMVPTIEEFKEILGCPLGGRKPYLFSGFLPSLSKIAAAIGDSAKELDRMKQTRNSVVGLPRKYLEGKARDMASQERWGPFADILALLIFGVVLFPNVDSL

SEQ ID NO: 171740 - protein, 102 aa, Glycine max
  Coding DNA Sequence Number=SeqID_80055
MNTARESFSSGAELRTAVQAEVANPKSPQRGTTNKTTQLDNSATTDHLSKDTSNNKGHGNANHATESTQKIVCVREKQGNLVEACWLNTRVAVLMVVQVGEL

SEQ ID NO: 171741 - protein, 468 aa, Glycine max
  Coding DNA Sequence Number=SeqID_80056
  Gene Ontology: Mol. function=6-phosphofructokinase activity; Cellular component=6-phosphofructokinase complex; Biological process=glycolysis
  Homolog annotation: Hit_ID=Q8VYN6; Match level="QueryCoverage=25%, HitCoverage=24%, E-value=3e-40, Identity=68%"; Hit description =Putative pyrophosphate-fructose-6-phosphate 1-phosphotransferase
  Pfam annotation: Domain name=HSP90; Domain location=1-238; Score= -198.7; E_value=1.2e-07; Accession=PF00183.9; Description=Hsp90 protein
MALLKIKCKMDVAFKDANPKAFLWEQVSRSVKKCKEKFENIYKYHRRTQEGSKLSCFLEWVAGVEAEEIVRGENKEDYNKFYEAFSKNLKLGIHEDSYNKGKIVELLKYYSTKSGDKMRKVRVKSTTSQEVLYMVDAIDEYVVDQLKEFESKKFVSATKEGLKLDKNEDEKKKQEELKEKFDNPCKVIKDDKSMKDLILFLFETALLTSSFSREVVADMPPLEEAEADAEGSKMEKEIAGFGPCDEFHYHTTSMDFLAKELLKKFERRDKALEMAAFSPGVTKHENKEYKVIAKEASKIGREMCNKIGIAFTNFVPKGTYDVIILDVFQPMGSIAEVLADNCFLELSSKGSSTRWSHCKRRLKIFVTGVPKTIDNDILLIDKTFGFDTAVEEAQRAINSAYLEAHSAYHGDRGFIAMHASLASGQIDICLTPKAPFNLHGPCGVLSYLKYLIETKGSVVVYVAKRARQ

SEQ ID NO: 171742 - protein, 128 aa, Glycine max
  Coding DNA Sequence Number=SeqID_80057
MFRSKVWEVAARVAAEELGEGRVPLSLLKNHRRLQEGVQCLSTKLDDLPSDLALFTRVVLKIIYVVVELPQQSYMNIFVWKPGELFVPTSQLELLQELIIVYVGQLGVPLQKDVPYTNVLLIYVPSHF

SEQ ID NO: 171743 - protein, 155 aa, Glycine max
  Coding DNA Sequence Number=SeqID_80058
  Homolog annotation: Hit_ID=A5B631; Match level="QueryCoverage=80%, HitCoverage=18%, E-value=3e-24, Identity=45%"; Hit description =Putative uncharacterized protein
  Pfam annotation: Domain name=DUF26; Domain location=82-135; Score =49.2; E_value=1.5e-11; Accession=PF01657.8; Description=Domain of unknown function DUF26
MVQLKLIALTLSVLWSWWSFEGAVGDPQLFLLKWECGVVSVHDLSNFNQNRNASLADLRLQLVSNQSKHFVTAQSTTGADPVYAMFQCRNYLSNTDCTACLAAATTNIRNCSTGNTARIVYDGCILRYTSKKLLYCVQLWENTTERTAIAVVMRL

SEQ ID NO: 171744 - protein, 193 aa, Glycine max
  Coding DNA Sequence Number=SeqID_80059
  Homolog annotation: Hit_ID=A2Y1D2; Match level="QueryCoverage=68%, HitCoverage=23%, E-value=5e-12, Identity=34%"; Hit description =Putative uncharacterized protein
  Pfam annotation: Domain name=Transposase_24; Domain location=11-146; Score=11.0; E_value=5.2e-05; Accession=PF03004.5; Description=Plant transposase (PttaEnSpm family)
MVAHIPDPRVDPSQYRDLVYYWCSEKGQKINNINKRSRLKYEDLHCMGTNNLPRRIHEMTTKAKGVQPSRAKIYIDSRTRKDGSIVTEKAAIIIDELKKKMVEAESSQNLQSTQDSTNWTNDIYSKVKGPKKRGRVHCLGKLPHQASSSQSSYANNKIQKLENLLGNLVAVLKVRFAEDPQINQVLEAIDQEV

SEQ ID NO: 171745 - protein, 115 aa, Glycine max
  Coding DNA Sequence Number=SeqID_80060
  Homolog annotation: Hit_ID=A5BP71; Match level="QueryCoverage=61%, HitCoverage=18%, E-value=7e-11, Identity=47%"; Hit description =Putative uncharacterized protein
  Pfam annotation: Domain name=zf-CCHC; Domain location=88-105; Score =18.9; E_value=0.0021; Accession=PF00098.14; Description=Zinc knuckle
MAIIVNAEACGYVSMNYYQYIDVVYTNEHILKAYSAQWWPLGNEAAIPPSDEAWTLIPDPTTIRAKGRPKSTRIRNEMDWVEPSDHRQKCSRCGAEGHNRRRCPMQYDRGSNSFN

SEQ ID NO: 171746 - protein, 66 aa, Glycine max
  Coding DNA Sequence Number=SeqID_80061
MAAHQGELMLHPEVTSSPRRAGSFSPRQFGGPGKSKASLGELGSRKIPEKTLLPLPFCWIKWPQNN

SEQ ID NO: 171747 - protein, 131 aa, Glycine max
  Coding DNA Sequence Number=SeqID_80062
  Gene Ontology: Mol. function=protein serine/threonine kinase activity; Biological process=protein amino acid phosphorylation
  Homolog annotation: Hit_ID=A5B631; Match level="QueryCoverage=87%, HitCoverage=16%, E-value=1e-23, Identity=49%"; Hit description =Putative uncharacterized protein
  Pfam annotation: Domain name=DUF26; Domain location=80-131; Score =25.5; E_value=4e-06; Accession=PF01657.8; Description=Domain of unknown function DUF26
MQFKFVALTFLVFWSRWSFEGAVGDPQLFLLVSECSGFGVPNLSNFYQNLNASFADLRAQVSNNSKHFATAQSVTGTSPVYAMFQCVNYLSITDCATCLAAAAAEIRNCYTGTNNGARVVYDGCFLRKVIF

SEQ ID NO: 171748 - protein, 97 aa, Glycine max
  Coding DNA Sequence Number=SeqID_80063
MMVSLTFFLKSELCWRCMYDFKATGLPDTTEFYCSPMLWHCYLLGKDVGFNRCNISRLIKTLIGSGGTVSTFLGSIKGTTLICLDTLCLTEGFVCEN

SEQ ID NO: 171749 - protein, 158 aa, Glycine max
  Coding DNA Sequence Number=SeqID_80064
  Homolog annotation: Hit_ID=Q2HW90; Match level="QueryCoverage=100%, HitCoverage=38%, E-value=9e-17, Identity=33%"; Hit description =Putative uncharacterized protein
FSKAYGKIWDLAMIEVFAEAITSLTQYYDQSLRCFTFGDFQLAPTIEEFEEILGCPLGGKEDIPLWIPWKRLEEKVEALANQGEWTSFINMLALLVFGTILFPNVDGLVDLAAMDAFLAYHHDKESLVIAVLADAYDTFDLRCKKSSARIVCCTPALY

SEQ ID NO: 171750 - protein, 101 aa, Glycine max
  Coding DNA Sequence Number=SeqID_80065
  Homolog annotation: Hit_ID=A5BP71; Match level="QueryCoverage=67%, HitCoverage=17%, E-value=4e-07, Identity=44%"; Hit description =Putative uncharacterized protein
MAIIVNAEACGYVSMNYYQYIDVVYTNEHILKAYSAQWWPLGNEAAIPPSDDAWTLIPDPTTICAKGRPKSTRKRNEMDWLEPSDNRQKCSRCGAEGHNRR

SEQ ID NO: 171751 - protein, 140 aa, Glycine max
  Coding DNA Sequence Number=SeqID_80066
  Homolog annotation: Hit_ID=A5B631; Match level="QueryCoverage=88%, HitCoverage=18%, E-value=4e-24, Identity=48%"; Hit description =Putative uncharacterized protein
  Pfam annotation: Domain name=DUF26; Domain location=82-134; Score =27.9; E_value=2e-06; Accession=PF01657.8; Description=Domain of unknown function DUF26
MVQLKLVALTLLVLWSWWNFEGAVGDPQTLILKFECSVVSVHDSANFFQNLNASLANLKSQLVSNQSKHFVTAQSTTGTDPVYAMFQCRNYLSNTDCVTCFAVAAATVRNCSTMNTARAIYDGCILRKKREFYATLRGLR

SEQ ID NO: 171752 - protein, 225 aa, Glycine max
  Coding DNA Sequence Number=SeqID_80067
  Homolog annotation: Hit_ID=Q6WAY6; Match level="QueryCoverage=55%, HitCoverage=21%, E-value=1e-15, Identity=38%"; Hit description =Putative uncharacterized protein
HCSCVEKGKANWDQLLASMEGASVNWFPRWKEGRNVILSLCEGFPNVPLIGTRGCINYNPILAIRQLGYPMRGAPSEESITPFIARGFSDPNVRVLQGVRKAWDVVRRKDKKVRGSSNGTIGGYQKWLRVRTQGLDWLPKLRVARDEEAEAPEESDEVEGMILKDELKACLRSKRNLSQQLSKTEGNMWAAIDECKKKLNLATTHEQRLEDEYTKISVEREARER

SEQ ID NO: 171753 - protein, 76 aa, Glycine max
  Coding DNA Sequence Number=SeqID_80068
MGAMWMIFLKSCMSYALWLFVDAKGGEKIGIKSRTHIIKFVIIKKGEIVEASFMMMNQVDSSSFDDDKDDDKKPKE

SEQ ID NO: 171754 - protein, 87 aa, Glycine max
  Coding DNA Sequence Number=SeqID_80069
MRTLLIGQGVGLGLIFQIIPQGTHENDDLETTCKISHGHSQVGTQASHLRHCDTTVRNLHKQTQRFPIMFFHQFNEFIHSYLGYSGK

SEQ ID NO: 171755 - protein, 95 aa, Glycine max
  Coding DNA Sequence Number=SeqID_80070
MVHASCVKVIPLWERMLLDLPGSYYSHLVGDEGGQEVFVRHWDRGEFWNWPRGKVFHRVGTGTKVGIAGWASRGWSRSLGGLPLDGGGRSRLFAS

SEQ ID NO: 171756 - protein, 484 aa, Glycine max
  Coding DNA Sequence Number=SeqID_80071
  Gene Ontology: Mol. function=transporter activity; Cellular component= outer membrane-bounded periplasmic space; Biological process=transport
  Homolog annotation: Hit_ID=A4WDC7; Match level="QueryCoverage=100%, HitCoverage=96%, E-value=0.0, Identity=80%"; Hit description=Lytic transglycosylase, catalytic precursor
  Pfam annotation: Domain name=SBP_bac_3; Domain location=25-236; Score= 40.5; E_value=1.2e-10; Accession=PF00497.11; Description=Bacterial extracellular solute-binding proteins, family 3
  Pfam annotation: Domain name=SLT; Domain location=259-375; Score =134.6; E_value=2.7e-37; Accession=PF01464.11; Description =Transglycosylase SLT domain
  Pfam module annotation: Pfam domain module=SBP_bac_3::SLT; Domain location=25-236::259-375
ALWPSIPWFGKAENRIAAIQERGELRVSTLNSPLIYSDINGKIIGLDYELAQQFADYLGVKLKITVRQNINQLFDDLDNDDADILAAGLVYNSERSKNYQPGPTYYSVSQQLVYRVGSQRPRSLASINDRQLTIAPGHVVIDDLRELKEKKYPDLSWTVEAKLGTTELLEQVKDQKVPYTIADSVAISLFQRVHPEIAVALDLDNDQTLSAAMLDFFNTINEDGTLARLEEKYLGHGDDFDYVDTRSFLRAVDSVLPDLQPLFEKYAQEIDWKLLAAISYQESHWDTQATSPTGVRGLMMLTKNTALSLGVNDRTDAEQSISGGARYLQDMMAKVPETVPEEERIWFALAAYNMGYAHMLDARTLTAKTKGNPDSWSDVKQRLPLLSQKPWYNKLTYGYARGHEAYAYVENIRKYQISLVGYLLEKEKEATEAKQLAESYPVVAPDELNRPSASILPFVAFSADGAFERNRLIAPNTLVQVPHR

SEQ ID NO: 171757 - protein, 158 aa, Glycine max
  Coding DNA Sequence Number=SeqID_80072
  Homolog annotation: Hit_ID=Q1J7G7; Match level="QueryCoverage=20%, HitCoverage=60%, E-value=9e-07, Identity=66%"; Hit description =Transposase
  Subcellular localization annotation: CTP_CleavageSite=46; ConfidenceScore=5.29e-01
MVKVGTSYVPINVSFSPKVGPGLPAVPPVQLLTGWCVTAKAPPDISAGKCSGRVPFAIQAAQLLGRAIGAGLFAITPAGERGMCCKAIKLGNARVFPVTTLNSITNEERMKNGEERRRTMKNFHIIASVTLPRCFHKQNREGFPPLFTVLHPFFVLQR

SEQ ID NO: 171758 - protein, 87 aa, Glycine max
  Coding DNA Sequence Number=SeqID_80073
NNKLGGKHTETDSTPFTIQEQRVESNNKLGGKRAEIDYAPFIIQEQRVEWLDRVQQNAETTMAILRLVSTKRNKFDSSAGREVHWPN

SEQ ID NO: 171759 - protein, 88 aa, Glycine max
  Coding DNA Sequence Number=SeqID_80074
  Subcellular localization annotation: CTP_CleavageSite=47; ConfidenceScore=5.18e-01
APFEKLVDKFFCPMLLSQPTLLRASGARLTGASSKGGKCAESPPTFICRKRWKNRRKPVMKNIPDSGVVFTFEKCISTSHVCLKGQQP

SEQ ID NO: 171760 - protein, 45 aa, Glycine max
  Coding DNA Sequence Number=SeqID_80075
MWGSREWFPTVFRREEKEKSDFTVTKRIGRARLNSKTYTYSFLYR

SEQ ID NO: 171761 - protein, 54 aa, Glycine max
  Coding DNA Sequence Number=SeqID_80076
ITMAAQLIHDRVVMEYLEGVWETLEGNERCRFRGTIQLTATSLVHPEKPWRDNE

SEQ ID NO: 171762 - protein, 165 aa, Glycine max
  Coding DNA Sequence Number=SeqID_80077
  Gene Ontology: Mol. function=thiosulfate sulfurtransferase activity; Cellular component=cytoplasm; Biological process=sulfate transport
  Homolog annotation: Hit_ID=Q6AFC9; Match level="QueryCoverage=95%, HitCoverage=52%, E-value=6e-60, Identity=68%"; Hit description =Thiosulfate sulfurtransferase
  Pfam annotation: Domain name=Rhodanese; Domain location=23-133; Score= 87.3; E_value=4.8e-23; Accession=PF00581.11; Description=Rhodanese -like domain
MAVEFDSSSPKFADYAEPGRLVSTQWLAERLGEPGLVVVESDEDVLLYETGHIPGAVKVDWHTELNDPVVRDYVDGEGFAELLSRKGIARDDTVVIYGDKNNWWAAYALWVFSLFGHEDVRLLDGGRDRSIAEGRELTREATVRPATEYPVIDRDDSVIRAYQED

SEQ ID NO: 171763 - protein, 117 aa, Glycine max
  Coding DNA Sequence Number=SeqID_80078
  Homolog annotation: Hit_ID=A5C4I3; Match level="QueryCoverage=41%, HitCoverage=19%, E-value=1e-14, Identity=81%"; Hit description =Putative uncharacterized protein
MAARALGVPRHLRAPGVGLWAPHSARLETRTKESDMCASQRASKPVRRKEADWWDPPNWRCGMNRKLGYGAQLRANLDPTKGVGRLRQQDGGHGSRNPLRVCNNSPAESTSPENGWR

SEQ ID NO: 171764 - protein, 188 aa, Glycine max
  Coding DNA Sequence Number=SeqID_80079
MASRKRKSTASRPTTQYDTRQFQSLEAWNRYTDNILGWNILSKRNVKLYHTEFNEFQVELERRNLHKCLANLQDGSIDVAVVKEFYVDLYTTEDQAPKLRTNHQEIEAMLCIPRKGFVLNAEGQPWKLLRKDLATLAQTWSVFSYSNLAPTSHTSDLNIDRVRLVYGFMTNTDMNIRTSPHSTHVFNS

SEQ ID NO: 171765 - protein, 55 aa, Glycine max
  Coding DNA Sequence Number=SeqID_80080
MCTYAIFDSQSALSMHVCKFSKGNACDVGMAPRKLASKRSRKDKAAEGTSSAPGV

SEQ ID NO: 171766 - protein, 110 aa, Glycine max
  Coding DNA Sequence Number=SeqID_80081
MANDGNKSDSNSSYSLHHSNHPGMVPLAHVQPLVNGLTELQLQQILSIMQAMEHLNQLLPRQIMPIFLQDLMTGMTIGLGEQRDGLYYLVSMNKTHKVYTIKAASTSNTS

SEQ ID NO: 171767 - protein, 232 aa, Glycine max
  Coding DNA Sequence Number=SeqID_80082
  Homolog annotation: Hit_ID=Q2HW90; Match level="QueryCoverage=87%, HitCoverage=38%, E-value=2e-16, Identity=31%"; Hit description =Putative uncharacterized protein
MDGLVDLVAIDAFLAYHHSKESPVVAILADLFDTFDRRCEKSSAQIICCLPALCVWLVSHLFQQDIRHPCPLRSHHSCVEKRRVDWDQYLAGIGGRTINWFPRWKEGKEGVLFSCGDYPNILLIGTMGCINYNPALAIRQLGYPMRGALAEESLSPFLVRDFGTQSFKIIQRVHKAWESPLRKDKELRGIRNGIIGGYHEWLKVHTQGLDWLSKLKVINEENFEALEEDEEV

SEQ ID NO: 171768 - protein, 71 aa, Glycine max
  Coding DNA Sequence Number=SeqID_80083
MPFWRASEARLTGALSKGGKMRGVATNVYLWRTSEKPKETGQNENSKFGSCRQKRGFCSYVPSIEEEIRPT

SEQ ID NO: 171769 - protein, 120 aa, Glycine max
  Coding DNA Sequence Number=SeqID_80084
  Gene Ontology: Mol. function=RNA-directed DNA polymerase activity; Biological process=RNA-dependent DNA replication
  Homolog annotation: Hit_ID=Q2A9Z5; Match level="QueryCoverage=45%, HitCoverage=15%, E-value=1e-08, Identity=44%"; Hit description=Gag -pol polyprotein, putative
MIMRGQDICSSQDETTTSPSSSESEEAKGEKSSEEIYPQQEGQPLMVKEECKEVSVSSKSDQGVPMNPKRIKVIFEWPTPPSIRKIWRFYDLTNFYKRFVPYFSILVAPLTELLRNHVPS

SEQ ID NO: 171770 - protein, 175 aa, Glycine max
  Coding DNA Sequence Number=SeqID_80085
YIYLGCNTENKRGYISCGSVQVERTSTWLFKENKEGYIPCGSLLVKDFTRLLEISRTGGAWGLDEGTCCGRTMVSNDGSSGDVGTWIRARNGFRLKRQWRGKFGKIHREPQEGVPLCHIDESFVSVNWMCEGWIAMIHEETPQKQPNWVWLCPLEFELGNWKIVKQPGISVANAM

SEQ ID NO: 171771 - protein, 122 aa, Glycine max
  Coding DNA Sequence Number=SeqID_80086
  Pfam annotation: Domain name=G-patch; Domain location=1-34; Score =2.7; E_value=0.088; Accession=PF01585.14; Description=G-patch domain
HGYKPRMGLGWNNDGMASLIEFKENRGRFGLGYRPMRADVRRSALERRSRGMGQQQRPQVKEAHPCHISKSFMSASDDESGEGTNTEDPDVDFERIASQAEDGEDNDMGFSPELERMVAQED

SEQ ID NO: 171772 - protein, 75 aa, Glycine max
  Coding DNA Sequence Number=SeqID_80087
MKWGDIQGYLMVTHTVHQPWANEPNDAQRLTSSSPPFVVLTCEVSSHAGLPYGENEPVDARRLTSSYCTFCRPDP

SEQ ID NO: 171773 - protein, 504 aa, Glycine max
  Coding DNA Sequence Number=SeqID_80088
  Gene Ontology: Mol. function=ATPase activity, coupled to transmembrane movement of substances; Cellular component=integral to membrane; Biological process=transport
  Homolog annotation: Hit_ID=A5BZY6; Match level="QueryCoverage=81%, HitCoverage=29%, E-value=1e-145, Identity=63%"; Hit description =Putative uncharacterized protein
  Pfam annotation: Domain name=ABC_tran; Domain location=77-248; Score =132.9; E_value=9.3e-37; Accession=PF00005.18; Description=ABC transporter
  Pfam annotation: Domain name=Dynamin_N; Domain location=80-233; Score= -44.4; E_value=0.045; Accession=PF00350.14; Description=Dynamin family
  Pfam annotation: Domain name=MMR_HSR1; Domain location=78-155; Score=- 17.2; E_value=0.04; Accession=PF01926.14; Description=GTPase of unknown function
  Pfam annotation: Domain name=Miro; Domain location=79-191; Score= -9.5; E_value=0.078; Accession=PF08477.4; Description=Miro-like protein
  Pfam annotation: Domain name=SMC_N; Domain location=66-252; Score= -129.3; E_value=0.04; Accession=PF02463.10; Description=RecFRecNSMC N terminal domain
  Pfam module annotation: Pfam domain module=ABC_tran::Dynamin_N::MMR _HSR1::Miro::SMC_N; Domain location=77-248::80-233::78-155::79 -191::66-252
MPIYSLPDTISMIAQTKVSLERIASFLRLDEWKTDVVEKLPQGSSDKAIELVDGNFSWYLSSPYPTLKNVNLTVFHGMRVVVCGNVGSGKSSLLSCIIGEVPKISGTLKICGTKAYVYESPWIQSGKIEDNILFGKEMDREKYDEVLEACSLTKDLEVLPFGDQTTIGEKRINLSGGQKQRVQIARALYQDSDIYLFDDPFSALDAHTGSHLFKECLLDLLKSKFVIYITHQVEFLSDVDLIVVMREGRITQSGKYNDILRSGTDFMELVGAHKAALSLIKSLERRPTFKTSTTTKEDTSSVSCFELDKNVVRSNDTSDDIVKPKGKLVQEEEWEKGRVGFNVYWKYITTAYGGALIASNYWMILATLMSATAEPDIGSFKLMVVYVALSIGSSIFTFARAFLAVIAGYKTAITSVRQGLVMMGHKLLVVGEEWVKSGKGCWMKFVPKLDERSELSNESDDNDHHQIPRKEYGKPGSGQREVDEGFRHVYTAGNDYGTPGQGGN

SEQ ID NO: 171774 - protein, 68 aa, Glycine max
  Coding DNA Sequence Number=SeqID_80089
MSIKVMTVSDEDMTKSKGKDPLEGLGGPMTRARARKAKEALQQVLSILFEYKPKFQGEKSKVVSCIMA

SEQ ID NO: 171775 - protein, 1438 aa, Glycine max
  Coding DNA Sequence Number=SeqID_80090
  Gene Ontology: Mol. function=carbonate dehydratase activity; Biological process=one-carbon compound metabolic process
  Homolog annotation: Hit_ID=A7NZL7; Match level="QueryCoverage=26%, HitCoverage=96%, E-value=9e-51, Identity=37%"; Hit description =Chromosome chr6 scaffold_3, whole genome shotgun sequence
MTDPEIPQGNTVETEKIRKQQRSLHLLLKPEIANLCEILHLPENVKSMVENCLEYTMNNYQICTEPVSILQAFQLSLCWTAAALLNHKLDFEESLMLAKQNLNFDCKKEVVDEINSRLWDLKEFFLKLTGNSNVASYPKASESSNGVYSFIEETPEVELVKNDNSKNIKNVQKSKSQWNKLLLTQQEEKQKLKKDIENENGEFWRRYRIHRAAIQSCSPNDVTKEQKLKVFNSEYMKIIRELERQHEICLKDLEDKQLKTRLTFQEISAPDELINPVTSNKSGTKVDQTCDQAQHSNAPKDLVSDHVVEGEGFNDIVEIMTRTGTGIGLSEAPDANASVVVPCSSTVELQTPLVKHAYANEMDIVASKDGPVSGNKCYNVAENEYDSQGNIFSKHYNSREQCSDGAISSPEEGEFVNYSCESHDFWKDAITQVLPSSNEEICDGITLDIQCSDGAISSPEDGEFVNYSSESHDFGQDAMTRVLLSSNEEMCDWKTLDVQRSDGAISLPEEGECINYSCESHDFGQDAIAQVLPSSNEEICDGKTLDVPCGEVSPTGCNTSSSNGDHVEIPSSRQGELDGTILSNPVCGSSIEVGANGSNDGAKNMAPLNSQSSEEHIPCVNTISTPNCVNAAQIHEADDNNGSKNAETLNSSLSDERISSLNSKSPQDHVRNENAMCMQNCENFAPSLEDDDGDGSTIVIPNPPLIDERNADRTIVLNRDAHVGMLETVNLTPSTEQISGGAVDEDGLPNHIPKSSVLDSVLSRPREADSPSNSSDADCIILSNQPSLEKQNHEVLSNIPVGQIPVEVSDTCHERITVNVLDGEEAVGRPATVNCTDYPENIIPLNSSSMDQISNGGPLLDGDLSSGPCATSPGNGLTLPDEQIPVLVPENSDKVARCQLTDSAVVKKNAISDQQEGVCRTMTENSLSQETPVSRTVHDLMEPLEPLQSLSSVESPPDPDTAREMPNTLISSPVDFVPDNQSINDSLVMEPPEQEGQLPSAGILSSNQDLANLPLVTRTEDQPSNEDGIPNHIPETSIEIQNQAVGQCASNVELDSCSRQVVHPASNMDLDSLLPGGFRRQSSDTRNLSTLTENNSHPVQPASQSASRIIRHLCLDPLTNELERLRILTDQNMKEYENKKLQLKCDFEKELEELYRKYDIKRKEIEVEFQNIRKNLDTRNKIVFVNKILAEAFRAKSMDLKVSGASRMQQDASVPMQLFQLASQQNATQPCLVGASSCGPPAASVQSSYATTTTQTMVSPIQATYSTPGTFSSVSPRLPHINSLSSPLGNVQTAGEIRAPAPHLQPYRPPTSIPASSPCTVPHGRPGQPTPGNIPVTSPPFSHRTPRPMPANFQSVPHRGHWPVSTGGLSTPNLSAAMNSRGDANSQPGINLANVRPHMPDLPTLMNLNLSKFGCNSSPANSAHQATSPDVVCLSDDE

SEQ ID NO: 171776 - protein, 59 aa, Glycine max
  Coding DNA Sequence Number=SeqID_80091
MRKNPYLTTYTRSIVGLPSFGMLQAEGGEGGGGGLWKEQMVVVEFAKGVKGGVGWHDRG

SEQ ID NO: 171777 - protein, 56 aa, Glycine max
  Coding DNA Sequence Number=SeqID_80092
METDWLYKKKQYLFSTSSWKNKRSGCSRYRRCRWHPGLEGRLRGCYFFSFYFQEVS

SEQ ID NO: 171778 - protein, 333 aa, Glycine max
  Coding DNA Sequence Number=SeqID_80093
  Subcellular localization annotation: CTP_CleavageSite=46; ConfidenceScore=5.32e-01
MVKLGYAPTGAKPVYEGVSLSQSLYFSVVALSAPCPLSVSCYFLKMASRKRKSTASRPQEPYDTTRFISEVAWETYEQNVHSQNIRPERNVNLYVTEYDELCRELERRRWHKALTRQPDGRIDVALVKEFYANLYDSEDKSPRARLVYRLVHLRPDFSDGPVQLLLAWLPDPYHCFMHCQGSCSRLVDLRNPDDPTITFSGTRKTRARGPDASAPPAPAPPVPLPASSSTSAQSIEILVPMLQSLHHGLCLVMKSIHDLAQHQPIMSMEYFMTQVPWPGVQPSPVGGGEAPTTQESQPEPEATPEATSEETPEVMPAATPTEDTNYAADMAAA

SEQ ID NO: 171779 - protein, 146 aa, Glycine max
  Coding DNA Sequence Number=SeqID_80094
  Homolog annotation: Hit_ID=Q1RU80; Match level="QueryCoverage=65%, HitCoverage=78%, E-value=2e-10, Identity=40%"; Hit description =Putative uncharacterized protein
MTITLDDVASLLHLPIVRAFHIFEQLHVNDVVDMLVELLESVTHVHAIFLDALRDLTQSGTYAWGAAALMHMYDNLNETSKSTVRQLAGYIALLQFIAFGNTFFTAFIKDKSLSVTITPGNASNSMKRPQNQCRAQTTLLRRSPSK

SEQ ID NO: 171780 - protein, 90 aa, Glycine max
  Coding DNA Sequence Number=SeqID_80095
  Homolog annotation: Hit_ID=A5BEV8; Match level="QueryCoverage=88%, HitCoverage=11%, E-value=5e-09, Identity=41%"; Hit description =Putative uncharacterized protein
MTFSATFAYLEGEPVQGLFMRVDALPGVIVTDRDLSLMNAVKNVFSDAKNLLCQFHIDKNVKAKCKTQVAQKNAWDYMIELEGVWLTVHG

SEQ ID NO: 171781 - protein, 179 aa, Glycine max
  Coding DNA Sequence Number=SeqID_80096
MPPTRHTLDPDKSNRALHFPALITGLCQSFGVPVTPSKVIRPSITRAFIENYCTPRNVQGGDPQAPDAPLPPHQAYPAGSFDTERYLWHLVRQQAANHRAHMQTHDCLYQLSLSLQSQGFASFPCPTPDQFRAEVAWPGDWPEAQAREAPAEAPGDADEARMDEEMTDLLDFLGGSGTT

SEQ ID NO: 171782 - protein, 75 aa, Glycine max
  Coding DNA Sequence Number=SeqID_80097
  Subcellular localization annotation: CTP_CleavageSite=41; ConfidenceScore=5.14e-01
MVLVAAIAAALTSIISFMLIMASIIVAICSFKASVSAFICSCTSSTSPITLALKRIWLIILTWLAHEENSRIMHE

SEQ ID NO: 171783 - protein, 48 aa, Glycine max
  Coding DNA Sequence Number=SeqID_80098
MEKSDKRNFKEKKAYITWEDSNMDSSSDSENEIINLGLMAKDYESREV

SEQ ID NO: 171784 - protein, 63 aa, Glycine max
  Coding DNA Sequence Number=SeqID_80099
MATPHNDAKTVVKFLKNIFSRFGVPRILICNGGIQNNIQDSNRLISISNGVWRVLSSTSGNGI

SEQ ID NO: 171785 - protein, 33 aa, Glycine max
  Coding DNA Sequence Number=SeqID_80100
MACSSLKARTCRPLKARMCSHLKARACSPLKVK

SEQ ID NO: 171786 - protein, 352 aa, Glycine max
  Coding DNA Sequence Number=SeqID_80101
MAAACTSVPRAMARPPSGRSWPIGAKGAGVRGRRGVGDAVGVGQHACLRQDLRAGRAAGLHPGRDRAPVRGLERPSASGDERADGRGPDAGVAVRMLAGAAADVARQPRFPAQRQHLRGADGARTECGADGPGGGGARLPGAGALVREPASTGAALGRIAPVAATSPGRNDLRAARPRADSDSFSEYPSASNAFRMSDWLSCTACARDGLRQVGHRQARQHRQGGARADAADLDQFAEGAAFAGGGETVEDVGVFAHGQVRVQRDAGAGFRQRVQRAHGHVDVIAQTVDVHADGGRQFLDQGSGDASDHGGSGLAEEEAASVAANAGILYGSARRVARAAAFSAQQAAVADA

SEQ ID NO: 171787 - protein, 122 aa, Glycine max
  Coding DNA Sequence Number=SeqID_80102
MSLPSAVHVSSTFESGALRMSLPSAVRQLSILHCFSEPHECHCLAVFMCHPPSSLEPRMSLPSAVRQFSILHFFSEPHECHCLALFMHHPPTSLEPRECHCLVLFANSPFSTVFRSPMNVIA

SEQ ID NO: 171788 - protein, 299 aa, Glycine max
  Coding DNA Sequence Number=SeqID_80103
MAPRKLASKRSRKDKAAEGTSSAPEYDSHRFRSAVHQQRFEAIKGWSPAVDISGYPHGQWIPFDADAIGQLLGYPLVLEEARSASMARGGTGFCPDCCRKTGADHAHQHDHPDSNMDDLLLSNILPTDHNSDLPMPKCQLVYAILTRMSIHVAQLIADAIYIFAGMAPTRHPLDPDKSNRALGFPALITGLCQSFGVPVAPTKVIRPPITRAFIEKYCTQRQAQGDAPQAAGAPPPPHQAGQAGAFDMEQYLRHLVRQQAANHRAHVRTHDCLYQMSLSMQSQGFAPFSCPTPDQFRAE

SEQ ID NO: 171789 - protein, 73 aa, Glycine max
  Coding DNA Sequence Number=SeqID_80104
  Subcellular localization annotation: CTP_CleavageSite=38; ConfidenceScore=5.08e-01
LSSFIGSGVYPDLSSFTGSGVYPDLSSFIGSGVYPDLSSFTGSGVIQISVTCIKRSAPTQVHIKTKKPSRPTL

SEQ ID NO: 171790 - protein, 53 aa, Glycine max
  Coding DNA Sequence Number=SeqID_80105
MADIKLKLGARDKSSKHKVSFLAKVATTIKTWPSSSSIHAFSPYFRESCKNQY

SEQ ID NO: 171791 - protein, 88 aa, Glycine max
  Coding DNA Sequence Number=SeqID_80106
MRIQGTNRLRILCPNTLEGTSFVAQVEGTSTWVVILRTREGTSLVEGTSTWLFKENKGGYIPCGSLACKGFYKVERNLKNHWLLRDWM

SEQ ID NO: 171792 - protein, 124 aa, Glycine max
  Coding DNA Sequence Number=SeqID_80107
MIARWVVNAQRQILRPLSFRNNKLGEIDFAPFIIQEQQAEWVNAQRQILRPLSFRNNKLGGKRAETDSAPFIIQEQQAEWEQQAEWVNAQRQIMCPLSFTSSEAGDKRAETNSTPFAIQISQVG

SEQ ID NO: 171793 - protein, 73 aa, Glycine max
  Coding DNA Sequence Number=SeqID_80108
MGSKIYPNVHENPRAFFSSSSLSLLESSIQYPWGKLNFCDLMLNPTQFHAKEEKVKVVNDSLSEADWLRDAST

SEQ ID NO: 171794 - protein, 68 aa, Glycine max
  Coding DNA Sequence Number=SeqID_80109
MSHHSSSVNGEGRHKSHPRPHSHRREKERKPQEANINVPYFHGKDNVGAYLDWEIKVEQLFSCHHTSE

SEQ ID NO: 171795 - protein, 86 aa, Glycine max
  Coding DNA Sequence Number=SeqID_80110
  Subcellular localization annotation: CTP_CleavageSite=57; ConfidenceScore=5.06e-01
MAYSLVDGAASYLLSFVFLLHLHGGKSPLKDLIEAQRSSLHRSSTSKLPSSGNQSTRASKFPPIKLAIEARFDFLWFKFIVLVLEP

SEQ ID NO: 171796 - protein, 115 aa, Glycine max
  Coding DNA Sequence Number=SeqID_80111
  Homolog annotation: Hit_ID=A5BP71; Match level="QueryCoverage=60%, HitCoverage=18%, E-value=3e-08, Identity=42%"; Hit description =Putative uncharacterized protein
MVIIVNAEACGYVSMNYYQYIDVFYTNERILKAYSAQWWPLGNEADIPSSNDAWTLIPDLTTIRAKGRPKSTKIRNEMDWVEPSEHRQQCSICGAKGHNRCRCSMQYERGSCSNH

SEQ ID NO: 171797 - protein, 50 aa, Glycine max
  Coding DNA Sequence Number=SeqID_80112
MLQDRTVASILEEETHFSDLLSPNSPSSREFANQNSEVVTVATCPFAGMR

SEQ ID NO: 171798 - protein, 37 aa, Glycine max
  Coding DNA Sequence Number=SeqID_80113
MWVIINEYKEKLNQAVTHEQRLEDEYTKISAESEARE

SEQ ID NO: 171799 - protein, 164 aa, Glycine max
  Coding DNA Sequence Number=SeqID_80114
MPPTRHPLDPDKSNRALGFPALITGLCQSFGVPVTPSKVIRPPITRAFIEKYCTPRQAQGDAPQATDASPPPHQADPPGSFGMERYLQHLVRQQAANHRGQSQGFALFPCPTPDSFRAEVAWPGDWPEDQTEEAPAEAPGDPEDARMDEEMTDLLGFFGGSGAT

SEQ ID NO: 171800 - protein, 159 aa, Glycine max
  Coding DNA Sequence Number=SeqID_80115
  Homolog annotation: Hit_ID=Q6WAY4; Match level="QueryCoverage=86%, HitCoverage=25%, E-value=2e-14, Identity=35%"; Hit description =Putative uncharacterized protein
MGTNQTGKRFYQVKIKGLDVTSLKELGRLMGPLQMQAFRKAYGKILDLTTAEIFTEAVVSLTQYYDQPLRCFTFGDFQLVPTIEEFGKILGCPLGGRKPYLFSGFLPSLSKIAVVVKDSARELDCVKQTRNGVVGLPRKYLEGKARDIANQEEWVPFVD

SEQ ID NO: 171801 - protein, 275 aa, Glycine max
  Coding DNA Sequence Number=SeqID_80116
  Gene Ontology: Mol. function=hydrolase activity; Cellular component =extracellular region; Biological process=phosphate transport
  Homolog annotation: Hit_ID=Q6UUU1; Match level="QueryCoverage=21%, HitCoverage=40%, E-value=4e-18, Identity=78%"; Hit description =Putative uncharacterized protein
  Subcellular localization annotation: CTP_CleavageSite=42; ConfidenceScore=5.18e-01
WNSYVPINVSFSPKVGPGLPAVPPVQLLTGWCVTAKAPPDISAGKCSGRVPFAIQAAQLLGRAIGAGLFAITPAGERGMCCKAIKLGIRCYTAGKDELVQTTVVKDGQDGAAGRNGKEVLNGKVNPQPADGKDGDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 171802 - protein, 128 aa, Glycine max
  Coding DNA Sequence Number=SeqID_80117
MSSKVILMMPKNQESRKIQRFKNQVSRIKIQESSFKNQDSRIIKIKIQETREDSIKIRYILCGTSRGYIYLGIVILRTREGTSLVDQFKWRVYPLGYSKRTREGTSLVDLWLEKDFTRLKEISRTAVA

SEQ ID NO: 171803 - protein, 113 aa, Glycine max
  Coding DNA Sequence Number=SeqID_80118
MVGYTPSSFADLVFTSERIDVGPKRGKFSHSAWMNEKTGANEEGENKGETHVVTAIPIWPSFPPTQQCHYSANNNPFPYPPPNHSQRPSLNQPQSLSTTLPITNTTFTSPPKH

SEQ ID NO: 171804 - protein, 291 aa, Glycine max
  Coding DNA Sequence Number=SeqID_80119
  Gene Ontology: Mol. function=S-adenosylmethionine-dependent methyltransferase activity; Cellular component=cytoplasm; Biological process=chemotaxis
  Homolog annotation: Hit_ID=Q6D6I8; Match level="QueryCoverage=99%, HitCoverage=100%, E-value=1e-132, Identity=80%"; Hit description =Chemotaxis protein methyltransferase
  Pfam annotation: Domain name=CheR; Domain location=95-286; Score =277.9; E_value=2.1e-80; Accession=PF01739.9; Description=CheR methyltransferase, SAM binding domain
  Pfam annotation: Domain name=CheR_N; Domain location=26-82; Score =56.8; E_value=7.5e-14; Accession=PF03705.6; Description=CheR methyltransferase, all-alpha domain
  Pfam annotation: Domain name=Methyltransf_11; Domain location=189 -263; Score=2.9; E_value=0.045; Accession=PF08241.3; Description =Methyltransferase domain
  Pfam annotation: Domain name=Methyltransf_12; Domain location=174 -261; Score=24.0; E_value=0.00054; Accession=PF08242.3; Description =Methyltransferase domain
  Pfam module annotation: Pfam domain module=CheR::CheR_N::Methyltransf_ 11::Methyltransf_12; Domain location=95-286::26-82::189-263::174-261
MKKSTLLDQNEATTLLSQMVQRLPLSDTHFRRISQLIYQRAGIVLADHKREMVYNRLVRRLRMLNIDDFGRYLALLEQDPNSAEWQAFINALTTNLTSFFREAHHFPILAEHARKRSGNYSVWSTAASTGEEPYSIAMTLAETLGTGPGKFSVHASDIDTQVLEKAVAGVYRQEELRTLSQSQLQRFFLRGTGPHAGMVRVRSELANMVNYAQLNLLAHDWALPGPFDAIFCRNVMIYFDKETQEQILRRFVPLLKPGGLLFAGHSENFSQISKEFWLRGQTVYGLTKERR

SEQ ID NO: 171805 - protein, 437 aa, Glycine max
  Coding DNA Sequence Number=SeqID_80120
  Gene Ontology: Mol. function=oxidoreductase activity; Cellular component=microsome; Biological process=aromatic compound metabolic process
  Homolog annotation: Hit_ID=A7P5C7; Match level="QueryCoverage=97%, HitCoverage=99%, E-value=0.0, Identity=75%"; Hit description =Chromosome chr4 scaffold_6, whole genome shotgun sequence
  Pfam annotation: Domain name=FMO-like; Domain location=44-436; Score=- 402.5; E_value=3.7e-06; Accession=PF00743.10; Description=Flavin -binding monooxygenase-like
  Pfam annotation: Domain name=Pyr_redox_2; Domain location=43-339; Score=-32.1; E_value=0.0057; Accession=PF07992.5; Description =Pyridine nucleotide-disulphide oxidore
  Pfam module annotation: Pfam domain module=FMO-like::Pyr_redox_2; Domain location=44-436::43-339
  Subcellular localization annotation: CTP_CleavageSite=59; ConfidenceScore=5.26e-01
MEYFLREIEGKQAHDPLFMNNNKSSLSSSSSSSFSTVWVHGPVIVGAGPSGLAAAACLREKSVPSVILERSNCIASLWQLKTYDRLRLHLPKQFCELPFMGFPSHFPTYPSKQQFVQYLENYAERFGIRPRFNETVQHAEFDAKLGLWRVKSVDKAEKTTEYVCRWLIVATGENAEAVVPDIEGVEEFGAPIKHTSLYKSGEEFRGKRVLVVGCGNSGMEVCLDLCNHNATPSLVVRDTVHVLPREMLGKSTFGLSMWLLKWLPIRLVDRFLLMVSWLLLGDTSKLGLDRPRLGPLELKNLSGKTPVLDVGTLAKIKGGDIKVRPGIKRLKRQTVEFVDGRTENFDAIILATGYKSNVPYWLKEEDMFSKKDGYPRRPFPNGWKGRNGLYAVGFTKKGLLGASMDAKRIAEDIEQSWKAGANHRTTFARSHLPQPNS

SEQ ID NO: 171806 - protein, 1259 aa, Glycine max
  Coding DNA Sequence Number=SeqID_80121
  Homolog annotation: Hit_ID=Q52ZP2; Match level="QueryCoverage=39%, HitCoverage=99%, E-value=1e-173, Identity=64%"; Hit description =EMBYO FLOWERING 1-like protein
MCKGHEQHFLTLDDTTVKLCSRGRESELGAAPRGFSLECATLGCGFFAEPLRIGEEVGGDRVWWSAAVENHLQGGFNTVTEFMGSYIHIDSISIDLADSIGKRDAGKCEHFSIRGYVSEMRKKDWKNCWPFTVHESDKQPSFLPLDVPKYRCRHCQNSAQEIAAKDIQRDDQTNFDCCSTGCISGSNCNNAALKSVIQQDPMLDTLEMREIDLNTTLSCVNDYLTNNEKGKKGGVVPSRIIDLEFGLEDNLNHQVTSIPSPKNYTDLAPEVHTTKKGEGNEVSFPELASNLKCMEKNSAEMCNGGTPADNQCQKDLIKACTVLGKGTTVMEVDNTDDHPTGPSLEPVACNNAAPAGSVDNTVENDFQDHHSEKSTGLSRRRPRKVRLMADLLSDNGELKTEQISIQESVSLGTSNASAASQAHSMVPGKVDIQSCLTLTSTGPSRKRKFPLDEVLRPASMCNEVLNSEGNEKTADTVLDTRSNFKDVPTGLGLQDVAKGHWSKTETERSHIIGKKKYKKIQVVDNCLIPEQPQGHQRENEDTVDTTDKVYASKTNSSRLAPCAFTGKGMDNFPIRPLRIENEFNLSKEKGKMLQTDRELDSLSWHKNNMLVQDSCAYSGEKARSNMPVTIPIPSAQGVLKGRGLEEGLHLSLNNYLVDAQVYNKKSIHQIGNHLPYSMPFEDGTSKVPLLNWKDSDTNVFGGQNIPSKNPTGKGVHCEEINGARTVQKTIEAVDQLGFMKRYSEQTVEVSEQGTLDDIPMEIVELLAKNQYERCLPDVENRSSTLEKPTLGRKAQMTGGSTVHRKGEMSLLKDSQKEKPQGRHKKNMVTRGENVKPSKRKPVNYFSPFDGNNLGMNNICPPQSTFGLEVSQSQKKPSSGFQFSPIGSSQLGSARSFRLNGTFEERGSPNATFQAPGGCSLHKNILHQDDEASRIWASLTSNSQGYDFPKKVVSSQHPSSSVDITSLQSGSFHKQNMKRDIDLNYMNLNAAGLEKLSRNSSSETFNRMNGEYSFPCKHSGMEPHQNLRGSLDLYSNETIPAMHLLSLMDAGMQSRTAFDVGVSSQMLKRPSYLGDCNTKLEIGTSKTPGTLKRPSSDYYSRSFLPDKHGCFAGSPTFGASSSTPHDKKLIRATAFNGQNPMKSGRKEKMKSSNSTLQNKVSKQICWPRNETETSLQRKLEVNGNHETPVPYKIISGNTCMVNRNPADLTIPETGNIYMIRGEDLKFEKNFPKKRPRFPIPYGSKQQKNLKGTKMKEHSKH

SEQ ID NO: 171807 - protein, 168 aa, Glycine max
  Coding DNA Sequence Number=SeqID_80122
  Homolog annotation: Hit_ID=A7P5A5; Match level="QueryCoverage=98%, HitCoverage=39%, E-value=3e-45, Identity=56%"; Hit description =Chromosome chr4 scaffold_6, whole genome shotgun sequence
MPYIYDTGFQWAIDNDKCQGRVDSIKPLFEVARDHLGKVAIDKEVARKVWDRIAPGLASQFNSPYSIPTIAPHPLLILNGAEDPRCPLGGLEIPRAKATKAYRKFHCLDNFRVYPLKLDEIKLDGVFGWEFFLEYVWNEFIAEAGIGHQVTRFMIKESADWFDRFLNP

SEQ ID NO: 171808 - protein, 73 aa, Glycine max
  Coding DNA Sequence Number=SeqID_80123
MKRTDAAIKNLEVQIGQLAELVAEKPIETFAVYVEMKPKEDCKVLPEYTSFMATLAKRRKCKEDEFFVTFMPP

SEQ ID NO: 171809 - protein, 252 aa, Glycine max
  Coding DNA Sequence Number=SeqID_80124
  Homolog annotation: Hit_ID=Q6UUU1; Match level="QueryCoverage=23%, HitCoverage=40%, E-value=3e-18, Identity=78%"; Hit description =Putative uncharacterized protein
MENCTKPIYKLVFTLGGRRMNENTIHGAALKKGREWRISLSNLYPAPNSWVADACKKNQFMGLRKKRREWRIAISNHYAWLQTRRMNENAIHGARKKGREWRIAISNHYAWLQTRGWGRIDTVDLEKGLRTENCNRGGPVPAFVPFTEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 171810 - protein, 294 aa, Glycine max
  Coding DNA Sequence Number=SeqID_80125
MGRGNYGSKLVECLPISDGEALGELALTNGGHQVHVASVHDINGTALVNEDPRHHEVFYDYRDNHGVILVDRFDALEVLVRKGDRRETSLLSLTPPLLVSLSRSIFYSSFCLLRGSCAAPLDVLQYLVAFDPDRGGFIWGSQMGTSRLNASSRIMLVHVVRFVRVGLGVCFVLVALLLGLANFIPESGHFFHLDVALGSMQCYLGVEILDLDDHAPKSVHELFEGLFVYLSQTGQGGQCHAMRPASYVLRTESFDEGAEAVYGRRFAYIKKASRCLSGYVVPSYFMRLSGFHPK

SEQ ID NO: 171811 - protein, 112 aa, Glycine max
  Coding DNA Sequence Number=SeqID_80126
  Homolog annotation: Hit_ID=A0ST23; Match level="QueryCoverage=22%, HitCoverage=51%, E-value=3e-07, Identity=100%"; Hit description =Putative reverse transcriptase
MITRFEVDFDGGDGVPDPDRKDQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 171812 - protein, 165 aa, Glycine max
  Coding DNA Sequence Number=SeqID_80127
QAKKEHLLIGSLARRKENQDSIFMRRMSKCSLDGNKGCINYNPVLAIRPLGYPMRGVPSDKSITPFIARGFSDHNARSEHKDWIGSQNLKTVRDNEVKASEESDEVQALKAKLERARPWPSKAAMVSSNSEEVKGIITGQRHDLEGRAKGLPLVEKKFVPTVKRD

SEQ ID NO: 171813 - protein, 69 aa, Glycine max
  Coding DNA Sequence Number=SeqID_80128
MCAQEMAPKRLSAKRSRRDAAVEGTSATPEFDSHRFRSVEHQQRFEAIIGWSFHRERRVQLRDDEYTDF

SEQ ID NO: 171814 - protein, 76 aa, Glycine max
  Coding DNA Sequence Number=SeqID_80129
MAPRNLSTKRSRKDAAAEGTSAAPEFDSHCFRSVEHQQRFEAIKGWSFHRERRVQLRDDEYTYFQEEIARRRWTSL

SEQ ID NO: 171815 - protein, 171 aa, Glycine max
  Coding DNA Sequence Number=SeqID_80130
  Gene Ontology: Mol. function=structural constituent of ribosome; Cellular component=ribonucleoprotein complex; Biological process =translation
  Homolog annotation: Hit_ID=A7MLN0; Match level="QueryCoverage=54%, HitCoverage=100%, E-value=3e-40, Identity=85%"; Hit description=50S ribosomal protein L25
  Pfam annotation: Domain name=Ribosomal_L25p; Domain location=4-91; Score=170.6; E_value=4e-48; Accession=PF01386.10; Description =Ribosomal L25p family
MFTINAEVRKEQGKGASRRLRAANKFPAIIYGGKDAAVSIELDHDAVMNMQAKPEFYSDVLTLVVDGKETKVKVQAVQRHPFKPKLHHIDFLIAQIRRRAFDGQRIGGRIPENALAQQHGIKGAAVGREMLFQLITLLLGKRLKGFFAQRRQLAGEIFQRNLLARLQLFIA

SEQ ID NO: 171816 - protein, 178 aa, Glycine max
  Coding DNA Sequence Number=SeqID_80131
  Homolog annotation: Hit_ID=UPI00006A2939; Match level="QueryCoverage =61%, HitCoverage=62%, E-value=2e-07, Identity=31%"; Hit description =UPI00006A2939 related cluster
MAGPLDESISCFLIRVDLWVLVPITFRGLHVLAIRGLHVLTIRGLHAFTFRGLHVLTIRGLHVQAFRGLHVLTFRGLHAFTFRGLHILTFRGLHALAFKRRHVLNFRGLHTLAFRRLCVLVFSGLHIHTLRELRDRAHKTPSGPRGAQQGPGVSSSGYGPLSVLQGARSPQQGHAIMT

SEQ ID NO: 171817 - protein, 161 aa, Glycine max
  Coding DNA Sequence Number=SeqID_80132
  Homolog annotation: Hit_ID=Q6L477; Match level="QueryCoverage=75%, HitCoverage=19%, E-value=8e-11, Identity=28%"; Hit description =Putative uncharacterized protein OSJNBa0009L15.8
VDATYENWKQVPTSQKDLISEDIQTEFDIPEASNVRTKKKILQTVGERWRQFKSDLMSKWELAADKDNVDDTVCEKYNISNEKWAQFCQSCRDPLWEDVRKKAQAIQKQNTVSHVLSCGGYEYLENKLMDEKRKKKLEEAAQSGSTDTVIDPPSPIRRHVK

SEQ ID NO: 171818 - protein, 98 aa, Glycine max
  Coding DNA Sequence Number=SeqID_80133
SDFLITIEEYVGAKGNTLVDHEKRKNIKGLSSLMTDVWGANTFPVRKYNSRTFSFKVRRSRLFRFFRRFPQINVGGDSARIPFVEHASRESRVALLPK

SEQ ID NO: 171819 - protein, 78 aa, Glycine max
  Coding DNA Sequence Number=SeqID_80134
  Gene Ontology: Mol. function=endonuclease activity
  Homolog annotation: Hit_ID=Q9AY32; Match level="QueryCoverage=83%, HitCoverage=98%, E-value=3e-27, Identity=95%"; Hit description=RRNA intron-encoded homing endonuclease
MINRDSRGAFVFHSQRRSDTVLVSTINDADQGSADVAFRTPLAPYEKSKSLGSGGSMVARLKLKGIDGRAPPGVEPAA

SEQ ID NO: 171820 - protein, 65 aa, Glycine max
  Coding DNA Sequence Number=SeqID_80135
MFAKFLIFFCNASIFRIAVRLPWWQRRMILPENVEELSLADMEKSKPTRKKDEVRRGKRWSEGNK

SEQ ID NO: 171821 - protein, 172 aa, Glycine max
  Coding DNA Sequence Number=SeqID_80136
MAAQLIHDRVEMECLEGAWETLKGNTRCRFRGTIRFTATSLVHPDEPVRTLQRTVEWILPTPTPYRLVEPVQVIEVTSSEEDPEEDPEELPPEPAVDALDFLKGDEDHFLRWILPRKSCRHLRQTLRRIVARERWRPVETLHHSGQFHGLEFDDCIHAVEAITVDTFALDDT

SEQ ID NO: 171822 - protein, 393 aa, Glycine max
  Coding DNA Sequence Number=SeqID_80137
  Gene Ontology: Mol. function=phosphoglycolate phosphatase activity; Cellular component=chloroplast; Biological process=carbohydrate metabolic process
  Homolog annotation: Hit_ID=Q9EYY5; Match level="QueryCoverage=50%, HitCoverage=79%, E-value=1e-104, Identity=94%"; Hit description =Phosphoglycolate phosphatase
  Pfam annotation: Domain name=Hydrolase; Domain location=191-392; Score=127.2; E_value=4.6e-35; Accession=PF00702.17; Description =haloacid dehalogenase-like hydrolase
  Pfam annotation: Domain name=Ribul_P_3_epim; Domain location=7-174; Score=336.0; E_value=6.5e-98; Accession=PF00834.10; Description =Ribulose-phosphate 3 epimerase family
  Pfam annotation: Domain name=TMP-TENI; Domain location=5-170; Score= -70.0; E_value=0.011; Accession=PF02581.8; Description=Thiamine monophosphate synthaseTENI
  Pfam module annotation: Pfam domain module=Hydrolase::Ribul_P_3 _epim::TMP-TENI; Domain location=191-392::7-174::5-170
MRMKQFLIAPSILSADFARLGEDTAKALAAGAHVVHFDVMDNHYVPNLTIGPMVLKALRNYGITAPIDVHLMVKPVDRIVPDFAAAGASIITFHPEASEHLDVILLMSVNPGFGGQSFIPHTLEKLRQVRQLIDQSGYDIRLEVDGGVKASNIGEIAAAGADMFVAGSAIFGQPDYKKVIDQMRSELAKAIRGVAFDLDGTLVDSAPGLTAAVDSALYALELPVAGEERVVTWIGNGADVLMERALTWARQERATLRAAMGKPSVDDHDIPQDEQLRVLRKLFDRYYAEAAEEGSFLFPAVADTLGALHAKGLPLALVTNKPTPFVAPLLEALDIAKYFSVVIGGDDVQNKKPHPDPLLLVAQKLSLTPAELLFVGDSRNDIQAAKAAVAALS

SEQ ID NO: 171823 - protein, 379 aa, Glycine max
  Coding DNA Sequence Number=SeqID_80138
  Gene Ontology: Mol. function=aldehyde dehydrogenase (NAD) activity; Cellular component=cellular_component; Biological process=metabolic process
  Homolog annotation: Hit_ID=Q84P31; Match level="QueryCoverage=100%, HitCoverage=85%, E-value=1e-113, Identity=94%"; Hit description =Aldehyde dehydrogenase family 7 member A1
  Pfam annotation: Domain name=Aldedh; Domain location=1-362; Score =278.1; E_value=1.8e-80; Accession=PF00171.13; Description=Aldehyde dehydrogenase family
IPAPKRGEIVRQIGEALRAKLDPLGRLVSLEMGKILPEGIGEVQEIIDMCDYCVGLSRQLNGSIIPSERPDHMMFEVWNPLGIVGVISAFNFPCAVLGWNACIALVCGNCVVWKGAPTTPLITIAVTKLVAEVLERNKLPGAIFTSFCGGADIGQAIAKDTRIPLVSFTGSSKVGLMVQQTVNERFGKCLLELSGNNAIIVMDDADIKLAVRSILFAAVGTTGQRCTTCRRLGGKILTGGSVLESGGNFVQPTIVEISPDAPVVKEELFGPVLYVMKFQTLEEAIALNNSVPQGLSSSIFTQRPGTIFKWIGPRGSDCGIVNANIPTNGAEIGGAFGGEKATGGGREAGSDSWKQYMRRSTCTINYGSELPLAQGINFG

SEQ ID NO: 171824 - protein, 104 aa, Glycine max
  Coding DNA Sequence Number=SeqID_80139
  Gene Ontology: Mol. function=hydrolase activity
  Homolog annotation: Hit_ID=A7PWY7; Match level="QueryCoverage=49%, HitCoverage=17%, E-value=3e-13, Identity=67%"; Hit description =Chromosome chr12 scaffold_36, whole genome shotgun sequence
MEPYCILVDLFLLHYIIKEWSKGTGFLTWIPRNIWYTWRHQMIAIAKAGYWAIAFDFRGYGLSQHPAEPQKANLLDLVDDVVGLLASLSITKVCNNMCYTIQFE

SEQ ID NO: 171825 - protein, 193 aa, Glycine max
  Coding DNA Sequence Number=SeqID_80140
  Gene Ontology: Mol. function=inositol or phosphatidylinositol phosphatase activity; Cellular component=intracellular; Biological process=abscisic acid mediated signaling
  Homolog annotation: Hit_ID=A7PCE3; Match level="QueryCoverage=59%, HitCoverage=20%, E-value=1e-47, Identity=79%"; Hit description =Chromosome chr2 scaffold_11, whole genome shotgun sequence
MKVVTSGDHDQVKNCMNVSSLKQQQDNFQCLSKSITYNQYIAKCVLREQIKKARLLANPGCYPTSVQLPLVPFIKLSKELRMGHVFDGWKQGLINFPPTYKYEINCDRYVGERPKQGEKRRSPAWCDRILCLGKGIKQLQYGRAEIKLSDHRPVSSALLVEVEVFDHRKLKRALNFTRAAVHLEIFLDEDGEI

SEQ ID NO: 171826 - protein, 127 aa, Glycine max
  Coding DNA Sequence Number=SeqID_80141
MSIIVPFSTESHPKFLSMNEGFVSLWVSMDMNSIARFQARTYKIVEFWDDEFEKADAKADQALVKATRALKAKMTMTEDSTKPLQEEVECLNKESTLFKPNATKVEEKLKSDLDEIEAEILKTHEVE

SEQ ID NO: 171827 - protein, 118 aa, Glycine max
  Coding DNA Sequence Number=SeqID_80142
MATNDNDANSVNQGKGPHEHESTMSRMLAMGASEMRNPTNVASPSRQKVDDHSIIIALQREMDTLKEKNAQEMNEILIQRSDVVPDVTTSRFRTRRLYLTPSCLYSSVHIWAATACAG

SEQ ID NO: 171828 - protein, 55 aa, Glycine max
  Coding DNA Sequence Number=SeqID_80143
MSLTVKVGLMSLVAEPGGSAWAELFSGPLVMAGMFDKEMKRGGGVEKGNHMRGKG

SEQ ID NO: 171829 - protein, 304 aa, Glycine max
  Coding DNA Sequence Number=SeqID_80144
  Gene Ontology: Mol. function=nucleoside-triphosphatase activity; Cellular component=integral to membrane; Biological process=transport
  Homolog annotation: Hit_ID=A7P308; Match level="QueryCoverage=99%, HitCoverage=50%, E-value=1e-128, Identity=67%"; Hit description =Chromosome chr1 scaffold_5, whole genome shotgun sequence
  Pfam annotation: Domain name=ABC2_membrane; Domain location=40-246; Score=174.0; E_value=3.8e-49; Accession=PF01061.15; Description=ABC -2 type transporter
MGIVADVKQEEQIDHHEDQASIKYSKEEGSENQWTTSWWEQFMVLLKRGLTERRHESYLGLRIFQVLSVSILSGLLWWHSDPSHIHDQVGLLFFFSIFWGFYPLFNAVFAFPLERPMLMKERSSGMYHLSSYYVARMVGDLPMEFVLPTIFVAISYWMGGLKPSLVTFVLTLLIMLFNVLVSQGIGLALGAILMDVKQATTLASVTMLVFLLAGGYYIRHIPFFIAWLKYISFSHYCYKLLVGVQYSVNEVYQCRQGLHCRIRDFLAIKCLRLDSLWGDVAVLAVMLIGYRVVAYLALRMGLHH

SEQ ID NO: 171830 - protein, 123 aa, Glycine max
  Coding DNA Sequence Number=SeqID_80145
MADFHGGFSKKRHRIAVAWRVWDGGAMAVVAVMAGTTFHLRENPTASLPCTSRVPPAPHTRTQPRHPQPHAHAAATTSGSDAPAQTAATSSGSDAPVTNGGLQREVLAEKTKLSRIRRRRRFS

SEQ ID NO: 171831 - protein, 245 aa, Glycine max
  Coding DNA Sequence Number=SeqID_80146
  Homolog annotation: Hit_ID=A2YUV0; Match level="QueryCoverage=31%, HitCoverage=15%, E-value=7e-09, Identity=48%"; Hit description =Putative uncharacterized protein
MAEYIKRSALENDVASLCHLHLTKRFSENPVPLLLDPLPVRFTLNRSGNTGPFPVDPARPKGGELGRFAEADGPNGRVGLRIRVSEVERKGFGEGENGGSYWWSGMKSSATKAPDWLEAAIRDSKMDSMETSTSSSSGRAIRIVSVILCEHGKKYLAQKVVIMDLFTFCGGLSLYCCHIVTIDMEFGWQIVVGTFVGFCVATFGSVGGVGGGGIFVPMLSLIVGFDEKSSTAKHKIRNAHAEIKT

SEQ ID NO: 171832 - protein, 143 aa, Glycine max
  Coding DNA Sequence Number=SeqID_80147
  Gene Ontology: Mol. function=acyltransferase activity; Cellular component=plastoglobule; Biological process=metabolic process
  Homolog annotation: Hit_ID=A5B7J6; Match level="QueryCoverage=83%, HitCoverage=26%, E-value=2e-38, Identity=61%"; Hit description =Putative uncharacterized protein
MSIFEFHFPMIYGCLGHGFTITHHITLVFQVVFDYDDLVKIPYFRSEIESLTDEAMQLSDAGGEVVNQPVHMPLILPKVPGRFYYYFGKPLEMEGRKRELKDDRQKSHELYLQVKSEVERCIAYLKEKRESDPCRGIGPRLLY

SEQ ID NO: 171833 - protein, 481 aa, Glycine max
  Coding DNA Sequence Number=SeqID_80148
  Pfam annotation: Domain name=Transposase_28; Domain location=164-325; Score=-65.5; E_value=0.097; Accession=PF04195.3; Description=Putative gypsy type transposon
MGSRTSHVSLESIRAPITGLLGGLTRAIECHVGCHVCFVGPGQYISPQALSRLADEQIGDEFVEPPSVDEYCLLSVVCDGHIFGESDKACAAHMKYSCMRVTHRVGMYWSRSLCEVPCLRIPAEVPLTLIPPLQRGPGHCDPPLFYFWDVRRDSDGGDVRVSPYVRRSQSVGSPSSTPVVAGYESVRDDVLKYKSGDFPFLRMTPGQTPFFFMYRCLFEVLGLILLLIAFQCALLEHLNVALSQLHPKSWTMVRAFEILCPFFNIRPSVSVFLFFFQMKLSGKIGWVSLNSVSKKLFEFDSNIFRRFKDHFFKVLATGVVTDGMPLMFNRDRVSRFPFYWKSNPTRFKSYGEDLLTLAEKVDKAILEQLPTSLDMRAILSLPSMSDPLISLDGKVPNLALRPLVKQVRPTGGIVPSSATALDVGEGGPYKPSCPKAGCRINVRCNRPSIAQDVPQAPPAVEAPVVVATHAPSPLLVKRRMT

SEQ ID NO: 171834 - protein, 164 aa, Glycine max
  Coding DNA Sequence Number=SeqID_80149
  Homolog annotation: Hit_ID=A5B8Q0; Match level="QueryCoverage=78%, HitCoverage=18%, E-value=6e-09, Identity=26%"; Hit description =Putative uncharacterized protein
MVNTIKIEKFTVKNSCNFWCIKMQALLKEQGIWAPLSVFEELSVVGLWLKFKKLFMTKSISNKLLLKQRLFGLQMSEAFFPPSYENFVSFLSVDNDSITLEEVKSSLYSREFLVKTFGNGDEVFASGLSMIDSTKRQKMKKDKGGKKSKIDPKDICNYCKKLSH

SEQ ID NO: 171835 - protein, 266 aa, Glycine max
  Coding DNA Sequence Number=SeqID_80150
  Subcellular localization annotation: CTP_CleavageSite=84; ConfidenceScore=5.08e-01
MEELHTQLIKPRNESNSSGGNPRVSTDKTSNSELKSFFSLKNTKPRPMHPLASSSAGTFIPILGKIQSPQHRPSIPRPLDPATSSNGVVYAALHHHSPRILLPGPPKKRKIRALHRGEFGARRYSALVDGEAGVLARVGSAVGQDGVVAGVAVGAAEDEAAALEDRGSVSKDEVDCAIDITFSVELAEDVGVEGVLVACYTASVKAERSEAMFRATACWPSGPALLWKPMSRAMKPSPVIAGKGSKVGVTRLSAIVNMTWGKGYET

SEQ ID NO: 171836 - protein, 76 aa, Glycine max
  Coding DNA Sequence Number=SeqID_80151
  Homolog annotation: Hit_ID=A7NUY7; Match level="QueryCoverage=77%, HitCoverage=13%, E-value=7e-14, Identity=62%"; Hit description =Chromosome chr18 scaffold_1, whole genome shotgun sequence
MVVVVVVWFCGVEMVVVIEIFMLWLFKTTKWRALVAGAVAGSSMLLIGLEDQHTSLAIYILMRATVLASRCGIKSK

SEQ ID NO: 171837 - protein, 105 aa, Glycine max
  Coding DNA Sequence Number=SeqID_80152
MCHPTVYVYVYYNGQISNTNEGTTFASNNTKTFMVKKNIPRQGGFLGYSFIETNPIRFDIPLGCSMAKLKDLIKQVAPMGVPPYGIHESRMVRRLFIRQPGHAKY

SEQ ID NO: 171838 - protein, 82 aa, Glycine max
  Coding DNA Sequence Number=SeqID_80153
  Pfam annotation: Domain name=zf-CCHC; Domain location=46-63; Score =14.2; E_value=0.011; Accession=PF00098.14; Description=Zinc knuckle
MCVQEEERLIMEEGERVNLTIHGKEKGNQPKNKGKIPAQSVIKKESKCFFCKKKNHMKKDFLKFKSWMDKKGYGKPKEASGK

SEQ ID NO: 171839 - protein, 664 aa, Glycine max
  Coding DNA Sequence Number=SeqID_80154
  Gene Ontology: Mol. function=enzyme inhibitor activity; Cellular component=cell wall; Biological process=cell wall modification
  Homolog annotation: Hit_ID=Q9MBB6; Match level="QueryCoverage=99%, HitCoverage=100%, E-value=1e-128, Identity=55%"; Hit description =Pectin methylesterase
  Pfam annotation: Domain name=PMEI; Domain location=73-226; Score =116.8; E_value=6.4e-32; Accession=PF04043.6; Description=Plant invertasepectin methylesterase inhibitor
  Pfam annotation: Domain name=Pectinesterase; Domain location=353-649; Score=704.2; E_value=9.5e-209; Accession=PF01095.10; Description =Pectinesterase
  Pfam module annotation: Pfam domain module=PMEI::Pectinesterase; Domain location=73-226::353-649
MAFQDFDMITERRRNEERLKMKKKILIGLISAVLLACVIGAATFVVVQRTGPNNNPKHATPLPQNSAATSHVDQNSRLVKMICGSAEYKEKCETTLGEALKKDPKLAQPKDLMMVSMILAEKEVTKAFDGTAKMMDKASEEEKGAYEDCQGLFKDAKEELELSITEVGDNDADRLSTKGAELNNWLSAVMSYQQTCIDGFPKGKIKDELSNMFNESKELVSNSLAVVSQFSSFFSIFQGAGELHLPWEITSDDAPAPTTASASAVGAGFGSIFGSGSSSFGSASAPGVAPTTTGVASAPGVSPTTAGAALAPGVAPGPVPSWAAGSIPAWAGPVPVWAGPAEFIGSNEKPTPNVTVAKDGSGNFKTISEALAAIPPKYDGRYVVYVKEGVYDETVTVTKKMLNVTMYGDGQQKSIITGNKNFVDGVRTFQTASFVVLGGGFLAKDMGFRNTAGAEKHQAVAARVQADQAIFFNCAFEGYQDTLYAQTHRQFYRDCYISGTIDFIFGDASAVFQNCTMVVRKPLDNQQNIVTAQGRLDKQENTGFVLQKCVIKADTDLVPVKDRIKNYLGRPWKEYSRTIIMETQIDDLIHPDGFLPWEGNFALSTLYYGEYNNNGAGSITTARVNWPGRKVINRDEATRYTVEAFLQGTWINGTGVPAQLGLYN

SEQ ID NO: 171840 - protein, 100 aa, Glycine max
  Coding DNA Sequence Number=SeqID_80155
MIGQARKLTSCMRGNSLAGNLAPLDLEIEGSCRRNNAKRRRKFLQERTTQPSLEEAQSSKSSSALPELRDSEVGASEAHIMSEDQPHRVTLEDYSSSTVL

SEQ ID NO: 171841 - protein, 366 aa, Glycine max
  Coding DNA Sequence Number=SeqID_80156
IASRKRKAIASQPQEPYDTTRFISEVAWERYEQNVHSQNIIPERNVNLFITEYDEFLQELERQVRVQGRLIKFDGDMLNAFLETPVVLEPGENYITYTRFCSTHPDPQELASKLCIPGHSFVLNAEGASWKLLRKDLITLAQTWSVLSYSNLAPTSYTSDLNMDRARLVYGLITRMGMDVGLFISGQISQMAQSNSSRLSFPALITALCIPRGVIPDSLTIESLSPTINLAYIRKNFWNLDDPMITFTGTCKTRARGLDASAPSSSAPPAPAPPAQPAPTPTPSGPSAQSTDLLAPTAQEPQPKLEATLEATPEETPKDTPAATPAEDIDYAADMAVAQSSWDPCPLQHWIHLCQPRMLPPHLMIS

SEQ ID NO: 171842 - protein, 148 aa, Glycine max
  Coding DNA Sequence Number=SeqID_80157
MGDVGLKPIAFAYRQTDGEQLQQEELILLGLIGLKCTTSLESIKSALENVRNDANTQMKLVLEDDIMEVKAIASGLGLEHGIVLEGRKVKDLNKEAIRRSGSAHVAEVADVVYIHWSDYGMVAALNNKYTCLPCINNTMFCSWVLCRR

SEQ ID NO: 171843 - protein, 74 aa, Glycine max
  Coding DNA Sequence Number=SeqID_80158
MGSNPETASLHMQDSKGWMEATMKVTFPHDVVNSLEFYSKVLEPLNALKEASGRGGSKCFYRGGRCMVELSKFA

SEQ ID NO: 171844 - protein, 108 aa, Glycine max
  Coding DNA Sequence Number=SeqID_80159
MEEMIVFRERMCKEPLKKLVEQEAKIESGRSRDRSRADRPSQSKFIHYTPLMKSRGRALKEACSVYLKSVNSIEDEKKVLRSMPPIIFTIKDFGDIERCHNDPMVIKI

SEQ ID NO: 171845 - protein, 250 aa, Glycine max
  Coding DNA Sequence Number=SeqID_80160
MSEPIWSDGGDCNVLLCVAVRLGRGREWVAVAAESGTEKQALRRRWRHELTEKERYLRRKVVEWVDEIKKEEFSLEEKDITIEVHGETLNGFAKPPNSDEERAMEGDFLTKGIHINVFDDEKDDIKGLRHKRKEIFSSGERRRKEGKTSNKEMLDKIVSIWSDSMSQRTTTSRAREERYKGKTSQASQATSPISDPYSAKACMELLDNMQDVPTSAYFKLMEKFTSEHWRQMFIVMDAERRKQLIESLTE

SEQ ID NO: 171846 - protein, 118 aa, Glycine max
  Coding DNA Sequence Number=SeqID_80161
MVRIHSLTNMLNNSVDMDDQWLSVEQQGVNKNQAAEMTQVVVLTFVLGLFLEPLVKLRSFFGFWCKDWRIGGHLRYISPEVQSRRHCRCCVRGSVAWKAVYPLGSGHYFPQLLLLASK

SEQ ID NO: 171847 - protein, 92 aa, Glycine max
  Coding DNA Sequence Number=SeqID_80162
MDEDQWMDNSIMSEEVDMNEQNKDEVGVNEEHVGCSDLFNTSQVFATRDDVLHWARSVAYEIGFVVMITRSDTNTGMRRRTSFVLIGCERSS

SEQ ID NO: 171848 - protein, 56 aa, Glycine max
  Coding DNA Sequence Number=SeqID_80163
MGRYTIHGAVCFEYDNPNLRGLQWKVVKGIRGYKQHRGKGCACLSCCSVGGDYASE

SEQ ID NO: 171849 - protein, 50 aa, Glycine max
  Coding DNA Sequence Number=SeqID_80164
MEVVILMVAVTLMMVVEIMMVVMVVVMVMTMVVMIAVLVVMVVTMMAANI

SEQ ID NO: 171850 - protein, 96 aa, Glycine max
  Coding DNA Sequence Number=SeqID_80165
MALEELKAKPSSTTTNFREPYVLVINYDSEHEQHNSLLEHHSDPSFDEHTSGHHHSDIACSKRTKLLERLKRWVDAGSEKPRVRHSISKGADEHCT

SEQ ID NO: 171851 - protein, 210 aa, Glycine max
  Coding DNA Sequence Number=SeqID_80166
MAKVESKDSASGFPKFVLFHLMDESPFDLPHTIYINILQNMKTLGGEDHIYYATLVNKLLWEYQVFHVFKQSIINKGTFYARQQHFSVVNLKENKVDIKRNMPIPPMDEEDIKKMRQKKLVKTTIDEEKLLQTFSIAKERGNTNSYSSTIKSTFHTATQTFIPINTSKFKPLEDVTGGNGTTQQLKPFLAESFLLLSSTKTNRTTTRRVI

SEQ ID NO: 171852 - protein, 96 aa, Glycine max
  Coding DNA Sequence Number=SeqID_80167
MSLCVSESVKDLRDSGTRKRVSWGLEPKTHLFQDDGVPLSDQKQISYSMVEKCREMDTFQRLIAGWDFGANVHVCADKKNIFFISRIKHTCCEHEE

SEQ ID NO: 171853 - protein, 210 aa, Glycine max
  Coding DNA Sequence Number=SeqID_80168
MTEDVPHMTEDVPHMAEDAPEMTADVQATVAEDLGRDGAEGALCPDILQHKVPLSTSPSHLFPRTQGSRSSQDPNTNSKPGQAHETIYAKTQAYMQCGTMSVKNLIGRLGVHDKTNHTIGDQSGLQCFAKMLQPYEINIGLKEHSNCVTFKAYTPKSPSGPLPPDSGPTQKTFYHTDSIYELYKTHDFSIILKIILTRRHLRVLSLTRRP

SEQ ID NO: 171854 - protein, 103 aa, Glycine max
  Coding DNA Sequence Number=SeqID_80169
MDLLRTCHHIFLDWCFIRELLKVLECPKLKILQLNIQDIAFVGEITSFEFLNHEKYEFRELLAEIRGLSNLRLLDLIDCSTLGVFPCNMILSLTTMANASYMV

SEQ ID NO: 171855 - protein, 78 aa, Glycine max
  Coding DNA Sequence Number=SeqID_80170
MDEDNDNDAENDLVFEDDDALNWATVYEASGFEDIELESEEDEIMVNFEAFDGEEGEGDAPLPYDNNEDDYVGIEEDD

SEQ ID NO: 171856 - protein, 129 aa, Glycine max
  Coding DNA Sequence Number=SeqID_80171
MGCCWDMSFWGHIFLFGILLQRISQTRAVLELFPRGCSFGTYPAWEAPLQLASSCMVDTCHLLEESANTVGDLTGWRQWYWRFDWSVRQSAAAAAAAKVQARQPRCAGKRHSQWRVLLDRKALLPLALR

SEQ ID NO: 171857 - protein, 118 aa, Glycine max
  Coding DNA Sequence Number=SeqID_80172
MCPPLEKVNTKGAQKKSMTKHQISIKCDLSYWEYVDALYSVQNSNSSVKHSASSSDQAIPRRTMPMLDQFHPCIHDSIENIVDVKVDGMVKINGLWCTTMCLKNLPNGLMSISTSLVA

SEQ ID NO: 171858 - protein, 123 aa, Glycine max
  Coding DNA Sequence Number=SeqID_80173
  Subcellular localization annotation: CTP_CleavageSite=91; ConfidenceScore=5.41e-01
MTVGRFSENSPLSSVAGNRLQTYGNRLHVQNSNSKPFSTALFHSSLLVIDYTSCPTTALATLFRRISTQTRQRTPKSDAICTCIVGGKLINAEMKVEAVAKLITGDKRTKALRESGEAVECKI

SEQ ID NO: 171859 - protein, 199 aa, Glycine max
  Coding DNA Sequence Number=SeqID_80174
MEEAQSWHKRVLPAFVGEGPIGCCDALVLHLEPRNIDSDWESFSTALIKRFGDNYVFLKERTNISELKRMLRILFNEEADCQATEQDKNSMGGSGSERNEVEASSWTRKFLKSENKSKGTVIKNYTLCGGEETKNDEAKLVRETKIEKVMEEEVDPLLKREKHKENRVMMWAVVMMKQKSFMKVVGTSMVSESWNVNLV

SEQ ID NO: 171860 - protein, 117 aa, Glycine max
  Coding DNA Sequence Number=SeqID_80175
MTCEGQGLLSDVNLTGRNFRPSATINSLDNVSTSGPSSFSIWAFILLHLGLHPSPLGGFILLHLGIRPSPLGPLAYIWPVSGFSSFPPSWKTFALKCPGSSPGSSTTSFFFLWAYLA

SEQ ID NO: 171861 - protein, 177 aa, Glycine max
  Coding DNA Sequence Number=SeqID_80176
MDQRVRTQAQGPLERAKGNMRKDQGDHPPWENLGLLVEPRNYHPSDQIGGVIVVQLSIIYSTTEIAKLVMEAMKKIEKISASAKVSKPRTTGSSTRIETEATYSRTMRIPQERHKNRKDKMLRKYSCPSPHPSDVHPKLPDYDDIVMFILVFVHPKSILIPKYSTFKINGSFEIHKG

SEQ ID NO: 171862 - protein, 148 aa, Glycine max
  Coding DNA Sequence Number=SeqID_80177
  Homolog annotation: Hit_ID=A5C0G0; Match level="QueryCoverage=91%, HitCoverage=28%, E-value=2e-17, Identity=28%"; Hit description =Putative uncharacterized protein
MAKVWSLIKAILIIESDNDVFTFWLFHLKDIQRVIQVPMQEIPIWIEVHNIPLGLTTIAVGNFLDQFVDYDDKHNSSPLMSYMRIKVMIDVNKPLKCTKKIKKEGHNDDLCGKLFKVENDNGLSSWGPELRADARVLRPWKEALVILG

SEQ ID NO: 171863 - protein, 158 aa, Glycine max
  Coding DNA Sequence Number=SeqID_80178
MKSTSTCGSVQVEGTFTWLFKENKEGYIPCGSLACKGFYKRDDGGHEDDERWIDEMKGFMKRRGGSVKGERENYSINGKKGEKVYEQTFTVAHSWVGQVEDFPFDIYNQVGRSRATQRGAVMRRLLLLGETTIRPHKEVMVETKLGAYQQSFWVNNKR

SEQ ID NO: 171864 - protein, 206 aa, Glycine max
  Coding DNA Sequence Number=SeqID_80179
  Homolog annotation: Hit_ID=Q75I89; Match level="QueryCoverage=33%, HitCoverage=17%, E-value=6e-28, Identity=86%"; Hit description =Expressed protein
MEIRFSRVLGNMKINLHPFITLGRSHIPPLYKWGLVRSYCKQARSFKSDRIVTPVKMTFEIYATCVVPISAFFASSLWFGNTAYLHISVAFIQMLKALMPVATFIMAVLCGIDKASWYSLPGHRHICRSFKTGLNTSSSAEKGVDFKSYYKLILHSSLQFCVSLCALVPTREACDGSFTDSVQFLDLLFQRYMCSSLEFLHFLSHW

SEQ ID NO: 171865 - protein, 204 aa, Glycine max
  Coding DNA Sequence Number=SeqID_80180
  Homolog annotation: Hit_ID=A2Q3I7; Match level="QueryCoverage=47%, HitCoverage=89%, E-value=8e-07, Identity=29%"; Hit description =Polynucleotidyl transferase, Ribonuclease H fold
MTKSIGSGKYLGLPSIIGKKKKNLWFHQGDTLEAYQSLVLPTLIKSEQRDSHQINNGFRELVFSLLESQPNHTFKKIAIILWAIWRSRNWKIWKNNHQQPVVEIYLAMSFFHEWLSVRTAQHDNNHQSTQASTIWSPPLVDLSNAILMLLSSRMSSLFCVGMCLRDHNGTYMKAPTHFLQGIPSVAIAEVVALHKVFNGLSNSN

SEQ ID NO: 171866 - protein, 143 aa, Glycine max
  Coding DNA Sequence Number=SeqID_80181
  Homolog annotation: Hit_ID=A5AV98; Match level="QueryCoverage=52%, HitCoverage=9%, E-value=2e-13, Identity=46%"; Hit description =Putative uncharacterized protein
MTVVDSINTTLPKIDSVKEFMGLVREHSQTTNKSLAGTLISTLTTMKFDDSCTMHEHVIEMTNITTRIKTFGIAVKIKECRKEEDKHKIYTGSATTRAYIQSPSNQQFLRFLSTLYNPLQAKDTQGMYPPLFSLNNQVDVPST

SEQ ID NO: 171867 - protein, 80 aa, Glycine max
  Coding DNA Sequence Number=SeqID_80182
MQMKPLEHIKPQIKPPKQCKRNERKKTTNLTKSANPHNHENAGEGKANRKQLKKPTNILALPHRIADLDSNLPHWDAYVD

SEQ ID NO: 171868 - protein, 92 aa, Glycine max
  Coding DNA Sequence Number=SeqID_80183
MLGVAGREEEGGEGGGGCGGGRVLQALPELAVKGVEGRGGEEQGGEGREGGGRKKGEGEWRKGEKEVMRKNTRKNHTLTQQRDHTGKMTLKQ

SEQ ID NO: 171869 - protein, 120 aa, Glycine max
  Coding DNA Sequence Number=SeqID_80184
MEESTDRSKVAEKRQISPFGVILKTFSSDGVLLKLFIQEGSFGRKLHAWSSKSPMGLAGLLLVTGLATASGDKHMQREQIASETRDIGARWEPFPPVKLASSRLFRRPAFFKLFQVAGAV

SEQ ID NO: 171870 - protein, 112 aa, Glycine max
  Coding DNA Sequence Number=SeqID_80185
MSLILAPLFGLLQWQRTMMPPSGEGLLQLPGFPGGSHDTSVLRDFENLIALIVWNGEECSKLKLSSHGRKMTKFERPTPEIEGLVAASGLSPLIACSLDMSDRGLMSAFVEH

SEQ ID NO: 171871 - protein, 85 aa, Glycine max
  Coding DNA Sequence Number=SeqID_80186
MAIETEATTTTAVEKGNTTTATAKIKTMAITTIQENMIDGEAKRKNASSHEENVWSRHQRLFEENVRKTKMMKGVALAPTYPQVQ

SEQ ID NO: 171872 - protein, 393 aa, Glycine max
  Coding DNA Sequence Number=SeqID_80187
  Gene Ontology: Mol. function=protein serine/threonine kinase activity; Cellular component=cytoplasm; Biological process=protein amino acid phosphorylation
  Homolog annotation: Hit_ID=A0MNI9; Match level="QueryCoverage=99%, HitCoverage=91%, E-value=1e-158, Identity=67%"; Hit description=CBL -interacting protein kinase 1
  Pfam annotation: Domain name=NAF; Domain location=259-319; Score =112.5; E_value=1.3e-30; Accession=PF03822.5; Description=NAF domain
  Pfam annotation: Domain name=Pkinase; Domain location=10-220; Score =185.8; E_value=1.1e-52; Accession=PF00069.16; Description=Protein kinase domain
  Pfam annotation: Domain name=Pkinase_Tyr; Domain location=10-218; Score=-47.0; E_value=1.6e-09; Accession=PF07714.8; Description =Protein tyrosine kinase
  Pfam module annotation: Pfam domain module=NAF::Pkinase::Pkinase_Tyr; Domain location=259-319::10-220::10-218
EEQGVRLGKYELGKTLGEGNFGKVKLARDTHSGKLFAVKILDKSKIIDLNNIDQASKGKLKEAEGRKIFQQLIDCVSFCHNKGVFHRDLKLENVLVDAKGNIKITDFNLSALPQHFREDGLLHTTCGSPNYVAPEILANKGYDGATSDIWSCGVILYVILTGYLPFDDRNLAVLYQKIFKGEVQIPRWLSPGSQNIIKRMLDANPKTRITMAMIKEDEWFKEGYTPANPEDEEESVYIDDEDFSIHDVSHEADQGCPRSPTLINAFQLISMSSSLDLSGLFEQEDVSERKIRFTSIHSPKDLVERIEDIVTEMGFRVQKKNGMLKVIQEIKVQKCPGSFSVEAEVFEISPSLYVVELSKSCGDASLYRQLCKKLSNDLGVHTRQQLGSSEVMA

SEQ ID NO: 171873 - protein, 403 aa, Glycine max
  Coding DNA Sequence Number=SeqID_80188
  Gene Ontology: Mol. function=magnesium ion binding; Cellular component=chloroplast; Biological process=photosynthesis, light harvesting
  Homolog annotation: Hit_ID=A7PDT5; Match level="QueryCoverage=62%, HitCoverage=88%, E-value=1e-117, Identity=78%"; Hit description =Chromosome chr11 scaffold_13, whole genome shotgun sequence
  Pfam annotation: Domain name=Chloroa_b-bind; Domain location=64-240; Score=265.3; E_value=1.2e-76; Accession=PF00504.12; Description =Chlorophyll A-B binding protein
  Pfam annotation: Domain name=DUF1723; Domain location=321-365; Score =9.5; E_value=0.04; Accession=PF08330.1; Description=Protein of unknown function (DUF1723)
  Pfam module annotation: Pfam domain module=Chloroa_b-bind::DUF1723; Domain location=64-240::321-365
  Subcellular localization annotation: CTP_CleavageSite=40; ConfidenceScore=5.27e-01
MALALSSTALSSLPNREIRQKGFPERTPTCLSLTRRTIANATKGVSAVCEPLPPDRPLWFPGSSPPEWLDGSLPGDFGFDPLGLGKQVLLLPWSDPELLKWFAQAELMHSRWAMLAVFGILVPELLERIGYIENFSWYDAGTREYFVDPTTLFVVQMGLMGWVEGRRWADIVNPGSVDIEPKVPHVTNPKPDVGYPGGLWFDPMMWGRGSPEPVMVLRTKEIKNGRLAMLAFVGFWFQAIYTGEGPIENLMAHLADPGHCNIFSEPVTIDVRADTQGFSGGPKDTSALTDYVHHVAIKVWKGQECTNLKLASHGRKVEKFGRPTPEIEGIVETSSFHLLIGDVTITLNDVASLLHLSITSAFHTFDAHDVNQVVDLIVELLEVSTQEAKDETFQTKGTYVRLA

SEQ ID NO: 171874 - protein, 130 aa, Glycine max
  Coding DNA Sequence Number=SeqID_80189
  Gene Ontology: Mol. function=hydrolase activity
  Homolog annotation: Hit_ID=Q9FI75; Match level="QueryCoverage=50%, HitCoverage=12%, E-value=2e-21, Identity=67%"; Hit description =Similarity to 5'-nucleotidase
MVSLVGTDGQDAFEGPVEEVVRAEAKEAKDSLEKLDIPAWEGRAYDYCMENLKNMGFPVDGLAFHPELGGNLVKAGRFGYIKRAMHGTKMLSTRAVCVASAIGDTSGIATCTGALAMQSEVVGQLGATSL

SEQ ID NO: 171875 - protein, 203 aa, Glycine max
  Coding DNA Sequence Number=SeqID_80190
FKSDLTRKWTLAADKDSVDDTRPLVGGCAEKGTEQKLMAEKTKKKLEEATQSGSIEAVIDPLSPIIRHVKWKMARTKKTRKMTSEAAKEIIEKITSVTGFLCPSWTSGSPDCCHWVTRIPWPCACYWSRCDHKAILWISSTNLPQFFLHASQRFRVADSTNQGPAGGVDHKKSDSAADVILQPDVIPVAITYPITGTCTVSEA

SEQ ID NO: 171876 - protein, 167 aa, Glycine max
  Coding DNA Sequence Number=SeqID_80191
  Gene Ontology: Mol. function=nucleotide binding; Cellular component =Golgi apparatus
  Homolog annotation: Hit_ID=Q9FH12; Match level="QueryCoverage=79%, HitCoverage=20%, E-value=1e-51, Identity=77%"; Hit description=Axi 1 (Auxin-independent growth promoter)-like protein
  Pfam annotation: Domain name=DUF246; Domain location=1-167; Score= -86.1; E_value=1.3e-09; Accession=PF03138.5; Description=Plant protein family
MKRRRRVRILTEIKTHFQLEFWKEITQMQILGTREYEKDMLAFTGCSHNLTAEEDEELRQMRNEVGHWKEEINGTERRLTGGCPLTPRETSLLLRALGFPSQTRIYLVAGEAYGRGSMKYLEDDFPNIFSHSSLSSEEELNTFRNHQNMLAGIEYIVALQSDVFLYT

SEQ ID NO: 171877 - protein, 125 aa, Glycine max
  Coding DNA Sequence Number=SeqID_80192
  Gene Ontology: Mol. function=nutrient reservoir activity; Cellular component=extracellular region; Biological process=auxin mediated signaling pathway
  Homolog annotation: Hit_ID=O04011; Match level="QueryCoverage=34%, HitCoverage=20%, E-value=4e-09, Identity=62%"; Hit description=Auxin- binding protein ABP20 precursor
MSNHIEATQMQKISAYRQHLKHHQGRGDAGLRRRAILRRKRPGNLHCAPRPSTWWSHPTPHSPWSLRTTVVVKGKICTGFIASDNTVYLKTLEKGDVMVYPQGLLMLNQSTEMLLALWVMLCILG

SEQ ID NO: 171878 - protein, 65 aa, Glycine max
  Coding DNA Sequence Number=SeqID_80193
MGVKYLEVVKRGSHPNNGWSPDEIRGSKDRTLISFERNTIRLVKLPASGTCKIFESDQYRRPRSS

SEQ ID NO: 171879 - protein, 736 aa, Glycine max
  Coding DNA Sequence Number=SeqID_80194
  Gene Ontology: Mol. function=RNA-directed DNA polymerase activity; Biological process=RNA-dependent DNA replication
  Homolog annotation: Hit_ID=A7NW01; Match level="QueryCoverage=66%, HitCoverage=97%, E-value=1e-121, Identity=50%"; Hit description =Chromosome chr5 scaffold_2, whole genome shotgun sequence
  Subcellular localization annotation: CTP_CleavageSite=56; ConfidenceScore=5.79e-01
MKQESPASPLPSSLPQPSPTMTTTKNVIKLQNSLTPSRLRLPSKYREPPKTPPEVVVNNVVVSTPSRRAKSVTPELKHNSRIKRGLVLNKAKPNEEVVGTTQRGREAEETKVVARFVRPHVVEQFARPRNGAGDFAFKRDKEDSDEKSKKELMEKLEASESLIKNLQSEVQALKAELEKVKGLKVELESHNRKLTEDLAAAEVKVVSLGGNEKEPNGEHQSPKFKHIQKLIADKLERSIVKKEAIANGGFVEASIPPPTAIPAIPDAPTARKGRKPTPNSCLPPPPPPMPPSIPSRPIAKASNTQRVPAFVKLFHTLKNQEGMKSTTGTVKQQKPVSVNVHSSIVGEIQNRSAHLLAIRADIETKGAFINDLIKKVVEAAYTDIEDVLNFVNWLDGELSSLADERAVLKHFNWPERKADAMREAAVEYRELKLLEQEISSFKDDPEIPCGASLRKMASLLDKSESSIQRLIKLQNSAMRSYQEYKIPTAWMLDSGIMTKASMILVKMYMKRVTMELGSARNSDRSSQESLLLQGMHFAYRAHQFAGGLDAETLCAFEEIRQHVPGHLAEQFPELTDKIKEVLIPLSPFEDRLVWKHTFSGEMCMKDVLHFSSPLFLSSAGAKWFIHGSMSIVNIKNKVIADVVLASTYSMNFKVPIHPNKAPTVKPVTWSPLCGWIKCNSDGAARGAPGNVACGGILGDYRGSISWHIGSTTALFAELLAAMKSIEIAASCGWCNL

SEQ ID NO: 171880 - protein, 76 aa, Glycine max
  Coding DNA Sequence Number=SeqID_80195
MRKVFLSAQICIKIPNGENAQNWASNVVLKFHDDPMVNESKIIVFLRQVRWSAGKKEGFGRNEIVRQRRLKSQSEN

SEQ ID NO: 171881 - protein, 76 aa, Glycine max
  Coding DNA Sequence Number=SeqID_80196
MDQWHLRHHAHQVYKRGLVQLRVTFCGCNPSMFQNMFGMRKQTENYTSDEQCRRIKVKNKYQRKLFLCFGNVGFIG

SEQ ID NO: 171882 - protein, 301 aa, Glycine max
  Coding DNA Sequence Number=SeqID_80197
  Homolog annotation: Hit_ID=A3RI55; Match level="QueryCoverage=51%, HitCoverage=31%, E-value=6e-07, Identity=27%"; Hit description=WRKY protein
MEDKIVINELLQDEEKPSSDNTMGSTLLSLSLNNSGQSLNQMGMLRIKLEEAKKENEILKAMLNQVNEHCTTLQNRILFEMQQHQLSASSSSPRNNNNHHDSQGNKQDAEKPMLHTRQFLNIGESSILDGNTKACAIAENVEKKILGKNLASDINKYNVKGEINSQITLNEVKSTEDQASEVTCRRARVSIRARSDFSLVLKAFVYLLNQILHEVEGWAMGVNGESTDKRQRKATLVLEPTTVAAWELHAQFVSMFVDIHLHFLAIISLCFNYFLVTCIHYTHCIIAVRGGRILNSAEKNP

SEQ ID NO: 171883 - protein, 95 aa, Glycine max
  Coding DNA Sequence Number=SeqID_80198
  Homolog annotation: Hit_ID=A7PAV4; Match level="QueryCoverage=61%, HitCoverage=4%, E-value=8e-07, Identity=51%"; Hit description =Chromosome chr14 scaffold_9, whole genome shotgun sequence
MKVYIVVDNLDVNSIKSVNLRAVVYSNFLHASRVEISKLKMSIEGSSSGNNLVVTDVDNFQPESLDKYKEEINKLQMEVERYMEKNIGNPKPRNF

SEQ ID NO: 171884 - protein, 255 aa, Glycine max
  Coding DNA Sequence Number=SeqID_80199
VEEDKRGKHIPYRNTTTMEGKSYATVVGEKNQYHAKEKNLKDARNAKEGGKDVEGMYAGLTMEKTQSMITSNDDDVMSLLYVVQPMEPCVLCDGIPLQAWGEQCFSRVVGLFGTFVSLDIEIANLERLGRAQIMLKVSFFLPISSCYDVKDSDNDEDFEHSVLEMDISSFSSECYSKEGMRAEDDESSVVYQPMEVGVGQSMDLSPFTHPYMEVGEGKGARDYKVLGDEQPIEGIQEPLKYKAGNEKENLKWVKE

SEQ ID NO: 171885 - protein, 124 aa, Glycine max
  Coding DNA Sequence Number=SeqID_80200
MNQQTWDEFAASRKTPTWQDSLQEQTTQGSFVPHGHDDILNIAIARPEHPGRVRVAGSGMTISQYYGRASCGSSSSSTSITQQQLAEIIGSLKEEYMNEIIRNPKEEVRNEIEEENKWSQEKKK

SEQ ID NO: 171886 - protein, 254 aa, Glycine max
  Coding DNA Sequence Number=SeqID_80201
  Homolog annotation: Hit_ID=P04670; Match level="QueryCoverage=16%, HitCoverage=14%, E-value=4e-08, Identity=69%"; Hit description =Uricase-2 isozyme 1
MVLNFKNLHKNYVRDALLVKFEDDVYLPTDEPHGSIQASLSRLWYYLKGPVVFTDVTWFCEDCATKLGVPPALDQSTPISFKLKKKQKEGKTNSSLVAKTKGVLSSRHISPEPKHPQCSNRCEECEVKDECGPKDVANFDVGEEESVARDLANSDEGFKFVLVSQGATDNDSGCVELDGHVYAYPTIDPIWRYINVTDEAVQKGIFYPSIDCIRYVTTEVEAVVVHATIVEKQPKGHGDVGFKDLSRNQKYGKF

SEQ ID NO: 171887 - protein, 188 aa, Glycine max
  Coding DNA Sequence Number=SeqID_80202
  Homolog annotation: Hit_ID=O82334; Match level="QueryCoverage=68%, HitCoverage=18%, E-value=1e-08, Identity=27%"; Hit description =En/Spm-like transposon protein
  Subcellular localization annotation: CTP_CleavageSite=38; ConfidenceScore=5.07e-01
MDSRWKSIYNKVQPMSTMCMFFLSLSKTLRNLVKGLICIQMPRPTINVDPATGRGLGPQKQKFHSYLGVVAREKIPIVLSNRKDVSKSLKDLVLDDILAKFDIPKASNAKKKVMSTVATRWRQFKSSLTTKFVYADTNDEKRKKRQEEAMLIENTPFLEDHPSPIERHVKWKMARTKRYGQMTSQTAQ

SEQ ID NO: 171888 - protein, 82 aa, Glycine max
  Coding DNA Sequence Number=SeqID_80203
NFLMAVSAIAGNNGGRRRNAKEKRTSKKKQQRKEEAFNLIPTTMAATKMRKKQKREEEDFTWEEEAARRRRCRMKQKNEEQE

SEQ ID NO: 171889 - protein, 200 aa, Glycine max
  Coding DNA Sequence Number=SeqID_80204
  Homolog annotation: Hit_ID=A7PDX0; Match level="QueryCoverage=86%, HitCoverage=46%, E-value=4e-54, Identity=63%"; Hit description =Chromosome chr11 scaffold_13, whole genome shotgun sequence
MATDRYASPPATSPEENALFLDILHEAPLFAHRKAARVIGSVFYCILLASSNNSNSAPLAKHAGYATLAIGAHWIFRPVQGLISPVLCSCDVLLLLLTGIFQQYLVYQVQKIRLQGYYSFSQKLKFIVRIPFAITAYGTAAMLLVIVWKPYTGFLSISAILRIIMVVEAVSAGGGGDGATNSIYDLFILYIDGAKISQQI

SEQ ID NO: 171890 - protein, 31 aa, Glycine max
  Coding DNA Sequence Number=SeqID_80205
MATKFDIEKFTGSNDFGLWKIKMEAILIQQE

SEQ ID NO: 171891 - protein, 85 aa, Glycine max
  Coding DNA Sequence Number=SeqID_80206
MEKTWPDIVINNMVITNDHQPNSAEVTKGMINHFSLIVSFWMVRTAKVEAGYKVCHFAKAIHHNKNGIMSMLSMWEAQYEICRSK

SEQ ID NO: 171892 - protein, 27 aa, Glycine max
  Coding DNA Sequence Number=SeqID_80207
MADAGFREIMCAYEGDERWHGQYEKVK

SEQ ID NO: 171893 - protein, 110 aa, Glycine max
  Coding DNA Sequence Number=SeqID_80208
MGQNDISGFLLQTIYRRGFVLKEFPVKCKATQRVLPIALARYPHAIQPIHPSSPAHPCMLGFASQTGEITLSWFRQSRLQDGLGPLVLPVILTRYNPCSATVTCMRVGSV

SEQ ID NO: 171894 - protein, 155 aa, Glycine max
  Coding DNA Sequence Number=SeqID_80209
MIPPSGRFEGFNPSINEAINLIQAEMMDYIAIKITTCPSNFTAQNYPCHVMKLLPEDHRDYPCLSNDEYESWDVQGNTQYQYSLMRAQIQGYKWFFSESNKQKKDKEIYEASGCHGQQTPPFPSIDLSMEDSSDIFCSGNIQDEEDVTITKSTKN

SEQ ID NO: 171895 - protein, 44 aa, Glycine max
  Coding DNA Sequence Number=SeqID_80210
MSASVQLPVSLSGILLVCVDLKFTGKCTRSSSSSTKHRCLVSLA

SEQ ID NO: 171896 - protein, 120 aa, Glycine max
  Coding DNA Sequence Number=SeqID_80211
MDDFSEHEDQQFFDHINDQSDDEGVGGPTSPPLKYHQPRCSMELNLDHLRHHFVQQQDSVQPPTGALEIGTPRGPTTPQLTYGFRKHPISSTCATLHKISFAIRIHGEDALATSWGYPCI

SEQ ID NO: 171897 - protein, 28 aa, Glycine max
  Coding DNA Sequence Number=SeqID_80212
MTATFSRVLWDAELVKVAEKLGAVEGLE

SEQ ID NO: 171898 - protein, 94 aa, Glycine max; identical to SEQ ID NO: 107670
  Coding DNA Sequence Number=SeqID_80213

SEQ ID NO: 171899 - protein, 214 aa, Glycine max
  Coding DNA Sequence Number=SeqID_80214
  Gene Ontology: Mol. function=enzyme inhibitor activity; Cellular component=cell wall; Biological process=double fertilization forming a zygote and endosperm
  Homolog annotation: Hit_ID=A7PDS0; Match level="QueryCoverage=74%, HitCoverage=70%, E-value=6e-46, Identity=57%"; Hit description =Chromosome chr11 scaffold_13, whole genome shotgun sequence
  Pfam annotation: Domain name=PMEI; Domain location=29-182; Score =163.3; E_value=6.3e-46; Accession=PF04043.6; Description=Plant invertasepectin methylesterase inhibitor
  Subcellular localization annotation: CTP_CleavageSite=67; ConfidenceScore=5.14e-01
MQLQLTLSSLFLSLLLTITLTSPTLAAQSKPQDLVRSSCVHARYPRLCLHTLSNYPGSANTPLDVARTALKVSLAHTRRASKFLHALSHDDSIIMRKRERSALRDCTEQISDSIDQLRRSLDELQHLRSETFRWQMSNALTWVSAALTDGDTCLEGFGGNARPDVKRRVTDVARVTSNALYMINRLGQSRTGKPKYKPRPRTQPGSASSTEKLN

SEQ ID NO: 171900 - protein, 105 aa, Glycine max
  Coding DNA Sequence Number=SeqID_80215
YGVSNTFNVTDLTLCDVDTFNINSRANSSHEVGYDRGLSKEEEFDLRGLNMDGPITRARSKRFQEKLEPRGLENATRSGELPATCKSPVLLASLLCVLETASLTS

SEQ ID NO: 171901 - protein, 85 aa, Glycine max
  Coding DNA Sequence Number=SeqID_80216
MDFYKVERNIKDRRSLGDWSKKANKGSLANTVRVENKNWQGTLAKMMMMEHDDRGNDWQNNGSDNNKDGNERLGLESFGHKNGTM

SEQ ID NO: 171902 - protein, 223 aa, Glycine max
  Coding DNA Sequence Number=SeqID_80217
  Homolog annotation: Hit_ID=A2Q186; Match level="QueryCoverage=70%, HitCoverage=41%, E-value=4e-12, Identity=30%"; Hit description =Reverse transcriptase-beet retrotransposon, putative
MAGRTGHHDHNFSMVTSVDERKGKSPHSSQEALEVLEFNRFVEDLELVVDVPIVGGKFMWISAGAIEEGWNLEVYGDMEAKRKNLVLLINELYKKAEDGTITNSKDYMAKRRRLKYKLFSHNSELEEENNSIKGPFVDGSWVEEPKVVKATVKKYFEEKIKEEDVPLVRLDDVRFTKLEDHDNVTLTVEFTKEEVRQAIWECDGNKCQGLMVITSTSSRSVGV

SEQ ID NO: 171903 - protein, 111 aa, Glycine max
  Coding DNA Sequence Number=SeqID_80218
MVVNYKPSSLHTKHMHRGVLLRDASIGKGAKEAITGAEPQDNYTLRVSQGSTIQDLLEQQGLDQTLEDERLTSINETEWTKIQRRIVSTIRLALAPEIKHNVLKETTPKAL

SEQ ID NO: 171904 - protein, 186 aa, Glycine max
  Coding DNA Sequence Number=SeqID_80219
  Gene Ontology: Mol. function=oxidoreductase activity; Cellular component=integral to membrane; Biological process=electron transport
  Homolog annotation: Hit_ID=A7PDR6; Match level="QueryCoverage=98%, HitCoverage=18%, E-value=7e-35, Identity=48%"; Hit description =Chromosome chr11 scaffold_13, whole genome shotgun sequence
  Pfam annotation: Domain name=NADPH_Ox; Domain location=132-186; Score= 12.1; E_value=7.8e-07; Accession=PF08414.1; Description=Respiratory burst NADPH oxidase
TGEFDLPENFDASSPVTGGHAYGAMLPVFLNDLRSNHHKELVEITLELENDAVVLCNVAPAPSSAPNASPSSSTAGGDGSGGGVARSLSITSRIRRKFPWLRSMSSASVESAAASVEDPLVTARNARKMRVKLERTRSSAQRALKGLRFISKSGEATEELCRKVEERFNVLAKDGLLAREDFGECI

SEQ ID NO: 171905 - protein, 87 aa, Glycine max
  Coding DNA Sequence Number=SeqID_80220
  Gene Ontology: Mol. function=oxidoreductase activity; Cellular component=extracellular region; Biological process=response to oxidative stress
  Homolog annotation: Hit_ID=A7QR22; Match level="QueryCoverage=86%, HitCoverage=23%, E-value=2e-16, Identity=49%"; Hit description =Chromosome undetermined scaffold_147, whole genome shotgun sequence
MLCKPPLKCLKIVIMANLLTMFFVMEMIVVNGFNFGASGLSKNYYFLSCPIAELVVKNTINRALQDDPTLAAGLVRVHFHDCSMIQC

SEQ ID NO: 171906 - protein, 168 aa, Glycine max
  Coding DNA Sequence Number=SeqID_80221
MDLYPMNLQTKFRKDPTVNDGWEAFLPRQLHVTSLRSFIKRLPREASSLTSLQRLEECNYDSSGLASAQFRTTLYSGNKRVQRQNGCGFVSTGSPYCFFLQILQSQAASCLHLCPRTLHHYYCSKEMTSIFIGPSLNHPHGPSEPQGVDDSSGANTRATNVFSQTDWL

SEQ ID NO: 171907 - protein, 172 aa, Glycine max
  Coding DNA Sequence Number=SeqID_80222
  Gene Ontology: Mol. function=nucleotide binding; Cellular component =nucleus; Biological process=defense response
  Homolog annotation: Hit_ID=Q19PK9; Match level="QueryCoverage=88%, HitCoverage=27%, E-value=1e-30, Identity=40%"; Hit description=NBS -LRR type disease resistance protein
NNCGSKIMITARKSDLAFTSSIESNYKVYNLHPLKEDEALDLFLRNTFQGHSCPSHLIDICKCILRKCGALPLEFVAISDVLATKDKHRIDEWDMIFCILGAKIHGNGKLDNFKTILNLNFNEGFIKAKEWKTKKDVADDYLKELLNKNLIQGSCVKKLSGKPKLDDNRATK

SEQ ID NO: 171908 - protein, 116 aa, Glycine max
  Coding DNA Sequence Number=SeqID_80223
MKVFGLEELHGGGAGVVVGLEPALDVGVVIGDSGAEDDKGFHEDEGDRALEEPVNKMKRARDDIYGQNQVPGSGGGGGGGGGDNQGVVGGVATTSQKLTTNDVLSYLKEVKDMFQD

SEQ ID NO: 171909 - protein, 115 aa, Glycine max
  Coding DNA Sequence Number=SeqID_80224
MNSAIGGVPIAEEKWAARSHTLSARPSAKRPDDLPQTSSCAHTWGSIRLGLLPLHLGDRLAQVVRFDAETINDFLDTPIILVDGEEHPAYSQYLRTPPDHDTILSTLCTPGGVLC

SEQ ID NO: 171910 - protein, 60 aa, Glycine max
  Coding DNA Sequence Number=SeqID_80225
MGRASEGGGTRGREWGSGGGWGQLGRGRRKKEEGGREKDQGFSREGRQRSNDAVLNFNNF

SEQ ID NO: 171911 - protein, 83 aa, Glycine max
  Coding DNA Sequence Number=SeqID_80226
MSFVVSCDDAWTKLKKAYANRSLAKILSFKLKEQLATISKEQEYWCSEFGDPFTAHDRNQPVVVSWERSVIKFSYQCSGAFSL

SEQ ID NO: 171912 - protein, 68 aa, Glycine max
  Coding DNA Sequence Number=SeqID_80227
MDEHQQTWKEMTNIMIKINKESNEMFNTVHVIDQLYGEVGCAEYHVLIYESRKIHSSELGRDEVYTSL

SEQ ID NO: 171913 - protein, 46 aa, Glycine max
  Coding DNA Sequence Number=SeqID_80228
MIAVTIREKGHFGAVAARPGELKLNLEAMSSPRRAGAHPSKLVSSP

SEQ ID NO: 171914 - protein, 407 aa, Glycine max
  Coding DNA Sequence Number=SeqID_80229
  Gene Ontology: Mol. function=hydrolase activity, acting on ester bonds; Cellular component=cellulose and pectin-containing cell wall; Biological process=lipid metabolic process
  Homolog annotation: Hit_ID=A7PDQ4; Match level="QueryCoverage=85%, HitCoverage=89%, E-value=1e-146, Identity=70%"; Hit description =Chromosome chr11 scaffold_13, whole genome shotgun sequence
  Pfam annotation: Domain name=Lipase_GDSL; Domain location=51-366; Score=190.4; E_value=4.6e-54; Accession=PF00657.13; Description=GDSL- like LipaseAcylhydrolase
  Subcellular localization annotation: CTP_CleavageSite=71; ConfidenceScore=5.33e-01
MTKQNFPLGCSVVCISIILIQFIASMNFSTSQSFKNETSSISTTTTTTKAFFIFGDSTVDSGNNNYLNTIPENKADYKPYGQNGFFQEPTGRFSDGRVIVDFIAEYAKLPLLPPFLQPNADYSNGANFASGGAGVLAETHQGLVIDLQTQLSHFEEVTKLLSENLGEKKAKELISEAIYFISIGSNDYMGGYLGNPKMQESYNPEQYVGMVIGNLTHAVQSLYEKGARRFGFLSLSPLGCLPALRALNQEANKGGCFEAASALALAHNNALSNVLPSLEHVLEGFKYSNSNFYDWLRDRIDNPANYGFKDGVNACCGSGPYGGVFSCGGTKKVIEYFSLCDNVGEYVWWDSFHPTEKIHEQLSKALWNGPPSSVGPYNLENFFNKEIKLTIADVVDAPQIQNGEFHY

SEQ ID NO: 171915 - protein, 146 aa, Glycine max
  Coding DNA Sequence Number=SeqID_80230
MSVHGPVMEDDIFTLWTWLKGFEKDFDRPYSYWSSNMSLRQTTTVPKGDRKHQGGRQVLIVEVGMGEAADLGAGKEKPSHSPQIQLKKAEVCNTTVLDEVQQQWNLGKALGLKVDTDQSIYIQNFANMEVRDKEEAMELGNRKTCR

SEQ ID NO: 171916 - protein, 191 aa, Glycine max
  Coding DNA Sequence Number=SeqID_80231
MGCYLETPQSLTVVVSPLCSRAVPPLSCSRVAVNVEGVNPHSHFRLCHAATLKVVHAGQYPLDIYNRLCLRMDPYQINKGSQTLGRANNGCLFCSYSCIKGIQDSPLNTKIKLWESCFWFFRYFFVIKNIQEIMSNIIRIEKFNGKNSFNLWRIKMRALLKEQRVWATVASASVKTEMASDSNRQDLYFKD

SEQ ID NO: 171917 - protein, 145 aa, Glycine max
  Coding DNA Sequence Number=SeqID_80232
  Homolog annotation: Hit_ID=A5BLR1; Match level="QueryCoverage=78%, HitCoverage=14%, E-value=5e-13, Identity=36%"; Hit description =Putative uncharacterized protein
  Pfam annotation: Domain name=zf-CCHC; Domain location=95-112; Score =23.0; E_value=0.0005; Accession=PF00098.14; Description=Zinc knuckle
MSLATLFGKLQEHEMELMRLHQHEENDKKNKRIALRASSSSIQEESDKEDLNEIEEDDDFRFFVKRFNKFMRNKGNQRRSNTNPNKKGENSSLAPKCYECDQPGHLRFDCSVFKKIMENLTREISKKRNKRKHTTLGKIMHEFFK

SEQ ID NO: 171918 - protein, 407 aa, Glycine max
  Coding DNA Sequence Number=SeqID_80233
MPKKGVRTPVFLLEIVMYALSTPAALSLFIAAVKSLDFQMITLSRPCRAKRDKRTLCTKPECYSGEAELSVPYCAKLKSSTERYTDIMVPRKILPERNVVIYHTEFDDFKEKIERRNWHEELTSFEEGSIDVAIVKEFYANLYDLEDKSPKQVRVKGHLVKFDEDALNTFLNTPVIIEEGETLSAYSRFALLRPDPQELAAKLCIPGRGFELNKNCWNLDDLTVTFKGPRKAKGKKFETLPSSKVPPTTSAPASSTLATSAPSPTQLPVLALSSSGPSYFSFTPEMLHAMMQSLHRGQLDWPGVQPSPSGGGGTSAAQEPEPTEEDTPAVEDDLTPPEPFLFASNSVVAHEEVPSPEPISEPSPTPISEDTLPSAPALEQEQPISQDPPAAPVLDLNEHAEDHPQED

SEQ ID NO: 171919 - protein, 98 aa, Glycine max
  Coding DNA Sequence Number=SeqID_80234
MKKSIEGLFSTESLRWIAENNNDSWWPPMVVGGREAARESTFSAKHNFLRNSFCAKRDNSRSAQFPWVGIALSTLLTQRERLKIIILEIPTVRPWGIG

SEQ ID NO: 171920 - protein, 601 aa, Glycine max
  Coding DNA Sequence Number=SeqID_80235
GHVTRYGTPLRLRLITMGWGAACAQQGDLDTCCLVFLSESVVWTCLGYFLDEWTVVEYLKLDSFMELPSRHDDNGDIIVPRRVVTTCKTNDSNAQGSIEPSTYRSGMELWVLVFKGKRGCLVLKSGVQGSSLDKYEGDKLVEPPSEDKCCPVSRAVTSTGVRVAGSSDSESSSSEKLRASCRTGGGTSRLHGRVRPSTTSLTKEPISFTVVLPSSDYKIGWVSLNNVSKTFFEFDSNVFRSFKKCFFKVLATDVVPDGLPLMFNRDGIMGNFRWRPLVKQVNPAGRTVPPSVVPLTAKERGQLAGEVGPVVVTEVVPSHPSSLQDFPLALSAVEDLAPATVVAATSAPSPPLTVPIREVTSATRVSAPTTSVGSIIASSSTIVTPLLSVNRLPRLLVTVSLDHLYTFNDTDSMWGVNYKLEQKTPLIKTSFDQLGFKTLWTPPKSSFREEFPKVANANIAFAEAIKSNHQLSSMEEKNDLADKVEGIMAKRNELAKVDVNLEAWLKELESKQEEFELLVAKERGASKELEDDLIIYKNEVMRQHEKGFQKAARQAEFFTKDLDLGLFDPFKDVKDSVLLDNKEIATEEEAVNEEQGSEERR

SEQ ID NO: 171921 - protein, 88 aa, Glycine max
  Coding DNA Sequence Number=SeqID_80236
  Subcellular localization annotation: CTP_CleavageSite=60; ConfidenceScore=5.15e-01
MSGHPDLTRKVMTKNPNKVKVQGRKLQKNPKIVLSSRDQPSSLPQIEPSLTLYPNTPIPETSAAQSKLVEEYASNATHTSTEATVQIQ

SEQ ID NO: 171922 - protein, 557 aa, Glycine max
  Coding DNA Sequence Number=SeqID_80237
MASSNTPSTEIIPTMEITIIHIYNESSINIEHFFDIHELKKVGLKLNETLLFCVNKKTIASKVLGVKVVLSSDTIVKAIGCLHEGSTYQGKWEKNYDSRVTRALYWENSDKKVKIWANILNKSALHIAASKTTLSNLHNFILFHLMKNLPFDLPHIIYINILRNLKGLEQSLKKTPLVDLDAINKRKQKRLAKVIADEDQDLSETDEGLVQAVLQKRKIAALVISFTRNKEDPTSSSSLDTESTNDTLISPLCKHAPSTQPRTLPSPLHLDRFRRVAPREALIDAKRFPLAFTNGNPTPETLYSKLIFSKPMARENIIVQAPTWMKHDCEHTLSESFKALPTNAIVHLRSPQWTHPVATDIKMSANKVSPRLPIWDVAKKNKFELYYNEKLPRRKIKVEIANFPSSTSGYDGSNNTKHRDVIQVLCPVRKYHFDDASQQRKKAKEEVGVVAEKENVASIQAKAFAKSVDDTIVPGIIIVLTNTGVMDETPEESNIVMADEVEHNVIEPTSKQSKTSNVATSRDKGEPDAIIVTLPVPASLLSTMHNPPLSLEIKYKI

SEQ ID NO: 171923 - protein, 56 aa, Glycine max
  Coding DNA Sequence Number=SeqID_80238
MCKTLVMKGEDDDSYMDTYVSPLSTQMTSNSIGEEEADDVHANRNDHDEGELINIV

SEQ ID NO: 171924 - protein, 105 aa, Glycine max
  Coding DNA Sequence Number=SeqID_80239
MKLIYPSLMTQRLKKTRNKLAIRRSTAELHSLMFEFVQNEGMKAPKDFFHKDQCRNLPFCGRARRGSRVDKSGALAPTYPPSKRKSDLRSSFKRGESSDSFLLGR

SEQ ID NO: 171925 - protein, 153 aa, Glycine max
  Coding DNA Sequence Number=SeqID_80240
MGYVGVRELSWRWAIGDGGFMRDLWMWKTCCAPSPDRHLSGTWRYVAGVRRPWGRQASSWQSTDKRNKYHKARRLVWWLASCESCVIYRLWPLVIDYQGLENEVVEASGNRLPVCVIDYTEEWVTGNRLPGMKSLEIPLLLACSGYETHCVAA

SEQ ID NO: 171926 - protein, 78 aa, Glycine max
  Coding DNA Sequence Number=SeqID_80241
MAMLGWSKVSCIIVQFSSFVELLSFDRISTLSLSTLGKTARKPHYKRNLKESWASSSKGNNTRKSSLPWIQTENANET

SEQ ID NO: 171927 - protein, 52 aa, Glycine max
  Coding DNA Sequence Number=SeqID_80242
MTLWNDSGDPPTLEQMMEQMEYIRRQMAQMEDIRRENWLSPASAPDHASSIK

SEQ ID NO: 171928 - protein, 174 aa, Glycine max
  Coding DNA Sequence Number=SeqID_80243
MEVGHLLLGRPWQYDMKIIYNGLTNEKTLAHLETKFMLHPQKPLQLRRKVIVQQGQTFKKLPFLDNLHIFSFFKEHLLALPYLLSLRLFLRYYEAPNPYDRCEQGVTTNPKRIKLIPECPTPTSIREIWGFHDLTNFYKSVERRSPEFEKPLDLRSNPFQGGRDDAILPPKGIG

SEQ ID NO: 171929 - protein, 351 aa, Glycine max
  Coding DNA Sequence Number=SeqID_80244
  Homolog annotation: Hit_ID=A5BC53; Match level="QueryCoverage=68%, HitCoverage=26%, E-value=3e-09, Identity=23%"; Hit description =Putative uncharacterized protein
  Subcellular localization annotation: CTP_CleavageSite=41; ConfidenceScore=5.68e-01
MAESSKKRKGSSSTTTTAGQRRHGTSDDPPTSNPPSFSSPRSLTLFSFNDQRQRYYSQFSNRVILDPKYLDGEFFDGETFDCYQVFQNSELVEFMSLKLPYYPELVRVFYNNLKIQDGVIFSEVHHIPIIIDQSLFYSLTKLSSQGVSFEGTLVDDWKHVYSNHDARKMVCTDHDDMTGRLLAGSTNLAQASEEDLILLSALQIGRQIDWAHLVRYRMHKALRANAPLPYPHLVTLFLQHFNVPLEDEPFVKVKRYFAIGVGAITSFGYQKDMDGQWVRKQDLPPPIPDERTPSPPPQWDASSSLLTEVLTELRDLRAFVDDRFDAMDSHITRLEDSMSFIRRCFDPSTDY

SEQ ID NO: 171930 - protein, 109 aa, Glycine max
  Coding DNA Sequence Number=SeqID_80245
MINLLEMQRESLGGRWRFRVGGGDFAFKEKFKGLKKVLKVWNIDHFGNVHKKFQEISKEMNILNVKEEGRALIEGELRRRIELQGNFWEALCNHESLMRQKSRARYVTS

SEQ ID NO: 171931 - protein, 279 aa, Glycine max
  Coding DNA Sequence Number=SeqID_80246
MSVASSFLSLGGAYLHGTAWLFWYGNRIGLITEGYQGIWGAASLVKYITTGLGLPKPPLVLGYRGIWGAASLLLFTPLIADFQPALVYHLLQQRAGMHQTGIFPVPTRGIMPPFCRASDKPPWGRQVLQRLGPAWPTRLDGINCSPSMIGKWVHFHVGPVLLKRQPSGVYQMLDLVFKGQAVFGGVARGFPMVCAGCVRERRLVDFPGRYHSHLVGDEGWQEVFVRHWDWDECCPRGKVPYRVGTGAKLGITGRASRGWSRSLGGLPLDGRRRPSLYGC

SEQ ID NO: 171932 - protein, 332 aa, Glycine max
  Coding DNA Sequence Number=SeqID_80247
  Homolog annotation: Hit_ID=A5BJ82; Match level="QueryCoverage=68%, HitCoverage=50%, E-value=5e-50, Identity=47%"; Hit description =Putative uncharacterized protein
  Pfam annotation: Domain name=DUF702; Domain location=127-289; Score =226.7; E_value=5.4e-65; Accession=PF05142.3; Description=Domain of unknown function (DUF702)
  Subcellular localization annotation: CTP_CleavageSite=45; ConfidenceScore=5.06e-01
MSMLGLRDLVLIAQTPSSLHHQHQGQPISENQTHTHTPNLPLPSSAASLSVGFGIFPLLTATPCVPQPHQNNEVQECGGGGANSNTTTTNYWNLKMCQEVNNPPKKGVINVADHDDEKGVMESEENGVYGPDFRVCQDCGNRAKKDCVFRRCRTCCKGRGYDCNTHVKSTWIPSVRRREREITVASGGGVGGNGGCKRPRAVVGSSQNATSHSSNSNATTPKSLATSSFHQDASFKQSLPGHVRAPAVFKCHRVSAIGNGEDEFAYLATVQISGHVFKGFLYDHGVDGKTANVVPCVSELQLGNNCSGKNRECSSAIAIGVANNNAYPASAS

SEQ ID NO: 171933 - protein, 116 aa, Glycine max
  Coding DNA Sequence Number=SeqID_80248
MRDTSLQLIVVSLQLSQLLLMASLHLRNAVLELLESISIVGAKCTYQNLELAHIKVDVAKVVSWTSHVGLRVTFVRRKGGGTCKTKDFDAQLLRVRCSCSCTRADMEGGHMSQNTK

SEQ ID NO: 171934 - protein, 77 aa, Glycine max
  Coding DNA Sequence Number=SeqID_80249
MLFILAPIIDFKLTKIDHTLQQLLHCRACLHVVWQTQAWHYSIECPGVPPWYAHVPLGKEDLISSSRGYYRHMDGQQ

SEQ ID NO: 171935 - protein, 107 aa, Glycine max
  Coding DNA Sequence Number=SeqID_80250
MTQSENSFDSSHSLIQKRSKVKPPENSFVSPFTKYQRGYIYLGLAENKRGYISCGSVLVEGTSTRFKENKGGYIPCGSLLVKGFLQGWKKSQGSQVAWGLEVGTGLC

SEQ ID NO: 171936 - protein, 116 aa, Glycine max
  Coding DNA Sequence Number=SeqID_80251
MALRKLASKRSRKDKAAEGISSAPEDDEYTDFQEEIVRWRWASLVTPMAKFDPDIVLEFYANAWPTEEGVRDMRSWGQECEYGQRRNQSDGFDEEAIAQLLCIPGQDFAQTAAERR

SEQ ID NO: 171937 - protein, 45 aa, Glycine max
  Coding DNA Sequence Number=SeqID_80252
MEDIPKDIHIATTKVPNKYSQVGLPGTKRRQGVRNLGREIGMIQP

SEQ ID NO: 171938 - protein, 49 aa, Glycine max
  Coding DNA Sequence Number=SeqID_80253
MASAITWATWTLIRVRMAYTNWHLDRERSELWLLGKTLLSSRFIQIWVR

SEQ ID NO: 171939 - protein, 175 aa, Glycine max
  Coding DNA Sequence Number=SeqID_80254
MAYNASSKENQNVMNSQEIDVAKSYSIEKSQGTPKLELYNQGEAEREEVTQCVARIEEDLVEIEAQEEIPTKEHGLRGKDEIKGEEKAQQWEEYIQQDIQQESMLQINNFPHQLIVRKQRQGEQKRALSVFLSRITNPSSEMSWHTLPKYMKFMEFLAKRWNYKEDVFFVTFMPP

SEQ ID NO: 171940 - protein, 125 aa, Glycine max
  Coding DNA Sequence Number=SeqID_80255
LGQLMGQLQRKAFCKAYGKIWDLTTVEDFQLIPIVEEFEEILGCLLGGRKPYLFSGFYPSMVRVAKAKALASQGEWAPFIDILMLLIFGVVLFPNGEGLVDLAVIDAFLTFHHIKESPVLAILAD

SEQ ID NO: 171941 - protein, 327 aa, Glycine max
  Coding DNA Sequence Number=SeqID_80256
  Gene Ontology: Mol. function=phenylalanine-tRNA ligase activity; Cellular component=cytoplasm; Biological process=phenylalanyl-tRNA aminoacylation
  Homolog annotation: Hit_ID=A6EKE0; Match level="QueryCoverage=96%, HitCoverage=40%, E-value=1e-111, Identity=64%"; Hit description =Phenylalanyl-tRNA synthetase beta subunit
  Pfam annotation: Domain name=B3_4; Domain location=87-260; Score =342.7; E_value=6.3e-100; Accession=PF03483.8; Description=B34 domain
  Pfam annotation: Domain name=B5; Domain location=245-327; Score=19.5; E_value=5e-05; Accession=PF03484.6; Description=tRNA synthetase B5 domain
  Pfam module annotation: Pfam domain module=B3_4::B5; Domain location =87-260::245-327
LGTSHAGIVELPADVAVGTLVKDHYNIQDDYRYEIGLTPNRADAASHLGVARDIAAHSRTQLLKADVSAFKAGAAEGTAVVVDNAQASPRYSGINISGVQVAESPDWLKEKLNVIGVRPINNIVDVTNYILHDLGQPLHAFDADKIAGNKVLVRLATEGEKFVTLDGVERALSSEDLVIADAEKPMCIAGVFGGAFSGVSAETTNVFLESAYFNAVSVRKTSKRHGLKTDASFRFERGTDPNMTVEALKRAALLIQEIAGGTISSTLKDEYPVEIKPFSFHAIPNDEIKSIIVALGIEVAAETESGLDVLVPAYRVDVTREVDVVEE

SEQ ID NO: 171942 - protein, 75 aa, Glycine max
  Coding DNA Sequence Number=SeqID_80257
VTARPLASKHWRAFSHQYSASSTRVYVPKETFYPSGHADAILLRKGSVTRAMSKRLQEDWAIAAEEGPRVLMNLR

SEQ ID NO: 171943 - protein, 82 aa, Glycine max
  Coding DNA Sequence Number=SeqID_80258
MVMVDPWTWGSLESKVFLAYEFMHGVQIVARDHEVVKSEAMQDTRACWQQWLAKQERDLHLRGRLLEYKYEVKSHIGKEWEI

SEQ ID NO: 171944 - protein, 321 aa, Glycine max
  Coding DNA Sequence Number=SeqID_80259
  Gene Ontology: Mol. function=protein transporter activity; Cellular component=membrane; Biological process=protein secretion
  Homolog annotation: Hit_ID=A4WA96; Match level="QueryCoverage=97%, HitCoverage=87%, E-value=4e-97, Identity=62%"; Hit description =Secretion protein HlyD family protein precursor
  Pfam annotation: Domain name=HlyD; Domain location=19-308; Score =133.0; E_value=8.6e-37; Accession=PF00529.11; Description=HlyD family secretion protein
LWPFTSTIQSTENAYVRGQVTFISPQVSGYLTNVEVVDLQPVRKGQLLMTIDDRIYRQRVHQAQAQLAMKIAAQNNNQQQQKSAEATIVSNKAALENAKAQALKSSLDLKRVENLAADGSLSVRERDAARAANAQAQAQLRQAAAQVAVSQQNLQTTIVNRAALAGDVASAQAALELANIDLDNTRIIAPDSGQLGQLSVRKGTYVTAGTRLTSVVPDNKWVIANLKETQLARVRPGLPVSIRVDALDGKRFDGRVEFISPAAGSEFSAISPDNATGNFVKIAQRIPVRIKILGDDLQQLRPGMSVEVNIDTAAEPHRETP

SEQ ID NO: 171945 - protein, 179 aa, Glycine max
  Coding DNA Sequence Number=SeqID_80260
MEVNMATVVAVSTAIEVDPTHPPGLNQHSFPPYGLPPNYTPPNVSHAPDENVDNSAPIPFESQHPQSGHAQVPQPMGETHEVPRDHTLADFEPHLRYATEGQAFGGVPLPNTLGGPQYRPQPQSLHFAVGRVPPAMVEREKFDHIEERLRVIEGGKNYAFADKVELCLVPDVIIPLKFK

SEQ ID NO: 171946 - protein, 141 aa, Glycine max
  Coding DNA Sequence Number=SeqID_80261
MLGAPSNTLLLMGYFEIVCRDMLGAPSNIAGAPSNLLKGQFCPSFKNIKNFFPLSEAFCLLSSAKNLFSSLLSSAKASFLGGLLLREASPPSSSPQGFSLPFAFEMNFRVEDAGKNSGSLVTVSLPEDFRKKGSSEVVYVY

SEQ ID NO: 171947 - protein, 92 aa, Glycine max
  Coding DNA Sequence Number=SeqID_80262
MRDPLLFITLLCCLAKHLTETCMRVGNSDIYGFLEPQSIHWSRQSQFESENYIKSWMQSSQRNVYLGAYLNGFHCSGHWQMVVILPKEHLVV

SEQ ID NO: 171948 - protein, 25 aa, Glycine max
  Coding DNA Sequence Number=SeqID_80263
MGVKYLDPVKRGSYAIKQWSPDEIR

SEQ ID NO: 171949 - protein, 91 aa, Glycine max
  Coding DNA Sequence Number=SeqID_80264
MSINKVATLYAKWRGGKAPKWAPLEKRSTTTKIEVKPWDWGSPMMKNEGAIKRKPNFAMIMKEVPSNGIFRGEKLAPVWHTGQYICGNIAE

SEQ ID NO: 171950 - protein, 311 aa, Glycine max
  Coding DNA Sequence Number=SeqID_80265
  Gene Ontology: Mol. function=glutamate-1-semialdehyde 2,1-aminomutase activity; Cellular component=cytoplasm; Biological process =tetrapyrrole biosynthetic process
  Homolog annotation: Hit_ID=Q1GXW0; Match level="QueryCoverage=100%, HitCoverage=72%, E-value=1e-121, Identity=69%"; Hit description =Glutamate-1-semialdehyde 2,1-aminomutase
  Pfam annotation: Domain name=Aminotran_3; Domain location=1-251; Score=58.4; E_value=3.9e-18; Accession=PF00202.12; Description =Aminotransferase class-III
GTEATMSAIRVARGFTKRSKIIKFEGCYHGHADALLVKAGSGLLTFGEPSSAGVPPEVAAHTLTLDYNNTQMLKDTFSSIGDEIACVILEPVVGNMNLIVPHQEFLQTLRELCTQHGTVLIFDEVMTGFRVALGGAQALYGITPDMTTLGKVIGGGLPVGAFGGRKDIMSVLAPLGPVYQAGTLSGNPVAVTAGLTTLKLVQAPGFYEKLTAQTTKLMDGFKQAAQAAGVAFSAQSVGGMFGLYFSAQCPSSYAEMMLADKNAFNTFFHSMLDSGIYLGPSAFEAGFVSAAHTDADIAQTVQAATKAFAAL

SEQ ID NO: 171951 - protein, 303 aa, Glycine max
  Coding DNA Sequence Number=SeqID_80266
  Gene Ontology: Mol. function=protein histidine kinase activity; Cellular component=integral to membrane; Biological process=two -component signal transduction system (phosphorelay)
  Homolog annotation: Hit_ID=P0AA94; Match level="QueryCoverage=93%, HitCoverage=49%, E-value=1e-128, Identity=84%"; Hit description =Inner membrane protein ypdA
  Pfam annotation: Domain name=GAF; Domain location=47-168; Score=29.2; E_value=1.5e-05; Accession=PF01590.17; Description=GAF domain
  Pfam annotation: Domain name=His_kinase; Domain location=184-266; Score=140.6; E_value=4.4e-39; Accession=PF06580.4; Description =Histidine kinase
  Pfam module annotation: Pfam domain module=GAF::His_kinase; Domain location=47-168::184-266
MILGASSIGLIVLLVQSVEGEKEAIAARQAKLALEIANKTLPLFRQVNSDSLRKVCAIIRSDIHADAVAITNTKQILAYVGYGEQNYHNGDDGISPTTAQAIASGKIIIKNNDEAHRTKDIHSMLVIPLWEKGEVTGTLKIYYRRAHRITGSLKEMAVGLSQIISTQLEVSRAEQLREMANKAELRALQSKINPHFLFNALNAISSSIRLNPDTARQLVINLSRYLRYNLELNDDEPIDIKKELWQVKDYIAIEQARFGDKLSMIYDIDEDLHFSLPSLLIQRWWRTPSCTVFSPVAAKAWSR

SEQ ID NO: 171952 - protein, 222 aa, Glycine max
  Coding DNA Sequence Number=SeqID_80267
  Gene Ontology: Mol. function=nucleic acid binding; Biological process= RNA-dependent DNA replication
  Homolog annotation: Hit_ID=Q2AA09; Match level="QueryCoverage=65%, HitCoverage=51%, E-value=8e-11, Identity=32%"; Hit description =Retrotransposon gag protein
MERSMIDAASGGALGDMTPAEARNLIEKMASNSQQFSARSDAILIRGVHEVAINSLGETKKLEGKLDALVNLVTQLAMNKKFAPVARLCGLCSSPDHHTDHCPSVQQSEAIEQPEAYAANIYNRPPQPHNRYNPGWRNHPNLRWSNPSQQQQQQQQPYFQNVAGPSRPYVPPPIQQQQPQKQQIVKAPPQPSLEELVRQMTMQNMQFQQETKASIQSLTNQM

SEQ ID NO: 171953 - protein, 50 aa, Glycine max
  Coding DNA Sequence Number=SeqID_80268
NAVSVSTRITPRIKHSSAVDITTAEDNFFRGDSRKTFSTSTHGRSCLPQL

SEQ ID NO: 171954 - protein, 251 aa, Glycine max
  Coding DNA Sequence Number=SeqID_80269
MVRTIGLHQALGKVIGRSLGAKVSGDADEAPQRRRPTTSARRQQTTAPVVEDVENADHRVDEIVLEFYANAWPTEEGVRDMRSWVRGQWIPFDADALSQFLGDPLVLEEGQECEFSQRRNRVNGFDEEAIAQLLCTLGQDFAQTAAGRRVRIMHTNMTTLTQMWMTLLLSNVLPSDHNSNLPLPKCQLVYAILTRMSVHVAQLIVDAIYLFAGMSLTRHPLDPDKSNRAMGFSALITGLCQSFGVPVTSSK

SEQ ID NO: 171955 - protein, 48 aa, Glycine max
  Coding DNA Sequence Number=SeqID_80270
ANSFLLSVLGPPPDLGGGPPMQVQPEEEAIMQLLCIPGQDFTRAAAKK

SEQ ID NO: 171956 - protein, 164 aa, Glycine max
  Coding DNA Sequence Number=SeqID_80271
  Pfam annotation: Domain name=Transposase_24; Domain location=16-139; Score=-7.5; E_value=0.0024; Accession=PF03004.5; Description=Plant transposase (PttaEnSpm family)
MFKDAQNENKRPYWIGDHVWNDLLSHWNAPEYRSKCAQAKKNQSYEKGGCMHTGGSINLQDHVICLSKELGRSVYVDEEEFEARLSQVRYDAASSVGKSQFTPLDPAEEQRLRSRCWVAVAGPKRKVPLYGTGDLAHTYKYGNDNFMQHTQGSSSHAKDATKIN

SEQ ID NO: 171957 - protein, 125 aa, Glycine max
  Coding DNA Sequence Number=SeqID_80272
MEARPMINRSPSHVQLRTPFSLVYGMEATDRHPTSSFGQARSATGRQARLARLGEHPCTRKHKNEGRERRVQLREDEYTDFQEEIARMHWTPLVTLMAKFDPEIVLEFYANAWPTEEGVRDMRSW

SEQ ID NO: 171958 - protein, 38 aa, Glycine max
  Coding DNA Sequence Number=SeqID_80273
GEERHAQKELPRAVISGMDPVKYIFEKPALTGRIARWQ

SEQ ID NO: 171959 - protein, 121 aa, Glycine max
  Coding DNA Sequence Number=SeqID_80274
MGSKIYPKVHENPMAFFSSSSPSLLESSIQYPWGVGLHHKSLCFVGAQNRYWVPLNPKRIKVIHLWPTPPSIRKIWGFHEGMMQSYPPRAFDRRLQEDWTRAAEEGPRVLISLRVDFWPMG

SEQ ID NO: 171960 - protein, 23 aa, Glycine max
  Coding DNA Sequence Number=SeqID_80275
MVIPKFKVPDFDKNLPESILGKT

SEQ ID NO: 171961 - protein, 136 aa, Glycine max
  Coding DNA Sequence Number=SeqID_80276
CFDDNKDDAKGDDKKLKGQSKNEFKMFKIESRTLQDSRGKLNSRIKIQDSRDQGSRLKIQESRKGYSRIKKKLNQDKYEKLNQDQRVFTLWVHLLGLLIENKRGYISCGSILVEATSTRFKENKGGYIPCGSLLVK

SEQ ID NO: 171962 - protein, 163 aa, Glycine max
  Coding DNA Sequence Number=SeqID_80277
  Gene Ontology: Mol. function=hydrogen ion transmembrane transporter activity; Cellular component=integral to membrane; Biological process=proton transport
  Homolog annotation: Hit_ID=A2Q1I0; Match level="QueryCoverage=30%, HitCoverage=24%, E-value=4e-13, Identity=75%"; Hit description =Nuclear protein SET, putative
MKKGKRHSHSGEKKKNKRYREQNLDVEIIVATQNSEDGVMYNPHCKAEEIQGLDGHRDSDTGAAIKPCRSKKDKKKRKEVQDSPEKEGEGCNQTVMGDTIGDPLKDTSGPSLNILIKLMAVESLLAGPERERQLSDTDVQSAVWEVCGDSGALQLLVDLLHVK

SEQ ID NO: 171963 - protein, 68 aa, Glycine max
  Coding DNA Sequence Number=SeqID_80278
MPIWLCLNPCAPHYVHPYVHAYPCTLSVTCCYHGGPWRLPLYPVDGYWRGNNHKGKMRKSRRNTYGDF

SEQ ID NO: 171964 - protein, 230 aa, Glycine max
  Coding DNA Sequence Number=SeqID_80279
MRASPGAAVKLCLGDLLVMGSNPGNSPLCICKGKAAYNIPPPYLRIAKSLWAIDNTYMMNSVITVLCFNGRVYEDNDGVIFEGSKKTIQIKRGISFNTLKKKIGDKENIVLQICDDEDVETMLESFKQQQEMSVLELYIEKDVAGGSMFHSANSLTSCGNYVSNDYTQPPTNMSNLNLDEDDDHDDDDYLVSNSYVEESLDEDDNVDGISDTDNEVSDMIPPVRIVHPAE

SEQ ID NO: 171965 - protein, 436 aa, Glycine max
  Coding DNA Sequence Number=SeqID_80280
  Gene Ontology: Mol. function=nucleotide binding; Cellular component =intrinsic to membrane; Biological process=defense response
  Homolog annotation: Hit_ID=Q2YE87; Match level="QueryCoverage=90%, HitCoverage=47%, E-value=1e-90, Identity=57%"; Hit description=NBS -LRR type disease resistance protein Rps1-k-2
  Pfam annotation: Domain name=NB-ARC; Domain location=44-298; Score= -52.4; E_value=6.2e-07; Accession=PF00931.13; Description=NB-ARC domain
MARAFGNFCLKDYGVASVPDVSYRNLTNEDKFVVLASDGIMAEAVGGAFLSAFLDVVFDKLVTDEVVDFIRGKKLDLNLLENLKTTLRLVGAVLDDAEKKQIKLSSVNQWLIELKDVLYEADDLLDEISTKSATQKKGLPLQVMAGESNESWNAQPTTSLEDGYGMYGRDTDKEAIMRLLLEDSSNVLPLSKLSNEDCWLVFANHAFPSSGSARSLGGMLRRKHAIRDWNNILESDIWELPESQCKIIPALRISYHYLPPHLKRCFVYCSLYPKDYEFQKDDLILLWMAEDLLKLPNKGKSLEVGYEYFDDLVSRSFFQHSRSNLTWDNCFVMHDLVHDLALSLGGEFYFRSEDLRKETKIGIKTRHLSVTKFSDPISKIEVFDKLQFLRTFMAIYFKDSPFNKEKEPGIVVLKLKCLRVLSFCGFASLDVLPDSI

SEQ ID NO: 171966 - protein, 467 aa, Glycine max
  Coding DNA Sequence Number=SeqID_80281
  Gene Ontology: Mol. function=nucleotide binding; Cellular component =intrinsic to membrane; Biological process=defense response
  Homolog annotation: Hit_ID=Q2YE88; Match level="QueryCoverage=99%, HitCoverage=43%, E-value=1e-156, Identity=57%"; Hit description=NBS -LRR type disease resistance protein Rps1-k-1
  Pfam annotation: Domain name=LRR_1; Domain location=149-170; Score =7.2; E_value=14; Accession=PF00560.24; Description=Leucine Rich Repeat
  Pfam annotation: Domain name=LRR_1; Domain location=280-301; Score =7.0; E_value=16; Accession=PF00560.24; Description=Leucine Rich Repeat
  Pfam annotation: Domain name=LRR_1; Domain location=303-325; Score =1.3; E_value=1.8e+02; Accession=PF00560.24; Description=Leucine Rich Repeat
  Pfam annotation: Domain name=LRR_1; Domain location=362-382; Score =5.4; E_value=31; Accession=PF00560.24; Description=Leucine Rich Repeat
  Pfam annotation: Domain name=LRR_1; Domain location=384-406; Score =3.5; E_value=68; Accession=PF00560.24; Description=Leucine Rich Repeat
  Pfam module annotation: Pfam domain module=LRR_1::LRR_1::LRR_1::LRR _1::LRR_1; Domain location=149-170::280-301::303-325::362-382::384-406
KDLILLWAAEDLLKLPNRGKALEVGYEYFDDLVSRSFFHRSSNLTWGNYFVMHDLVHDLALYLGGEFYFRSEELGKETKIGIKTRHLSVTEFSDPISDIEVFDRLQFLRTLLAIDFKDSSFNKGKAPGIVASKLKMLTRLPTDMQNLVNLCHLHIDGTEIGEMPRGMGMLSHLQHLDFFIVGNNKENGIKELGTLSNLHGSLSIRNLENVTRSNEALEARMMDKKHINHLSLEWSNGTDFQTQLDVLCKLKPHPGLESLTIGGYNGTIFPDWVGNFSYHNMTSLSLNGCNNCCVLPSLGQLPSLKQLYISRLKSVKTVDAGFYKNEDCPSSVTPFSSLETLYIGHMCCWELWSIPESDAFPLLKSLTIEDCPKLRGDLPNHLPALETLNITRCQLLVSSLPRAPTLNILVIWKSNNVSLHVFPLLLEWIDVEGSPMVESMIEAISSIEPTCLQRLRLRDCSSAISFP

SEQ ID NO: 171967 - protein, 514 aa, Glycine max
  Coding DNA Sequence Number=SeqID_80282
  Gene Ontology: Mol. function=methyltransferase activity; Biological process=metabolic process
  Homolog annotation: Hit_ID=A7QFG7; Match level="QueryCoverage=100%, HitCoverage=100%, E-value=1e-172, Identity=59%"; Hit description =Chromosome chr8 scaffold_88, whole genome shotgun sequence
  Pfam annotation: Domain name=Methyltransf_11; Domain location=110 -193; Score=31.9; E_value=2.3e-06; Accession=PF08241.3; Description =Methyltransferase domain
MDPTVAKPGFLRNVLVRLLLFGVFIVVVRFAYVITLAGESCTVGDFCFFSPSINLAIAGTRSGALAARGGAAGPPERYASKDWINGVRFYSSAFQDMISGGFLSPAAKALCVETPTGRDVLALREIGVIDAVGISKKASPPLVKSGEARRIPFPDGSFDFVFAGDGALEKSPRPAEFAAEISRTLKPEGFAAFHVKANDTYSYNSFVDLWNFCCNVVKINDMLGFDSSIPHIREIVVKKVRHTIDSESNSNSNSNGKECSVPEYKEKLVRNAEALIEEEPLKPWLTLKKNVKNIKYLSSMVDISFKDRYVYVDVGARSYGSSIGSWFRKQYPKQNKTFHVYAIEADKTFHQEYETKKGVTLLPYAAWVRNESLVFEINRDPGEKEKEKEKEKVKGKGRGMGRIQPLKSSGGFDGGEVEKIPGFDFADWLKNTVSENDFVVMKMDVEGTEFDLIPRLFETGAICLVDEIFLECHYNRWQRCCPGQRSPKYEKTYDQCLQLFTSLRQSGVLVHQWF

SEQ ID NO: 171968 - protein, 31 aa, Glycine max
  Coding DNA Sequence Number=SeqID_80283
MSYARMVFDEIPDPKLMLSQGHVDVGVTNLV

SEQ ID NO: 171969 - protein, 487 aa, Glycine max
  Coding DNA Sequence Number=SeqID_80284
  Gene Ontology: Mol. function=sequence-specific DNA binding; Cellular component=nucleus; Biological process=regulation of transcription, DNA-dependent
  Homolog annotation: Hit_ID=A7QFG9; Match level="QueryCoverage=70%, HitCoverage=87%, E-value=7e-99, Identity=53%"; Hit description =Chromosome chr8 scaffold_88, whole genome shotgun sequence
  Pfam annotation: Domain name=WRKY; Domain location=206-264; Score =139.0; E_value=1.3e-38; Accession=PF03106.6; Description=WRKY DNA -binding domain
  Pfam annotation: Domain name=WRKY; Domain location=355-403; Score =56.3; E_value=1e-13; Accession=PF03106.6; Description=WRKY DNA -binding domain
  Pfam module annotation: Pfam domain module=WRKY::WRKY; Domain location=206-264::355-403
  Subcellular localization annotation: CTP_CleavageSite=34; ConfidenceScore=5.13e-01
MSFSFTDLLSTNNNNSLNMDDDPFGLEFANNFKSASLPLSPSSIYPSSYAEFPPGFVPTSQSLNSHHFFSSQIVPASYTTEQSSSMSYNMRNTSTEGQQGNKEEERNYSDLSFLTKTNHVPLFQSSTTMFQVEPLKKQDTMISSEAAKQTDFSSERTETKPEYPSTQGFSAALASIKPEIQSNSAPGSVHFNSTYAPKSIREQKRSEDGYNWRKYGEKQVKGSENPRSYYKCTHPSCPTKKKVERSLEGHITEIVYKGSHNHPKPLGRKNGSQSIHQTSSSCTNSGISDQSVGEEDLEQTSQTSYSGGGDDDLGNEAKRWKGENENDGHSYSSAGSRTVKEPRVVVQTTSEIDILDDGYRWRKYGQKVVKGNPNPRSYYKCVAPGLSRKHIHDVPLGRGNSSYSMNRTSLNNNTNTSTSNVTAPAPIRPSAVTNYSNSASFTNSLHDTKPPTSASQEPFPMDVLLSPGSIGFAANDLFLQSFLSKNF

SEQ ID NO: 171970 - protein, 182 aa, Glycine max
  Coding DNA Sequence Number=SeqID_80285
  Gene Ontology: Mol. function=nucleotide binding; Cellular component =intrinsic to membrane; Biological process=defense response
  Homolog annotation: Hit_ID=Q2YE88; Match level="QueryCoverage=96%, HitCoverage=35%, E-value=2e-26, Identity=35%"; Hit description=NBS -LRR type disease resistance protein Rps1-k-1
MPRGMGMLSHLQHLDFFIVGKHKENGIKELGTLSNLHEVEGSPMVESMVEAITSIEPTCLEHLTLNNCSSAISFPGSESFKSLNYFKITGCPNIASFPREGLPAPNLTYFAVKYCNKLKSLPDEMNNLLPKLEYLQVKHCPEMESFPERADLPGQKEKETRVWSDDGRVFQIRRVGNNEKLN

SEQ ID NO: 171971 - protein, 193 aa, Glycine max
  Coding DNA Sequence Number=SeqID_80286
MKKQKLSEPQNDTTNPFEVLSEELMFVILDFLQTTSLDKKSFSLTSPSFASPATCGTPARARCPLPERNGIGSFLVSARGRRRAGARRWRVRGDAAANGPVAVAAVHGDRAAKPRRTVRAPGGAGLVERDGAEGRRRRRGGACAELAEAVAGEVQDGDGYGDWVYCGGVQEAEAALLEVVCGNWGFGCGFGCD

SEQ ID NO: 171972 - protein, 239 aa, Glycine max
  Coding DNA Sequence Number=SeqID_80287
  Gene Ontology: Mol. function=methyltransferase activity; Cellular component=cytoplasm; Biological process=fatty acid biosynthetic process
  Homolog annotation: Hit_ID=Q2HRW2; Match level="QueryCoverage=75%, HitCoverage=53%, E-value=2e-63, Identity=69%"; Hit description=Beta -ketoacyl synthase; SAM dependent carboxyl methyltransferase
  Pfam annotation: Domain name=Methyltransf_7; Domain location=2-238; Score=93.9; E_value=5.2e-25; Accession=PF03492.6; Description=SAM dependent carboxyl methyltransferase
MATERVLHMKDGLRETSYAKNSLLQRKVAMKVKIILEENVKRMMSNINIESCLQALLSVYEAYFKQFEKDFKLFLKSRSEELRSGGIMVLTFIGRDKTRKINNPAEVIGMVLNGMVQEGLVEEEKLDFFDLPIYGPTAEEVGQVIEREGSFTLQTLKTIKIGWDANLEEEVDDGILDSKIRGEFIAKSIRAVLEPILSAEFSEDIMDELFSRYANLVAQLIEVETLEYTNVVVTLTKHS

SEQ ID NO: 171973 - protein, 222 aa, Glycine max
  Coding DNA Sequence Number=SeqID_80288
  Gene Ontology: Mol. function=nucleotide binding; Cellular component =intrinsic to membrane; Biological process=defense response
  Homolog annotation: Hit_ID=Q2YE87; Match level="QueryCoverage=81%, HitCoverage=14%, E-value=9e-71, Identity=74%"; Hit description=NBS -LRR type disease resistance protein Rps1-k-2
  Pfam annotation: Domain name=LRR_1; Domain location=109-132; Score =5.2; E_value=34; Accession=PF00560.24; Description=Leucine Rich Repeat
  Pfam annotation: Domain name=LRR_1; Domain location=133-155; Score =2.3; E_value=1.1e+02; Accession=PF00560.24; Description=Leucine Rich Repeat
  Pfam annotation: Domain name=LRR_1; Domain location=158-179; Score =13.4; E_value=0.84; Accession=PF00560.24; Description=Leucine Rich Repeat
  Pfam annotation: Domain name=LRR_1; Domain location=16-43; Score=4.4; E_value=48; Accession=PF00560.24; Description=Leucine Rich Repeat
  Pfam annotation: Domain name=LRR_1; Domain location=61-85; Score=4.1; E_value=54; Accession=PF00560.24; Description=Leucine Rich Repeat
  Pfam module annotation: Pfam domain module=LRR_1::LRR_1::LRR_1::LRR _1::LRR_1; Domain location=109-132::133-155::158-179::16-43::61-85
MVESMVEAISSIETTCLQHLKLRDCSSAISFPGGRLPASLKTLVISNLKNLEFPTQHKHQLLESLFLYNSCDSLKSLPLVTFPNLKSLPIENCEHMESLLVSGAESFKSLCSLRISQCPNFVSFWREGLPAPNLTDFEVLHCDKLKSLPDKMSTLLPKLEYLDISNCPEIESFPEGGDCPGLAMARAFGNFCLKDYGVASVPDVSYRNLTNEDKFVVLASDG

SEQ ID NO: 171974 - protein, 130 aa, Glycine max
  Coding DNA Sequence Number=SeqID_80289
MGLQAINEDIELNRLAEPVGGGVFQSKPWKQSRDSLSYSSGNWWNEEISTFPLAVLDFGKYFFKNFSTTSSHVRKLFPLNECNHLFASPAKEKENRLRWMASSGTPTIFIVLQISIYVARWAYRSSLGSP

SEQ ID NO: 171975 - protein, 98 aa, Glycine max
  Coding DNA Sequence Number=SeqID_80290
MIKSNSIVEGNSEDENVGNLAYQSYSFMAKEEKVKTADDSLNEANWLSEMHPHGEASSSLSGWETLEEDKSEICALNTQPARPVTMLSLLALSAPMLA

SEQ ID NO: 171976 - protein, 92 aa, Glycine max
  Coding DNA Sequence Number=SeqID_80291
  Gene Ontology: Mol. function=catalytic activity
  Homolog annotation: Hit_ID=Q9M006; Match level="QueryCoverage=50%, HitCoverage=14%, E-value=3e-13, Identity=69%"; Hit description =Putative uncharacterized protein F7A7_220
MVMGVIQIMEKKNIAFTLNCSSSPLFSGGIDPRTFLPQCHSGEAMRIFAVEEDPTVNRVWMPKRDCPGLAMARAFRNFCLKDYGVASVPDVS

SEQ ID NO: 171977 - protein, 74 aa, Glycine max
  Coding DNA Sequence Number=SeqID_80292
MTRKEWWRGPLRIEQTQQPLAGTFKINPKELSWMCKGRRGVQQRRCVQMAMAAMEGGHGLSMKAPNCYVQGKTS

SEQ ID NO: 171978 - protein, 93 aa, Glycine max
  Coding DNA Sequence Number=SeqID_80293
MGFVAGSVSWSIPWISMNKGMRGEGEEGNEVVLYTSSLVFDSIFTWFLAPKSSMVVLGGAVCVLVVGWRWGYSGSGGVGGVVLPSWIFGRCKK

SEQ ID NO: 171979 - protein, 894 aa, Glycine max
  Coding DNA Sequence Number=SeqID_80294
  Gene Ontology: Mol. function=nucleotide binding; Cellular component =intrinsic to membrane; Biological process=defense response
  Homolog annotation: Hit_ID=Q2YE87; Match level="QueryCoverage=99%, HitCoverage=76%, E-value=0.0, Identity=60%"; Hit description=NBS-LRR type disease resistance protein Rps1-k-2
  Pfam annotation: Domain name=LRR_1; Domain location=537-558; Score =16.5; E_value=0.1; Accession=PF00560.24; Description=Leucine Rich Repeat
  Pfam annotation: Domain name=LRR_1; Domain location=560-582; Score =13.8; E_value=0.65; Accession=PF00560.24; Description=Leucine Rich Repeat
  Pfam annotation: Domain name=LRR_1; Domain location=584-605; Score =6.3; E_value=21; Accession=PF00560.24; Description=Leucine Rich Repeat
  Pfam annotation: Domain name=LRR_1; Domain location=715-736; Score =6.5; E_value=19; Accession=PF00560.24; Description=Leucine Rich Repeat
  Pfam annotation: Domain name=LRR_1; Domain location=796-819; Score =8.9; E_value=6.9; Accession=PF00560.24; Description=Leucine Rich Repeat
  Pfam annotation: Domain name=NB-ARC; Domain location=142-395; Score =127.8; E_value=3.1e-35; Accession=PF00931.13; Description=NB-ARC domain
  Pfam module annotation: Pfam domain module=LRR_1::LRR_1::LRR_1::LRR _1::LRR_1::NB-ARC; Domain location=537-558::560-582::584-605::715 -736::796-819::142-395
MAEAVGGAFLSAFLDVVFDKLSTDEVVDFIRGKKLDLNLLENLKTTLRVVGAVLDDAEKKQIKLSSVNQWLIEVKDALYEADDLLDEISTKSATQKKVSKVLSRFTDRKMASKLEKIVDKLDKVLGGMKGLPLQVMAGEMNESWNTQPTTSLEDGYGMYGRDTDKEGIMKLLLSDDSSDGVLVSVIAIVGMGGVGKTTLARSVFNNDNLKQMFDLNAWDYENWSNLTKPFLHGKRGSKILLTTRNANVVNVVPYHIVQVYPLSKLSNEDCWLVFANHAFPPSESRGEDRRALEEIGREIVKKCNGLPLAARSLGGMLRRKHAIRDWNNILESDIWELPESQCKIIPALRISYQYLPPHLKRCFVYCSLYPKDHEFQKKNLILLWMAEDLLKLPNRGKALEVGYEYFDDLVSRSFFQRSSNRTWGNYFVMHDLVHDLALYLGGEFYFRSEELGKETKIGIKTRHLSVTKFSDPISDIEVFDKLQFLRTLLAIDFKDSSFNKEKAPGIVASKLKCLRVLSFCDFASLDVLPDSIGKLIHLRYLNLSFTRIRTLPESLCNLYNLQTLVLSRCRVLTRLPTDMQNLINLCHLHIDGTDIREMPRGMGMLRHLQHLDFFTVGKHKENGIKELGTLSNLHGSLSIRNLENVTRSNEALEARMLDKKHINHLSLEWSNGTDFQTELDVLCKLKPHQGVESLTIRGYNGTIFPDWVGNFSYHNMTSLSLNDCNNCCVLPSLGQLPSLKKLYISILKSVKTVDAGFYKNEDCPSVTPFSSLEFLSIDEMCCWELWSIPESDAFPLLKSLTIEDCPKLRGDLPNHLPALETLRIKNCELLVSSLPRAPILKVLEICKSNNVSLHVFPLLLESIEVEGSPMVESMIEAITSIEPTCLQHLTLRDC

SEQ ID NO: 171980 - protein, 112 aa, Glycine max
  Coding DNA Sequence Number=SeqID_80295
MGILLNYMVLNFSTFTQCETSPHTCTPTHLPFKCESLPHGSLPLELTSIAILTTCSTCTTATSAGYPAPPSYSSEPVTSIAILATYGTYTATACCAVPSYLFESVTKSNLHL

SEQ ID NO: 171981 - protein, 149 aa, Glycine max
  Coding DNA Sequence Number=SeqID_80296
  Subcellular localization annotation: CTP_CleavageSite=21; ConfidenceScore=5.54e-01
MASPPASPPPPPPSDASASPFAMMRTRKASRLRSLSTGPPGAERPVVHVDPATGKADGPHRKKLRIYLGIVAHDKVDVTQNLKTQRLLTVGRKGSSFRLRWRQFKSNLMRKWALAADQDGVDDTVCEKYDISKEKWSQFCQTRRDPSWE

SEQ ID NO: 171982 - protein, 151 aa, Glycine max
  Coding DNA Sequence Number=SeqID_80297
MPALYVWLVSHLFLQESRPTCPLQGHRLCTEKGKAKWEQHLASVTTWLPHERSAIGGKHHAFHHTGFQGPQHEGASRSPQGIGCGAKEGKELRGSSNGIIGGYHKWLRVRTQGLDWLPKLRAVRKEEAEALEESEEVQALKAELEQARAVK

SEQ ID NO: 171983 - protein, 96 aa, Glycine max
  Coding DNA Sequence Number=SeqID_80298
MKDARTALGNQFVGLQTQWLRMHERQSSHGAPNKMVEDARTALGNQFVWLRTQWARQSNRRVSDSMVDDAFPGAPNKMADDSLTDLGTPFEGVRTQ

SEQ ID NO: 171984 - protein, 51 aa, Glycine max
  Coding DNA Sequence Number=SeqID_80299
MLTSLGKVQVTMASPHANGLTGHDSKKWGSRQKQGFCSYVSSICDEELRPT

SEQ ID NO: 171985 - protein, 173 aa, Glycine max
  Coding DNA Sequence Number=SeqID_80300
  Homolog annotation: Hit_ID=Q5QJQ3; Match level="QueryCoverage=60%, HitCoverage=82%, E-value=2e-57, Identity=100%"; Hit description =Putative uncharacterized protein
VDSRGSPLGRSAAASGISSLKGGSAPLTSITKIDAQVRGGETRQDYKDTRRFPLEAPSCALLFRPCRLPDTCPPFSLREAWRFLIAHAVGISVRCRSFAPSWAVCTNPPFSPTAAPYPVTIVLSPTRISRARYVGGATEFLKWWPNYGYTRRTVFGICALLKPVTFGKRVGSS

SEQ ID NO: 171986 - protein, 240 aa, Glycine max
  Coding DNA Sequence Number=SeqID_80301
DPTLHVLNFRGLHVLAFTGLHVLAFRGQHVLAFRGLHVLVFRGLHALALRGLHALVFRGLHILAFKRLHALAFRGLRVLTFIPGPPPDLGGGPTVRAHLEGGYCAAIMHIGARFHPCRCKETSADHAHQHDHSYTDMDGCPSPLARSCHRDIGITPARHLVEPEKSNKVLGFQSLITGLCQFYGVPVAPNKGETPQQSGDGRQQAIDTPSPPPEPLSSSTKAEALPMTRDRLAGDQVQSQ

SEQ ID NO: 171987 - protein, 98 aa, Glycine max
  Coding DNA Sequence Number=SeqID_80302
  Gene Ontology: Mol. function=transcription factor activity; Cellular component=intracellular; Biological process=regulation of transcription, DNA-dependent
  Homolog annotation: Hit_ID=A6TBR9; Match level="QueryCoverage=92%, HitCoverage=40%, E-value=4e-23, Identity=57%"; Hit description =Putative DEOR-type transcriptional regulator
  Pfam annotation: Domain name=HTH_DeoR; Domain location=3-42; Score =24.9; E_value=0.00013; Accession=PF08220.3; Description=DeoR-like helix-turn-helix domain
MSGELSQRFGISEDSIRRDLRELAAEGLLQRVHGGALPVSAALASFEKRKNVQMSSKTVCGAKGGEADSTRAELVQLLPADLAFTAITHSPRYCGCAG

SEQ ID NO: 171988 - protein, 103 aa, Glycine max
  Coding DNA Sequence Number=SeqID_80303
  Homolog annotation: Hit_ID=A4WA28; Match level="QueryCoverage=100%, HitCoverage=100%, E-value=2e-49, Identity=86%"; Hit description =Putative uncharacterized protein
  Pfam annotation: Domain name=ABM; Domain location=10-75; Score=16.0; E_value=0.0049; Accession=PF03992.7; Description=Antibiotic biosynthesis monooxygenase
MIVRTWHGCVPLKHAEDFAKHLEKTGVEHSRSIAGNIGAYVRRETQGDWEHFFLATYWKDLQSVKTFAGENYHVAVTYPDDEQFELLSDPYVFQHTVEAVLPL

SEQ ID NO: 171989 - protein, 104 aa, Glycine max
  Coding DNA Sequence Number=SeqID_80304
MWAFHKGLQIDWAHLIRHHMHKALRLNAPLPYPHLVTLFLQHFNIPLDSEPYVPIKRSFLIGASVIASFDMCFNGMESRITKVEEDVSYIRSRFDLPPPPPPSS

SEQ ID NO: 171990 - protein, 54 aa, Glycine max
  Coding DNA Sequence Number=SeqID_80305
MVLNGANCKDWKKNMQIVLGCMDLDLALRIEKLFSPTVPLNKGTLMRSGITQIA

SEQ ID NO: 171991 - protein, 110 aa, Glycine max
  Coding DNA Sequence Number=SeqID_80306
MGVADVPQCAPFSSYRVRERMVRGGWESWVCFGSRTNSGSSRHCFTQFGVLLSLIALKVVGPFLLDSNSSRYGTNPPFQFPIWQLTNKETKRQAITKDKKNEMKAKPIEF

SEQ ID NO: 171992 - protein, 193 aa, Glycine max
  Coding DNA Sequence Number=SeqID_80307
  Pfam annotation: Domain name=Transposase_23; Domain location=80-145; Score=-17.0; E_value=0.087; Accession=PF03017.5; Description =TNP1ENSPM transposase
MAPEELEQLTQQIRDQLEESITEKVTWQLMLSFSQMQSQLQSQIQSQGLALHPKSEVGPSAARVSIKGSCVDPSVADPNTGDSEKCELYIIENYSRLVALGRVYEGSTTIHNIPLLHGQVKVGVEEVKDAEAPIPVPTDEAAVSPAKPPDRLDHKVDDPLYLMTLTIPQLFLKSLQVMWDATVFGVFNEDFSL

SEQ ID NO: 171993 - protein, 77 aa, Glycine max
  Coding DNA Sequence Number=SeqID_80308
  Homolog annotation: Hit_ID=Q32703; Match level="QueryCoverage=48%, HitCoverage=88%, E-value=5e-07, Identity=72%"; Hit description =Putative uncharacterized protein
MPFFVHGSIFWCPRRRGTTPIHPELGGYSGEQISSGDDGVGPVAQRIRARGYEPRCRGFESLLAPQPAKKGKDFSLW

SEQ ID NO: 171994 - protein, 61 aa, Glycine max
  Coding DNA Sequence Number=SeqID_80309
MSNAINHHRHLEGPSSLLENLYVFIITDPGVVIALLEDPTSICVCHWLSDPPGIKDSGGKN

SEQ ID NO: 171995 - protein, 183 aa, Glycine max
  Coding DNA Sequence Number=SeqID_80310
  Gene Ontology: Biological process=DNA replication initiation
  Homolog annotation: Hit_ID=P03689; Match level="QueryCoverage=31%, HitCoverage=24%, E-value=2e-26, Identity=100%"; Hit description =Replication protein P
  Pfam annotation: Domain name=Phage_lambda_P; Domain location=1-172; Score=0.2; E_value=6.4e-06; Accession=PF06992.2; Description =Replication protein P
MEQVNAGMRVARRQNRPFLPSPGQFVAWCREEASVTAGLPNVSELVDMVYEYCRKRGSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 171996 - protein, 109 aa, Glycine max
  Coding DNA Sequence Number=SeqID_80311
  Gene Ontology: Mol. function=nucleic acid binding; Biological process= DNA integration
  Homolog annotation: Hit_ID=A5B5H1; Match level="QueryCoverage=86%, HitCoverage=23%, E-value=1e-14, Identity=42%"; Hit description =Putative uncharacterized protein
MAIIDITGSNNNYLNKPFKFEGYHFKCWKQKMMFSLTMRKVVYVLNTDIPVIPEDVEKEVKDKMTMELALWNENDYLCKNFILNGLAGDLYDYYSPYKSAKLVWLALEQ

SEQ ID NO: 171997 - protein, 175 aa, Glycine max
  Coding DNA Sequence Number=SeqID_80312
VEGVTVAAFLAKIESGHIHLSSRDFLCWKANPNGLYSTKSTYKVLQEARNNANEDRASRIIWSLKIPPRASAFSWRLFNNRLAATRFLEDTTKIHIHPHSVDCWKRRAEPNGQYTTRGAYLLMQGEATEENSDGVFTELWKLQIPAKATIFAWRLVKNKLPTKVNLRRRQIQLKG

SEQ ID NO: 171998 - protein, 52 aa, Glycine max
  Coding DNA Sequence Number=SeqID_80313
MSRNFTDCATMLSIDFRHVMELHGFPNDGCQVPRSGQTRVASQQTDGPRTKL

SEQ ID NO: 171999 - protein, 89 aa, Glycine max
  Coding DNA Sequence Number=SeqID_80314
  Homolog annotation: Hit_ID=A5C070; Match level="QueryCoverage=68%, HitCoverage=6%, E-value=6e-07, Identity=39%"; Hit description =Putative uncharacterized protein
MLGDLKVATQGSDPDAYVDWEMKIQHAFSYNDYPEEQKGYAKEDKEMEMALVRANIEEDTKAVHDGFTNKISFQHHDQKIILKPQSLKE

SEQ ID NO: 172000 - protein, 165 aa, Glycine max
  Coding DNA Sequence Number=SeqID_80315
  Homolog annotation: Hit_ID=A5AIK9; Match level="QueryCoverage=75%, HitCoverage=8%, E-value=5e-11, Identity=33%"; Hit description =Putative uncharacterized protein
MIRGNPGDLQSFDPEIDRTFHRLVRHSVHFGHYVHFEHSEHSVEGDSEYSDFEHSTTNFHTENMAQPPPHERTLREMAAPDFTYESLCIQYPDEGVPCVLKIGLIHLLPKFHGLAGEDPLKHLKEFHIVCSTMKPPNVQEDHIFLKDFPHSLEGVAKDWLYYLLP

SEQ ID NO: 172001 - protein, 39 aa, Glycine max
  Coding DNA Sequence Number=SeqID_80316
MFAYSPFAKRKPRAKRIFGHVLSREPLVLSAQPLHLRLI

SEQ ID NO: 172002 - protein, 36 aa, Glycine max
  Coding DNA Sequence Number=SeqID_80317
ISRAHRRPAYKSQVFINKETEAATEPHRIGKEREEG

SEQ ID NO: 172003 - protein, 786 aa, Glycine max
  Coding DNA Sequence Number=SeqID_80318
  Gene Ontology: Mol. function=protein serine/threonine kinase activity; Cellular component=plasma membrane; Biological process=two- component signal transduction system (phosphorelay)
  Homolog annotation: Hit_ID=Q5DW44; Match level="QueryCoverage=93%, HitCoverage=70%, E-value=0.0, Identity=80%"; Hit description =Phototropin
  Pfam annotation: Domain name=Pkinase; Domain location=477-769; Score =193.9; E_value=4.1e-55; Accession=PF00069.16; Description=Protein kinase domain
  Pfam annotation: Domain name=Pkinase_Tyr; Domain location=477-752; Score=-53.6; E_value=4e-09; Accession=PF07714.8; Description=Protein tyrosine kinase
  Pfam module annotation: Pfam domain module=Pkinase::Pkinase_Tyr; Domain location=477-769::477-752
MGYGGRMQVEVSKHTEGAKEKMLRPNGLPESLIRYDARQKEKANSTVSELLLAVRRPRALSESAGRPMIKKSASGDDAQDKPPEKSSRRKSESVASFRRKSHAGDRSSMERITELPEKKHKSSRRRSFMGFIRKSQSNFGSFNDEAVVENSSESSDEDDERPESFDGKVQKKEKRKGLDLATTLERIEKNFVITDPRLPDNPIIFASDSFLELTEYSREEILGRNCRCFQLYLRLHLPDYECFHEGSTEKFYKKECNCCIQNTYKANTENLRKLNSKIITRQLPKTDIPGYDLEGVAENQWFLQGPETDPATVRKIREAIDNQTDVTVQLINYTKSGKKFWNLFHLQPMRDQKGEVQYFIGVQLDGSQHVEPLHNRIADDTAKEGEQLVKDTAENVDDALRELPDANMVMSPDYQFPLKSFCIQFFSQSFGYLQKPEDLWMNHSKVVHPKPHRRDEAAWKAIQQILNSGEQIGLNHFRPVKPLGSGDTGSVYLVELGETGHYFAMKAMEKGVMLNRNKVHRACTEREILDMLDHPFLPALYASFQTKTHVCLITDYCSGGELFLLLDRQPAKVLREDAVRFYAAEVVVALEYLHCQGRFKFITHTHGIIYRDLKPENVLLQSSGHVSLTDFDLSCLTSCKPQLLVPVINEKKKAQKGPHAPIFMAEPMRASNSFVGTEEYIAPEIITGSGHTSAVDWWALGILLYEMFYGYTPFRGKTRQRTFTNILHKDLKFPKSKQIVTTITSSTLLLNFGTANSKLLSQVFKSGFWKCLGQNVNTLILYFAVQ

SEQ ID NO: 172004 - protein, 103 aa, Glycine max
  Coding DNA Sequence Number=SeqID_80319
  Subcellular localization annotation: CTP_CleavageSite=70; ConfidenceScore=5.05e-01
MEMKNNEKCAQQLSNSNFRHRWQQWWKKQNAKKKRTLKKKQTHSPNHGTTTMRRRNTKNNEEAETRRTVKKMESRRRRRLKKQTNEEAAESEEEEAELRGRRS

SEQ ID NO: 172005 - protein, 183 aa, Glycine max
  Coding DNA Sequence Number=SeqID_80320
  Homolog annotation: Hit_ID=A7NZ84; Match level="QueryCoverage=50%, HitCoverage=19%, E-value=2e-26, Identity=63%"; Hit description =Chromosome chr6 scaffold_3, whole genome shotgun sequence
  Pfam annotation: Domain name=Ank; Domain location=104-140; Score =22.5; E_value=0.0015; Accession=PF00023.21; Description=Ankyrin repeat
MEESTEKLFLKEKALSTRGSGNRIARGCPTKATLKSQCFLPTTTQQVPMDTPNAQPQAASASTPRKKMTKQLTARAGNMTVLKDTVGGTEEGELRVLLTKQNHAGETVLYVAAEYGYVDMVRELIQYYDLAGAGIKARNGFDALHIAAKQGDLGMSSMWFCRLLFFCGVILGGNLCCVFVEMP

SEQ ID NO: 172006 - protein, 62 aa, Glycine max
  Coding DNA Sequence Number=SeqID_80321
MDHFKEDFNEDYKFVENETFIKFLFVIVEEISFQALRDGLSYHEYMDINLELHLYEFDCSLH

SEQ ID NO: 172007 - protein, 170 aa, Glycine max
  Coding DNA Sequence Number=SeqID_80322
TNIVIDPPSPIRRHMKWKMACTKKTDQMTSEATKEIDDKIASQGSFVAHRRQDVLTAAIERLEHPGCVRAVGASGSQGLALPPESEVSPSAARVSTKESSVDPLGNDPDTGDLEKCGLYVEENPPRLVALGRLCEGLKTVHNIPFCNDQIKVGVEEVRDADAPIPVPTQE

SEQ ID NO: 172008 - protein, 81 aa, Glycine max
  Coding DNA Sequence Number=SeqID_80323
MNLLPSVVLLSSTLKSYPEPLKLLVIHASSTIEFGAPRIDFLALFVYPPPSNLIRSPMNCLSFMHAPPSKKEEGETEVVID

SEQ ID NO: 172009 - protein, 149 aa, Glycine max
  Coding DNA Sequence Number=SeqID_80324
  Gene Ontology: Mol. function=nucleoside-triphosphatase activity
  Homolog annotation: Hit_ID=A4W8A2; Match level="QueryCoverage=100%, HitCoverage=30%, E-value=2e-57, Identity=74%"; Hit description=ABC transporter related
  Pfam annotation: Domain name=ABC_tran; Domain location=29-139; Score=- 49.2; E_value=0.0081; Accession=PF00005.18; Description=ABC transporter
MASLQISQGIFHLSDSRTLTLPDLTLHSGESWAFVGANGSGKSSLARALSGELTAAKGELRQDFQRRTRLSLEQLQQLVTQEWERNNTDLLSEGEDDTGRTALEIIQDEVKDEARAQALAQQFGISALLTRRFKYLSTGETRKTLLCQA

SEQ ID NO: 172010 - protein, 136 aa, Glycine max
  Coding DNA Sequence Number=SeqID_80325
STLEDPTEKYCTQRQVQGDAPQAADAPPPHQAGPAESFDPEQYLRHLVRQQAANHRAHVQTHDCLYQMSLNLQSQGFTSFPCPTPDQFRAEVAWPGDWPEARAGEAPAEAPDEADEAREDEEITDLLDFLGGSGAT

SEQ ID NO: 172011 - protein, 143 aa, Glycine max
  Coding DNA Sequence Number=SeqID_80326
MAAQLIHDRVEMECLEGVWETLEGNARCRFRGTIRLTATSLVHPEEPAHTLQRTMEWILPTPTPYRLVEPVQVIEVSSSKEDPEEDPEELPPEPAVDALNFPEGDEDPLPNVDSPEDVMSASEADSTEESGPGGIATSGDSSS

SEQ ID NO: 172012 - protein, 53 aa, Glycine max
  Coding DNA Sequence Number=SeqID_80327
MAPNSEGGRHMNEKEIHGAPKKELHYAITTHGSKLEGGGHMNENAIHGAPKKG

SEQ ID NO: 172013 - protein, 56 aa, Glycine max
  Coding DNA Sequence Number=SeqID_80328
MTCAFHGGVSGHSIVHCMTLKHKMQSLIDAGWLRFEEENRSNCSFYTFGGGAVNDE

SEQ ID NO: 172014 - protein, 150 aa, Glycine max
  Coding DNA Sequence Number=SeqID_80329
  Gene Ontology: Mol. function=endonuclease activity; Cellular component=chromatin; Biological process=chromatin assembly or disassembly
  Homolog annotation: Hit_ID=Q9M2Z3; Match level="QueryCoverage=36%, HitCoverage=9%, E-value=1e-17, Identity=72%"; Hit description=Flap endonuclease GEN-like 2
  Pfam annotation: Domain name=Chromo; Domain location=5-56; Score =12.3; E_value=0.017; Accession=PF00385.15; Description='chromo' (CHRromatin Organisation MOdi
IPVKCPVSEIIKSRRVQGRECYEVSWEGMDGLETSIVPADLIESACREKILEFEERKAQRKKQNIQKRKPKKKETNSSVAELDLKLQNLLLDINLRDEANFNASDSSGRISRITTDTAEADLNTTDLLPLSHDIEHSGVITDKNEIFKDM

SEQ ID NO: 172015 - protein, 338 aa, Glycine max
  Coding DNA Sequence Number=SeqID_80330
  Homolog annotation: Hit_ID=Q6WAY4; Match level="QueryCoverage=73%, HitCoverage=58%, E-value=3e-16, Identity=35%"; Hit description =Putative uncharacterized protein
LKELGRLMGPLQRQAFRIVYGKILDLATAVVFTEAIVSLAQYYDQPLRCFTFGDFQIVPTVEEFEENLGCPLGGRKPYLFSGFLPSLSKIAATVEDLARELDRMKQTRNGVVGLPWKYLEGKARDMANQEEWVPFADILALLIFGVVLFPNVDGSTINWFPRWKEGKEGVLFSCGDYPNIPLIGTRGCINYNPALAIRQLGYPMRGAPKEESLSPFLVRDFSAQSLKIVQRVHKAWESPLRKDKELRGIRNGIIGAPEEDEEVQALKSELGKARLAKEKFKSVATDIRKECAELRKENAATAIALEQETKRARKEEHGRDKFRGALWDNNNELKLRKE

SEQ ID NO: 172016 - protein, 93 aa, Glycine max
  Coding DNA Sequence Number=SeqID_80331
MSVKNLVGRLEVHDKMDHTPEVRSLSLGKIIGKPVNVTLFCENVSTMYDRHKLKRALKHGVFTPRPRLRRVCQVLSLLSQVQPRKYLTRRLYL

SEQ ID NO: 172017 - protein, 79 aa, Glycine max
  Coding DNA Sequence Number=SeqID_80332
  Homolog annotation: Hit_ID=A5C693; Match level="QueryCoverage=75%, HitCoverage=27%, E-value=4e-08, Identity=43%"; Hit description =Putative uncharacterized protein
MASLDSWFFKSIFRNRLFQDLDEDQVNFCLMTKSHGNHKEESVRKKWYIDSGCSKHMTGDVSKFTIISPKKSGHVTHGY

SEQ ID NO: 172018 - protein, 86 aa, Glycine max
  Coding DNA Sequence Number=SeqID_80333
MGAKYLEVFKRGLHPNNGWSPDEIRAHNDHNLSLCVFGRDRDLATRRRMTIICLCVPPDTIASGWRKGVRNDHNLSLRVYHSTCEI

SEQ ID NO: 172019 - protein, 314 aa, Glycine max
  Coding DNA Sequence Number=SeqID_80334
  Homolog annotation: Hit_ID=UPI00016621D1; Match level="QueryCoverage =41%, HitCoverage=40%, E-value=1e-11, Identity=37%"; Hit description =UPI00016621D1 related cluster
GLHVLAIGGLHALTFRGLRILTFRGLHVLTFRGLHVLTFRGLHILTFRGLHVLAFRGLDVLTFRGLHALSFRGGLHALTFKGLLVLAIRGLHALTFRGLDVLTFRGLHVLAYRGLRVLTFSELHSHTLREFKFLGHPLILEDRPTVLAQPEREAIAQLLCILGQDFTRAAAKRRVDRAHKTPSGPGGAQQGPRVSGSGYGPLSVLQGACPPSKVVPSRHRDRAHKTPVDPEEPNRVLGFPALDRARKTPSGPEEVQQGLGVASFDYGPLSVLRSACRPQQGTGQNTTAAWGWPIVGNRRTATTSKSSPQLIHKK

SEQ ID NO: 172020 - protein, 58 aa, Glycine max
  Coding DNA Sequence Number=SeqID_80335
MLVPKLWFFLVGGLKTKDDDKGDDKKLKDQSKNNSSESRTSQEFKIRIKKNSRLKKKV

SEQ ID NO: 172021 - protein, 74 aa, Glycine max
  Coding DNA Sequence Number=SeqID_80336
MSGLIRDSPQISASPHQLDFAPYASGSYNAQWNAPGLLHDKDTLRSSRILRKMEVCAKGGVHHWKCGRQALWLI

SEQ ID NO: 172022 - protein, 155 aa, Glycine max
  Coding DNA Sequence Number=SeqID_80337
MQSLQELAQQRPIMSVDQFIEKVALPGAQPSFVGDNESFIAQAPRQHELEPKNNHSSEAIIPGAVDFSKRRLEMRSNEVAHPEPVPVSAVAPFLGVDPSSPQHTANFSTPVLEIPEGQTIPVLTLDTSPPANPVLHLTDEEDVQTQDTQDQSQEF

SEQ ID NO: 172023 - protein, 139 aa, Glycine max
  Coding DNA Sequence Number=SeqID_80338
MAHEHKVVEEYARVFTEKEARGGKDAITKRAPRHPYRTRSKSRTMGDQEEVQEQMRADMSALKEQMASMMDAMLGMRQLMEKNAATAAAVSSAAEADPTLPAHASPYPRCGRTRKKHTRTHQQPPSGIQSGGLPLWIAT

SEQ ID NO: 172024 - protein, 157 aa, Glycine max
  Coding DNA Sequence Number=SeqID_80339
  Homolog annotation: Hit_ID=A7PJZ4; Match level="QueryCoverage=70%, HitCoverage=24%, E-value=7e-09, Identity=32%"; Hit description =Chromosome chr12 scaffold_18, whole genome shotgun sequence
CTITLEDVALHLGIRVNGRVVAGPNFLHWDELCHELLGEFPPENARKRAALKLTWLLNMLRAPLPEEPTMHQLQCRTPNAILNLLQSTITPTHDAIMYYNGKQNIPRQGEFLDYSFTGTNPIRFGIPSGCDMEKLKDLIKQVAPIGVPPNGIHGSQL

SEQ ID NO: 172025 - protein, 341 aa, Glycine max
  Coding DNA Sequence Number=SeqID_80340
  Gene Ontology: Mol. function=sequence-specific DNA binding; Cellular component=nucleus; Biological process=regulation of transcription, DNA-dependent
  Homolog annotation: Hit_ID=A2Q4C9; Match level="QueryCoverage=79%, HitCoverage=76%, E-value=6e-54, Identity=47%"; Hit description =Homeodomain-related
  Pfam annotation: Domain name=Homeobox; Domain location=29-90; Score =47.1; E_value=6.2e-11; Accession=PF00046.20; Description=Homeobox domain
MEDQGQQQQQQHQVEAKSPRQGTERSEAVRSRWTPKPEQILILESIFNSGMVNPPKDETVRIRKLLEKFGAVGDANVFYWFQNRRSRSRRRQRQMMQQQATATATATVTTFDHPQPQTQTLVNVGGAIPHDHHTLGNLVVATESSATSTMGFGCSSQSSYGFLGSSSSSSSCGGGVIGGQQQGMDGFFSSVSSHQMGFPDHHHTSPASSALYPPLDPNLTYQAGYGGPNISGFITVFINGIATELPKGPIDLKTVFGEDVMLVHSSGVPIPTNEFGFLMHNLQHGDSYFLGGVRVSNSQVQTFVKGGFDCQMVAAREGALAVMTDGSESKRHDKGFIERKG

SEQ ID NO: 172026 - protein, 75 aa, Glycine max
  Coding DNA Sequence Number=SeqID_80341
MRNLSISMYHSTNHMNVWVVNETIKENKTGIDQREMVPATCAMVSSWSKRVKIGIAKINRGRRQSAVKDKTIHDL

SEQ ID NO: 172027 - protein, 666 aa, Glycine max
  Coding DNA Sequence Number=SeqID_80342
  Gene Ontology: Mol. function=ARF GTPase activator activity; Biological process=regulation of ARF GTPase activity
  Homolog annotation: Hit_ID=Q5N770; Match level="QueryCoverage=98%, HitCoverage=91%, E-value=9e-66, Identity=31%"; Hit description=ZIGA1 protein-like
  Pfam annotation: Domain name=ArfGap; Domain location=1-82; Score= -14.1; E_value=0.00043; Accession=PF01412.9; Description=Putative GTPase activating protein for Arf
MRRSPNREFTHRVKSVSMAMFTSQEVDALQNGGNQRAREIHLKNWDFQRQRLPDSSNVDKVREFIRNVYVDQRYAAAKSSDKPPRDSPIEDDTRRASSYHSYSQSPPYDYQYEDRRYGKQAAALTRKPGSDKVCYERKISSIIFSPGRFSDHAYDDRFANERSGPRISDFSMSNGGEQFKTDFQHSGTCSSKDVLPHVTNTSLETNSKRDADGIHRPQQMSIGSLLAGEIEPAIFPPFPSFLTTQPTLYHCVPCLSMTFSLVQLSGKRARDELQQYWRTTSLGSTDSNLSSLRSYSSGGLVDFFSEPFQASGPHQNKVSCTPQPSDLGSTVSSDLSEAPVAPKPFSSSASSIDLFQLPAAPSQASSVDLFQSSALSAIASFNERQPLKTSQSSSVDFMDLSQQPSAATSSEKSLELSVPENEGWATFDMPQHTSTAQVEIQPAVQEKFDPFLNLNANTLWPCFETSSASALSSVTSNLWRDVTWTREEQVSVMASNSQSWSAFKDPANSVPVDALITQGSQMHDLPSTDDQFLDLRASEGSNKDGMHRIDPVAGFDHDLSSHFVSGSPCPPSAFPPMGEVQPNEINHKSTNPFDYPFDSDVEHNNTCQLQFLDVSSLQAALPDSQLTPTFQSGIAEPWLPQNTLNPYFSSAGQGGPSRLILEVQTF

SEQ ID NO: 172028 - protein, 419 aa, Glycine max
  Coding DNA Sequence Number=SeqID_80343
  Gene Ontology: Mol. function=pyridoxal phosphate binding; Cellular component=chloroplast; Biological process=cysteine biosynthetic process from serine
  Homolog annotation: Hit_ID=A7Q9Z5; Match level="QueryCoverage=80%, HitCoverage=73%, E-value=1e-110, Identity=64%"; Hit description =Cysteine synthase
  Pfam annotation: Domain name=PALP; Domain location=73-403; Score =304.6; E_value=1.9e-88; Accession=PF00291.16; Description=Pyridoxal -phosphate dependent enzyme
  Subcellular localization annotation: CTP_CleavageSite=44; ConfidenceScore=5.80e-01
MALSSSSSPPLLPFDLQRHRLVSLKPYTRSRSSQSQHTVTVTVTAAKAKASSATPLVYSTRQGFDTVNIAEDVTQLIGNTPMVYLNKVTEGCVANIAAKLESMEPCRSVKDRIGYSMLSDAEEIGAISPGKTILVEPTTGNTGLGIAFVAATKGYKLIVTMPASVNVERRILLRAFGAEVILTDAEKGLKGAVDKAEEIVHSTNNAYMFRQFDNMTNTKIHFETTGPEIWEDTMGNVDILVAGIGTGGTVTGTGQYLKMMNKNIKFADSIHIIFLIFGISGDLALCPVLERERERVVGVEPADRSVVSGDSPGFMPSILDVKLLDEVIKNNLLEVILFGFGISILKSKLCLVTNVEAVEMARRLALKEGLLVGISSGAAAAAAINLARRPENSGKLIVKWQLMAKHKSVTNKGLGKDAV

SEQ ID NO: 172029 - protein, 233 aa, Glycine max
  Coding DNA Sequence Number=SeqID_80344
  Gene Ontology: Mol. function=hydrolase activity; Cellular component =integral to membrane; Biological process=G-protein coupled receptor protein signaling pathway
  Homolog annotation: Hit_ID=A7QA19; Match level="QueryCoverage=76%, HitCoverage=50%, E-value=2e-48, Identity=50%"; Hit description =Chromosome chr8 scaffold_68, whole genome shotgun sequence
MGFLHFGRKREDSKRKHGRGAGGAGSVNRWSDWGCESCLSWVNDGSDYNKLHFVEKEPLLGRPYTSCEGNDACLNALSMLAGKKFWSPLSFGYSYMSWYEHLGPTVCLVYCRNHRIWESILKFIARKRHLHFLTIDLTRHTHHSAWSTMHNVICGGEKFVDSYLMILTKAGVRINVIQGDKDKAVPMECCSKLNLKAPNAEISIIPNANHGTVLFGRKKEFACSLEHIWESCC

SEQ ID NO: 172030 - protein, 190 aa, Glycine max
  Coding DNA Sequence Number=SeqID_80345
GGQSITRLKNEDKRLRWSLVIHYQGASKGNWKTMEASGNRLPVCVIDYTEEWVTGNRLPVPRGELGRPSKAMRGAGFRGMIRFTATSLVHPDEPARTLQRTVEWILPTPTPYRLVEPVQVIEVTSSEEDPEEDPEELPLEPAVDALDFLEGDEDAVPEVDSPEDVMSASEADSTEDSGPGEMAISGGSSS

SEQ ID NO: 172031 - protein, 120 aa, Glycine max
  Coding DNA Sequence Number=SeqID_80346
MAEEPRRVTLEDYSSSTVPQFFTSIAQPEVQSQTITYPPSLIQLIQNNLFHGLPIEDPYAHLATYIEICNTISLKSWDEIVEKFLKKYFPESKTAEGKAAIPSFHQFPDESLSEALGGIL

SEQ ID NO: 172032 - protein, 143 aa, Glycine max
  Coding DNA Sequence Number=SeqID_80347
  Subcellular localization annotation: CTP_CleavageSite=81; ConfidenceScore=5.60e-01
FGVRGLGFRVRGSGFGVPGSGFGVQGSGFRVQGSGFRVRGLGFGVWGSGFGVWGSGFGVRGLGFRVSGFGFRVSGFGFRVSGFGFGVWGLGFGVWGLGFGVWGLGFGVWGLGFGVWGLGFGVWGFGFRVSGFGFRVSGLGFRV

SEQ ID NO: 172033 - protein, 82 aa, Glycine max
  Coding DNA Sequence Number=SeqID_80348
MVCGGDGQQQRWRRMILFASSMILPFDEVLVYGQEGFHSQKVVASSIRFVHNNCRQKYILLLQWIKQQYFVSYYAKKLEQIQ

SEQ ID NO: 172034 - protein, 180 aa, Glycine max
  Coding DNA Sequence Number=SeqID_80349
  Pfam annotation: Domain name=zf-CCHC; Domain location=8-25; Score =21.5; E_value=0.00084; Accession=PF00098.14; Description=Zinc knuckle
MQEKTSSMKCFKCLGRGHITSQCPTKKTMIIRAKTFIVDKMRLLLHLPLVKVKKQKGEESSEDIYPQEEGQPLMVKEECKEVSVSSKRLAKKERHFEIKTNIKEISPLKTTSTFFSFVKKTLVSIVSPLRLEFIPQVKELLDEGLVRKSLNLCALLVPEIGVLMNPKRIKVIPEWPAPPS

SEQ ID NO: 172035 - protein, 118 aa, Glycine max
  Coding DNA Sequence Number=SeqID_80350
  Gene Ontology: Mol. function=hydrolase activity
  Homolog annotation: Hit_ID=A7QA19; Match level="QueryCoverage=54%, HitCoverage=18%, E-value=5e-14, Identity=57%"; Hit description =Chromosome chr8 scaffold_68, whole genome shotgun sequence
MHNVICGGAKFVDSYLMILTRVGVRINVIQGDKDQIVPMECCSKLKLKAPNAEICIIPNANHGTEKEIDVAESSIQVCKGPHGMQEDNSVMHDPELQGMRKSTRARKANNQLKDFVTS

SEQ ID NO: 172036 - protein, 810 aa, Glycine max
  Coding DNA Sequence Number=SeqID_80351
  Gene Ontology: Mol. function=succinyl-diaminopimelate desuccinylase activity; Cellular component=cytoplasm; Biological process=lysine biosynthetic process
  Homolog annotation: Hit_ID=A8S1S8; Match level="QueryCoverage=34%, HitCoverage=63%, E-value=2e-44, Identity=38%"; Hit description =Putative uncharacterized protein
  Pfam annotation: Domain name=Peptidase_M20; Domain location=627-784; Score=73.0; E_value=1e-18; Accession=PF01546.19; Description =Peptidase family M20M25M40
FAAENHVPGFAQPVTFDSKTGVLLLGKPAACDAYDFAGNRPAGDRRAGWRLLYVVFAVRTAADCAGYDAGDHHGRRGRLGGRGDGRGRVGRRTTADAAIPAAGGAGRTAYRSAGRADHRAGGGDRPHSGNCWHAGAVRRLAHGAVCAAGRAVAFRSARRSDACADAAAAGAAADGLADYRGLGAGVAGAAPYAVRVMAAGRRGVLCGLAATCYIATYRNVEMTVGGTLALEAIAAVSARHAARRTAVAHSAKWPAADWRALAMANRGYRGGAVAGAEQRSSQWAAVIAKEAGMKLWRKAPDLTLLLALWLLLLGAIAIVLPQMLAAWSLSSILQFATLLSLVALGQSLVVMTGGGGLDLSVGGNVSLSAPGRRAERPAGGALTPLAADRYARQFLSVLRFGAGINRRCGAGRRAAAADAVGPGGHAVRSVAFLNLCHPGVSAGVADPQQQRLGQMDLRLRLQRARHAAGGHSGRSPAAAVADRRAAGWRGDLWRARQRSWRSRRRADAGHPQNLHVAAGAEQRVATGRGGHAVNRGRIAQTLCDLLAFPSVVKVDPREAGPGERDCQHYLQQRLMALGMDTDLWDPDGPALYQKYQGRPGANKGRTFEGRPNLGGTLSGSGGGRSLMLTGHIDVVPPGPAEHWHSDPFVPEIRNEAVYGRGAVDMKGGVACMLMAVELLQDLNVQLAGDVVFTTVVDEEIGGMGSLAMVDRGFKADAGIMTEPTANRIAPICHGILWARIILDGIGGHAELTPNSWDSSGPVDAVMLCRQMLDGLDVLNRRWQTQADKNHPLMDLPNQIIVTQVKVGEHP

SEQ ID NO: 172037 - protein, 107 aa, Glycine max
  Coding DNA Sequence Number=SeqID_80352
MGKAEEVQKKVKADMEAMKEKMATMMEAMMSMKKIMEANAVTIAATSTVAKVNPMPPSGLNQMNHPTLDMTHEIPHHNLADFEPCLGYATEGQAVGGIPLQNPLEGP

SEQ ID NO: 172038 - protein, 189 aa, Glycine max
  Coding DNA Sequence Number=SeqID_80353
  Homolog annotation: Hit_ID=Q6WAY4; Match level="QueryCoverage=84%, HitCoverage=29%, E-value=1e-15, Identity=33%"; Hit description =Putative uncharacterized protein
MGAKYLEVVKRGSHPNNGWSPDEIRVKSLGITSLKELGQLMGQLQRQAFCKAYGKIWDLAMAEVSTKAIASLAQYYDQPLRCFTFGDFKLLPMVEEVEEILGCPLGGRKPYLFSGFYPSLARISKIVQISAHELDHRKQVKNGVVGVSRKCLEAKARILAGRGEWAPFIDILALSIFGGVLFPNVEGIL

SEQ ID NO: 172039 - protein, 217 aa, Glycine max
  Coding DNA Sequence Number=SeqID_80354
  Homolog annotation: Hit_ID=A8GJF5; Match level="QueryCoverage=31%, HitCoverage=52%, E-value=8e-13, Identity=52%"; Hit description =Putative uncharacterized protein precursor
MMIKPLNRTLRMGLLCLLALSAAACQNQKSGKPAVNTQNQAVQAPSEEALRKQREAEQLQQCQQQLGALRTINEKQHQRYKQAFDSLMSGASQYANLRARVNGDTQETVDALYRYKVNYLCAGVNQAVLTGLADRGEQADDGVPALLQFAEQYQRQSTGPKSENAAPADHASGQKKREPAKRPSDTHQPASPAKAFTLSQALLARDQQLARQRMELT

SEQ ID NO: 172040 - protein, 124 aa, Glycine max
  Coding DNA Sequence Number=SeqID_80355
  Subcellular localization annotation: CTP_CleavageSite=31; ConfidenceScore=5.07e-01
MSLPSGAACVLATTCKPGLSNIRRYLRPAVRLARKVRNNNENEGWCAHRCRCRATDWLYAADERAGGGADPERRPGAGPGGGNPQRLSGPDSTGRGNFGTGQPHQRGPHGKLPETGGQQQSAGG

SEQ ID NO: 172041 - protein, 113 aa, Glycine max
  Coding DNA Sequence Number=SeqID_80356
MASSNRLPIIAMAAQLIHHCIVMECLEGVWETLEGNERCRFRGTIRLTATSLVHPEEPVRTLHQPVDALDFPEDDEDPLPDVDSPEDVMSASEVDSTEESGPGGTANSDNSSS

SEQ ID NO: 172042 - protein, 243 aa, Glycine max
  Coding DNA Sequence Number=SeqID_80357
MAADNQPEAVGRAANAMQVIVAVNQAYDLLQDAETVALRRQRPGDVSGVVLFIALAVLVKELGAAYFDDLIAGAEQAITAAHADSVVEHIGEIGGLLIDGNDVHSLSAPQRQPFTEFALIEHLFGGAHAGFGADVAAQRRRRSLVGDAELRFVQRIAVLSGYAARAARNEAIQATLGQVKPFVFTAARRRWRRGAAPADSSWPSIAQNGLGQPRGETFASTKLEQVWTGYALHQCRQRFGGMA

SEQ ID NO: 172043 - protein, 250 aa, Glycine max
  Coding DNA Sequence Number=SeqID_80358
  Pfam annotation: Domain name=Transposase_23; Domain location=37-107; Score=4.8; E_value=0.00035; Accession=PF03017.5; Description =TNP1ENSPM transposase
MQSQGLALPPKPLVGLSSPRVSTNESCVDPSGNDPETGDSDRCDLYIEANPARLVALGRVYEGSTIVHNTPLFPGQVKVGMEEVKDPDASILVPTDEVSIVGQAIHTFLAWPTHLVKSLSQQTVVSPTKPPPKLDPEVDDPLYLMTLTIPELFLRPYQVTWDATVFGVFNPDFPLYIKHEDLSEIAHGGQCLSISMLQLWILHLTETSMRVGNSDIYGFLELQSIQRSRQSQFETEMDIGRWRSSCPRNT

SEQ ID NO: 172044 - protein, 107 aa, Glycine max
  Coding DNA Sequence Number=SeqID_80359
GKLPRSYIINRTSKRVKLRSQKPPVATCPLQASEGEAHGCDLQRKKDARSRHQRLFVENVGKTEGNRSKMKILSSGVVVTLEEGISTSHVCLKGQQPIFKNCGNCIT

SEQ ID NO: 172045 - protein, 179 aa, Glycine max
  Coding DNA Sequence Number=SeqID_80360
DPVEAEQYSRQMMERGHGMYYTPATFSEYPSQMYQYPFTGHHTDTSETSHSFGGVAETQPHFSWPTMTPSQQHDAPMATPNALFAPQWNKRGDNAATEEILIVKREDGIDHVAHLHDITDTIMTDFHGYGLEVYGLCLGVTIYVFGFRVRAYGLGLGSLWAWIRGGGYDLGLGLGLGLR

SEQ ID NO: 172046 - protein, 146 aa, Glycine max
  Coding DNA Sequence Number=SeqID_80361
  Pfam annotation: Domain name=G-patch; Domain location=1-42; Score =5.0; E_value=0.047; Accession=PF01585.14; Description=G-patch domain
MVARVMLGHGYEPRMGLGKNNGSTTSLVSTRGNCGKFGLGYKPTQADIRKNISERKNKGQSPRSGQRAKEAPPCHISRSFISAGTNTGDPAVDFEQEANRMENEEDEDIGLPLELERIIAQEDREIRPHEEETKLVDLGISSGKKE

SEQ ID NO: 172047 - protein, 56 aa, Glycine max
  Coding DNA Sequence Number=SeqID_80362
MQQKRHPHAQSSSQPTINYTSEYDSSGSNFLTAYEDCQSPTNQPVINTEGNKCTCS

SEQ ID NO: 172048 - protein, 211 aa, Glycine max
  Coding DNA Sequence Number=SeqID_80363
  Pfam annotation: Domain name=G-patch; Domain location=46-90; Score =9.4; E_value=0.014; Accession=PF01585.14; Description=G-patch domain
MLVSCPSSAPYVEAAEESLETAFHSFEVVSCASVEPSPSLPSLSTVAIMVARVMLRNGFEPGMGLDKDCLGNADVVDIKGNPYKYGLGYEPGMPGRRNVPSRFQADRAWPSRISQCFTSAGMTSEEEVAAIEEEFPQDPPSFVQPCHPDSQVGNWRVISQSEIYAADSIYEGRFFEDPNNEGLTIDFDRDISQTINEEEEEEEDDLSPELE

SEQ ID NO: 172049 - protein, 41 aa, Glycine max
  Coding DNA Sequence Number=SeqID_80364
MYPLLFLVKPKLKAQVKKDEGLSGEGQSPRVEKDEGPSGEG

SEQ ID NO: 172050 - protein, 581 aa, Glycine max
  Coding DNA Sequence Number=SeqID_80365
  Gene Ontology: Mol. function=transporter activity; Cellular component= cell outer membrane; Biological process=transport
  Homolog annotation: Hit_ID=A6E965; Match level="QueryCoverage=67%, HitCoverage=48%, E-value=2e-53, Identity=35%"; Hit description =Possible TonB-dependent receptor
  Pfam annotation: Domain name=Plug; Domain location=263-361; Score =37.3; E_value=5.4e-08; Accession=PF07715.6; Description=TonB -dependent Receptor Plug Domain
MVYKLVDLFLGDKETVVKPKKTAYTASELKGFEGIYERIPGSYFDVSVKENNLYLKTYKQEEGELLEPVGDNRFSIPSVATASLVFNKDSAFFKIADFTFPMKKIRMNPPKVDLKDLKKLEGFYRNEEFNYDVPAVQQAFIHQNPTSDSLISNGLHQVLTLLPAQDIQRFSLSGTIKSDGTQSLVISLFDAENTLIKTETADRQGQFRFSALKVGRYQLKVYRNGFEVYHSENIPVTENKMLPVIDLTVKSIEEVTITKTRPFIERQEGKMILNVENSISATGSSAFEILEKAPGVSVDNNDNLSLHGKGNLLVQIDGKNTPMTGSDLAGYLRGIPSASIDKIEFVTNPSSKYDAEGSSIINIRLKKEQKKGTNGTVSISAGAGKYIKTNNTVSINHRSGKVNAFANYGFVDRIFYNHLLLNRNFYENNQFKKAFIQDNFLKFGITGHMTRMGIDYDLNNKNILGLSVGLVANNVKIDGNTSSLTLGSNQLPESTFGTISKTRNHFANPSLNLNHKYSLDSLGSELTTDFDYINYSNGSLQNFETRNYNLSGSLDRLDILKGDMKGKLNIFSLKSDLTKNF

SEQ ID NO: 172051 - protein, 92 aa, Glycine max
  Coding DNA Sequence Number=SeqID_80366
MTLKWNVDDVGNALRWGCADLVRCPLCGKLEWLKNLSISKGMLRSFNSSMVKYLMTPMVHALYDTGNSINCGSMYFVLGGVSPGRELPCGPG

SEQ ID NO: 172052 - protein, 114 aa, Glycine max
  Coding DNA Sequence Number=SeqID_80367
MPVLELYIEKDVAGGSAFHSANSVRSCGNNLSNNESEPPRNVSNLHQDEDEEDDDDYLVSNSYVEDSLDEDNSVDDGIQNPFWNDAFHYNNINWSHPDEEDICSLEMPSTFNVG

SEQ ID NO: 172053 - protein, 393 aa, Glycine max
  Coding DNA Sequence Number=SeqID_80368
  Gene Ontology: Mol. function=acyltransferase activity; Cellular component=integral to membrane; Biological process=metabolic process
  Homolog annotation: Hit_ID=A9XUG6; Match level="QueryCoverage=97%, HitCoverage=72%, E-value=1e-148, Identity=65%"; Hit description=Beta- ketoacyl-CoA synthase
  Pfam annotation: Domain name=ACP_syn_III_C; Domain location=276-360; Score=8.4; E_value=2e-06; Accession=PF08541.1; Description=3-Oxoacyl- [acyl-carrier-protein (ACP)
  Pfam annotation: Domain name=Chal_sti_synt_C; Domain location=219 -362; Score=17.0; E_value=7e-05; Accession=PF02797.6; Description =Chalcone and stilbene synthases, C-te
  Pfam annotation: Domain name=FAE1_CUT1_RppA; Domain location=1-262; Score=511.4; E_value=1.1e-150; Accession=PF08392.3; Description =FAE1Type III polyketide synthase-lik
  Pfam module annotation: Pfam domain module=ACP_syn_III_C::Chal_sti _synt_C::FAE1_CUT1_RppA; Domain location=276-360::219-362::1-262
MLLDRAKRVGFLSDENYKLVNKILDRSGLGPWTYVPEGLLEIPPRLTLEEARKETDTVLFGAVDELLEKTGVEAKDIGILVVNCCLFNPTPSLSDSIVNRYKLRGNILAYNLSGMGCSAGVLAVDFAKQLLQAHPNSYALVLSTENEISSMYWGNNPSMLLVNCLFRMGGSAALLSSHLSDRQRSKYELFHTLRTHVGADDNSYKCVFQEEDDENKVGVSLSKELMNVARDALKVHITSLGPVVLPISEKLKFLVNLIERKVLKTKIESYMPNFKLAFKHFCIHTGGRAVLDRMQKSLELEDWHMEPSRMTLYRFGNTSSSSVWYELAYCEAKGRIKKGDRVWQMAFGSGFKCNTAVWVALNTIEPGSIKSPWRDEIHNFPVKVDPLPVKSNK

SEQ ID NO: 172054 - protein, 130 aa, Glycine max
  Coding DNA Sequence Number=SeqID_80369
  Gene Ontology: Mol. function=oxidoreductase activity; Biological process=response to red or far red light
  Homolog annotation: Hit_ID=Q4W8C1; Match level="QueryCoverage=76%, HitCoverage=30%, E-value=6e-29, Identity=67%"; Hit description =Gibberellin 2-oxidase
MVGAVKCVIIAMPATCLSNGFGLKRKSSVISTLSAYTEAVRELACEILELIAEGLGVPDTRIFSKFIRDVDSDSVLRLNHYPPIINKDNNKDMSQQFTKVGFGEHSDPQIITILRSNEVGGLQISLQDGV

SEQ ID NO: 172055 - protein, 277 aa, Glycine max
  Coding DNA Sequence Number=SeqID_80370
  Subcellular localization annotation: CTP_CleavageSite=55; ConfidenceScore=5.06e-01
MAKRVSLAKPPCLCSLNKPGLSELVSLSPKWPLGRGNLLPLGPRSPMTPLDLFLRAPGRDMHRTFTPGTSFQRGMLIYLSQNKSPRQVGVRGKLIKFVATSLNTFLETPVVLEPGEHLTTYSRFCHSCPDPQEFATRLCIPGHGFVLNAEGAPWKILRKDLTTLAQTWSVLSYSNLAPTSHVSDLNMDRARLVYGLVMKMDMDLGSLISDQISQMAQSNSSRLDFPALIIALCVARGVISDSLMFESLNPAINLAYIQKNCWNPDDPSITFPGTCKT

SEQ ID NO: 172056 - protein, 213 aa, Glycine max
  Coding DNA Sequence Number=SeqID_80371
  Homolog annotation: Hit_ID=A5AVQ0; Match level="QueryCoverage=18%, HitCoverage=4%, E-value=2e-08, Identity=69%"; Hit description =Putative uncharacterized protein
  Pfam annotation: Domain name=DUF1723; Domain location=35-84; Score =40.0; E_value=8.5e-09; Accession=PF08330.1; Description=Protein of unknown function (DUF1723)
MTFGIAPLLWKRHLHRSREVTNGVIQSYAQVEQVKIGNTLVTSLVERWRPESHTLHLLVGECTMTLEDVAHQLSLRVDVKTPNHFPPRAISYQNPFSLSSSLLRLERPISLSSSSSPPHRATQPAIEVHVTATNCSTCNCAAPRVRVLDIVLAPGWWVRKFVGSAQKAGPYIVCLGFSGFLANFQDSNSPKASYFAAFVPLVNCLRLLVNGVY

SEQ ID NO: 172057 - protein, 111 aa, Glycine max
  Coding DNA Sequence Number=SeqID_80372
MDSQPHTPRTPPILATPNSTITPLSSFNYKISVKLDATNYLVWLQQIEPVLRAHCLHRFCVIPEIPPQYASEHDRLANIENPAFSNWELQDQLLLAWLQSSLSPAILPSVI

SEQ ID NO: 172058 - protein, 38 aa, Glycine max
  Coding DNA Sequence Number=SeqID_80373
MGTTTGVELATQLAQASKVASSRRNSLPEEESGRPKWV

SEQ ID NO: 172059 - protein, 83 aa, Glycine max
  Coding DNA Sequence Number=SeqID_80374
MVTLEGEYGEVHGAEVIGGAAGGREDAKVEPREGLEEHMVAKDGWGEVVVNGEIRSKRCGRDKEGGELGELRHDGEEGGEVEV

SEQ ID NO: 172060 - protein, 762 aa, Glycine max
  Coding DNA Sequence Number=SeqID_80375
  Gene Ontology: Mol. function=DNA-directed RNA polymerase activity; Cellular component=nucleus; Biological process=transcription
  Homolog annotation: Hit_ID=A7Q5C4; Match level="QueryCoverage=82%, HitCoverage=83%, E-value=0.0, Identity=78%"; Hit description=DNA -directed RNA polymerase
  Pfam annotation: Domain name=RNA_pol_Rpa2_4; Domain location=157-214; Score=84.0; E_value=4.8e-22; Accession=PF06883.3; Description=RNA polymerase I, Rpa2 specific domain
  Pfam annotation: Domain name=RNA_pol_Rpb2_6; Domain location=270-643; Score=531.2; E_value=1.1e-156; Accession=PF00562.19; Description=RNA polymerase Rpb2, domain 6
  Pfam annotation: Domain name=RNA_pol_Rpb2_7; Domain location=645-755; Score=89.5; E_value=1e-23; Accession=PF04560.11; Description=RNA polymerase Rpb2, domain 7
  Pfam module annotation: Pfam domain module=RNA_pol_Rpa2_4::RNA_pol _Rpb2_6::RNA_pol_Rpb2_7; Domain location=157-214::270-643::645-755
  Subcellular localization annotation: CTP_CleavageSite=42; ConfidenceScore=5.03e-01
MDHLTAGRTTPKGCKPPNSYNPPKGCKPPNSYDSPKGCKVRRCESRGHDPWEQSQPTVMIRPRGARSVDANQEGMTLGNRITVNCLGTFVIEKQCKEWMQTSQNMIWSSVLVPWGLLPRITSFFDSQGNVGMTPSLPKIFLPGPPEALTVLLDGCVVGCIASSEAEKVVAHIRELKVSSAAVIPDDMEVGYVPLSMGGAYPGLYLCTSPSRFVRPVRNISIPSNGSENIEFIGPFEQVFMEIRCPDGGDGGRKSSFPATHEEIHPTVMLSVVANLTPWSDHNQSPRNMYQCQMAKQTMAFSSQTIQHRADQKLYHLQTPQTPIVRTSTYTKYNIDEFPTGTNAIVAVLAYTGYDMEDAMILNKSSVERGMFHGQIYQTETIDLTEQGGRLDRSSRMFRKSNLEKSACPSIDSDGLPHVGQMIRPDEPYCSIYNEVTSSIHTLKRKGSEAVYVDYVAVDVKNKKHLQKVNIRFRHPRNPVIGDKFSSRHGQKGVCSQLWPDVDMPFSGNTGMRPDLIINPHAFPSRMTIAMLLESVAAKGGSLRGEFVDATPFRSSVKKDSGESDSMSGSIVDDLGLLLREKGFNYHGLEVLYSGVYGTELTCEIFIGPVYYQRLRHMVSDKFQVRSTGTIDQVTRQPIKGRKRGGGIRFGEMERDSLLAHGAAYLLHDRLHTCSDYHIADVCSLCGSMLTTTFTQPQKRPVREIGGLPPGRAPKKVTCHACQTSKGMETVAMPYVFRYLAAELAAMNIKMTLKLSDGAGAGA

SEQ ID NO: 172061 - protein, 170 aa, Glycine max
  Coding DNA Sequence Number=SeqID_80376
  Homolog annotation: Hit_ID=A5AMX5; Match level="QueryCoverage=35%, HitCoverage=11%, E-value=5e-15, Identity=65%"; Hit description =Putative uncharacterized protein
AIGAGLFAITPAGERGMCCKAIKLGNARVFPVTTFAGNPSLEPTKPPTLLFEVLLEENPTYTIGTRVLKVSWVLKAQSFLREESFKFRAILLDLTAIVTVWVRGQFSGSALVDELQGHNAVLKDCIEQLTAIESSRTSLVSLLREALEDQEFKLGQVRSQIQVWNLSQFN

SEQ ID NO: 172062 - protein, 213 aa, Glycine max
  Coding DNA Sequence Number=SeqID_80377
  Gene Ontology: Mol. function=[ribulose-bisphosphate carboxylase] -lysine N-methyltransferase activity; Cellular component=chloroplast
  Homolog annotation: Hit_ID=Q43088; Match level="QueryCoverage=63%, HitCoverage=29%, E-value=2e-50, Identity=71%"; Hit description =Ribulose-1,5 bisphosphate carboxylase/oxygenase large subunit N- methyltransferase, chloroplast precursor
  Pfam annotation: Domain name=SET; Domain location=93-212; Score=-6.6; E_value=0.008; Accession=PF00856.19; Description=SET domain
MTLNVFFILQVTKYRLDEKFNEHAFSVVQPGILDKIICRGCECNTSLVAFRIHEAIHFCAGFDKDLSFTSKRPLSANCVASLETEVSVSPAIDTFWKWLKEEGVVSAKTPVKPSVVPEGLGLVALKDISRNEVVLQVPKRLWINPDVVAASKIGKVCIGLKPWLPVALFLIRERSRSNSLWKHYFSILLKETDSTIYCWVSFALLVRVCLDKI

SEQ ID NO: 172063 - protein, 55 aa, Glycine max
  Coding DNA Sequence Number=SeqID_80378
MIIIGNSPSRIVGLGSSSSMDSFASWKMNDSRMEKEEREEMPLQGQDESRRSSPP

SEQ ID NO: 172064 - protein, 559 aa, Glycine max
  Coding DNA Sequence Number=SeqID_80379
  Pfam annotation: Domain name=Transposase_23; Domain location=300-370; Score=10.8; E_value=7.8e-05; Accession=PF03017.5; Description =TNP1ENSPM transposase
  Subcellular localization annotation: CTP_CleavageSite=30; ConfidenceScore=5.74e-01
MASPPASPPPPPSASSDASASPSAMKRTRKASRLRSLSTKPPGAERPVVHVDLGTGKADSPHRKKLRTYLGIVARDKVDVTYENWKEFKSDLTRKWALAANQDGVADTVCEKYGISKEKWAQFCQTRKDPSWEDVRKKAQAIQKQNTAPHLLSRGGYDYLEQKLLAEKTKKKLEEAAQSGSVDGVIDPPSPDSFEEQETQGSFVPHGRQDVLTTVIGRPEHPGCVRAAGAGQLTQQIRDQLEESITEKVTRQLMASFSQMQSQIQSLGLAVPPEPLVGPSGPRVSTKGSCVDPSGNDPETGDSDRCGLYIEADHARLVALGRVYEGSTIVHNTPLLPNQEKVAVEEVTDADAPVLVPTNEVSLVGQALHTFLAWSTHLVKSLSQQVTWDATVFGVFNPDFSLYIKHEDLSEIAHGGNSDIYGFLEPQSIQRSGQSQFESESYINNWMQSSKCDVYLRAYLNGPDNYLKGIINSALKGLDDAPQPKSKAPARWIVVKCNRQKGSTKCGYYVMHWMSTIILGTFRNNWEAYFNDPRPLEPERLKALRIQWTQYYLRVRDQT

SEQ ID NO: 172065 - protein, 64 aa, Glycine max
  Coding DNA Sequence Number=SeqID_80380
  Subcellular localization annotation: CTP_CleavageSite=32; ConfidenceScore=5.26e-01
MVSFLLFLACDNPHDCSLTANGSSFLGDPSVPSSKGKGKNSYPRSRFMANELRFWLKRLVEGRT

SEQ ID NO: 172066 - protein, 69 aa, Glycine max
  Coding DNA Sequence Number=SeqID_80381
MAGTPHPHPGAQIPSSLFGRPGIGIKLHDYLRVEFSHGCHEWRLAPTAYLLLKIRELIVPQLDPPLFKE

SEQ ID NO: 172067 - protein, 68 aa, Glycine max
  Coding DNA Sequence Number=SeqID_80382
MSRNFTDYATIPSSDFGRLRNFTDCAIMFLFDSRHVAKLHRLLNDGCQVPRSGQAKVACHQTMVLERN

SEQ ID NO: 172068 - protein, 77 aa, Glycine max
  Coding DNA Sequence Number=SeqID_80383
  Subcellular localization annotation: CTP_CleavageSite=43; ConfidenceScore=5.16e-01
MGPKSTLRLMRTLGSSLASLAQSSWSLLSNALGAQQKFPTEALAFHGKLSPFSYNRGFWKQNSDYAVVGVSPPPLGT

SEQ ID NO: 172069 - protein, 258 aa, Glycine max
  Coding DNA Sequence Number=SeqID_80384
  Homolog annotation: Hit_ID=UPI00006A16D8; Match level="QueryCoverage =94%, HitCoverage=86%, E-value=2e-15, Identity=28%"; Hit description =UPI00006A16D8 related cluster
MQALTSRGLDIHALRALHVFAIGGLHASTFRGQHVLAIKGLHALTFRGLHIFAIKGLHALTFRVLHILAIRGLHVLAIRGLYSLTFRRLHVLAIRGLHALIFRGLHVLAIRGLHALIFRGLHVLAIRGLHALTFRGLDILAFRGLHVLAMRGLHALTFSGIQVLASRGLDALTFRGLHIFTIKVLDILAFRRPHDLAIRGPHVLAIRGLHAVTFRGLQVLGIRGLHILTFRELHGHAIRGLDIHAFRGLDVLAFRGLH

SEQ ID NO: 172070 - protein, 76 aa, Glycine max
  Coding DNA Sequence Number=SeqID_80385
MAHHVPFAGVADLDDEGSADLRTNPLQEGGDDAILPRRGPITRVMARRLQEDWAKDAGDDPRILMSHRLSKKEAKS

SEQ ID NO: 172071 - protein, 160 aa, Glycine max
  Coding DNA Sequence Number=SeqID_80386
  Homolog annotation: Hit_ID=Q6UUU1; Match level="QueryCoverage=37%, HitCoverage=40%, E-value=1e-18, Identity=78%"; Hit description =Putative uncharacterized protein
MAFALANRRGSTSITLPLAIKLIDTVDLRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 172072 - protein, 65 aa, Glycine max
  Coding DNA Sequence Number=SeqID_80387
MSLRSAVHVSSAFESRPPRMSLPSAVRQFSILHFFSEPHECHCLALFMCPPSSSAEPLKKKKEKE

SEQ ID NO: 172073 - protein, 198 aa, Glycine max
  Coding DNA Sequence Number=SeqID_80388
MSNQKSTESAIKNLEVQMGQLTKQLADRSSSSFSANTEKNPKEECKAVMTTSRMGTHVDERKADQKVEEVKQQLADELPLEPVDDLVELEEIVEEAEGDEEGETPIRDCQEKGKSEANSEKKKEATPIECKQGVQIAIRPTWAFQILPPEGGCFWRKQPGSPGGRNEEGKGSAFLALRILLKLLRKIVYVKKIQAKAL

SEQ ID NO: 172074 - protein, 106 aa, Glycine max
  Coding DNA Sequence Number=SeqID_80389
  Subcellular localization annotation: CTP_CleavageSite=35; ConfidenceScore=5.03e-01
MGMSPEWGWNSNGMASLVEFTGNCGRFGLGYKPTRTNMRRSALERRSDNESCEGNDTEELDVDFEQLVNQAEDGEDEDWGFPSELKRMVEQEDKEVDAILPRKGIG

SEQ ID NO: 172075 - protein, 27 aa, Glycine max
  Coding DNA Sequence Number=SeqID_80390
MEEWSQGKGGYEKDIYAKTKEKEGQWG

SEQ ID NO: 172076 - protein, 162 aa, Glycine max
  Coding DNA Sequence Number=SeqID_80391
  Subcellular localization annotation: CTP_CleavageSite=27; ConfidenceScore=5.37e-01
MLKHLQIAESSKKRKGSSSTTTAVGHRCQGNSGDHPAPVPPSLSSSRSSILFSSDDQRQRYYSQFCNKVILDPKYLDLEFFDEETFDCYLVFQNSALIDFMTPKLPYFPELVKVFYNNLKIQDGILYSKVHNIPIVIDQSLFCSLTKLPNQGVPFEGTLIDD

SEQ ID NO: 172077 - protein, 163 aa, Glycine max
  Coding DNA Sequence Number=SeqID_80392
  Homolog annotation: Hit_ID=A1AIV4; Match level="QueryCoverage=49%, HitCoverage=55%, E-value=1e-19, Identity=57%"; Hit description =Putative uncharacterized protein
MAVLQLVLFHKLRFEFHRTEAVDFAIDIVVTFNQTDAFHFSADFQGGRAAFHPEIFHYGYAIAICQQVTVGIAHYQPFAAVIRAGGPDMAAGGAVQAGQAGKVVIHFPQWSVCDEEGTAKRAPSYTLILYKDSIKACCPDAPGRPPAPAATPPWHSACCGCSA

SEQ ID NO: 172078 - protein, 766 aa, Glycine max
  Coding DNA Sequence Number=SeqID_80393
  Homolog annotation: Hit_ID=Q48NV7; Match level="QueryCoverage=64%, HitCoverage=78%, E-value=9e-68, Identity=32%"; Hit description =Putative uncharacterized protein
MRTSGPEFLERVSITAGIPDKDGDVGCWRGFHKLGLALAFEHGCPDATVPLFYHSSKTWKPLIKRGLYKAEWLNEAIFDLFNEPVYFDELKTHRPCLLIGGRGTGKTTVLRGLSYEGQYASFSAHKKNVEEWPFYGMYHRVNTNRVTAFRGPEIDESSWTRYFSHYINLTFCKQILDFVKWFNLITKLDIELNKSSIKKICLSLGINEVDTLEELSEELEYAVIDFEISVNSIIDNPPKNLSILAAPIDILTESLCSLSIFKGKQFYFLIDEFENFEDYQQIILNTIIKHSNNYYTFKIGVRELGWRQRGTLNSNESLISPADYALISISERLQKNNFELFAKKVIIDRLKKEFTEVKDECIDPTNLLTSITEREEAEILIGSEDYNKTIESLSTIVSKKDLDKIRSIERGMLGFLKYLSPDDDTYALKEYALKYLKEPSSLRNEMNNHFYAYLFTLKKGKTGVRKFYCGWDVYLLLANGNISIFNRTSSCGLYKSYRNDGVLFEPISPKTQTDAATQIGKKNLSELEGLSVDGAKLTKLVLSLGRIFQVMASDGKGHSPEVNQFHIKTDSIPSEANEADFIPEDNSIYIFGRSGEERSKHINSVYTNTPNVEFREIFAEDLYGFTSENEHKFYLRSERSILDFIGLVEINQCVYIDITGLTHSVWARLIQVSLNQKYKVRVVYVEPDQYSRSTAPVEGQIYDLSEKIQGIAPLTGFAKISDDSEKDFQFIPLLGFEGTRLSFITEQVQPNTENIIPIIGTPGFKP

SEQ ID NO: 172079 - protein, 121 aa, Glycine max
  Coding DNA Sequence Number=SeqID_80394
MLLSSNVIYICVRVVMLVRMIRTRLFAAARVKSCPGMHSSCVIASLSGCACTVGRPPISGGGPGTVRMWSTLKMRTRSPLKVRACNPLKAMMYSPLEVRACSPLKVRACSPLLARTCSPLK

SEQ ID NO: 172080 - protein, 251 aa, Glycine max
  Coding DNA Sequence Number=SeqID_80395
  Subcellular localization annotation: CTP_CleavageSite=35; ConfidenceScore=5.00e-01
AFRAGLFVRTPDGERPHSRKSPAFDRSPRTVGTASCTALVRTAACCRDGQDPGPDDAFDHAELQRARVLGEADAHDRGGDAVRGRDRHAEVGGQGQDGGRAGLRGEAMDRVQLDHLVAQGLDDLPATRGGTGSHHHRTGQHDPHRDAVTGVGVRVHEGQPGRQIVQCAGGFGTNQGHRDDAHGLLRVVVAVGEAHVGRRGDLRLAEEGIDDARTGQAADGATTPARPAISASQDHHQNAQQEHRRGDHRHE

SEQ ID NO: 172081 - protein, 81 aa, Glycine max
  Coding DNA Sequence Number=SeqID_80396
  Subcellular localization annotation: CTP_CleavageSite=50; ConfidenceScore=5.19e-01
MGANDIIIGKQIIKSNCSVCFKSCILLFTIKKTSCRNLSFGGRATRGLTGASSKKGKCAESPPTFIRGKRRKNWKDVVYEL

SEQ ID NO: 172082 - protein, 94 aa, Glycine max
  Coding DNA Sequence Number=SeqID_80397
MLMFATGYYLFVWMRSLLASAPGRQALGPLTEQIDAIKDVSLIKDVSVFYAEGSSTKHGCLIGKEFTSITQQESPTEGLAFHSKEAPFTMKKRS

SEQ ID NO: 172083 - protein, 64 aa, Glycine max
  Coding DNA Sequence Number=SeqID_80398
KDDRSKSKKKNLMIIMKQAKYSLKAQVEKDKTPEWRRMKAQVEKDEGPEAETLSRLLIVAEGPN

SEQ ID NO: 172084 - protein, 290 aa, Glycine max
  Coding DNA Sequence Number=SeqID_80399
  Gene Ontology: Mol. function=transporter activity; Cellular component= integral to membrane; Biological process=transport
  Homolog annotation: Hit_ID=A6TA99; Match level="QueryCoverage=100%, HitCoverage=72%, E-value=1e-116, Identity=76%"; Hit description =Putative transporter protein
  Pfam annotation: Domain name=MFS_1; Domain location=15-289; Score =16.4; E_value=0.0054; Accession=PF07690.7; Description=Major Facilitator Superfamily
MFNPDQNRLAPTLAMIMAASLVGFITGYTVPLISLELAQQQVAPLYVGLLAALPPAGMMLSSFLSPALCRRFEMGALLSVSLILLALATIASCMTTDMTLLLVPRLLTGLASGVIIVLGESWITGGAAGSNRATLTGIYASAFTGCQLAGPLLISVGPAWQHAALMAIVAITAVCLLMLRHLPRGSRESLAERASWRSLGAFLPVLASGVFCFAFFDASILALLPLYGIDKGLNETMAVLLVSVVLTGDAMFQAPLGWVADRFGIRRVHLICAVVFSLSLLALPFMLASR

SEQ ID NO: 172085 - protein, 219 aa, Glycine max
  Coding DNA Sequence Number=SeqID_80400
  Homolog annotation: Hit_ID=Q9AVH2; Match level="QueryCoverage=20%, HitCoverage=15%, E-value=2e-18, Identity=97%"; Hit description =Putative senescence-associated protein
MTEGCGEGFCLANLPGDAFSLWGNFFEAKKQMMADANLGKPLVEICPPVNFVVLPVVGLARVGGAGLWPRAKFRIGWPPPPPRDQFCCQDFANFGLRPGRIKATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNCANQRFL

SEQ ID NO: 172086 - protein, 92 aa, Glycine max
  Coding DNA Sequence Number=SeqID_80401
  Subcellular localization annotation: CTP_CleavageSite=28; ConfidenceScore=5.01e-01
GSRLQDTQWTRRSPTVSWSCQALIMGLCQSYGVPVAPSKVIRSPTNRAFIKKYCVPRQVQGETPQRPGDGRQRATDAPPSPLEFTSAHPQKR

SEQ ID NO: 172087 - protein, 77 aa, Glycine max
  Coding DNA Sequence Number=SeqID_80402
MEAPEKLKLSLLFTRMSDSGALDIETLEIERQEALEKFKSTSHIESPSKLNNGSSRNTNGDNFTHGGPIQAHHMSRR

SEQ ID NO: 172088 - protein, 15 aa, Glycine max
  Coding DNA Sequence Number=SeqID_80403
VNTVKIFPDAQNGLG

SEQ ID NO: 172089 - protein, 83 aa, Glycine max
  Coding DNA Sequence Number=SeqID_80404
QKKVYKDNHSGISARQRDSSVSMTDLVSAEDDQKKVYTDNHSGIFTRQRDSSVSMTDLVRVADKSEALATTYPQMRNSDLRSS

SEQ ID NO: 172090 - protein, 78 aa, Glycine max
  Coding DNA Sequence Number=SeqID_80405
MVIFHHGDAAEDKGEELGEDASMEEKKERRGEHEIEGIKEGKKWNFEVYLIRLSFIKVTTSVTHASINRLGSFLEKLS

SEQ ID NO: 172091 - protein, 98 aa, Glycine max
  Coding DNA Sequence Number=SeqID_80406
TLIFRGLLALTFRGLHVLTFRGLHVLAFRGLHALTFIGLHVLAFRGLDFLAFRGLHVLTFRGLHVLAFRGLHVLTFNTPSPSEDYTSSSSEGCTPSPS

SEQ ID NO: 172092 - protein, 210 aa, Glycine max
  Coding DNA Sequence Number=SeqID_80407
DKELRGSNNGPIGGYHKWLKAHVQGLDWLPSLRTAKREEVEAPEEDEEENTELRDINVATTKALERETKRACREEHGRNKFRGALWGNNSELKLRREERDQSRVDSLILKDELKTNMLAIITKYQEELNLAPAHEHRVADEYAQVYAEKEARGRVIDSLHQEATIWMDRFALTLNGSQELPRLLAKAKAMADTYSAPKEIHGLLSYCQQT

SEQ ID NO: 172093 - protein, 126 aa, Glycine max
  Coding DNA Sequence Number=SeqID_80408
  Subcellular localization annotation: CTP_CleavageSite=74; ConfidenceScore=5.17e-01
MYPPLFSLNNLVDVPSTRTDPQEMYPLLFSVTTTQVDVPSTCITKDVPSNVLRQSSQAVSPSKLCERGNKRILRRQREKGMKKMNSTSFVFKVLKTRKLKKAFAKEEEEEVQRDSRVVKDCNDCSQ

SEQ ID NO: 172094 - protein, 109 aa, Glycine max
  Coding DNA Sequence Number=SeqID_80409
MAESTRSKANSDRLEDAITKLTTHQLSLSDTLQHLTHKIDELIHHLHKLDPPNHSPSSSSTVPFPVSPSSPHRIKLDVLRSLREEKVQTQIYTGSITPLCLRPVPKQPA

SEQ ID NO: 172095 - protein, 220 aa, Glycine max
  Coding DNA Sequence Number=SeqID_80410
FIVNNSPTSMGIIASMPYVSQLAESSTWGPQDDSISCLCLTVGLRMFDRGELFHLVGRNFPQWSCFYPLGEVVVPVCPFPTWQRAKGSSDCEDCQEDSHHFGGKGASSGVETADPFINFSHDEVLVGGHPIWFLLFSSHNFINIYGGSLEYLLDDSLEVPNHLGIGHLGEQVCSGVAFSGDVVHFKTFEIVNESLRDVIVLDQHCFLDLIYVGNLSLDKL

SEQ ID NO: 172096 - protein, 267 aa, Glycine max
  Coding DNA Sequence Number=SeqID_80411
MPLWGRIAANAIVAFAEVIRRCKDLQVEIKDLAGKLEGITSERDEHAKVVVDLEEKEARKELEEEVLVYKKEDVKDGVLLDEEDIVVEEEAVDEEKNVSKQGDDASSPVMFVRSMFDFPLVEGLANHLGSRSLDMHSSSSDGYEESKCDLHQIEGLVMQSDDRSAYQGQSLGFCTKGGPWVLEECIPMTEDMFAWGFVKPVELSQGLPRMGLGFCEPLRITKHGAWDSPRADLRFYEPFGGSTRELSDLGFRHRALAYMTLVMGDMY

SEQ ID NO: 172097 - protein, 83 aa, Glycine max
  Coding DNA Sequence Number=SeqID_80412
MKIQKKKDQGVLTDPKRIKVIPERPTPPTPLIELVRNHVPSWEDAQERGVEGRSLELQEPLDLRSNPFQGGRNDAILPPKGIG

SEQ ID NO: 172098 - protein, 130 aa, Glycine max
  Coding DNA Sequence Number=SeqID_80413
MPSRGEKTVSFLRLSSFLEQDCSCDWGFSKRVGSHEANSEWNSGPATEILGRQGKGYGEPLQGGIPPPLLSTSQSLSSSLISLKLKNPRLLCKAAPLAASRASILKLALWSPCSGILKKCVYPNSAQDKL

SEQ ID NO: 172099 - protein, 89 aa, Glycine max
  Coding DNA Sequence Number=SeqID_80414
VFATRDDVLNWAQAVAYEIGFVAVIMRSGQYRCRKTDFVRRDTGSDTEMQQLMKLLEQDQYIHWHRLKDEEVVRNIFWCHPDAVKLSNA

SEQ ID NO: 172100 - protein, 128 aa, Glycine max
  Coding DNA Sequence Number=SeqID_80415
  Homolog annotation: Hit_ID=A5BSQ9; Match level="QueryCoverage=91%, HitCoverage=14%, E-value=2e-08, Identity=30%"; Hit description =Putative uncharacterized protein
MVVIIKKGENALCAMNPDFDHICDQILIPSMDSLMTCLFHVPTPRKIGNSLEHSKSSAMVSTRGRGGSWERGMARLIGIGHETRGLYYLETSPSMSCLASSSPKLLHDHLGHPHLSKLTKMVPKLSKL

SEQ ID NO: 172101 - protein, 132 aa, Glycine max
  Coding DNA Sequence Number=SeqID_80416
  Subcellular localization annotation: CTP_CleavageSite=49; ConfidenceScore=5.12e-01
MEELITKHNSLPQNNANVIKSAQRLLTRILLPTPCCCHSAPMNKAVSVEATLSPKATPPPPNSDQLESQGSSKPSDTPPSTSIPPHKELQGHPTRSMHPPMNIHNIQCMKHGHLKYMTMDELKRLSIPSENA

SEQ ID NO: 172102 - protein, 100 aa, Glycine max
  Coding DNA Sequence Number=SeqID_80417
MSEHESGSFSATTEVNPREQCKVVTIGRGTMVGLKDENEFSENKTNEGVVKISDEKVVEKNKKNEVLAKEEEKEISKVEKQKLTTFHKGKVQQRQGLLIV

SEQ ID NO: 172103 - protein, 48 aa, Glycine max
  Coding DNA Sequence Number=SeqID_80418
MKMLFCVMCCLWRLATYFLSARQLLHLYLQGRYLIMSFPKRCLMVYLF

SEQ ID NO: 172104 - protein, 236 aa, Glycine max
  Coding DNA Sequence Number=SeqID_80419
  Gene Ontology: Mol. function=motor activity; Cellular component=cell projection
  Homolog annotation: Hit_ID=UPI00016621D1; Match level="QueryCoverage =82%, HitCoverage=41%, E-value=5e-17, Identity=33%"; Hit description =UPI00016621D1 related cluster
LHVLTFRGLHTLTFRGLHALTFRGLHVLAFRGLHVLAIRGQNVLAFRGLHVLAIRGLHVLTIRGLHALAFRGLHVLTFRGLHTRPQRTTQGYMQALKGLRVLTFRGLHALAFRGLHALTFRGLHILTFRGLHILTIRGLHVLTFRGLHALTLRGLHVLTFRGLHVLAFRGLHTLFFSGLHALAFRGLDALAFKGSVPGPPPDPGGGPTMRAQLEKEAIVQPLCILGQDFTRAITKR

SEQ ID NO: 172105 - protein, 63 aa, Glycine max
  Coding DNA Sequence Number=SeqID_80420
MMKVEKKLIHRIGQQQSPRSKKSGDNNNLQGVKRVGWNKLNQLKIDGVRFSLDSTKGNFPWHP

SEQ ID NO: 172106 - protein, 83 aa, Glycine max
  Coding DNA Sequence Number=SeqID_80421
  Subcellular localization annotation: CTP_CleavageSite=51; ConfidenceScore=5.27e-01
MGPKSALRLIRTLGPSLASLAQSTWSFLSNALAGPFGISRSLEIREKNCFREENLSRVGDFAKIFNRSSTFFVHSSSFFGLQP

SEQ ID NO: 172107 - protein, 146 aa, Glycine max
  Coding DNA Sequence Number=SeqID_80422
MQFMGLRKRGLEWRIALSNHYAWLQTRRWRTHERKRNSWGSEKGLRMENCTKQSLRIAPNSMEWRIALSNHYDSSKLEGGGHMNENAIHGAPQRLRMENCTKQSLRVAPNSKVEDTLNDNAIHGAPKRLRMENFTKQSLRIVPNSK

SEQ ID NO: 172108 - protein, 119 aa, Glycine max
  Coding DNA Sequence Number=SeqID_80423
  Gene Ontology: Mol. function=transporter activity; Cellular component= integral to membrane; Biological process=transport
  Homolog annotation: Hit_ID=A4WAE0; Match level="QueryCoverage=83%, HitCoverage=24%, E-value=8e-39, Identity=83%"; Hit description=Major facilitator superfamily MFS_1 precursor
MKPSLRRSTAALLASSLLLTIGRGATLPFMTIYLTRVYNMSVENIGYALTIALTIGVVFSLGFGILADKFDKKRYMLIAIVAFIAGFVAIPLVDNVTLVVLFFSLINCAYSVFSTVLKA

SEQ ID NO: 172109 - protein, 379 aa, Glycine max
  Coding DNA Sequence Number=SeqID_80424
ADVRGHHEAAELDDVVNVGTGNHFGHQRQHAVRRQFHDQTHQLHHPGLQGVDSHQHALAFRLVVFQQLQRRHAEEGGENHHADDRRRAGAGQIGERVFWDERQHHLRHGQAFGGQAEQVGDQYAHQRRDQRGEQQRADSQDADFAQRRGVMQLGHRAQDRGEHQRHDDHLQQLHIAVADDVEPADGFFQYRVVGAVHQLQAQTEHHADHQADQHFFRQAPLLVAGLRQQQQERDKHQHAKTPAARPQQRNAGGGEHIGQQMAEVTDDHGVQRVGRDRPAARHVQLEQRHAAGDRQQAVGETAVAECAGDGNGEPAQTLAQHRLGVIDVRQQRGQQRGGYDVPPVAGSQLWRHFRLLGEDRASDREYKVSFRGHAVAIPA

SEQ ID NO: 172110 - protein, 243 aa, Glycine max
  Coding DNA Sequence Number=SeqID_80425
MQVGLPPVPFESLLSWLAALQREHGIRVLALAVERAEQAPGIVQLAAVAWPLSLLPPSYCRALSTAGIIPDADGDNAGLAARHRGGLVFHAGVGCAVAGVGGDRQPMSAAAGLPDAVAAVDRLTVALPGAPGLFAGGGHWRDGGLSGALAIVLGISFGDRPRGAGIRRFQTVGGAWRLGRLCRFAVDPAVRLRRQPAMAVAARVARRRCGPIPALRAGAGDGGRRRGGLSVACAADKGLTQLG

SEQ ID NO: 172111 - protein, 16 aa, Glycine max
  Coding DNA Sequence Number=SeqID_80426
NLMERIQKLTSSDNSQ

SEQ ID NO: 172112 - protein, 241 aa, Glycine max
  Coding DNA Sequence Number=SeqID_80427
  Homolog annotation: Hit_ID=Q6WAY6; Match level="QueryCoverage=73%, HitCoverage=38%, E-value=5e-17, Identity=28%"; Hit description =Putative uncharacterized protein
IPRKRLEEKAKALASQGEWAAFINVLALLVFGTILFPNVDGLVDLVAIDAFLAYHHSKESPIIAILADLYDTFDLRCEKSSARIVCCTPALYVWLGFPNVPLMGMSGYINYNPMLAIRQLGYPMRGAPSEEIIMPFISRGFNEANAKILQKIYKAWNRVGRKDKELRGSSNGAEIPKESKEVQAFKGELEKTRVVKEKLKTAVTRVRKECDELKDINMTMVEANELKLRKVERDKSRMENM

SEQ ID NO: 172113 - protein, 103 aa, Glycine max
  Coding DNA Sequence Number=SeqID_80428
LSLSLQSQGFTSFPCPTPDQFREEVAWPGDWPEARAGEAPAEAPDEADEAREDEEMTDLLDFLGGSGATLLGDPLIHISFCFHFSCYISSYFCLTKGLTFISC

SEQ ID NO: 172114 - protein, 138 aa, Glycine max
  Coding DNA Sequence Number=SeqID_80429
MKLEETLAQFMQVFMSNQKSTESAIKNLEKIFEEAEGDEEGEIPIRDYQERIKKKEEKEKEKEEETKEKEEKEKKLKKEKQKEKVVEIEKKKRKSEANSKKKKEATPIECKKVPYPLVPSRKDKERHLARFPDIFKKL

SEQ ID NO: 172115 - protein, 152 aa, Glycine max
  Coding DNA Sequence Number=SeqID_80430
MPPTRHPLDPDKSNRALGFPALITGLCQSFGVPVTPSKVIRLPITRAFIEKYCTPRQAQGNAPQATDAPPPPHQADPAGSLGMERLCQQGQGFTAFACPTPDQFRVEVAWPRDWPEDQTEEAPTGAPKDAEDARMDEEMTDLLSFLGRSGAT

SEQ ID NO: 172116 - protein, 114 aa, Glycine max
  Coding DNA Sequence Number=SeqID_80431
MAAQLIHDRVVMECLEGVWETLEGNERCQFRGIVRLTATSLVSSSEEDPEGDPEELSPEPAMDAPDLPEDDEDPLPDVDSPEDIMPAPEANSTEESGPGGMANSDDSSSQQTTL

SEQ ID NO: 172117 - protein, 351 aa, Glycine max
  Coding DNA Sequence Number=SeqID_80432
  Gene Ontology: Mol. function=chitin binding; Cellular component =extracellular region; Biological process=chitin metabolic process
  Homolog annotation: Hit_ID=UPI00006A17C9; Match level="QueryCoverage =96%, HitCoverage=100%, E-value=4e-40, Identity=28%"; Hit description= UPI00006A17C9 related cluster
  Subcellular localization annotation: CTP_CleavageSite=58; ConfidenceScore=5.58e-01
MCILLKARVCSPLKARTCSPLKARARSPLKVRACSPLKVRACCPLKARTCSPLKARVRSLLKARTCNLLKARTCSPLKARTCSLLKARTCSPIKARTCSPVKARACSLVKARACCPLNVSTCSPLKARMCSPQKARACSPLKARLCSPLKASACSPLKTRMCILLKARACSLQKLRTYSPLKARACIPLKAKACSPLMTRTCIPLKMRAFSPLNARTCCPLMVGACSPLMVRACSPLKARTCGPLKARACNLLKARTCSPLKVKMCSPQKAWAFGPLKVRASSPLMARTCSPLKAKKCSPLKARMCSPLKAKACNHLKARTCSPLKAWTFRPWKARTCSLLKVRTCSGEDV

SEQ ID NO: 172118 - protein, 73 aa, Glycine max
  Coding DNA Sequence Number=SeqID_80433
MDGLKHLIKQVHLMGFPLMVFMKHKRRCVLVATVEPRLQEDFDYANSKAYPRQFKKIFIIPIVKHIQDNSGGF

SEQ ID NO: 172119 - protein, 299 aa, Glycine max
  Coding DNA Sequence Number=SeqID_80434
  Gene Ontology: Mol. function=RNA-directed DNA polymerase activity; Biological process=regulation of transcription, DNA-dependent
  Homolog annotation: Hit_ID=A5BTB5; Match level="QueryCoverage=84%, HitCoverage=47%, E-value=5e-43, Identity=35%"; Hit description =Putative uncharacterized protein
GTEFWDKNPFKVTAKAFPPGFHYKPTTILKTITFYELILVDSNSVSIKHFKDPKDQTLNTHSTIQILKVLQPRHFGSDLNKGKRFSVPFDPVGYTYWDYVDAWTKVFWHQNTRFKHSWLIYFKTNTIYNFPNWFLQWWHFFGPIPEIFPETVQQGFAQFKKQYNLQESRIPADLKYFSSYALSWIFSWQHAFVKWWTQFDSSKADPEQVKLWFQSHPEFLKAADPETSVFLNQKSHLTAFLAGSTSKEVLVKNLKEVLQMLQQEEEASSSKKEETSSAEKEEEDPFYQNEDDCFGICLD

SEQ ID NO: 172120 - protein, 177 aa, Glycine max
  Coding DNA Sequence Number=SeqID_80435
RAVERVRSRIRVGFIFLCDKEKNPRGETMSSVGEEAMASAVEADWNAKEEGPVAADADGTANDSLRASLPEGVVLCRRTVVHGVHDITEMSEDSLDVSQGPFVLACVGHGRGLVLRKWLLVVGCVMAREGVVQRMVWVGMAGAGRAAMEAPFGEWRSWSLNESTKLLGVGKKLADFE

SEQ ID NO: 172121 - protein, 223 aa, Glycine max
  Coding DNA Sequence Number=SeqID_80436
MALKHKVQSLIDAGWLTFQEDGLNVKTNLLANHGGSVVNAIEARGLERPKQMKDVVTSRRFIFEALQEAGMVSFDGHKGDPCLMHPDASHDMETCSTVEELLQQMMDQGRFEISEENKGEQNVCMQLADKESPAKPKPLVIHFTRDVVSQKPRGSRPIPGSRPISFPYRSNKAVPWRYASQKPSEKKEEATSIDLPSVKVTNITSLSGVTRSGCIFAAPDPFV

SEQ ID NO: 172122 - protein, 557 aa, Glycine max
  Coding DNA Sequence Number=SeqID_80437
  Homolog annotation: Hit_ID=A8GAE3; Match level="QueryCoverage=71%, HitCoverage=97%, E-value=0.0, Identity=81%"; Hit description =Putative uncharacterized protein precursor
  Pfam annotation: Domain name=SGL; Domain location=156-389; Score= -106.5; E_value=0.0053; Accession=PF08450.3; Description=SMP -30GluconolaconaseLRE-like region
MSGTLATPRALLSLLVAASLVVAGAVQADDACIKPQDIKREALSSAVVEMAYSTSQQALFVSAPDWKEEARSRVLRLDPNTLAIKAEIPLQVKGFGVALNDAGNRLYLTQGFNGEVGVVDTTTNHALGSIKLLDKAVLEQAYKQAGISGKRLDFLLAELKKFKITEDYLYRIREIKYDAQSGRLFLPGLGFGVDSVLYVVDTKAGKLEKVIPGFGYNAVGITLDEKGRRVFVSNMQGQVITLNADTLAITATHEVQADQLLNLVYDPASNRLLGVDQGIDRDNYRNHHLGHDYVKRSSGHRVFALDADSGKVLASELTDEVPIGLLLDERSQRLYVANRKGVRVDHGAGTLTVFDAKTLKRLQTVDLPPHPNSLALDPKGDALFVTVKNDGASTKAGKPESVVQVGVDAHVVGAARFVVGGRACTGDVDRAGVRIAHVLRVAGAELAFVEQVIDAGGEADVFGQVIGRAGADDGIRADLAGFAAGGRFTLVVVLLRLLTAVPGQGGLHRQILRGLPAEGRVDGELRDHRQVIAGGLVLVLDHVGGVVAPGDGLADRH

SEQ ID NO: 172123 - protein, 73 aa, Glycine max
  Coding DNA Sequence Number=SeqID_80438
MNVKLQIYNKGLINEDMQIIHFGVRDVVRMCHMVDPIFVLGDQDFFCPMLPLLLRQLRRKCVRKSTPNKSPVL

SEQ ID NO: 172124 - protein, 82 aa, Glycine max
  Coding DNA Sequence Number=SeqID_80439
MDVLRDCAGERKSRRQREKEREVRSYAVHSLDQATKRFDLVMMSLDLAMECIFDNEAEARRWWWLWLWTECDAKFSGRYGGF

SEQ ID NO: 172125 - protein, 435 aa, Glycine max
  Coding DNA Sequence Number=SeqID_80440
  Gene Ontology: Mol. function=carbohydrate binding; Cellular component= cellular_component; Biological process=fructose 2,6-bisphosphate metabolic process
  Homolog annotation: Hit_ID=A7NYC1; Match level="QueryCoverage=94%, HitCoverage=51%, E-value=1e-125, Identity=59%"; Hit description =Chromosome chr6 scaffold_3, whole genome shotgun sequence
  Pfam annotation: Domain name=6PF2K; Domain location=341-433; Score= -75.2; E_value=0.0021; Accession=PF01591.9; Description=6 -phosphofructo-2-kinase
MVGNSEEDRDGLHQSPLRIPELLYVSVKMENPNLTLSGDLLPHISGSCPSGDPSKALSMERESASVWELSFVVPPNHEALEFKFLLKPKYIDNPCFVEEGPSRVLIGGALQYGDRLALFRLDNDQVLEYRVFVEAKRASPFDLAASWRAYQENFRLSTVRGIPDVSINSEVQTGSECKTFIVNGQVISQNISSVSLELDLEHYIVPSPPVSASSALVYAANMTENPRSLDSGFASISSSTVDGGVPMIDQPETVKFMEVNAPDPAKVYQSPGMVKSQSAGTILPLQKEGDMRGLLVDRGVGVPRLVKSSSSYAFTTNLNLYTDTKNSIPAAAGAVAAAAIADQMLGPKEHRHLAIVMVSLPARGKTYTAAKLTRYLRWLGHNTKHFNVGKYRRLKHGSSQENLQSMSYSSLQSADFFRADNPEGVEARNEVTPGQ

SEQ ID NO: 172126 - protein, 146 aa, Glycine max
  Coding DNA Sequence Number=SeqID_80441
MSDGFEFKVCLFEHLKCWILSWVIELNLVLARSFTRDRFEVSNMKNGFFHKNPEDLYHSKKNHFLLCLPNCLWREPTLTQNEEGNEDGLKNNNNNNNRRASKLNNNKSNKFNLSKQHQQQIQARCSSDQATIRWHNAVALASDIHI

SEQ ID NO: 172127 - protein, 1076 aa, Glycine max
  Coding DNA Sequence Number=SeqID_80442
  Gene Ontology: Mol. function=small protein activating enzyme activity; Cellular component=cytoplasm; Biological process=protein modification process
  Homolog annotation: Hit_ID=A7NYA8; Match level="QueryCoverage=91%, HitCoverage=93%, E-value=0.0, Identity=84%"; Hit description =Chromosome chr6 scaffold_3, whole genome shotgun sequence
  Pfam annotation: Domain name=ThiF; Domain location=488-631; Score =160.8; E_value=3.7e-45; Accession=PF00899.12; Description=ThiF family
  Pfam annotation: Domain name=UBACT; Domain location=774-835; Score =43.3; E_value=8.4e-10; Accession=PF02134.12; Description=Repeat in ubiquitin-activating (UBA) protein
  Pfam annotation: Domain name=UBACT; Domain location=875-943; Score =119.6; E_value=9.5e-33; Accession=PF02134.12; Description=Repeat in ubiquitin-activating (UBA) protein
  Pfam annotation: Domain name=UBA_e1_C; Domain location=949-1071; Score=214.4; E_value=2.8e-61; Accession=PF09358.1; Description =Ubiquitin-activating enzyme e1 C-term
  Pfam module annotation: Pfam domain module=ThiF::UBACT::UBACT::UBA_e1_ C; Domain location=488-631::774-835::875-943::949-1071
MVRFRCVFCSLLHYMLPRKRVREGGVVVEVDSDATTTNTNSAAASFPKKARIGSFAACSGAGAADSPVNVSGQGFSSGGGGDNSLGNSVGGMALGNSHPAEIDEDLHSRQLAVYGRETMRRLFASSVLVSGMQGLGVEIENDVGKNRAEASVSKLQELNNAVVVLSLTSKLTKEQLSNFQAVVFTEISLEKAIEFNDYCHSHQPPIAFIKSEVRGLFGSLFCDFGPEFTVVDVDGEDPHTGIIASISNDNPALVSCVDDERLEFQDGDLVVFSEVHGMKELNDGKPRKIKNARAYSFTLEEDTTNYGRYEKGGIVTQVKQPKVLNFKPLREALSDPGDFLLSDFSKFDRPPLLHLAFQALDKFVSEIGRFPVAGSEDDAQKLISIASNINGSLGDGRLEDVNPKLLQQFSFGARAVLNPMAAMFGGIVGQEVVKACSGKFHPLFQFFYFDSVESLPTEPLDANDLKPLNSRYDAQISVFGQKLQKKLEDAEVFVVGSGALGCEFLKNLALMGVSCGQGKLTITDDDVIEKSNLSRQFLFRDWNIGQAKSTVAASAAASINPRLNIDALQNRVGPETENVFHDTFWENLSVVINALDNVNARLYVDQRCLYFQKSLLESGTLGAKCNTQMVIPHLTENYGASRDPPEKQAPMCTVHSFPHNIDHCLTWARSEFEGLLEKTPAEVNAYLSNPNEYTNAMRNAGDAQARDNLERVLECLDKEKCETFEDCITWARLKFEDYFANRVKQLIYTFPEDAATSTGAPFWSAPKRFPHPLQFSSSDLGHLLFLMAASILRAETFGIPIPDWVKHPKKLAEAVDRVIVPDFQPKKDAKIVTDEKATSLSSASIDDAAVINDLIVKLEGCRTKLQPEFRMKPVQFEKDDDTNYHMDLIAGLANMRARNYSIPEVDKLKAKFIAGRIIPAIATSTAMATGLVCLELYKALDGGHKVEDYRNTFANLALPLFSIAEPVPPKVIKHQDMSWTVWDRWILKDNPTLRELLEWLKAKGLNAYSISCGSCLLYNSMFPRHRERMDKKMVDLAREVAKVEIPSYRRHLDVVVACEDDEDNDIDIPQISIYFR

SEQ ID NO: 172128 - protein, 155 aa, Glycine max
  Coding DNA Sequence Number=SeqID_80443
  Homolog annotation: Hit_ID=Q9ZUQ3; Match level="QueryCoverage=72%, HitCoverage=13%, E-value=6e-08, Identity=28%"; Hit description =En/Spm-like transposon protein
PSSVKRTRKVSRLRSLSTRPPGAERPVVHVDPATDKADGPHRKKLRTYLGIMARDKVDVTYENWKEVPIAQKDLIWEDIQAEFDIPEAFDSRTKRKLLQTVGERWRTLSVRNMASARKNGPNFARLAETLLGRMCARRHRPSRSRILPPTFCLVG

SEQ ID NO: 172129 - protein, 96 aa, Glycine max
  Coding DNA Sequence Number=SeqID_80444
  Homolog annotation: Hit_ID=A5AV98; Match level="QueryCoverage=38%, HitCoverage=4%, E-value=4e-10, Identity=83%"; Hit description =Putative uncharacterized protein
MKKHDRGKGSLKNNDDSLQIQRKISKGNNCQFCRKSEHFQKDYLKCKSWFEKKSELNAHGKQAKHTKKGATRSTQLLEIVHTDICGPFDVSSFGKE

SEQ ID NO: 172130 - protein, 188 aa, Glycine max
  Coding DNA Sequence Number=SeqID_80445
MKRNPRSTKRDPSYWEYVNAFHSTQNSNSLVKRSALSSEQPNPRRIMPMLDQFQPFIHDFIDNIVDVQADGNCGYRSVAGLLELDKFSKDYIKLLGDTDKFEELRMSLHVDGLTKGTMDKWMDIIDMRYVIASRFILKDHCPLPPIALLWSSNCPPQAKQWPTPYISKMQHYRSFTMYKRDYVDLNDD

SEQ ID NO: 172131 - protein, 153 aa, Glycine max
  Coding DNA Sequence Number=SeqID_80446
  Homolog annotation: Hit_ID=Q6L477; Match level="QueryCoverage=45%, HitCoverage=11%, E-value=9e-09, Identity=34%"; Hit description =Putative uncharacterized protein OSJNBa0009L15.8
  Subcellular localization annotation: CTP_CleavageSite=47; ConfidenceScore=5.95e-01
MGSPPASTPPPPPPPPPPPHPSSSPPPPPPSPSDASASLSAVKRTPKASRLRSLSTRPPGAKRPVVHVDPATGKADGPHRKKLRTYLGIVARDKVDVTYENWKEVPTAQKDLIWEDIQVKFDILEAFDSRTKRKLLQTLGERWRPFKSDLMRK

SEQ ID NO: 172132 - protein, 148 aa, Glycine max
  Coding DNA Sequence Number=SeqID_80447
  Homolog annotation: Hit_ID=Q6UUU1; Match level="QueryCoverage=40%, HitCoverage=40%, E-value=9e-19, Identity=78%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPAFPPGGSLVRSPVPAFRFTGVIPLLWPRLSHSTPDTQFP

SEQ ID NO: 172133 - protein, 108 aa, Glycine max
  Coding DNA Sequence Number=SeqID_80448
MITLYHTVIKASFEKSTHVVGHVFKVTLYKGLFGMLSRKGENKRCSEEINDQRSTKCDPSYYEYVDALHFVQNGNSLDKRSASSSKQAIPRRTMPMLDQFHPCIHDSI

SEQ ID NO: 172134 - protein, 83 aa, Glycine max
  Coding DNA Sequence Number=SeqID_80449
MPFLFLLLYSFASVHILFHDSLTTVLKVTRLCPWKSWDRLLKNKKKVEKHINIAIFISRTSWVQRRWENTLRLQFLSQKLHGF

SEQ ID NO: 172135 - protein, 21 aa, Glycine max
  Coding DNA Sequence Number=SeqID_80450
ELARDAAIAVGRHMSPLRDKG

SEQ ID NO: 172136 - protein, 180 aa, Glycine max
  Coding DNA Sequence Number=SeqID_80451
MHVAQLISDAIHYLQGSRPQDTLWTRRSPTGPWGFQLWLWASVNPTGCPSPPARSRHRDIGIAPARHLVDPEKSNRVLGFPALITGLCQFYGVPVAPNKVIRPPINRAFIKKYRAPQASAGRDTTAALGWSATGNRRTTATSRSPQLIYKGWSVAYDLWLTSRRPSPKPKVARYLGYTCI

SEQ ID NO: 172137 - protein, 74 aa, Glycine max
  Coding DNA Sequence Number=SeqID_80452
MKVNKTRDELKVSDLKTYRLKNEERTKNGEEPQKIFTKLLTETSQKHYGSITAWIFFTETLFSPKNAEMHSQGG

SEQ ID NO: 172138 - protein, 22 aa, Glycine max
  Coding DNA Sequence Number=SeqID_80453
MGCLLATDIWMTPLPVKEDKSG

SEQ ID NO: 172139 - protein, 231 aa, Glycine max
  Coding DNA Sequence Number=SeqID_80454
MTCGEPFGPTLFQFLSSSGGGSDDMQEPFGPTLFHLLSSRGGRPDDMREPFGPCSFTFCHPEAAGPMTCGEPFGPTLFHLLSSRGGGPDDMHGTIWSRTFTFCHPEAAGPMTCGGGGPDDMCGTIWSRTFTFCHPEAAGPMTFGNHLVPHFLLLSSRGGGPDDMRRQIMVIRTLFLSRQVMAIVATYPLAGGRRVTRMCVFQERNTRRVATNIYLRKTSEKPEKTSSMNSK

SEQ ID NO: 172140 - protein, 110 aa, Glycine max
  Coding DNA Sequence Number=SeqID_80455
MKKILGLQAPMELTSCGRRNLFDKELGRASAFIEQATAISPNEALKDYWVWGADPKGIFTTSTAYLCIKGDQPIGHLNRGFSQLWEIKVPPRALSFAWRLLWDRLPTKEN

SEQ ID NO: 172141 - protein, 329 aa, Glycine max
  Coding DNA Sequence Number=SeqID_80456
  Gene Ontology: Mol. function=inorganic anion transmembrane transporter activity; Cellular component=integral to membrane; Biological process=inorganic anion transport
  Homolog annotation: Hit_ID=Q1H4J5; Match level="QueryCoverage=95%, HitCoverage=77%, E-value=8e-98, Identity=60%"; Hit description =Nitrate transporter
  Pfam annotation: Domain name=MFS_1; Domain location=1-277; Score =40.1; E_value=7.8e-09; Accession=PF07690.7; Description=Major Facilitator Superfamily
  Pfam annotation: Domain name=MFS_Mycoplasma; Domain location=59-287; Score=-157.1; E_value=0.084; Accession=PF07672.4; Description =Mycoplasma MFS transporter
  Pfam module annotation: Pfam domain module=MFS_1::MFS_Mycoplasma; Domain location=1-277::59-287
SSQKSGPDRPGDCHPVLLTAWLHGIHTYQQALLLGVFLGFAGAAFAVALPLASRWYPPEHQGTALGIAGAGNSGTALAALFAPGLAVAFGWSNVFGLALIPLALALIVYVLMAKDAPDAPAPKSMSQYLSVLKDKDAWWFMFFYSVTFGGFVGMASSLTIYFHDQYGLDPVHAGYFTAACVFAGSLVRPFGGLLADRIGGIRSLSAMYILAALFLFTLSVGIETQLIGLGVVMLAMAALGMGNGAVFQLVPQRFRKEIGVMTGLVGMAGGVGGFYLASSLGYSKQITGSYQVGLTIFAGLAILALIGLSNVKNRWRTTWGAATVTSAKI

SEQ ID NO: 172142 - protein, 95 aa, Glycine max
  Coding DNA Sequence Number=SeqID_80457
MDKFDIFVPHPLVITFFLPLECGCKPLVCLLKRPALLSLDFPRPFNQKLLLLHIWTTIDTSKPYTRAIRGTMRKPQANLGADQKFSPNRFSATRS

SEQ ID NO: 172143 - protein, 196 aa, Glycine max
  Coding DNA Sequence Number=SeqID_80458
MVPSRKDKERHLARFLDIFKKLEITLPFGEALQQMALYAKILKDMLTKKNRYIHSDCRNLPFCGRARRGSRVDKGVSLAPMYSSIVIRKSDLRSSFKRGESSDSFLLGRRSFKALDLKMIHFTWRENGLSDRSKLVKNGRKETESERNKDESQKNGNELKVSDLETYSLKNEERMKNGEERRKTFTDLLTETSRKH

SEQ ID NO: 172144 - protein, 205 aa, Glycine max
  Coding DNA Sequence Number=SeqID_80459
MAKFINYPLTNEEIEVNLEFEDHLKSFKEMHEEAQRLAVLNKKLKSKLKLHITKLASTQGEVNKLKQENEKVVSSCKATGCDYTSTSFYMDDHKSLQTKFENFKMDHYAKRMKLQTELSYHKDMFEKLNKGKSNLNHMLTVQKHTTDKTSLAYNMQTTFSKKTKFVSSKGVNPNKVSKKRNIVYSKRNAKTCHYCMKRSHTSYKC

SEQ ID NO: 172145 - protein, 284 aa, Glycine max
  Coding DNA Sequence Number=SeqID_80460
  Homolog annotation: Hit_ID=A2ZFJ9; Match level="QueryCoverage=100%, HitCoverage=26%, E-value=1e-154, Identity=94%"; Hit description =Putative uncharacterized protein
  Pfam annotation: Domain name=DUF395; Domain location=106-170; Score =74.3; E_value=3.9e-19; Accession=PF04143.5; Description=YeeEYedE family (DUF395)
MSWQQFKSQYLVRFWAPLPAVIAAGILSTYYFGMTGTFWAVTGEFTRWGGHVLQWFGLHPEQWGYFKVIGLQGTPLERIDGRMIIGMFAGCIAAALWANNIKLRQPQHRIRIVQALLGGIIAGFGARLAMGCNLAAFFTGIPQFSLHAWFFALATAAGSYFGAKFTLLPMFRIPVKLQKVKAAAPLTQKPEQARRRFRLGMAVFGLAVAWSLWTLFDAPKLGIAMLFGIGFGLLIERAQICFTSAFRDLWITGRTHMAKAIIIGMAVSAIGIFSYVQLGVAPKI

SEQ ID NO: 172146 - protein, 57 aa, Glycine max
  Coding DNA Sequence Number=SeqID_80461
DDGIQELRAIPFKGGGDGTKIDQEELKINTSDIQREVNGVGAVWNPHQGLSLITWLF

SEQ ID NO: 172147 - protein, 186 aa, Glycine max
  Coding DNA Sequence Number=SeqID_80462
  Gene Ontology: Mol. function=helicase activity; Biological process =viral genome replication
  Homolog annotation: Hit_ID=Q2A9I1; Match level="QueryCoverage=93%, HitCoverage=12%, E-value=3e-30, Identity=39%"; Hit description =Putative uncharacterized protein
MMLGSCKGPTSFEDIRTVANIQYPTYRETCFAMGFLQDDREYVEAIKEAKDWGIANYLRKLFVLILLIGAMSKPEEVWNQCWHWLVDDIAYQHSKSTMNSKLQINDDTLRNLTLIEIEQLLHINQRSLKDYPTMSYPQDINLTSYLQNNLVLSELDYNHDATRSEFEHLFASMTGNLPIHILCGIL

SEQ ID NO: 172148 - protein, 187 aa, Glycine max
  Coding DNA Sequence Number=SeqID_80463
  Homolog annotation: Hit_ID=UPI00016621D1; Match level="QueryCoverage =98%, HitCoverage=43%, E-value=2e-12, Identity=33%"; Hit description =UPI00016621D1 related cluster
TTRPHLSSRGLHALAIRGLHALTNRGLHVLAFRGLHILTFRGLHVLTFIGLHALTFRGLHVLAFRGLHVLTFIGLHVLHFRGPNILIFRGLHVLIFRGLHVLTFIGLHVLHFRGPNILIFRGLHILTVIRLHALTFKGLHVRAFRGTRHSRLQRATHLHFQCTTRPSLQRATRSRFQRAQHLHFKRI

SEQ ID NO: 172149 - protein, 100 aa, Glycine max
  Coding DNA Sequence Number=SeqID_80464
MTHHNFQVQAIGLFAQATCALEFGLPRPFNQRLLVLHVGEGAVKQRGQRFPCVQESPTTRDPRSLNPFSEIRRREEEISLKRDRLYNEDQSKFLIEYASG

SEQ ID NO: 172150 - protein, 313 aa, Glycine max
  Coding DNA Sequence Number=SeqID_80465
  Gene Ontology: Mol. function=CTP synthase activity; Cellular component=cellular_component; Biological process=pyrimidine nucleotide biosynthetic process
  Homolog annotation: Hit_ID=Q8PLS3; Match level="QueryCoverage=100%, HitCoverage=56%, E-value=1e-155, Identity=87%"; Hit description=CTP synthase
  Pfam annotation: Domain name=CTP_synth_N; Domain location=1-241; Score=551.4; E_value=9.6e-163; Accession=PF06418.5; Description=CTP synthase N-terminus
MMKLDPYINVDPGTMSPFQHGEVYVTDDGAETDLDLGHYERFVRTRLSRKNSVTTGRIYENVIRKERRGDYLGATVQVIPHITDEIRRCIDEATEGYDVALVEIGGTVGDIESLPFLEAIRQVRTERGPEKALFMHLTLVPYIGAAGELKTKPTQHSVKELRSIGIQPDVLLCRSEQAVPDSERRKIAQFTNVSERAVISVPDVDVLYRIPSGLHAQGLDEIVVNQLKLADKAGPVDLSMWEDAVDATLHPLDEVTIAVVGKYVDHQDAYKSVGEALKHGGLRQRTKVNLKWLEAQDLEGTDMAALADVDGIL

SEQ ID NO: 172151 - protein, 27 aa, Glycine max
  Coding DNA Sequence Number=SeqID_80466
MAQNGPRGTIKDTQLYPAAFFLLLYWM

SEQ ID NO: 172152 - protein, 500 aa, Glycine max
  Coding DNA Sequence Number=SeqID_80467
  Gene Ontology: Mol. function=ARF GTPase activator activity; Cellular component=plasma membrane; Biological process=regulation of ARF GTPase activity
  Homolog annotation: Hit_ID=A7P1F8; Match level="QueryCoverage=99%, HitCoverage=99%, E-value=1e-151, Identity=58%"; Hit description =Chromosome chr19 scaffold_4, whole genome shotgun sequence
  Pfam annotation: Domain name=ArfGap; Domain location=40-149; Score =151.4; E_value=2.6e-42; Accession=PF01412.9; Description=Putative GTPase activating protein for Arf
MNCKANVSKELNAKHKKLLMAARFIDLSIFLGINQSEYCGLILEGLLKLPENRGCADCKAKGPRWASVNLGIFICMQCSGIHRSLGVRSATLDTWLPDQVAFIQSMGNEKANSFWEAELPPNYDRVGIENFIRAKYDEKRWIPRDGNSKTPSGLREEKSPSHWQRPVERSGYAAVSENKFEERKKIQPSNAISTTRINVPAPPTASEQVTPITKPQHVEKVEPVAPQPPASQPQAETSKQATDTVQNIPPKVDYATDLFNMLSMDGPNENGSEAAGTTTDDNHWAAAAEVSTAEKTSPPKAADSTPVSASGIEDLFKDLSPVTPSLTPEKPQKDVKNDIMRLFEKGNIVSPFSMHQQQLGMLAHQQSLLMAAAAKSTGGDPRYPASIQQPRPPNVPIQSWPATGYSIPGVMPMGGQGDLQKLMQGQPRSMTPAHFAGSSVQYPPSSFYGMGQVAPPVNGMMTTMGVNKPQSGAPAVSSSPTQSAKDYDFSSLTQGMFTKQ

SEQ ID NO: 172153 - protein, 339 aa, Glycine max
  Coding DNA Sequence Number=SeqID_80468
  Gene Ontology: Mol. function=structural constituent of cell wall
  Homolog annotation: Hit_ID=Q9FG54; Match level="QueryCoverage=100%, HitCoverage=100%, E-value=1e-126, Identity=63%"; Hit description =Root cap protein 2-like protein
  Pfam annotation: Domain name=Root_cap; Domain location=247-303; Score= 123.1; E_value=8.4e-34; Accession=PF06830.2; Description=Root cap
MEITKRSSLLIFFLVFGAGLIHAKAYQNLYCGRGTRCYGKHITCPAECPDSETNNPKTKVCQIDCNKPICKAVCRSRKPNCNAPGSGCYDPRFIGGDGRVFYFHGKTNEHFTLVSDSNLQMNARFIGHRPEGRSRDYTWIQALGILFNSKTFSLEATKTPQWNDELDHFKFTYNGNQVALAEGSLSTWYTEEKDIKVERVASKNGVMVTLKDVAEILVNVVPITKEDDRIHNYQVPSDDCFAHLEVQFRFFALSQKVDGVLGRTYRLDFENPAKPGVAMPVVGGEDKYRTNSLLSPHCGSCVYSQGSSTEKETTPQQVMEYGTLDCTKFSYGLGIVCRK

SEQ ID NO: 172154 - protein, 141 aa, Glycine max
  Coding DNA Sequence Number=SeqID_80469
  Homolog annotation: Hit_ID=A7P1G9; Match level="QueryCoverage=90%, HitCoverage=83%, E-value=7e-16, Identity=51%"; Hit description =Chromosome chr19 scaffold_4, whole genome shotgun sequence
  Pfam annotation: Domain name=Root_cap; Domain location=94-138; Score =34.9; E_value=3e-07; Accession=PF06830.2; Description=Root cap
MAVSRSNGLIFVMFFAIFVMHINAETQTCTNRRSPCFLKKIQCAAECPSKSPTNLKAKVCYPLCNTQCKNCNQTAMALDLHAWTPTLLVQMEVLFKFYGLSSRVEGVLGRTYQPDFQNPAKPGVAMLVDSFSLLLHQYREN

SEQ ID NO: 172155 - protein, 601 aa, Glycine max
  Coding DNA Sequence Number=SeqID_80470
  Gene Ontology: Cellular component=nucleus; Biological process=cell division
  Homolog annotation: Hit_ID=A8Y921; Match level="QueryCoverage=40%, HitCoverage=69%, E-value=3e-15, Identity=27%"; Hit description=D6 -type cyclin
  Pfam annotation: Domain name=Cyclin_N; Domain location=16-147; Score =1.0; E_value=9.7e-05; Accession=PF00134.14; Description=Cyclin, N -terminal domain
MDSKTEFPIPSDKERQAINNYLQIEREFMATKGFYKAERNLLHRKHAVATIAKLSQGQVVDAYVAYLAMNYFDRYASSTNPFAVGLGSSVTDTVCFVATCCFMLSAKMRSNQFDLQQFLFEKDLNYQPTRLAAMELSILSGLNWRMLPITPFYFLDHYYPTFSEIGGFKRRSINEIIVQSQGVHQFTEFKPSHIAISAFLAATFVGYPSEFNAIQKSLDKPGKLEGCWRQLVHLCHRSAIEICSASGTVISATKIRTKLPIQSEEAAAEEASEIQTRKSEVQKYSTTKFIQFTVLDTEEEENVAPLIRRRRRERVEATEEGAEPEAETEATKQQGLDQGKAVTVGDSSEQKDAEAETKVNPKEHDKGIGEIEEICEEHVEAESELRLRKAKGKAKVGEEVLEKGKATIISEIVPAEEAAPKTLMNFDLRWSTSVPEYVEDSEQVEDTACFGVRCPGTILGSGDDSPLKSFQGYLINLRRFPSPTISRVALDRQASMRKILEIISKSKHLLLWGHACMMESTTQKNKGKKSSLLMRFKPVMGIDDSIIPKRNGSDPVLSYLAVAYNDGAVLPAMLSSLFGAAHALKTVISATTLVVFFFLPQ

SEQ ID NO: 172156 - protein, 992 aa, Glycine max
  Coding DNA Sequence Number=SeqID_80471
  Gene Ontology: Mol. function=nucleotide binding; Cellular component =cytoplasm; Biological process=defense response
  Homolog annotation: Hit_ID=A7P236; Match level="QueryCoverage=98%, HitCoverage=90%, E-value=1e-148, Identity=36%"; Hit description =Chromosome chr19 scaffold_4, whole genome shotgun sequence
  Pfam annotation: Domain name=LRR_1; Domain location=537-559; Score =0.1; E_value=2.9e+02; Accession=PF00560.24; Description=Leucine Rich Repeat
  Pfam annotation: Domain name=LRR_1; Domain location=561-584; Score =11.7; E_value=2; Accession=PF00560.24; Description=Leucine Rich Repeat
  Pfam annotation: Domain name=LRR_1; Domain location=586-607; Score =12.3; E_value=1.6; Accession=PF00560.24; Description=Leucine Rich Repeat
  Pfam annotation: Domain name=LRR_1; Domain location=609-630; Score =6.7; E_value=18; Accession=PF00560.24; Description=Leucine Rich Repeat
  Pfam annotation: Domain name=LRR_1; Domain location=632-653; Score =12.1; E_value=1.8; Accession=PF00560.24; Description=Leucine Rich Repeat
  Pfam annotation: Domain name=LRR_1; Domain location=655-679; Score =0.9; E_value=2.1e+02; Accession=PF00560.24; Description=Leucine Rich Repeat
  Pfam annotation: Domain name=LRR_1; Domain location=778-799; Score =2.3; E_value=1.1e+02; Accession=PF00560.24; Description=Leucine Rich Repeat
  Pfam annotation: Domain name=LRR_1; Domain location=868-892; Score =1.2; E_value=1.8e+02; Accession=PF00560.24; Description=Leucine Rich Repeat
  Pfam annotation: Domain name=LRR_1; Domain location=894-915; Score =1.3; E_value=1.7e+02; Accession=PF00560.24; Description=Leucine Rich Repeat
  Pfam annotation: Domain name=LRR_1; Domain location=939-958; Score =1.5; E_value=1.6e+02; Accession=PF00560.24; Description=Leucine Rich Repeat
  Pfam annotation: Domain name=MMR_HSR1; Domain location=164-267; Score= -18.2; E_value=0.049; Accession=PF01926.14; Description=GTPase of unknown function
  Pfam annotation: Domain name=NACHT; Domain location=164-312; Score= -30.7; E_value=0.015; Accession=PF05729.3; Description=NACHT domain
  Pfam annotation: Domain name=NB-ARC; Domain location=131-426; Score =207.1; E_value=4.2e-59; Accession=PF00931.13; Description=NB-ARC domain
  Pfam module annotation: Pfam domain module=LRR_1::LRR_1::LRR_1::LRR _1::LRR_1::LRR_1::LRR_1::LRR_1::LRR_1::LRR_1::MMR_HSR1::NACHT::NB -ARC; Domain location=537-559::561-584::586-607::609-630::632 -653::655-679::778-799::...
  Pfam module annotation: Domain location=868-892::894-915::939 -958::164-267::164-312::131-426
MATRIIESLVKISETYSLIFDLLYGFNSFNDNVQVLEMKLEELCSLEYDINKELEIAELQQGKKRKREVENWQRNVQRKKIEVYGIVQELRDCGVFKHLKLTAQVKKLIGQVTDLVECGRFPKGIVGCAHESRGYALLTTKLAGAMFQKNVAKIWDWLMNDGELIIGVYGMGGVGKTSMLMHIHNMLLTRVTNFDSVFWVTLSQSFSIHKLQCDVAKIVGLDISKESDERKRAARLSWTLMRRKRCVLFLDDVWSYFPLEKVGIPVREGLKLVLTSRSLEVCRRMNCQNNVKVEPLAKEEAWTLFLDNLGQQTTLSPEVTKVARSVAKECAGLPLAIITMARSMRGVEEICEWRHALEELRNTEIRLEEMEMEVLRVLQFSYDHLNDNMLQKCFLCCALYPEDFEIDRDVLIESFVDEGLVNGMKSLEAMFDEGQTILNKLENSCLLGKVENYVGGKKCMGLQDASSHIAISMMKRGCQCVAPIDNVEGYYVGSQLVKMHDLVRAMAINVIKVNYHFLVKAGLQLTEIPDEVEWNEDLEKVSLMCNWIHEIPTGISPRCPKLRTLILKHNESLTSISDSFFVHMSSLQVLDLSFTDIEVLPKSVADLNTLTALLLTSCKRLKHMPSLAKLQTLIRLDLSFTAITEIPQDLETLVNLKWLNLYAKNLVSTGKEIAKLIHLQFLILHWWSRKIKVKVEHISCLGKLETFAGNLYNMQHFNAYVKTMHEYGPRSYLLQLDSEESPGKSPWYFFAEVCFSKDVIISNCKIRTGVTPLMLPSDIQRLKVERCHDIRSLCDILSLKNATSLKRCEIADCDGQEYLFSLCCSSSCCTSLHNIESVELYNLKNLHTLCKENEAVAQTLPPPGAFTCLKYFCIYHCPIIKKLLTPGLLAYLQNLEEIIVHNCKSMEEIISVDGIDYESSGGNKYCVANRDAVKVTHPKLVSLSLKHLPELRSICRGLMICESLQNFRIFKCPKLIRLPETATPVQTLYDCF

SEQ ID NO: 172157 - protein, 123 aa, Glycine max
  Coding DNA Sequence Number=SeqID_80472
  Homolog annotation: Hit_ID=A7P1E6; Match level="QueryCoverage=65%, HitCoverage=41%, E-value=3e-24, Identity=55%"; Hit description =Chromosome chr19 scaffold_4, whole genome shotgun sequence
  Pfam annotation: Domain name=DUF1223; Domain location=23-123; Score= -45.2; E_value=6.9e-07; Accession=PF06764.2; Description=Protein of unknown function (DUF1223)
MAPRLLSCFRNKHAGGCSHHDEGCGASSEESAAGAREAAGEGPVLVEMFTSQGCATSPAADLDPFGSSQWTVRQKAYVEALGLDTLFTPQVVVQGQAHLEGNDDNALISAITSAPRFPAPTFQ

SEQ ID NO: 172158 - protein, 57 aa, Glycine max
  Coding DNA Sequence Number=SeqID_80473
MFGSKGENLGKSRRMGPVHGHPDGLVDLAVIDAFLAFHDRKESLVVAILVDLYDTFD

SEQ ID NO: 172159 - protein, 114 aa, Glycine max
  Coding DNA Sequence Number=SeqID_80474
  Subcellular localization annotation: CTP_CleavageSite=30; ConfidenceScore=5.28e-01
MYPLLFSITTTQVDVPSTCTTKDVPSNVLRQSSQAGKGRIKRILRLCRFEFFEKGEGRHKRIQAVSPLFFWKREKRDTKRIQVNKVRKPENLESFWKKKKKKKFKKIFKEIRRL

SEQ ID NO: 172160 - protein, 206 aa, Glycine max
  Coding DNA Sequence Number=SeqID_80475
THLLLEVASPLSFPFSIPLPFIFQEAKESIDEEDPRLTSSNGACIILGLQAPMELASLDVLAVRGLHVLTFRGLDVLAVRGLDVLAFRGLHVLHFRGLHVLAFRGLCALAFSGIHIRTLREFQLLCIPGQDFTRATAKRRVWIMRTNMTTLTRIWMTLLLSNIPSSGRNTDVPLWRDRAHKTPSGPGGAQQGPGVSSCGYGPLSVL

SEQ ID NO: 172161 - protein, 68 aa, Glycine max
  Coding DNA Sequence Number=SeqID_80476
MWLKPPQIPLRSRRHRDPSSPMDIRMFSPLLLDIQSTLDVFVLLEPVSPSSNTWIGSTDVLQLFLPAS

SEQ ID NO: 172162 - protein, 146 aa, Glycine max
  Coding DNA Sequence Number=SeqID_80477
MSRNFTDCATMPSFDFRHITELHELPNDGPQQQMPSLYDRTMKLEETLAQFMQVPMSNQKSTESAIKNLQVQVGQLAKQLAERPSNSFTSNTEKNPKEDYKAMITRSRMLADEPTLEPVDDLVELEESVEEAEGVEEEDKVVECKE

SEQ ID NO: 172163 - protein, 34 aa, Glycine max
  Coding DNA Sequence Number=SeqID_80478
MGVQIATRPTWAFQKIPPEGGGEVKRKIVQQPSS

SEQ ID NO: 172164 - protein, 99 aa, Glycine max
  Coding DNA Sequence Number=SeqID_80479
MAARNERERLLTEALNNLAQVMANQGGSGGATMYHGEIEKIFRVMECQDHQRCCLLLYMLADEAEYWWEYYSPTFRGSRWCCCPMGDFQTNFSGEVFSR

SEQ ID NO: 172165 - protein, 253 aa, Glycine max
  Coding DNA Sequence Number=SeqID_80480
SIDIAIVKEFYANLYYPEDKSTKQVRVRGHLVKFDEDTLNTFLKTPVILEELENLCTYSRFALLRPDPQELVAKLCIPGRGFKLNADGHPLKILRKNMTTLAQTWSVLSFSSLIPTSHTSNVTLDRAKLIYGIIMKMDMNLGYLISHQISLIAQHDTSRLGFLALITTLCKARGVQSDSRSLENLSPAINLAYIKKNCWNLNDPIVTFRGPRKARGKRSEVPTTSTPPETPAPSSSAAPVPLIQTPVIPPTFT

SEQ ID NO: 172166 - protein, 57 aa, Glycine max
  Coding DNA Sequence Number=SeqID_80481
MYMSALARKYDRLALSSQATRLIGKSDSPESAPDRQVFKIKTDESEYRTQGTSIRQG

SEQ ID NO: 172167 - protein, 164 aa, Glycine max
  Coding DNA Sequence Number=SeqID_80482
MGSKSTLRLMRTLGPSLGSLAQSTWSLLPNSLAGSHNSCKSLSEEFHDYYEGRHRSHLRPHSHRREKERKSQEANINLSYFHGKDNVEANLDWEIRIEQQLKMKSTSKSYGSHSYPKKDQGQGILGVTPSKPKDDKGKTIEKQPLKASMQEKTSSMKCFKCFGR

SEQ ID NO: 172168 - protein, 101 aa, Glycine max
  Coding DNA Sequence Number=SeqID_80483
SNSSRLGFPALITALYKARGVTSDSFSYESLSPAINLAYIKKNIWNLDEPSVYFPGTHKARAKAAEIPSSSTPQDPSVPTSAPPLAPAHPGPSTDLIMAML

SEQ ID NO: 172169 - protein, 170 aa, Glycine max
  Coding DNA Sequence Number=SeqID_80484
MTQELVTREDTLQLSAPRHSVTPSVIDEQRPIWSSAPFPEMSTSSGGDFFKSHKLSRTTSKSLAFVGRPTISVILTLRSCDMRRQNLVIPHPFAIQTQSCPMARRDKIWSFCTLLSSRGGGPDDMRRQNLVILHPFAIQTQWCPMARRDKIWSFCTLLSSRGGGPDDMRR

SEQ ID NO: 172170 - protein, 220 aa, Glycine max
  Coding DNA Sequence Number=SeqID_80485
  Homolog annotation: Hit_ID=A5C6I7; Match level="QueryCoverage=79%, HitCoverage=14%, E-value=8e-09, Identity=28%"; Hit description =Putative uncharacterized protein
  Pfam annotation: Domain name=zf-CCHC; Domain location=138-155; Score =28.3; E_value=2.8e-05; Accession=PF00098.14; Description=Zinc knuckle
MSLHSSSSVNGEGSTPKDPLRCHKSHTKHHFQRREKDRRTQEVNISLPYFHGKDNVEAYLDWKIKVEQLFACHHISEERNVPLATLTFNGMPFIGGLPLKDQAHGILGAVPSKPKEDKGKTIEKYIPKISSQERTSNIKCFKCLGRGHIASQCPTKKTMIMRGQDIYSSQEETTSCPSSRGSEDEVRGEESCEEVYPHEEGDLLMVRRLLGGQSCDLSQS

SEQ ID NO: 172171 - protein, 17 aa, Glycine max
  Coding DNA Sequence Number=SeqID_80486
MFCVIDYNDLVIDYNDL

SEQ ID NO: 172172 - protein, 301 aa, Glycine max
  Coding DNA Sequence Number=SeqID_80487
  Gene Ontology: Biological process=transposition, DNA-mediated
  Homolog annotation: Hit_ID=Q6UUU1; Match level="QueryCoverage=19%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSMSAPRPKLVYEGDFWNAIMAGHKVVQDGVLLYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 172173 - protein, 123 aa, Glycine max
  Coding DNA Sequence Number=SeqID_80488
MDKVDIIGGDYCSQCLMKGIVVMKDGFKKCHHKVSTLDDLASCLDKMTLLAEEDDRIIEAREKAPPSTQGLGRRRESVDAEAHVIPAMPEQQHGMYYTPDQFTQESSQMSPLYPYPYQSETSS

SEQ ID NO: 172174 - protein, 150 aa, Glycine max
  Coding DNA Sequence Number=SeqID_80489
MVRTRGLGRALGAGRGRGISEDAHEADVPRRRRPTASARRQRVCLREDITERPEDVPQLHEDVPHVSDATLEMTGAVDAVQTEGVATDGSLGSPVADVGFPGGPRNPSILTDFAEHVAHSIWSGQERPDLKMVSHGRKVDKIGRPAPEIE

SEQ ID NO: 172175 - protein, 65 aa, Glycine max
  Coding DNA Sequence Number=SeqID_80490
REFAKRNLQWLSVRKNPKEDKLSSSLSAPLQVIKRAASAHPLSETSVLSQNPLMCAKRSKSALSA

SEQ ID NO: 172176 - protein, 168 aa, Glycine max
  Coding DNA Sequence Number=SeqID_80491
MKADMEALKEQMATMMKVMMSIKEIMEANVVAVAAASAVAKHAFPPYGLPPNYTPPNVAYTPNENVNNSTPILIESQQPQSNHAHVSQTVGETHEIPHHNLADFEPCLGYATEGQAVGDIPLQNTLEGPQYHPQPHLLHSALGKNPHAMTEMGKLDHLEERLKAIEGG

SEQ ID NO: 172177 - protein, 524 aa, Glycine max
  Coding DNA Sequence Number=SeqID_80492
  Gene Ontology: Mol. function=oxidoreductase activity; Cellular component=membrane; Biological process=electron transport
  Homolog annotation: Hit_ID=A8G7P2; Match level="QueryCoverage=60%, HitCoverage=91%, E-value=1e-149, Identity=79%"; Hit description =Putative uncharacterized protein precursor
  Pfam annotation: Domain name=FMN_red; Domain location=20-189; Score =203.5; E_value=5.2e-58; Accession=PF03358.6; Description=NADPH -dependent FMN reductase
  Pfam annotation: Domain name=Flavodoxin_2; Domain location=20-176; Score=-52.7; E_value=0.0015; Accession=PF02525.8; Description =Flavodoxin-like fold
  Pfam module annotation: Pfam domain module=FMN_red::Flavodoxin_2; Domain location=20-189::20-176
MLYAESAHSKGRITMSDQALKIVTLLGSLRKGSYNAMVARALPGLAPQGVTIEALPSIRDIPLYDADMQQGEGFPAAVEAIAEQIRQADGVIIVTPEYNYSVPGGLKNAIDWLSRLPNQPLAGKPVAIQTSSMGPIGGARCQYHLRQILVFLDAMVMNKPEFMGGVIQSKVDEQAGELSDQGTLDFLTGQLSAFSDFIRRVDPAFAADMRYPAGEEPLELPAHSALNAQLSRSAQNQEDKKLGAMSLYLTLMREDGRNVWAPYQLAVSSAEKGQTELAERYLQLSADRGLWYYYNLLEDDAFNSIQHSATYQSILAATKARYLQHARHYEGKASYAMPDGEAPPEGWPTVIFLHTYGKAAAISPEERLLFGEMGVAYIELNGTQMLSENSFRWSNYSDESTQTAIQRTLQQLAPQLKLNPRRIYLSARGQGALHAANLIAKYPQFYAGALLIAPNGEIKPAQQSLAAQKKIVMAYYDRQNFSEQALALHFANLFGEDNQVQTLHFAQGEDAAGSWQARFKRRCS

SEQ ID NO: 172178 - protein, 172 aa, Glycine max
  Coding DNA Sequence Number=SeqID_80493
  Gene Ontology: Mol. function=RNA methyltransferase activity; Biological process=RNA processing
  Homolog annotation: Hit_ID=A7MH17; Match level="QueryCoverage=83%, HitCoverage=35%, E-value=1e-19, Identity=45%"; Hit description =Putative uncharacterized protein
MLEEQMNDEFKGKSGKVKVMYVRDEEGGQKPNPRTGKGGRPAARQEENRRSGPRSTRNNEESGRPRTARGDDAGRSRGPRDDSARGRRSDRDDRGFSDSPWRTVSRPPVAAEADAGDEAASSKPVIDPELIRRQRQEETRVYGEKRLPGAVPEPSRKLYRPRLVYPERDPAL

SEQ ID NO: 172179 - protein, 373 aa, Glycine max
  Coding DNA Sequence Number=SeqID_80494
  Gene Ontology: Mol. function=N-acetyltransferase activity; Biological process=metabolic process
  Homolog annotation: Hit_ID=A7MH14; Match level="QueryCoverage=56%, HitCoverage=23%, E-value=1e-70, Identity=67%"; Hit description =Putative uncharacterized protein
MPIPRAGANDEPTWTGSAVTTEINCGAGCVDKTGPRWLSDDAQPAGGRLWRSGVAGHAQIQGGQRRAGLAGCGHPALRPRSGDYLHPRQTQSGTFTAAGRKRLLCQPVADAPAGPQQSGPVSPLAGAECQLLTGTDCERTHRLYFAIGGGDSLDIDVDDLLDFLARDGKTSAILLYLEHLSDARRFVSASRSAARNKPILVIKSGRSHQAQAMIGTASGLDAAWDAAIQRAGLLRVQDTHELFSAVESLSHMRPLRGERLMIISNGAAPAALALDELYARNGKLATLDEPTLQALAALLPEGIGRGNPLDLKDHATPALYVACVTQLLDSHELDALMIIHSPSAVSPASETATQIIAAVAAHPRGKQVTLLTN

SEQ ID NO: 172180 - protein, 187 aa, Glycine max
  Coding DNA Sequence Number=SeqID_80495
  Gene Ontology: Mol. function=N-acetylmuramoyl-L-alanine amidase activity; Cellular component=cytoplasm; Biological process=cell wall organization and biogenesis
  Homolog annotation: Hit_ID=P82974; Match level="QueryCoverage=99%, HitCoverage=99%, E-value=4e-91, Identity=82%"; Hit description =Protein ampD
  Pfam annotation: Domain name=Amidase_2; Domain location=17-174; Score= 203.6; E_value=4.9e-58; Accession=PF01510.16; Description=N -acetylmuramoyl-L-alanine amidase
MQLNGGWLVGARRVPSPHHDCRPDDENPSLLVVHNISLPPGEFGGPWIDALFTGTLDADAHPYFAGIAHLRVSAHCLIRRDGEIVQYVPFDKRAWHAGVSSYHGRERCNDFSIGIELEGTDTQAYTEAQYQQLVVITQALIQRYLGIADNITGHCDIAPIRKTDPGPAFDWAKYRGMLAASSHKEIP

SEQ ID NO: 172181 - protein, 53 aa, Glycine max
  Coding DNA Sequence Number=SeqID_80496
MSNDPRNNKVDDLGDDKEGWVGVVGASDCPWQRWPTAAAVEDDPFLFFNDSSI

SEQ ID NO: 172182 - protein, 52 aa, Glycine max
  Coding DNA Sequence Number=SeqID_80497
MKFDRSGEEFIEELWVDILTYASAQYRAECFGLGYYVESTTLYLHTSEFVLK

SEQ ID NO: 172183 - protein, 116 aa, Glycine max
  Coding DNA Sequence Number=SeqID_80498
MKTSWKHYGSASAWIFFMETIFLTNSERILNTRKAEHFYSALFPQFIGEKREVVAAQLAQASWVASTRRMLRNFTDYATMPFLTSRMLWNFTDRATMLPFNFRHVAELHGLPNDWC

SEQ ID NO: 172184 - protein, 239 aa, Glycine max
  Coding DNA Sequence Number=SeqID_80499
  Gene Ontology: Mol. function=solute:hydrogen antiporter activity; Cellular component=integral to membrane; Biological process =regulation of pH
  Homolog annotation: Hit_ID=A2Q189; Match level="QueryCoverage=95%, HitCoverage=57%, E-value=8e-72, Identity=64%"; Hit description =Sodium/hydrogen exchanger
  Pfam annotation: Domain name=Na_H_Exchanger; Domain location=30-239; Score=-109.6; E_value=0.097; Accession=PF00999.12; Description =Sodiumhydrogen exchanger family
MTFNASTITTASEGAWQGDNPLNHALPLLIVQTILVVFVSRTLAFLLKPFRQPKVVAEIIGGILLGPSAIGRNKKFMHIVFPAWSTTMLESVASFGLLFYLFLVGLELDFRTIRRSGKQAFNIAVAGITLPFICAVGVTFLLQRAIRSENHNIGYVQHFVFLGVSLSITAFPVLARILAELKLLTTRVGETAMAAAAFNDVAAWVLLALAVALAGQGHKSSLLTSIWVLFSGGPTIVIT

SEQ ID NO: 172185 - protein, 988 aa, Glycine max
  Coding DNA Sequence Number=SeqID_80500
  Homolog annotation: Hit_ID=Q949M4; Match level="QueryCoverage=99%, HitCoverage=99%, E-value=1e-161, Identity=40%"; Hit description =Putative uncharacterized protein At4g28760
MNGVQNRRVHNVEKPFPGCLGRVVNLFDLTGGVNGNKLLTDRPHRDASSLSRSQSDVARIMSPTLGDQIEDKLIVSDSMRATNKKINGTPIKMLIDQEMSKEVVSKHNPPPNVVAKLMGLEALPQGELSVERSHRGDYSQHMCGHSGTPFNHWNLEDRFMDKEMLHEVHPNTEQIAYKDIYEIWLQSQRTSNVRDKTPEREKWTEDVNGKKMALIRQKFMEAKRLSTDERLRQSKEFEDALEVLSSNNDLLVRLLDSQNLYELQSTPVAETKRITVLKPSKMVDNENSGGKGKKNDKQIKKPANVGAGWEKYSPAYSPASQKIDEFAVQPTRIVVLKPSPGKAHEIKAVSSPTMSSPRNLQSGNFYQEPEDDDDVLESRKVPSQITQQMHENLRSHQRDEILYSSVFSNGYTGDESSFNKSDHEYTAGNFSDLEVMSPSPRHSWDYINRSGSPFSSSSFSRASCSPESSVCREAKKRLSERWAMMSNKGSQEQRHMRRSSTLGEMLALSDIKKSVISELEGIHKEQEPSESVSCSRNFKAETCMDGSPRNLSRSKSVPTSSTVYENGLNVEVCDNDAGKAHGSGELTKSKSMKSSFKGKVTSFFFSRNKKPSREKSCLSQSVDESQSTAIETSDSPVNSSRVLRDDVSQSFDSGSIGECSLPAPYESSGKILSDSISNGQGAVPLEIMECSRIIHAGLTLSKSMVPGISSENQDQPSPISVLEPPFEDDNAVVESLGCVRGGQLGSRVSLKSNLIDKSPPIESIARTLSWDDSCAEVASPYPLRPSSASLDTKQDWLVFVKKLLSAAGIDDQVQPGSFYSRWHSLESPLDPSLRDKYANLNDKEPQQQLHEAKRRQRRSNQKLVFDCVNVSLIEITGYGSEKNYLMGSRLCSGSHSRVQVPEAASPPLVDLIVAQMKELISSAMSSVWVVDCGDSNSLVVESVVRKEVVGKGWVELMRLEMDILVKEVEGKLLEELVEDAVVDLTGRA

SEQ ID NO: 172186 - protein, 1403 aa, Glycine max
  Coding DNA Sequence Number=SeqID_80501
  Gene Ontology: Mol. function=binding; Cellular component =cytoskeleton; Biological process=cell division
  Homolog annotation: Hit_ID=A7Q1F1; Match level="QueryCoverage=90%, HitCoverage=91%, E-value=0.0, Identity=72%"; Hit description =Chromosome chr7 scaffold_44, whole genome shotgun sequence
  Pfam annotation: Domain name=HEAT; Domain location=1239-1275; Score =22.2; E_value=0.0019; Accession=PF02985.13; Description=HEAT repeat
  Pfam annotation: Domain name=HEAT; Domain location=1328-1363; Score =19.3; E_value=0.015; Accession=PF02985.13; Description=HEAT repeat
  Pfam annotation: Domain name=HEAT; Domain location=171-207; Score =34.6; E_value=3.5e-07; Accession=PF02985.13; Description=HEAT repeat
  Pfam annotation: Domain name=HEAT; Domain location=341-377; Score =10.1; E_value=0.85; Accession=PF02985.13; Description=HEAT repeat
  Pfam annotation: Domain name=HEAT; Domain location=465-497; Score =1.5; E_value=16; Accession=PF02985.13; Description=HEAT repeat
  Pfam annotation: Domain name=HEAT; Domain location=799-832; Score =1.7; E_value=15; Accession=PF02985.13; Description=HEAT repeat
  Pfam annotation: Domain name=HEAT; Domain location=841-876; Score =22.2; E_value=0.002; Accession=PF02985.13; Description=HEAT repeat
  Pfam annotation: Domain name=HEAT; Domain location=881-917; Score =20.2; E_value=0.0075; Accession=PF02985.13; Description=HEAT repeat
  Pfam annotation: Domain name=HEAT; Domain location=967-999; Score =8.0; E_value=1.7; Accession=PF02985.13; Description=HEAT repeat
  Pfam module annotation: Pfam domain module=HEAT::HEAT::HEAT::HEAT::HEA T::HEAT::HEAT::HEAT::HEAT; Domain location=1239-1275::1328-1363::171 -207::341-377::465-497::799-832::841-876::881-917::967-999
MGCMRLRMTWERVLRCVERDNPDLGIVWDRCDSGGWWQTTALVTMAGDRQRWKCRAGLSHFDTNLKWLGRVERDDLDLGIVGDRCDGGGWRQTTTLVTMAGNRQRWKCRAGSSNSDTNLKCLSVKICTQKGSSAWPVDGWSFAWAHKSWRVREEFTRTVAAAINLFAATELPLQRAILPPVLHLLNDPNPAVREAAILCIEEMYTQAGPQFRDELHRHNLPSSLVKDINARLEGIQPKVRSSDGPGGYITGEIKHASVNPKKSSPKAKSSSRENSLFGGEGDITEKPVDPVKVYSDKELIREFEKIASTLVPEKDWSIRTAALQRVEGLVLGGAVDYPCFRGLLKQLVGPLSTQLSDRRSTIVKQACHLLCFLSKELLGDFEACAEMFIPVLFKLVVITVLVIAESADNCIKTMLRNCKVARVLPRIADCAKNDRNAVLRARCCEYAYLVLEHWPDAPEIHRSADLYEDLIKCCVSDAMSEVRSTARMCYRMFAKTWPERSRRLFSSFDPAIQRDGGIHRRHASPSIRDRGAPTSLSSQASAPSNLPGYGTSAIVAMDKSSSISSGTSISSGILLSQAKSLGKGTERSLESMLHASKQKVSAIESMLRGLDLSDKHNSSSLRSTSLDLGVDPPSSRDPPFPAAVPASNHLTSSLTTESTTSGINKGSNRNGGLGLSDIITQIQASKDSAKLSYRSNVGIEPLSSYSSKRASERQERSSLDDNHDMRETRRYMNPNTDRQYLDAPYRDGNFRESHNSYVPNFQRPLLRKNVAGRMSAGRRSFDDNQLSLGEMSNFADGPASLHEALSEGLSSGSDWSARVAAFNYLHSLLQQGPKGTLEVVQNFEKVMKLFFQHLDDPHHKVAQAALSTLADIVPACRKPFEGYMERILPHVFSRLIDPKELVRQPCSTTLEVVSKTYSIDSLLPALLRSLDEQRSPKAKLAVIEFAINSFNKHAMNPEGAANIGILKLWLAKLTPLVHDKNTKLKEAAITCIISVYSHFDSTAVLNFILSLSVEEQNSLRRALKQYTPRIEVDLINYLQNKKEKQRSKSSYDPSDVVGTSSEDGYVGYSRKAHYLGRYSAGSLDSDGGRKWSSQDSTLIKASLGQASSGETREHLYHNFETDPNSGSLGSKTKDLAYAVNPMGQNFGSQTSQHGHMDSSVSLEGLSTPRLDVNGLMSSEHLNGAEGYANDKEHPSELELNHHSAEDICSGGDGSPISSKRTALQQLVEASITNDHSVWTKYFNQILTVVLEVLDDSDSSVKELALSLIVEMLKNQKGAMENSVEIVIEKLLHVTKDIIPKVSNEAEHCLTIVLSQYDPFRCLSEELMAQLPSFLPALFEAFGNQSADVRKTVVFCLVDIYIMLGRAFLPYLQGLNSTQLKLVTIYANRISQARTGKAIDAVQD

SEQ ID NO: 172187 - protein, 127 aa, Glycine max; identical to SEQ ID NO: 97488
  Coding DNA Sequence Number=SeqID_80502

SEQ ID NO: 172188 - protein, 177 aa, Glycine max
  Coding DNA Sequence Number=SeqID_80503
MASRKRKSIGTRPTTQYDTRRFHSFEAWTRYTDNVLGRHILPERKVEIYHIELDEFKAELERHNFHKRLSNLVDSSIDLALVKEFYANLYSSEGPSPKQVRVRGHLVNIDANSLNTFLETPMVLAEGETLPAYSRYCRLPTDIREIEAALCIPGRRFVLNAEGHPGKILRKDLTTLA

SEQ ID NO: 172189 - protein, 113 aa, Glycine max
  Coding DNA Sequence Number=SeqID_80504
  Subcellular localization annotation: CTP_CleavageSite=75; ConfidenceScore=5.12e-01
MVIRTFRQLGASEPVDTQRPNVVICTLPGDVSIFRSRPRKSLNSAIVTRGPSSTHTHLMVIRTFRHPATTSPMTREDNIWSPGPFLSEDYRSPFYHPEMNKFDDIEMMMVVHF

SEQ ID NO: 172190 - protein, 349 aa, Glycine max
  Coding DNA Sequence Number=SeqID_80505
  Homolog annotation: Hit_ID=A0TT36; Match level="QueryCoverage=40%, HitCoverage=73%, E-value=3e-09, Identity=32%"; Hit description =Putative uncharacterized protein
RQRTAVGGGIADDRQHLAPGPLFAAGDKLAQQRLADAFALLPFGDIHRVFHGKAIGRPGAIRRGVAVAHNMAFAFRHQPGQPGFLHLAQPQLHFRQGRRLFFKRGGTVQHVVGVNAQHGGHIVRRGVKEAEYGSGERHGNACLPWKSADKRHYARRSPPGGSLGRAPVAQCLELPAFHRAAVEDFLGGFGDFVRLIGLDEVLHVRRVLVVFAGDDDVGVRRVLILDEDAVFGWRQAGLVDVGGADDGDGDLWIVQHVRQLRAFQLHDLVTVRVGADVQSCGQQPLALFQRNQSGFFQQQQGAPQVGRIERDGDHRAVRQLFERFYLFGVAGHREDKGIADRHQLIAVIF

SEQ ID NO: 172191 - protein, 201 aa, Glycine max
  Coding DNA Sequence Number=SeqID_80506
NIIEVPSVYHKQWTPDYPDYVVLDYNGKKHHIRVRKFSNRVYIVDGLKHFRRDMGIYEGVMITFAAPDKNWKFDIHFSPPLHAQTCGRPVHSAREYVFTVDVDNRMIVRLYPLVLPLDVVGYVNAGDGYVTVLGVCGHCHFWKLSMHNGLKCFADPWFQFLTENDLMAGDEVVFYFRPNQLLWEVIARKQTVWDEDEDDSP

SEQ ID NO: 172192 - protein, 85 aa, Glycine max
  Coding DNA Sequence Number=SeqID_80507
MSLPSAVHVFSLIRCEASGDWEARYSVVFQIGFFAKRKKEEVEMRVVIAKRAGWTKSVSYLCFPLISDERLVQSVKFRNVAEVEK

SEQ ID NO: 172193 - protein, 144 aa, Glycine max
  Coding DNA Sequence Number=SeqID_80508
MPNTIRAFRPTPETPPIRHPSSKGQLPLHKEPLLKPWEKPSSKEASGVCPNSDVIRGLIAILHRQPIGGGNPPKNLPVSFPEMVQPRRDLHVSRRMANIPRRWPKCEDKSARQSWGTDGKCNRGVQTAKTQANEGRGNLKKVYL

SEQ ID NO: 172194 - protein, 119 aa, Glycine max
  Coding DNA Sequence Number=SeqID_80509
  Subcellular localization annotation: CTP_CleavageSite=33; ConfidenceScore=5.01e-01
MHVLSASSARSARHFSPSRLSTSLVLRENLLTRAKRKNGAKHDVEYFIITCLWLDHPYVCTVRGFSIERCIVSLELDRAGFGYRMSGHGVRALDRRLQEDWAKDAREGPRVLMSLRVDF

SEQ ID NO: 172195 - protein, 206 aa, Glycine max
  Coding DNA Sequence Number=SeqID_80510
  Homolog annotation: Hit_ID=UPI00006A2D9E; Match level="QueryCoverage =84%, HitCoverage=85%, E-value=3e-14, Identity=15%"; Hit description =UPI00006A2D9E related cluster
RGLHALAFRGLHLLSFRGLHVLTFKGLYALTFVGLHALTFRGLHALAFRGLHVLVVRGLHALAFRGLHVLTFIGLHVLAFRGLHLLTFRGLHALAFRGLHILTFRGLHAFAFIGLHALTFRGLHFISFRGLHALALRGLRILTFRWLHAHAFRGLHGLTFKGRHILNFRGLHTLFFRGLCVLIFSGLYICTLREFKVSMHVAQQIS

SEQ ID NO: 172196 - protein, 219 aa, Glycine max
  Coding DNA Sequence Number=SeqID_80511
  Homolog annotation: Hit_ID=Q2HW90; Match level="QueryCoverage=68%, HitCoverage=33%, E-value=2e-14, Identity=35%"; Hit description =Putative uncharacterized protein
MGQLQRQAFRKAYGKVWDLARVEVSMEPIASLSQYYDQPLRCFTFEDFQLVPTMKEFEEILGCPLGGRKPYLFSGFYPSTTRVAKYQGSVWRKGQRPWQIKANGLSFIDILALLIFGVVLFPNMEGLVDLAAIDAFLAFHHGKESPVVAILAMYDTFDRGYPSIRYKVTARASKRERESRTSPIASQGQSSGGHLLRPRGDPRTSQLLSAYDRLNGPYD

SEQ ID NO: 172197 - protein, 88 aa, Glycine max
  Coding DNA Sequence Number=SeqID_80512
MSSVSLYYGTQSDIRVKSYCRWNWLRASTFNFERLDLRGAEFNIERLNRLRDSFRHPSKKLLSFELAQSFRIQFRASRYITGLNQTSE

SEQ ID NO: 172198 - protein, 105 aa, Glycine max
  Coding DNA Sequence Number=SeqID_80513
ETSWLWEAKILCWIFPVGSFNSGNWSDSDDLDRTGLSCCTITRNRVHLPEANTCALELISKFVQSEIVGSPRLTTIDASEPYTRAMRGTMHEPQVNLGADKKFSP

SEQ ID NO: 172199 - protein, 111 aa, Glycine max
  Coding DNA Sequence Number=SeqID_80514
LLPAPLSLCHSTTLAKTPCPQGVGIQCMASKSDAEIPSPIKRNNVEELVEGNGGHGGAVGMGSRGGMDGGGGIGSGVSMGDEVGMGGGGDIGNEVSMSREVDMSIVDMMCE

SEQ ID NO: 172200 - protein, 184 aa, Glycine max
  Coding DNA Sequence Number=SeqID_80515
  Subcellular localization annotation: CTP_CleavageSite=41; ConfidenceScore=5.37e-01
MAESSKKRKGSSSTTAAASHRRHGPSEAPKTPIHPSLSSPRSSTLFSSDDQLFKNYGLVEFMSLKLPYYPELVKVFYSNLKIQDDIISSEVHDISMIIDQSLFFSLTKLPSQGAPFEGTIVDDWKFDYSSHDARRMVCNDQAEMTGRLLVGSLTFDCRIMHYIIARILLPRSSNLAQAFEEGIL

SEQ ID NO: 172201 - protein, 208 aa, Glycine max
  Coding DNA Sequence Number=SeqID_80516
  Homolog annotation: Hit_ID=UPI00006A2D9E; Match level="QueryCoverage =80%, HitCoverage=82%, E-value=8e-08, Identity=17%"; Hit description =UPI00006A2D9E related cluster
MVQSTLTFRGLHTSTFKGLHALAFRELRALTFRGLHVVAFRGLHALAFRGLHVLTIRGLHVLAIRGPHALAFKGLHVLNFRGQHVLPFKGLHVLICRRATRPHLQRATRPRLHRATRPHLQRTTFPHLQRTTRPHLQRTTRPRFQRTTCPRLQRTTHPHLERATRPHHQRATRPRLQRATRFHLQRTTRPRLQRTTRPRLQRTTRPCL

SEQ ID NO: 172202 - protein, 28 aa, Glycine max
  Coding DNA Sequence Number=SeqID_80517
MGARYAEKREELEPEKRHGNRGRILAFQ

SEQ ID NO: 172203 - protein, 251 aa, Glycine max
  Coding DNA Sequence Number=SeqID_80518
  Pfam annotation: Domain name=bZIP_1; Domain location=116-179; Score =19.9; E_value=0.0026; Accession=PF00170.12; Description=bZIP transcription factor
MPCLTKELRNMGEAAKKICLASLKNQSCHVGEGSFSSPSTDAKGRNNPELDLTLGISTTHSAQTSDNHNHTSDQVEKNLIKGSPTTPGAGVNFNINQVYERQLSIPGLELKLATEKEDIKKLNRIMSNRASSEKYRTKRTLYMEQLEKLTRALSLQTSNTRQQFEETKNLQQTLLVEQHQLKLQIAAFEKDKIAKEESSNLFYFSDEIRKNIAEVNRLRELQINQLQANQHAMPNSDGGSNAIDAQLDLNL

SEQ ID NO: 172204 - protein, 190 aa, Glycine max
  Coding DNA Sequence Number=SeqID_80519
MYGFLEPQSIQRSGQLQFESESYMKSWMQNSKRDVYLGAYLNGAYWQMVVILPKENVVVWFCSLHNKLYNYLKGIINRPTLFFNTFALALLNNINILMFLVFNNALKGLDDTPQPKSKVGARWIVVKSNRQKGNTECGYYMMHWKSTIILGSFRNNWKTYFNDVRPLEVERLKALRIQWAQYYLKVRNKT

SEQ ID NO: 172205 - protein, 58 aa, Glycine max
  Coding DNA Sequence Number=SeqID_80520
IWLSARLLSLSGICRSENLQLPLSQALIRLAEIMHFKCRGASAERLKASLNTHTAASD

SEQ ID NO: 172206 - protein, 91 aa, Glycine max
  Coding DNA Sequence Number=SeqID_80521
YILCGTSRGYIYLGLTENKRGYISCGSVLVEGTSTRLFKENKGGYIPCGSLLVKKFYKVEKKSQGSQVAWGLDVGMGCFRTSIKLGGVVSW

SEQ ID NO: 172207 - protein, 76 aa, Glycine max
  Coding DNA Sequence Number=SeqID_80522
MAAEWRRKRERRCHFKEKMSLEEAHHHRTPWIRAWWKKEMNEGRGREEHEILCSKRALKSETTNTRSIPRFSTKCA

SEQ ID NO: 172208 - protein, 81 aa, Glycine max
  Coding DNA Sequence Number=SeqID_80523
MSLRGRTRYSFRAYHFQYGHRGRPCKDSCYFTIALPLLSARGALSRILPKWPFHYPICCKRRRSLILMIDAKRLLIASSVR

SEQ ID NO: 172209 - protein, 502 aa, Glycine max
  Coding DNA Sequence Number=SeqID_80524
  Pfam annotation: Domain name=Transposase_23; Domain location=272-342; Score=-7.3; E_value=0.0075; Accession=PF03017.5; Description =TNP1ENSPM transposase
PCDERWYVVLHGKTIGVNVEDDDSYIGTYVSPLSTQMTPNIVEKEEVDDVHANHRLVVHVDLAIGKADDMGGYLVKFDIPEASNADKDSVDDTVCEKYGISKEKWAQFCQTHRDPSWEDVRKKAQAIQKQNTFPHSGSTEVVIDPLSPIRRHVKWKMARTKKTGQMMSEASKEIAKKIDSLEEQVSQGSFVPYGSGVTIKQYFGSAPRTSHTSSSMAPEELEQLTQQIRDQLEESITQKGLALPPEPEVGPSATHVSIKGFCVDPSATDLDMSDLDKCGLYIEENPSCPVALGRVYEGSTVVHNIPLLHGQVKVSVEEVKNANALILVPTDEVILVGQALNTFLAWPTHLVKRLSELVAMSPAKPADRPDPEVMWDASLFGLFNSDFPLYIKHEDLSEIAHGGQCLSISVIQLWIFALKGLDDTPRPKSKAGARWIVVKCNRQKGNTECGYYMMHWKSTIILGSFKNNWKTYFNDVRPLEAERLKALRIQWAQYYLKVRNET

SEQ ID NO: 172210 - protein, 91 aa, Glycine max
  Coding DNA Sequence Number=SeqID_80525
MGKGKLELGFEDQKIDFDLFVEDKPTPEHNVCLQVMGEGQEVLKVRTKTPFTKRLLLAKRIIVHALSHEIQALGAQPWHLRLTNSTKLAKV

SEQ ID NO: 172211 - protein, 389 aa, Glycine max
  Coding DNA Sequence Number=SeqID_80526
  Gene Ontology: Mol. function=nucleoside-triphosphatase activity; Cellular component=protein complex; Biological process=protein catabolic process
  Homolog annotation: Hit_ID=A9RK27; Match level="QueryCoverage=31%, HitCoverage=33%, E-value=7e-54, Identity=83%"; Hit description=26S proteasome regulatory complex, ATPase RPT4
  Pfam annotation: Domain name=AAA; Domain location=76-243; Score=52.6; E_value=1.4e-12; Accession=PF00004.20; Description=ATPase family associated with various cellular activities (AAA)
ERETGKPIITGRHKGDFYVLSPMPESYFSNRFKFGSANIWHQHLGHPQIKELRESIELPLMNPELFLQFGIKPPKGVLLYGPPGTGKTLLAGLLPVVSSAIIDKYIGESARLIREMFGYARDHQSCIIFMDEIDAIGGLRFCEGTSADREIQRMLMELLNQLDGFDQLGKLCGREIHSIDYPLASIYTLWSLGLRVGWSWEKGVERWREDAKAIVMICGGEEQQQLFFNDYNNVYKATIFPHNVGLGVTRQTLVFQMLMLLYAVEYFNMLTLDLSLDPSINYPSFNMLALERIEKEKEEAFKIHEQKILQLQSDYEKEVEKLIRQISKSVVFTFLLSQSVDFASVATCPFAGERGEAHGCAFQRRKNARSRHQRLFVENVGKIEGNRSK

SEQ ID NO: 172212 - protein, 335 aa, Glycine max
  Coding DNA Sequence Number=SeqID_80527
  Gene Ontology: Mol. function=heat shock protein binding; Biological process=protein folding
  Homolog annotation: Hit_ID=O82368; Match level="QueryCoverage=96%, HitCoverage=97%, E-value=2e-40, Identity=33%"; Hit description =Uncharacterized protein At2g29880
MGDSQENNKGKSRDKDNYVSWTMEDTNELLHLLVDAMNRGLRDANGSLSKQNVERIILPQLNAKTKFPKTYSHYLSRMKWFRNQYNMMSTLMRNNSGFGWDPIGKTFTAHEDVWKDYLKSHPSHSKLRGKSMVDYEYLKIVVGGGVSSGNNSISVDPDDIDATTFEPENRTVGIEEFSYDPNSDTFITPNNYEPAYQPPSPNQPSPPSHPPLDSEVPIEKQNCHKRRRSEYGGSSSAVGINNQDNVLENLSVGIGTIAVNFEKISNMMEKREKDRDRDRELEGIIWDVIKEIPNLDDITRFKTAELLNTKAKKDFFLKMSPEERSSWINFKLGNN

SEQ ID NO: 172213 - protein, 174 aa, Glycine max
  Coding DNA Sequence Number=SeqID_80528
  Homolog annotation: Hit_ID=A5AK77; Match level="QueryCoverage=54%, HitCoverage=11%, E-value=1e-10, Identity=38%"; Hit description =Putative uncharacterized protein
MTRGNPGDLQPFDPEIDRTFHRVVRHSVHPDHSVHFEHFKHFEHSVYSEHYVAGDSKHFDFEHLAANFYTENMAQPPPRERTLREMVAPDFTYESLSIQYPDEDVPYVLKTGLIHLLPKFHGLAGEDPHKHLKEFHIVCSTMKPPDVQEDHIFLKAFPHSLEGVAKDWLYYLAP

SEQ ID NO: 172214 - protein, 363 aa, Glycine max
  Coding DNA Sequence Number=SeqID_80529
  Homolog annotation: Hit_ID=A2ZQL2; Match level="QueryCoverage=41%, HitCoverage=54%, E-value=4e-08, Identity=27%"; Hit description =Putative uncharacterized protein
  Pfam annotation: Domain name=bZIP_1; Domain location=70-121; Score =15.4; E_value=0.0075; Accession=PF00170.12; Description=bZIP transcription factor
  Subcellular localization annotation: CTP_CleavageSite=51; ConfidenceScore=5.15e-01
MVASKPPLIPILSFQSLQKTFYRDAPGTSNSTPQNENNRLENPADINPALVASESTPKLIVDQTQAKSPDADLKKLRRMESNRLSSRRSWMKKLIYLTNLENQDQLAQLRPQIASHESQKQFLMLEKQTLLQRMEILEKEINFRESDLEMKKEQVKYLRESYPMNQAKQLQEQFLNWNIGLQDPMSNDPIPNYYTNSDQGNYELETSYMLPADLSQMWMPNVPNMNEVNLSLPNNMGSMVSNVYETNLSHPNYMGSMVSNVYETNLSHPNYIGPMTPNMDGMNLNLPNYTGSMAPSDMNAMQFSLPNNMGQMVPIMDETNLNLPNFMGSMAPEMNEMNFSLPSNIGSMAPNPPSGTFPNPNLD

SEQ ID NO: 172215 - protein, 166 aa, Glycine max
  Coding DNA Sequence Number=SeqID_80530
MYKQNEKDFLKLVVRLGYNNLLLIQGAKDAIIIQGGSAISAACESGGAATSSDDASEMISEEEMGELLQAQAKKVDSPLEIVGVGSGRAASLGLTVEASFMMNQVDSSSFEDNKDDDKKPKRMISRLSQQDSRIKRMISRLSQQDSRIKRSLISRFKKKRIQDSRK

SEQ ID NO: 172216 - protein, 98 aa, Glycine max
  Coding DNA Sequence Number=SeqID_80531
MEKKMLQMGIEDQKISFDLFREDKEPPDRNIYFKVHVMEERRPEKKVLEVGTLLDPGYQDDASRSFSVCLSAKPRPCAKRNLFTREAELARAKCKDSD

SEQ ID NO: 172217 - protein, 166 aa, Glycine max
  Coding DNA Sequence Number=SeqID_80532
MAASDHAILRDRAHIPTKRSLVVSYVVEHMSSTVVFPKKKHDMKSTTWGTSQDKISMQGQWRNHPGKQFNKDQGGPSNRPQQQGPSLYDRTTKLEETLAQFMQVGQLAKQLADCPFSSFGANTEKNPNKECKVVMTKSRLVTANESENGIGAEKQQLVSDPALDPV

SEQ ID NO: 172218 - protein, 92 aa, Glycine max
  Coding DNA Sequence Number=SeqID_80533
MASQKRKAPTSASQARYDRSRFTSQEAWDRYSDIVIGRKILAERNVMIYHTEFDEFKYKVRVRGHLIKFDEDALNTFLKTPVINEEGEDLPA

SEQ ID NO: 172219 - protein, 205 aa, Glycine max
  Coding DNA Sequence Number=SeqID_80534
MSHHSFKGNSLKTWEEIVEKFLKKYFPESKIAEGKATISLFHQFLDESLSEALERGKIKLKTLEKATELIENMSASDHAILHDRVHQPTKKSLLQVVPYVVRLMKQANVFPLKKTLKKFTIWEINKGKDILGEDSQASKKNSKEECKAVMTRSKRFVEAEDEDSVMSKKKAAEKKDELAKRAYRAMRVHLVRMNTHPPIKIPVAK

SEQ ID NO: 172220 - protein, 29 aa, Glycine max
  Coding DNA Sequence Number=SeqID_80535
VLLSSSGNIQAQQRARFFSAGQGRLSAMA

SEQ ID NO: 172221 - protein, 75 aa, Glycine max
  Coding DNA Sequence Number=SeqID_80536
RRGVLRNVLSSLRSGEQCLCGFFPGTTTLIWGHIDGSLSNVGKWIRARNGYGPEQQWCSKFGGVHTEPQKVWTGI

SEQ ID NO: 172222 - protein, 58 aa, Glycine max
  Coding DNA Sequence Number=SeqID_80537
MRTFGKQRYLGLKRGMIFPVMRVCFCRDKEQFGKGRKSFQNFLEQSLLKGKNWLKPKC

SEQ ID NO: 172223 - protein, 63 aa, Glycine max
  Coding DNA Sequence Number=SeqID_80538
  Homolog annotation: Hit_ID=A6FJQ2; Match level="QueryCoverage=60%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARGVAHKFSAHLDIV

SEQ ID NO: 172224 - protein, 409 aa, Glycine max
  Coding DNA Sequence Number=SeqID_80539
  Gene Ontology: Mol. function=oxidoreductase activity; Biological process=electron transport
  Homolog annotation: Hit_ID=A1FSM6; Match level="QueryCoverage=49%, HitCoverage=42%, E-value=9e-84, Identity=78%"; Hit description=FAD -dependent pyridine nucleotide-disulphide oxidoreductase
VEHLADALADRVLAQAILLQAEGNVLLDRHVREQGIGLEHHVDRPLGDAALGGRLEAAQAAQQGRFATAGATEQGKDLALAHVQVDVVDGDETVEFLAQVTNGEIAGRTGRVDDGGYRLGFNGHGGSGSGRWTAAAILTAGGRRGYDGGRWQRPLAGLGVPRGVGFPPPWWPVRSKAWAPLDDPAAIPARRHGRWPDLQRFSEPDVLKARDIPRAMPRIKALHGPTLVISADSPSPFPPRLPGSLPARLPLVIIGAGQAGLSLSALLQEAGVAHRVLEAETVGASWQRRWESFQTNTANATMALHGHAYAGDDPEGFMGAPEVIRHLREYAHERSLPISEGCVVHRVGPESGGYAIDSSQGPIHARAVVVATGEYRRARMPRVPFAPAPGLTVLHSSDYRSPGLLPEGA

SEQ ID NO: 172225 - protein, 163 aa, Glycine max
  Coding DNA Sequence Number=SeqID_80540
  Subcellular localization annotation: CTP_CleavageSite=77; ConfidenceScore=5.08e-01
MPQELVARGDTLQLSAPRHSVTPSVIGEQRPMWSFAPFPEMSASSGGDFFKSQKIRRSKSLAFVGHPTRSVILTLRSCDMRRQNLVIPHPFAIQTQSCPMARRDKIWSFCTLCHPEAAGPMICGDKIWSFRTPLPFRHSRVRWRAETKFGHSAPFVIQRRRAR

SEQ ID NO: 172226 - protein, 160 aa, Glycine max
  Coding DNA Sequence Number=SeqID_80541
VEPFMVKLMKQANAIPLMITLKKFISLGISRGPYNQQGQWRTHPGNQFNKDQGGSPNRPIQQGPNIFQRTTKLEETLTQFTQVTMSNHKSTESALKNLELQVGQLAKQIADKSSNSFGANIENNPKEECKAVMTRSKRFVEAKDEENVVDKEQLSGRQVL

SEQ ID NO: 172227 - protein, 105 aa, Glycine max
  Coding DNA Sequence Number=SeqID_80542
IHKRFSSNFSQPASIYLAPYASGSYNAQWNALGPLHDKHMLRSSRILRKKEAFSLQNSFLGWCFGLRLALDVRPANFMDDWVVGNEKGRYWLSNDIVGLVGSLAM

SEQ ID NO: 172228 - protein, 49 aa, Glycine max
  Coding DNA Sequence Number=SeqID_80543
MAFRSHHRLITEWAKTDEISRYLAPIVAQYVKFRNMPEIERKHCYTIRE

SEQ ID NO: 172229 - protein, 92 aa, Glycine max
  Coding DNA Sequence Number=SeqID_80544
  Homolog annotation: Hit_ID=A5AM73; Match level="QueryCoverage=79%, HitCoverage=6%, E-value=1e-15, Identity=50%"; Hit description =Putative uncharacterized protein
MAKNDMQMPPDTPDTMEVRRKWKVKYGKMLFVLRMTVNKELIDHIRDLDTPKDVWETLEKLFSKKNVARLQLLENELASTVQDLSEKISEAR

SEQ ID NO: 172230 - protein, 175 aa, Glycine max
  Coding DNA Sequence Number=SeqID_80545
MYDISKEKWTQFCQSRRDPSWEDVRKKAQAIQKQNTAPHMMSRWGYEYLEKKLIDEKRKKKLEKATQSESTDTVIDPPSPIKRHVKWKLARTKETGDMTSEAAKEIVDKIDALEEQASQGYFVTHGRHDILTDAIGSRYNHQAILWIGYKDLLHCSQIPATVDATNQGPARGFDH

SEQ ID NO: 172231 - protein, 147 aa, Glycine max
  Coding DNA Sequence Number=SeqID_80546
LDWLPNLRTTKGVEVEAPEEDDEDLPKVQEKLVVAVMRDRDQHVNHRQQVPRRIKSSQAHKHKVADEYARVYAEKEARGRVIDSLHQEATMWMDRFSLTLNGSQQLPRLLAKAKAMADAYSAPEEIHELLNYCKHMIDLMAHIIRNH

SEQ ID NO: 172232 - protein, 43 aa, Glycine max
  Coding DNA Sequence Number=SeqID_80547
MEMQRKTKEKRGCFNEGKERGRERERGEHEIEGIKEVEKWNFE

SEQ ID NO: 172233 - protein, 41 aa, Glycine max
  Coding DNA Sequence Number=SeqID_80548
MEVFHSKMGEALVASNPMVLLGWLTSKTKKFSFKQCTNFLF

SEQ ID NO: 172234 - protein, 72 aa, Glycine max
  Coding DNA Sequence Number=SeqID_80549
MEELCLVSEVVIPPKFKVLDFDRYKGTTGPKNHLKMFSLSCPPLAERMIRWAHKRTWKKMTCTGALSESQTR

SEQ ID NO: 172235 - protein, 109 aa, Glycine max
  Coding DNA Sequence Number=SeqID_80550
MSSPSEDCTSLPSEDYMSSPSKGCTPSPLEDYTSLLLEGSTSAPSEDLIPWSPPDLGGGPTLRAQPEAGYRAATMHTGARFQPCRYKETSADHAHQHDYSYTDMDDVAT

SEQ ID NO: 172236 - protein, 75 aa, Glycine max
  Coding DNA Sequence Number=SeqID_80551
MASGASRTPAFQSIFVAGLLLEEATQTHQRSQWSHQLSQPTLWREGDVGLTGVSSKGGRRAESPPTFIWGKCRKN

SEQ ID NO: 172237 - protein, 98 aa, Glycine max
  Coding DNA Sequence Number=SeqID_80552
  Homolog annotation: Hit_ID=A8P9T1; Match level="QueryCoverage=91%, HitCoverage=12%, E-value=1e-08, Identity=41%"; Hit description =Putative uncharacterized protein
MLGEESEDDDQKGLDSTESNDDQDEEEELMQIKDETETNLVNLRKTIYSAIYIIEQLVQIQSQTWHVLMKVTEDEENGGESVKQFDAIVEGACIHKTD

SEQ ID NO: 172238 - protein, 42 aa, Glycine max
  Coding DNA Sequence Number=SeqID_80553
MAPLMVQLEQQWPPQNARGAARRLSENGGVGVKCDRGGGGGW

SEQ ID NO: 172239 - protein, 275 aa, Glycine max
  Coding DNA Sequence Number=SeqID_80554
  Gene Ontology: Mol. function=molecular_function; Cellular component =membrane; Biological process=auxin mediated signaling pathway
  Homolog annotation: Hit_ID=A7Q7B8; Match level="QueryCoverage=92%, HitCoverage=71%, E-value=6e-80, Identity=60%"; Hit description =Chromosome chr18 scaffold_59, whole genome shotgun sequence
  Pfam annotation: Domain name=DUF6; Domain location=26-152; Score =57.4; E_value=5e-14; Accession=PF00892.11; Description=Integral membrane protein DUF6
MKSFLLGCVATVEKNRPYFAMLFIQFMYAGMALLSKAAISKGMSPYVFVVYRQAFASVALSPFAFFDSKQSAPLSCSLLCKLFLVSLVGLTASSNLYCVSINYTSATFAAAATNTVPAITFIMAALIRVESISIKRVHGLAKILGSVLSLAGAITFALVKGPSLGFMKWYPENQNHSSHLLTTVHSKVDIVRGSLMMLSANTAWSLWLILQGFVVKQYPAKFRLTAIQCLFSFMQSTVVAVAVERNNPSAWRLGWDIHLLSVAYCVRVYNLILHA

SEQ ID NO: 172240 - protein, 41 aa, Glycine max
  Coding DNA Sequence Number=SeqID_80555
MSDFLKNFIRRETRLNSHKDKKGGANRGQAQKEAHKTSIPK

SEQ ID NO: 172241 - protein, 1475 aa, Glycine max
  Coding DNA Sequence Number=SeqID_80556
  Gene Ontology: Mol. function=endonuclease activity; Cellular component=intracellular; Biological process=regulation of Rho protein signal transduction
  Homolog annotation: Hit_ID=UPI0000D57995; Match level="QueryCoverage =96%, HitCoverage=22%, E-value=3e-44, Identity=22%"; Hit description =PREDICTED: similar to CG18255-PA, isoform A
  Pfam annotation: Domain name=DUF1103; Domain location=18-47; Score =2.0; E_value=63; Accession=PF06513.2; Description=Repeat of unknown function (DUF1103)
  Pfam annotation: Domain name=DUF1103; Domain location=202-230; Score =6.7; E_value=8.5; Accession=PF06513.2; Description=Repeat of unknown function (DUF1103)
  Pfam annotation: Domain name=DUF1103; Domain location=246-275; Score =3.9; E_value=28; Accession=PF06513.2; Description=Repeat of unknown function (DUF1103)
  Pfam annotation: Domain name=DUF1103; Domain location=292-322; Score =0.5; E_value=1.2e+02; Accession=PF06513.2; Description=Repeat of unknown function (DUF1103)
  Pfam annotation: Domain name=DUF1103; Domain location=338-368; Score =1.6; E_value=74; Accession=PF06513.2; Description=Repeat of unknown function (DUF1103)
  Pfam annotation: Domain name=DUF1103; Domain location=431-460; Score =5.5; E_value=14; Accession=PF06513.2; Description=Repeat of unknown function (DUF1103)
  Pfam module annotation: Pfam domain module=DUF1103::DUF1103::DUF1103:: DUF1103::DUF1103::DUF1103; Domain location=18-47::202-230::246 -275::292-322::338-368::431-460
MSKKDEGEGTLERCTWKAKKDLTQGRMQESEEVNEAIDKRKGKEIQHFVDKGNGEELISMKIEAKQDLTKEAMQESEDVKETMFKREGKEIDYFLDENEGEEPRRMHMRAKKDLITETVQDSEDVKEEMVKRNDKENENFAENGEGEEPRRMHMEVKKDLKKETVHKSELAKDIMVKRKDKEIDNFADKGEGEEPKRMYIEANKDLAKEIMKKGDVKELTVKRKDKEFDNFVDKGEGEEPKRILMETKNLKKETMQESEDVKEEIAKRKDKDIEYSVNKGKGEEPKRMMDVEAKNDLTIEAMKEAKDVTEVMVKRKDKEIKNFVDKSEGKEPKRMHMEAKEHLAKETMQENKDVKEAMFKEKGKETEYFVIKGEGEEPKRMHMKAKKDLTTNTMQESEYVKEAMGKRKCEEEIDYFFNEGEGEEPNRMHMEAKDITTEIMQESEDIKEATIKRKGKETEYFVGQGEGKEPKRIHTEAKKDFTKKTMQEVEYDSEAMVKRKGKEIDYFVNKSEGEELKRTHMEAKKDIAKETMQEEIEKIKNGIKDSDQQNVLEKTGKGKFEVPTEELPKLIGRPDGSRGLKVANMEEQKEMIKEEMVETKSSMEKVKGEKSNTTSKVTEKNMATEIIQKETEESNIERMSRDGPYVPNNMVKVVFEVLGTFQAKLPKQVIEAISQNKKEKNEYVIVKLKGEGSIKMHVEPNDAFDEDEIEDINQKEIGKPKLKSSDQISETDDVDVGVFDGSKRPKFPKMGETKDVKEDSAKIEESVEKVNEDKYEKIQVEEKGGMRKDTTGESTQTEREGSKIQTMEKDQHCLQETISKGIFEASTAAKEEFPVITVDSLADKRKGLKGKKIDEAKVAKEELVKQTSEEKKIIIKEKGSRIEQFVKKVQGEKYEMIQAEAKEGLRKDITKGKDQQGLQEGTSRGRYEANTTREKTLKPEIPLEKQIKKGEPITRKDEFAKGQKFRETIQEEIEGHKDKIDVSDQHVQRDVVKGVGKVDTIGKEMIKKEYVAHLGPVAKRMETKKDLKATPEKEKYTIAQNVKDEKPRIYEENIKVDVEKVDKKGYQTKVVEEGMLKGEHKAEVVLEIKTERPKVAKREETKEASKLPFKREMGKTIQSAEDRRPKTGEITSEFEKVIEFKQAVEKMHESHNGEHQRDSKEVTPKKEVKPPTITPEQGVEKSKKEDVSPMPMAIQRKEPHELSLPSKDYEIPKIEGVQQEKEGKRFTHALEAFTFKKEEKELAQISGTHSKAKGEIDEPQVNQLPSPSIEMWSKESRELEKNGIKEDDSKAKSLVNMQEGKKSIHSSEGTTTSEVVADEAAKPSKFSSSSSTQPFEVEGKDKIDASSDEESQVSNRDPEIDGQESTKSETDEEVEQRETLQPESPEDQQCINKDQEESHETHEIEEKVYEQVDEFDQEHSQLLEEQKECEEEATEGKKNGQKGSKKLFVSIIIAGSGLLASGIFLFIRHRRARKG

SEQ ID NO: 172242 - protein, 230 aa, Glycine max
  Coding DNA Sequence Number=SeqID_80557
  Gene Ontology: Mol. function=transferase activity, transferring hexosyl groups; Biological process=carbohydrate metabolic process
  Homolog annotation: Hit_ID=A2WXC1; Match level="QueryCoverage=36%, HitCoverage=16%, E-value=4e-10, Identity=42%"; Hit description =Putative uncharacterized protein
LKLRQWHNWCEVKGEQAIALKLEIVLELNVNCGLILQLGPVRVPKRVTENLKLQILGWSVMGLNICLTSMESLEGFDCKRKKDLSQMSNDELVTLDNISQDELESTSSEKEENWRENLEQKSSEVNSTAGVGLDHFILEPTGTERNLLVADHEIIFSRSMMEKCDSPRQDLILDRLSECEKEYGHCVRLATHADFDTFVKSAGVNFYPLGGDPRALAECKRFLFNTAINI

SEQ ID NO: 172243 - protein, 46 aa, Glycine max
  Coding DNA Sequence Number=SeqID_80558
  Homolog annotation: Hit_ID=Q337K2; Match level="QueryCoverage=86%, HitCoverage=35%, E-value=3e-10, Identity=78%"; Hit description =Uncharacterised protein family containing protein, expressed
MTTGLKYDNLFENNAKNGSFYLQSKVHRAKECLEAVQQGKSQGTPS

SEQ ID NO: 172244 - protein, 35 aa, Glycine max
  Coding DNA Sequence Number=SeqID_80559
MAAMEDARVSIWELLEYSPPQTQQMLNNVSTDWLD

SEQ ID NO: 172245 - protein, 425 aa, Glycine max
  Coding DNA Sequence Number=SeqID_80560
  Gene Ontology: Mol. function=metal ion binding; Cellular component =integral to membrane; Biological process=multicellular organismal development
  Homolog annotation: Hit_ID=A7PKX8; Match level="QueryCoverage=64%, HitCoverage=65%, E-value=1e-107, Identity=69%"; Hit description =Chromosome chr7 scaffold_20, whole genome shotgun sequence
  Pfam annotation: Domain name=PMEI; Domain location=282-420; Score =0.2; E_value=0.015; Accession=PF04043.6; Description=Plant invertasepectin methylesterase inhibitor
  Pfam annotation: Domain name=zf-DHHC; Domain location=1-65; Score =121.8; E_value=2e-33; Accession=PF01529.11; Description=DHHC zinc finger domain
  Pfam module annotation: Pfam domain module=PMEI::zf-DHHC; Domain location=282-420::1-65
MVNGHSVRVKYCDTCMLYRPPRCSHCSICNNCVERFDHHCPWVGQCIGLRNYRYFFLFVSSATILCIYVFSISAFYIKVLMDRYHGTVWEAMKESPASVILMAYCFISLWFVGGLTGFHLYLIGTNQTTYENFRYRADNRINVYNRGCLNNFLEVFCTKVKPSRNNFRAFVQEEVPRPPPPVISREPEPDLGGGDPRSKVEDDLDIGEDLLKISQRRNIEEIDEDIRSRGSIGPPHNTSEVDSVLGSDRRAPTIRSEARHSSEGRSESWEIASEMWGYLDIKDGKGNGAGQDKARCLEVLQAEPQIVGAKDNVELCKLILEFGLKKGLEAQRFLKDAMMTTPSPAIVQCATSLYDGTIGSFKSSLSELAEDGQTANYDAKVAGDGPTTCDIALSNAKIVNPTISALNKDILLISKLAFLATDKLP

SEQ ID NO: 172246 - protein, 135 aa, Glycine max
  Coding DNA Sequence Number=SeqID_80561
MLDSCYYSGFWEAWDGSDGVVGPLVRKGMPPSTSDETIWLDSHGSVVGPYLLSCGQGSKTESFSTVCQTWWLSAPWTLYFNSDNEKITLIPLLSDLIAEITLWIHDLLYMIDQIDNIFSFKIGTTTNWDWAVHSF

SEQ ID NO: 172247 - protein, 63 aa, Glycine max
  Coding DNA Sequence Number=SeqID_80562
  Gene Ontology: Mol. function=protein binding
  Homolog annotation: Hit_ID=A7PKY1; Match level="QueryCoverage=84%, HitCoverage=25%, E-value=2e-16, Identity=79%"; Hit description =Chromosome chr7 scaffold_20, whole genome shotgun sequence
MAKKRKSIANSLDDVDRTLYTSFCTAANSLSQLYTHSMNHQKLSFNAGERHALIGGLRCGGIG

SEQ ID NO: 172248 - protein, 164 aa, Glycine max
  Coding DNA Sequence Number=SeqID_80563
  Homolog annotation: Hit_ID=O22792; Match level="QueryCoverage=84%, HitCoverage=17%, E-value=9e-35, Identity=50%"; Hit description =Putative uncharacterized protein At2g33420
MATTTVLDTPETLMLQPKLRLCLYDKDSDLAWPFRDLEGLDHDDIRETAYEIFFTACRSSPGFGGRSPITFYSKHDGSGEGRSTPVSQTSRVKQALGLRMLRSSLSQRIMVSAPASPVTERSPRSRAVPRRTVTMAEVMRLQMGVSEQSDSRLRKTLVRTLVGQ

SEQ ID NO: 172249 - protein, 493 aa, Glycine max
  Coding DNA Sequence Number=SeqID_80564
  Gene Ontology: Mol. function=inositol or phosphatidylinositol phosphatase activity; Cellular component=intracellular; Biological process=abscisic acid mediated signaling
  Homolog annotation: Hit_ID=A2ZX87; Match level="QueryCoverage=84%, HitCoverage=75%, E-value=2e-86, Identity=40%"; Hit description =Putative uncharacterized protein
  Pfam annotation: Domain name=Exo_endo_phos; Domain location=75-466; Score=29.9; E_value=9.1e-06; Accession=PF03372.14; Description =EndonucleaseExonucleasephosphatase family
MGSYESDYSADPVDDDDDSESGSDNEELGKLSIGVNRMGELTVNCESGEDGRGLQMKMKLHLNQQDSGVYLPPRVCVGTWNVGGKLPPDDLDIDDWLGVNEPADIYVLGLQEIVPLNPGNIFGAEDTRPVPKWENIIRETLNRVRPEMPKIKSFSDPPSPSKFKPSDDIPDIEEEILLESDSDIGEEVHPLDEENNICDGTFMGETVNTNLLASDAADIANSGLPVKTDLQRQFSFPKMFDKQHSFSENMVTPFAHQATKLTRMLSGSERMGLSWPEPPLHLLSQRVLDRPTSFKSLKSFKSSKSFKTFNSFKSIMDEMPGIVGLPEIDLEALIKRKRRSPYVRIVSKQMVGIFITVWVRRSLRKQIQNLKVSTVGVGVMGYIGNKLIRELKNGVFGGWSEGVLNFPPTYKYEVNSDKYYGEDPKVGKRSPAWCDRILSYGKGMRLLSYKRAELKLSDHRPVTATYMVEVEIFSPRKLQRALTFTDAEIENEQ

SEQ ID NO: 172250 - protein, 468 aa, Glycine max
  Coding DNA Sequence Number=SeqID_80565
  Homolog annotation: Hit_ID=A7P5Q2; Match level="QueryCoverage=94%, HitCoverage=96%, E-value=7e-64, Identity=36%"; Hit description =Chromosome chr4 scaffold_6, whole genome shotgun sequence
  Pfam annotation: Domain name=DUF247; Domain location=45-457; Score =349.0; E_value=8.2e-102; Accession=PF03140.6; Description=Plant protein of unknown function
MDGASSVIPEYSEIGSTSSSESQAQAQYLETQLTNMLRKVDPEITELNEKCIYRVPEKFRRVNPKAYTPRVVSIGPFHNPRYSNGGDNLKLMEERKLKYLEKFLNRNKHLSMKGLFLRLIEKEKQIRGYYAEPVSYSSDDFLTMILVDACFIIEHFLRYYTGLTLTERDTLSEPCLLSDIYHDMILLENQLPFFVLEDIFNSAHPGMIVEFPYKDVKGINDDYAGPITDVESLSFIAITFHYFRKYNHYIIEPAHIDRPYHFIDLLRIFWLPIPIPPESLKSGFMDKLIPSASQLSEVGLIFKASLTPGLFDIKYDHHMGVMEIPCILINHKTETELRNILALEQCRYILSPNMTQYLFILDCLVNTDKDASILIDNKIFINWLGDANAVAKMFNSLCSNVGLPFISEECFSLCDNLVKFYENPRNKYKAIFYHEYFNTPWKKASTSAAVLLLLLTLIQTICSVISFF

SEQ ID NO: 172251 - protein, 629 aa, Glycine max
  Coding DNA Sequence Number=SeqID_80566
  Gene Ontology: Mol. function=nucleic acid binding; Cellular component= cytoplasm; Biological process=mRNA metabolic process
  Homolog annotation: Hit_ID=A7QRL0; Match level="QueryCoverage=97%, HitCoverage=94%, E-value=0.0, Identity=56%"; Hit description =Chromosome undetermined scaffold_151, whole genome shotgun sequence
  Pfam annotation: Domain name=PABP; Domain location=535-608; Score =96.9; E_value=6.2e-26; Accession=PF00658.9; Description=Poly -adenylate binding protein, unique domain
  Pfam annotation: Domain name=RRM_1; Domain location=108-178; Score =87.2; E_value=5.2e-23; Accession=PF00076.13; Description=RNA recognition motif. (a.k.a. RRM, RB
  Pfam annotation: Domain name=RRM_1; Domain location=199-270; Score =94.3; E_value=3.9e-25; Accession=PF00076.13; Description=RNA recognition motif. (a.k.a. RRM, RB
  Pfam annotation: Domain name=RRM_1; Domain location=21-91; Score =89.8; E_value=8.8e-24; Accession=PF00076.13; Description=RNA recognition motif. (a.k.a. RRM, RB
  Pfam annotation: Domain name=RRM_1; Domain location=303-373; Score =99.3; E_value=1.2e-26; Accession=PF00076.13; Description=RNA recognition motif. (a.k.a. RRM, RB
  Pfam annotation: Domain name=RRM_2; Domain location=197-284; Score =1.4; E_value=0.095; Accession=PF04059.3; Description=RNA recognition motif 2
  Pfam module annotation: Pfam domain module=PABP::RRM_1::RRM_1::RRM _1::RRM_1::RRM_2; Domain location=535-608::108-178::199-270::21 -91::303-373::197-284
MAAAMVPAGALNGMQSGNASLYVGDLERNVDEAQLFQLFARVGPIFSIRVCRDETNRSLGYAYVNFVNPQDAANAMEHLNFTPLNGKSIRVMFSNRDPSIRKSGYANVFIKNLDISIDNKTLHDTFAAFGFVLSSKVAVDSIGQSKGYGFVQFDNEESAQNAIKELNGMLINDKKVYVGLFVNRQERAQVDGSPKFTNVYVKNFSETYTDEDLEQLFSTYGTITSAVVMKDTDGKSRCFGFVNFESPDSAVAAVERLNGTTVNDDKVLYVGRAQRKAEREAELKARFELERIRKYEKYHGTNLYVKNLDYNINDDKLKELFSEFGTITSCKVMLEPNGRSKGYGFVAFSAPRNANRALHEMNGKMIGRRPLYVAVAQRKEERKALLEAQFSQMHALYAITHLPTGIPVYHPGAPRHGPQALHYGQGAPSLVAPQPTGYGFQQQLLPGMHPGVAPNFIMPYHRQRQVPPRLRNLHRNQMLHLNSSQGFGYMGNGQNGMDPSVVPHGIVAPMMPLPFDGSGISAAPTYNQHPGGSLSNTFASALASATPENQHLMLAEHLYPLVDEITKNHHQTEKVTGMLLEMDQSEVIHLTESPEDLKIKVFEAMQALGEAAPDSEEVGDQLGSVSLKE

SEQ ID NO: 172252 - protein, 753 aa, Glycine max
  Coding DNA Sequence Number=SeqID_80567
  Gene Ontology: Mol. function=isomerase activity; Cellular component =cytoplasm; Biological process=negative regulation of transcription
  Homolog annotation: Hit_ID=A7QRM7; Match level="QueryCoverage=91%, HitCoverage=96%, E-value=0.0, Identity=73%"; Hit description =Chromosome undetermined scaffold_151, whole genome shotgun sequence
  Pfam annotation: Domain name=MA3; Domain location=160-271; Score =141.7; E_value=2e-39; Accession=PF02847.8; Description=MA3 domain
  Pfam annotation: Domain name=MA3; Domain location=324-435; Score =157.8; E_value=2.9e-44; Accession=PF02847.8; Description=MA3 domain
  Pfam annotation: Domain name=MA3; Domain location=459-570; Score =119.9; E_value=7.4e-33; Accession=PF02847.8; Description=MA3 domain
  Pfam annotation: Domain name=MA3; Domain location=627-736; Score =146.5; E_value=7.5e-41; Accession=PF02847.8; Description=MA3 domain
  Pfam module annotation: Pfam domain module=MA3::MA3::MA3::MA3; Domain location=160-271::324-435::459-570::627-736
MDFGEGYVSNEHRELHRSATESADPLSVSPLQLSPKSSRSQKSPRSPKTPRSPQSPRSPKVQGKCSNLSPRSHRQSYFQKDGRPKKGEVFLPIEVFHGLITSSPSSYHKICGGSGGKGTWGGLLDTDDTNVLDPNDPNYDSSEELDHSNEKKPMTDLDNYKKKATIIVEEYFATDDVVATMNEVKELGKPQYGYYFVKKLVSMSMDRHDKEKEMAAILLSALYADVLDPSQVYKGFSKLVDSADDLIVDIPDTVEVLALFIARAVVDDILPPAFLKKHMAYLPKDSKGVEVLKKTEKSYLAAPLHAEIIERCWGGSKNTTVDDVKAKINNFLKEYVGSGDKKEAFRCIKDLKVPFFHHEIVKRALIMAMERRQAESPLLDLLRAAAEEGFINSSQMSKGFGRLIDTVDDLSLDIPDARGILQKLMSKAASEGWLCVSSLKSLSVEPEKNTIEDSAAKSFKVKTQSIIQEYFLSGDILEVNSCLEQENSKNCAALNAIFVKKLITLAMDRKNREKEMASVLLSSLCFPADDVVSGFVMLIESADDTALDNPVVVEDLAMFLARAVVDEVLAPQHLEEIGAQSLGPGSIGSKVLQMTKSLLKARLAGERILRCWGGGGSSRPGWAFEDVKDMIGKLLEEYESGGEIREACRCMKELGMPFFHHEVVKKALVTTIEKKNERLWGLLKECFESGLITMNQMVKGFGRVAESLDDLALDVPDAKNQFACYFERAKANGWLDNSFCFSKQEHATENGTH

SEQ ID NO: 172253 - protein, 211 aa, Glycine max
  Coding DNA Sequence Number=SeqID_80568
  Homolog annotation: Hit_ID=A7P5Q2; Match level="QueryCoverage=84%, HitCoverage=46%, E-value=7e-17, Identity=32%"; Hit description =Chromosome chr4 scaffold_6, whole genome shotgun sequence
  Pfam annotation: Domain name=DUF247; Domain location=32-211; Score= -147.3; E_value=0.0015; Accession=PF03140.6; Description=Plant protein of unknown function
MEGPTSDSLSQQQCLETKLTEMLQDVEPPAMYGLDKQCIYRVPQTFVKLIRKPIHLYLFPLALFTMLPMADFVVTLQASEEKIRSCYGERIKCNSDDFLKMILVDACFIIEHFLRWHRFEDWQGKDPLLIKPWMSWDIRKELVLLENQLPFFVLEQLYNLTGMNREFPSFLQISFNCLKHVGLGYVTRCPNRVPKALHRSFENLNNIVIKI

SEQ ID NO: 172254 - protein, 290 aa, Glycine max
  Coding DNA Sequence Number=SeqID_80569
  Gene Ontology: Mol. function=protein serine/threonine kinase activity; Cellular component=cell surface; Biological process =protein amino acid phosphorylation
  Homolog annotation: Hit_ID=A7QLQ9; Match level="QueryCoverage=93%, HitCoverage=65%, E-value=4e-25, Identity=54%"; Hit description =Chromosome chr18 scaffold_121, whole genome shotgun sequence
  Pfam annotation: Domain name=Pkinase_Tyr; Domain location=109-239; Score=-171.8; E_value=0.068; Accession=PF07714.8; Description =Protein tyrosine kinase
MQKNDVLRVLKLDGDANLRIYSSSYKGSGTSIIRWAAVKDHNTRTQNFEKIDPNNSRKGCRMKVRLEDCPEKMGMLNIPRFGGLYGQYDLVEYASGAPIQFSYKELKGLTNGFNEKLGAGSFGSIYRGMLGNGTIVVIKQIQGIELEEKQFKLEIATKFYLGTIFIRCGTSTCPITTLQGGINYHDFEAKLSYFNLVKLITPKDDRYQTVLNMRGTKGFWCIQEQPSQRTAISKVLHMLEGVTKIKKPPAPKSMNGGSFSGNEEWLRKNVSALSTVSTPTPTCSSSSFHY

SEQ ID NO: 172255 - protein, 678 aa, Glycine max
  Coding DNA Sequence Number=SeqID_80570
  Gene Ontology: Mol. function=carbon-sulfur lyase activity; Cellular component=vacuole
  Homolog annotation: Hit_ID=A7QX58; Match level="QueryCoverage=57%, HitCoverage=85%, E-value=1e-150, Identity=62%"; Hit description =Chromosome undetermined scaffold_213, whole genome shotgun sequence
  Pfam annotation: Domain name=Alliinase_C; Domain location=66-406; Score=642.9; E_value=2.8e-190; Accession=PF04864.4; Description =Allinase, C-terminal domain
  Pfam annotation: Domain name=EGF_alliinase; Domain location=6-64; Score=99.7; E_value=8.9e-27; Accession=PF04863.4; Description =Alliinase EGF-like domain
  Pfam annotation: Domain name=zf-MIZ; Domain location=420-462; Score =1.5; E_value=0.00079; Accession=PF02891.11; Description=MIZ zinc finger
  Pfam module annotation: Pfam domain module=Alliinase_C::EGF _alliinase::zf-MIZ; Domain location=66-406::6-64::420-462
MGEWEPTWSTRAAEEAEAVAAIPCSGHGRAYLDGLILKGHEHVHVCECNSCNGGSDCFKFLSDCIANASSGDPYFLEPFWMRHAASSAILVSGWHRMSYSYSDGSYISEVLVKYIQKVHSIVGNAITKGRYFIFGSGSTQLFNAAVYALSLNSSVSPAKVVATTPYYPLYRTQTQLFNSRDFSYEGDTSLWKNNTDSNSRFIEFVTSPNNPDGKLTKRVLEGPNVKTIYDRAYYWPHFTAIPSPADEDLMLFTISKLTGHAGSRFGWAIIKDEAVYQKMLIYLQLNTIGVSRDVQLRALKLLDVIVEGDGKEIFQFAYSTMRDRWIRLKQVISESKRFSLQKLSPQYCTFFKRVRDPSPAYAWLKCERQEESNCYEILEAAGIIGREGNSFSTQQRLPSHPMSTLFIALQCCQCSTMQALSLSLSLSLIFCVHSNPIDCNYVQVKQKKKSSNKWNCAVCNQKQSVCRVFAQGFMAKELRKFVQDFNMSRKSFDDGEYPLAGTLNPPLPATEHGDAELNLKKKRNDWSAYLHQEQQPDHDADDDFEPLVVTELQKGMFKKRRVVEDSTAGSDRLFKKSLFHNSQEELRIDQPRVTSLTESNPKRNNYVTPTNQRTQKCKPTSSRAASKWNNYLTEDNENLELGWKKSFNFEDHSGPRNNTVLETMTSEIVEDDIHPDFM

SEQ ID NO: 172256 - protein, 507 aa, Glycine max
  Coding DNA Sequence Number=SeqID_80571
  Gene Ontology: Mol. function=sucrose transmembrane transporter activity; Cellular component=integral to plasma membrane; Biological process=sucrose transport
  Homolog annotation: Hit_ID=A3DSX3; Match level="QueryCoverage=99%, HitCoverage=99%, E-value=0.0, Identity=69%"; Hit description=Sucrose transport protein SUT1
  Pfam annotation: Domain name=MFS_1; Domain location=28-451; Score =18.2; E_value=0.0047; Accession=PF07690.7; Description=Major Facilitator Superfamily
  Pfam annotation: Domain name=Sugar_tr; Domain location=25-459; Score=- 40.9; E_value=2.2e-07; Accession=PF00083.15; Description=Sugar (and other) transporter
  Pfam module annotation: Pfam domain module=MFS_1::Sugar_tr; Domain location=28-451::25-459
MEQPPSSSLQVETAQQAGPSPLRKMIAVSSIAAGIQFGWALQLSLLTPYVQTLGVPHAWASFIWLCGPISGLLVQPIVGYSSDRCRSRFGRRRPFILAGAVAVAIAVFLIGYAADIGHAAGDDLAKKTRPRAVAIFVVGFWILDVANNMLQGPCRAFLGDLAAGDHRKTRTANAFFSFFMAIGNVLGYAAGSYDKLHRAFKFTQTEACDVFCANLKSCFFFSIVLLLVLCFVVLTCVEDPQFTPRGDEDNYENDGVSRSWFSCFGELCGAFRGLKRPMWLLMLVTAINWVAWFPYVLFDTDWMGREVYGGKVGDKAYDSGVHVGALGLMLNSVVLALMSLAVEPLGRLVGGVKWLWGIVNVILAVCMAMTVLITKAAEHERLNAVSLVGYPSLGVKAAALTFFSVLGVPLAITYSVPFALASIYSTTSGAGQGLSLGVLNVAIVVPQMIVSAISGQWDKWFGGGNLPAFVLGAVAAAVSAVLAVVLLPKPKPADVAKVSSVTAGSFH

SEQ ID NO: 172257 - protein, 249 aa, Glycine max
  Coding DNA Sequence Number=SeqID_80572
  Gene Ontology: Mol. function=N-acetyltransferase activity; Biological process=metabolic process
  Homolog annotation: Hit_ID=A7PI41; Match level="QueryCoverage=92%, HitCoverage=83%, E-value=3e-92, Identity=73%"; Hit description =Chromosome chr13 scaffold_17, whole genome shotgun sequence
  Pfam annotation: Domain name=Acetyltransf_1; Domain location=123-214; Score=60.8; E_value=4.7e-15; Accession=PF00583.15; Description =Acetyltransferase (GNAT) family
MEINLDYEIAWNHVIGICRASQVVDLFPTVSPEIIVREARLEDYWGVAETHCKCFFPEYSFPLDFVLRIDRLVVAMLAAMLAGFFRPRDCRRICLVAVIDSSLDESFSFESEGLKIGGFDGKFSLNKGYVAGILTVDNNADFLPRKGPRRHRRTGIAYISNVAVRENFRRKGIAKKLIAKAECHARSWGCRAIALHCDLNNPVATMLYKGQGYKCIMVPEGANWPQPRTSPDIRFNFMMKLLKNSLGRK

SEQ ID NO: 172258 - protein, 67 aa, Glycine max
  Coding DNA Sequence Number=SeqID_80573
MSLRKLRIVKGGNKGDKVILLRKVVTARLSGMRETREKKRGGEVMEEMRDEGRPREKGWMCRKKGEG

SEQ ID NO: 172259 - protein, 582 aa, Glycine max
  Coding DNA Sequence Number=SeqID_80574
  Gene Ontology: Mol. function=unfolded protein binding; Cellular component=cytoplasm; Biological process=cellular protein metabolic process
  Homolog annotation: Hit_ID=A7PW56; Match level="QueryCoverage=100%, HitCoverage=100%, E-value=0.0, Identity=83%"; Hit description =Chromosome chr8 scaffold_34, whole genome shotgun sequence
  Pfam annotation: Domain name=Cpn60_TCP1; Domain location=38-566; Score=496.4; E_value=3.5e-146; Accession=PF00118.15; Description=TCP- 1cpn60 chaperonin family
MGFNIQPYGIQSMLKEGHKHLSGLDEAVLKNIDACKQLSTITRTSLGPNGMNKMVINHLDKLFVTNDAGTIVNELEVQHPAAKVLVLAGKAQQEEIGDGANLTISFAGELLQGAEELIRMGLHPSEIISGYTKAINKTVQILDELVEDGSDNMDVRDKEQVISRMKAAVASKQFGQEDIICSLVADACIQVCPKNPANFNVDNVRVAKLLGGGLHNSTVVRGLVLKSDAVGTIKQAEKAKVAVFASGVDTSATETKGTVLIHTAEQLYFFYCLSGEAYFVFAGISWRSIPISQIRKLKVDCDRLENYSKTEEAKVEELIKAVADSGAKVIVSGGAVGEMALHFCERYKLMVLKISSKFELRRFCRTTGSVAMLKLCQPNPDDLGYVDSVSVQEIGGVRVTIVKNEEGGNSVATVVLRGSTDSILDDLERAVDDGVNTYKAMCRDSRFVPGAAATEIELAKRVKDFSFKETGLDQYAIAKFAESFEMIPRTLAENAGLNAMEIISSLYAEHASGNAKVGIDLEEGICKDVSTLSIWDLHVTKLFALKYAADAACTVLRVDQIIMAKPAGGPRREQPAGGMDED

SEQ ID NO: 172260 - protein, 979 aa, Glycine max
  Coding DNA Sequence Number=SeqID_80575
  Gene Ontology: Mol. function=catalytic activity; Cellular component =nucleus; Biological process=metabolic process
  Homolog annotation: Hit_ID=A7PW61; Match level="QueryCoverage=92%, HitCoverage=100%, E-value=0.0, Identity=40%"; Hit description =Chromosome chr8 scaffold_34, whole genome shotgun sequence
  Pfam annotation: Domain name=PPR; Domain location=104-138; Score=8.2; E_value=0.82; Accession=PF01535.11; Description=PPR repeat
  Pfam annotation: Domain name=PPR; Domain location=170-204; Score =21.0; E_value=0.0046; Accession=PF01535.11; Description=PPR repeat
  Pfam annotation: Domain name=PPR; Domain location=270-304; Score =46.8; E_value=7.6e-11; Accession=PF01535.11; Description=PPR repeat
  Pfam annotation: Domain name=PPR; Domain location=371-405; Score =31.5; E_value=3e-06; Accession=PF01535.11; Description=PPR repeat
  Pfam annotation: Domain name=PPR; Domain location=472-506; Score =43.7; E_value=6.7e-10; Accession=PF01535.11; Description=PPR repeat
  Pfam annotation: Domain name=PPR; Domain location=573-607; Score =43.8; E_value=6.2e-10; Accession=PF01535.11; Description=PPR repeat
  Pfam annotation: Domain name=PPR; Domain location=674-708; Score =47.0; E_value=6.7e-11; Accession=PF01535.11; Description=PPR repeat
  Pfam annotation: Domain name=PPR; Domain location=69-103; Score=0.2; E_value=7.5; Accession=PF01535.11; Description=PPR repeat
  Pfam annotation: Domain name=PPR; Domain location=709-743; Score =14.8; E_value=0.14; Accession=PF01535.11; Description=PPR repeat
  Pfam annotation: Domain name=PPR; Domain location=745-779; Score=0.0; E_value=7.7; Accession=PF01535.11; Description=PPR repeat
  Pfam module annotation: Pfam domain module=PPR::PPR::PPR::PPR::PPR::PP R::PPR::PPR::PPR::PPR; Domain location=104-138::170-204::270-304::371- 405::472-506::573-607::674-708::69-103::709-743::745-779
MNETETNIRDNYQRLPSMLISSLSLRPFFFLCPKAYSFPRQCKFPLQNFPKPIFNDHKLLSGNLSFAAFSNTALSYAYSNDEGEANGINFLHLMEERGVRANSQTYLWLLDGCLSSGWFSDGWKLHGKILKMGFCAEVVLCERLMDLYIAFGDLDGAVTVFDEMPVRPLSCWNKVLHRFVAGKMAGRVLGLFRRMLQEKVKPDERTYAGVLRGCGGGDVPFHCVEKIHARTITHAKKVFDGLQKRDSVSWVAMLSGLSQSGCEEEARDEVSYNSLISGLSQQGYSDKALELFKKMCLDCLKPDCVTVASLLSACSSVGALLVGKQFHSYAIKAGMSSDIILEGALLDLYVKCSDIKTAHEFFLSTETENVVLWNVMLVAYGLLDNLNESFKIFTQMQMEGIEPNQFTYPSILRTCSSLRAVDLGEQIHTQVLKTGFQFNVYVSSVLIDMYAKLGKLDHALKIFRRLKEKDVVSWTAMIAGYAQHEKFAEALNLFKEMQDQGIHSDNIGFASAISACAGIQALNQGQQIHAQACVSGYSDDLSVGNALVSLYARCGKVRDAYFAFDKIFSKDNISWNSLISGFAQSGHCEEALSLFSQMSKAGQEINSFTFGPAVSAAANVANVKLGKQIHAMIIKTGHDSETEVSNVLITLYAKCGNIDDAERQFFEMPEKNEISWNAMLTGYSQHGHGFKALSLFEDMKQLGVLPNHVTFVGVLSACSHVGLVDEGIKYFQSMREVHGLVPKPEHYACVVDLLGRSGLLSRARRFVEEMPIQPDAMVCRTLLSACIVHKNIDIGEFAASHLLELEPKDSATYVLLSNMYAVTGKWGCRDRTRQMMKDRGVKKEPGRSWIEVNNSVHAFFAGDQKHPNVDKIYEYLRDLNELAAENGYIPQTNSLLNDAERRQKGPTQIIHSEKLAIAFGLLSLSSSTPIHVFKNLRVCGDCHNWIKYVSKISDRVIVVRDSYRFHHFKGGICSCKDYW

SEQ ID NO: 172261 - protein, 480 aa, Glycine max
  Coding DNA Sequence Number=SeqID_80576
  Gene Ontology: Mol. function=hydrolase activity, hydrolyzing O -glycosyl compounds; Cellular component=anchored to membrane; Biological process=carbohydrate metabolic process
  Homolog annotation: Hit_ID=A2Q5Q4; Match level="QueryCoverage=98%, HitCoverage=95%, E-value=0.0, Identity=76%"; Hit description =Glycoside hydrolase, family 17; X8
  Pfam annotation: Domain name=Glyco_hydro_17; Domain location=8-345; Score=223.5; E_value=4.7e-64; Accession=PF00332.9; Description =Glycosyl hydrolases family 17
  Pfam annotation: Domain name=X8; Domain location=366-449; Score =138.7; E_value=1.6e-38; Accession=PF07983.4; Description=X8 domain
  Pfam module annotation: Pfam domain module=Glyco_hydro_17::X8; Domain location=8-345::366-449
MVIMGKGLGVNWGTQATHQLRADTVVEMLKDNGIQKVKLFDADESSMSALSGSGIEVMVAIPNNQLAEMNDYDRALQWVKKNVTRYNFRGGVNIKVSICECGMFLNLRESKMYVAVGNEPFLKSYNGSFLNITLPALQNIQNALNDAGLGDSIKATVPLNADVYESPPNSPVPSAGIFRPDISDLMTQIVQFLAKNKAPFTVNIYPFLSLYGNDNFPFDYAFFDGVANPIIDNGVSYTNVFDANFDTLVSALKKVGYGNMPVLVGEVGWPTDGDKNANVGNAFRFYNGLLPRLAMNKGTPLRPGFIEVYLFGLIDEDAKNIAPGNFERHWGIFGYDGKPKFPMDLSGKGQKKVLVGAQNVHYLEPNWCMFNPDAQDLSKLADNINYACTLADCTALGYGSSCNNLDANGNASYAFNMYYQTQDQNYMACNFEGLARLTTSNISTPTCNFIVQINPSLSSSLRPQIVAFLFVTLLPFILFL

SEQ ID NO: 172262 - protein, 323 aa, Glycine max
  Coding DNA Sequence Number=SeqID_80577
  Gene Ontology: Mol. function=transcription factor activity; Cellular component=nucleus; Biological process=regulation of transcription, DNA-dependent
  Homolog annotation: Hit_ID=A5YBK4; Match level="QueryCoverage=89%, HitCoverage=93%, E-value=4e-26, Identity=57%"; Hit description=ERF transcription factor
  Pfam annotation: Domain name=AP2; Domain location=31-82; Score=78.1; E_value=2.8e-20; Accession=PF00847.11; Description=AP2 domain
  Subcellular localization annotation: CTP_CleavageSite=39; ConfidenceScore=5.08e-01
MEIQFQHPKKHLRASTSKGGKGRNNNNKTKSKYVGVRQRASGKWVAEIKDTTQKIRMWLGTYETAEEAARAYDEAACLLRGSNTRTNFITRVSLDSPLASRIQNLVNNRKGTKTKQEQYVVETCDTRIKSNRHESIALPEGASPPQRGELRSESSLEDVSKFSIQQLYIDQDCLRKKIRVGNEKKRRVNSTTCSTSNSTNSSNNSDSCENSLSSETTTQNTQQFDDDAYRPDLSNFMVSESGSHQNNPSWGFEPSFSQVMDVANLPDIAGLELPDFERIKVERQISASLYAINGVQEYMDTLQDSNNNNGAIWDFPPFCSFLC

SEQ ID NO: 172263 - protein, 766 aa, Glycine max
  Coding DNA Sequence Number=SeqID_80578
  Gene Ontology: Mol. function=pyruvate kinase activity; Cellular component=cytoplasm; Biological process=glycolysis
  Homolog annotation: Hit_ID=A5BD69; Match level="QueryCoverage=49%, HitCoverage=89%, E-value=1e-146, Identity=63%"; Hit description =Pyruvate kinase
  Pfam annotation: Domain name=PK; Domain location=371-675; Score =430.4; E_value=2.5e-126; Accession=PF00224.12; Description=Pyruvate kinase, barrel domain
  Pfam annotation: Domain name=PK_C; Domain location=678-765; Score= -6.9; E_value=6.3e-05; Accession=PF02887.7; Description=Pyruvate kinase, alphabeta domain
  Pfam module annotation: Pfam domain module=PK::PK_C; Domain location =371-675::678-765
MENDIEGVHWCNICSKMVNPMSDDENICPFCETEFSEVMDNLRDQNDVFDLRSAWVFSLYAPIFLGLMGAFSPSLARIAPHGGSSSSRGVEEEVEQERENELVLGRRRRTSTYMMHLFRGLHIRMVSELENPEDNNRNMDGSSILVIDPFSEGALIVRGPNLSHTTSSNENNAVGSSLNDLVVGSGFDLLLQHLAQIGPGGYSSVNPPAQKAAIEALPSVTSEEKFQCPVCLEDVEVGSEAKEMPCFRCHLRIQLLKPMWTIGTVSWSELEKRDPEMEGGTGVSSLQNHSKESVIISGTTTYRIDMLGLYFATSFEVVPPLVSTKIRAALLQYAVLTAAEAMLSKGLIGVGAGHGLNSNVWIGSCRSFPAKHNTVCAIKDCISNIGGLGSQTLDNLRTALNNTGILCAVMLDTKGPEIRTGFLKQGKPIEIQRGQEITITTDYSIKGDENMISMSYNKLAHHLSPESNILCADGTISFTVLECDMENGLVRCRCENSAVLGERKNVNLPGVVVDLPTLQKRTRRTFWSSDLVEVRNLLGKHAKSILLMSKVENQEGVANFDEILANSDAFMVARGDLGMEIPIEKIFLAQKVMKHKSSIQGKPVVTATQMLESAIKSPRPTRAEATNVANTVLDGTDCVMLSGETAAGAYPDIAVQTMARICSEAESFIDSTDLFRRVIETAPTPMSPLESMVSAAETPLRHSLIYRGLIPVLGTGSYGDSMTKSTEETIELALSYAKKNDLCKTGDSVVALHRLESSTVIKILDV

SEQ ID NO: 172264 - protein, 194 aa, Glycine max
  Coding DNA Sequence Number=SeqID_80579
  Gene Ontology: Cellular component=membrane; Biological process=amino acid transport
  Homolog annotation: Hit_ID=A7PW74; Match level="QueryCoverage=54%, HitCoverage=20%, E-value=7e-39, Identity=75%"; Hit description =Chromosome chr8 scaffold_34, whole genome shotgun sequence
  Subcellular localization annotation: CTP_CleavageSite=68; ConfidenceScore=5.25e-01
MRLSQPLFRYKPFTSQKINGTVNFVGHRTHLQTSYKKTVAPIFITNGSNAPLTTKLAPCNAITLPTLSAEDDANNANNRTKNEVSNGTSKGKSFWGAVSLIIGTAVGPGMLALPALTVKSGPFPSSIIILASWLYVISSIIIVAELCFESMEQDGVEEMSFTSLATKTLGSGFGALVALVYSTLSFSLLVACVA

SEQ ID NO: 172265 - protein, 354 aa, Glycine max
  Coding DNA Sequence Number=SeqID_80580
  Gene Ontology: Mol. function=DNA binding; Cellular component=nucleus; Biological process=regulation of transcription
  Homolog annotation: Hit_ID=A0JBY8; Match level="QueryCoverage=97%, HitCoverage=96%, E-value=6e-71, Identity=45%"; Hit description=NAC domain protein
  Pfam annotation: Domain name=NAM; Domain location=9-141; Score=305.1; E_value=1.4e-88; Accession=PF02365.6; Description=No apical meristem (NAM) protein
MGTPQSNNLPPGFRFHPTDEELILHYLRKKVASIPLPVSIIAEVDIYKFDPWELPAKAEFGEKEWYFFSPRDRKYPNGARPNRAAASGYWKATGTDKNIVASLPGGGVREHFGVKKALVFYKGRPPKGVKTNWIMHEYRFVDTNRPIRIKDTSMRLDDWVLCRIYKKTKHAVSPTTEAASSTLQVINEQLDQAEEEEQIKDNLLPILKNNTTLVPPQQTTLLMSQKSLSFSNLLDATDYSMLSTILSENNHSNNYLTPSEALFNNCENLDQEITPQNYYYNNNTNSYLFQKNPSHMENMARPKRHLSNMDHEDNMILYPSKKYQSSSCNFPNSNPQWNFMFKQPLMSPQYLPFQ

SEQ ID NO: 172266 - protein, 828 aa, Glycine max
  Coding DNA Sequence Number=SeqID_80581
  Gene Ontology: Mol. function=hydrolase activity, hydrolyzing O -glycosyl compounds; Cellular component=anchored to membrane; Biological process=carbohydrate metabolic process
  Homolog annotation: Hit_ID=A7P3T4; Match level="QueryCoverage=53%, HitCoverage=94%, E-value=0.0, Identity=82%"; Hit description =Chromosome chr1 scaffold_5, whole genome shotgun sequence
  Pfam annotation: Domain name=DUF292; Domain location=477-578; Score= -35.7; E_value=0.019; Accession=PF03398.5; Description=Eukaryotic protein of unknown function, DUF292
  Pfam annotation: Domain name=Glyco_hydro_17; Domain location=23-344; Score=349.7; E_value=5e-102; Accession=PF00332.9; Description =Glycosyl hydrolases family 17
  Pfam annotation: Domain name=X8; Domain location=359-444; Score =175.4; E_value=1.5e-49; Accession=PF07983.4; Description=X8 domain
  Pfam module annotation: Pfam domain module=DUF292::Glyco_hydro _17::X8; Domain location=477-578::23-344::359-444
MAVLMIFHMFAAIALPAYGDAFIGVNIGTDATNMPSPTEVVALLKAQGIQHVRLYDADRAMLRTLANTGIRVIVSVPNDQILGIGQSNATAANWVARNVIAHVPATNITAIAVGSEVLTSLPNAAPVLVSALKFIQAALVAANLDQQIKVSTPHSSSVILDSFPPSQAFFNKTWDPVMVPLLNFLQSTGSYLMLNVYPYYDYMQTNGVVPLDYALFRPLPPNKEAIDSNTLLHYTNVFDAIVDAAYFAMSYLKFTNIPILVTESGWPSKGDSSEPDATVDNANTYNSNLIRHVLNNSGTPKQPGIAVSTYIYELYNEDLRSGPVSENNWGLFYANGAPVYTLHLTNSGTVFANDTTNQTFCVAKSNADTKMLQAALDWACGPGKVDCSPLLQGQPCYEPNSVASHATYAINAYYQQMAKSAGTCDFKGVASVTTTNPSHGSCIFPGSGGKNVTSVNGTALAPSTNSTNSGKKMIKRAQCRLRHLKSKREVMAMQIGKDLSELIQNGHQETAIMRQSEKKLEESQEIARDTSIAVTMQKCDNSLSVAVAVELFPSNLVYKKSLTDDQKYKVVDEIASDNCLQQEVKEHIGNQLVESDGETNHTIAEYTSTENSALVYSVQQYPPCGEEMEKEDFPDLQNKGETMALGPSSEGVSLLPYAEAMVEYYVEEIEESENFESKDGQEESASERSSIRVGLRKSKGAPKKRLKRRSSLLERQGTTENGCIIYYQQPCKSPSTQNYAKATQREKLSTLTNVTAADLPCYCCFSYDKKCYSRALTMTTEQPKNYKDELLRTYSRSSPHPKHVHPKLPQCEDIVAIFTALKRERGRG

SEQ ID NO: 172267 - protein, 104 aa, Glycine max
  Coding DNA Sequence Number=SeqID_80582
  Gene Ontology: Mol. function=transporter activity; Cellular component= mitochondrial inner membrane; Biological process=transport
  Homolog annotation: Hit_ID=A7QPT9; Match level="QueryCoverage=85%, HitCoverage=29%, E-value=3e-32, Identity=77%"; Hit description =Chromosome chr10 scaffold_138, whole genome shotgun sequence
  Pfam annotation: Domain name=Mito_carr; Domain location=33-104; Score= 7.0; E_value=0.00069; Accession=PF00153.18; Description=Mitochondrial carrier protein
MAVEGSLFFGIYSQTKVYLQGGVQSGEPRPQVIIPSAAFSGAIISFVLGPTDLIKCRMQIQGTDSLVPKSSRYSSPLDCALKTVKAEGVRKFCNILQNLILAIL

SEQ ID NO: 172268 - protein, 153 aa, Glycine max
  Coding DNA Sequence Number=SeqID_80583
  Homolog annotation: Hit_ID=A7PA71; Match level="QueryCoverage=52%, HitCoverage=34%, E-value=6e-21, Identity=66%"; Hit description =Chromosome chr14 scaffold_9, whole genome shotgun sequence
MAVESFDCFRLKLGVPAQDIMMNGNGTQTEYWGESSGSTSHSSQQDVEDDRMIALVLSEEYAKLDGAVGRRLTNLEPVPHVPRINSFFPTVSDASMDHQRLLQREFGACCSYSGTFGRSCSCGWKNKIIKLPQNTIDESSILTFLPPLLNKPR

SEQ ID NO: 172269 - protein, 260 aa, Glycine max
  Coding DNA Sequence Number=SeqID_80584
  Homolog annotation: Hit_ID=Q2HRU8; Match level="QueryCoverage=83%, HitCoverage=83%, E-value=3e-37, Identity=44%"; Hit description =Putative uncharacterized protein
  Subcellular localization annotation: CTP_CleavageSite=57; ConfidenceScore=5.34e-01
TQLDFSYFSLASYKMKNNRASGILKLIAALRSMAKSKSLALKSKTNAIKARLVIFSLVMNKRYVMSTISDKFQSLLGHHHSHLKEVEDGNDSVEDKCTVVINDNAHLHEDFVSTSSLQASIGSSIVSTSERCEIFGHTRKAVSNVNPSETQMVVEDNDGADDDDGCECFYTYGDDDDDDDDGGGGGNKYPDLTHTMFESDDLEIGGSVIDLVKSSKEEAGQEFKMEDEIDHMADLFIRKFRRQIMLQKQDSLKRNEMQIQ

SEQ ID NO: 172270 - protein, 266 aa, Glycine max
  Coding DNA Sequence Number=SeqID_80585
  Homolog annotation: Hit_ID=A5AD37; Match level="QueryCoverage=30%, HitCoverage=16%, E-value=7e-22, Identity=62%"; Hit description =Putative uncharacterized protein
  Pfam annotation: Domain name=DUF247; Domain location=37-266; Score= -115.8; E_value=6.2e-05; Accession=PF03140.6; Description=Plant protein of unknown function
MTSNFTIEQRLEQLQKAKEEAQPQPPKKAMQNPTCSTSSPRPKAFHQALRAETDIILGPIHHGAPKLQLGEQYKQRWAARYIDTTGQTPQDLHNKVLKDIGNLNNLFDDDLLTASAQEYQKQGVATIEEKICWMMGDVLLLKNQLPFPLLQLLWRDTERVLMGKMRNFLRCHHWATKEEDKLPEIVVDDTTAATVLNLIAYEMCPDFENDYGICSYVSFLDSLIDHPDDVKALRSEQILLNSLGSDEKVANLFNTISTDLVPDMGK

SEQ ID NO: 172271 - protein, 66 aa, Glycine max
  Coding DNA Sequence Number=SeqID_80586
  Gene Ontology: Mol. function=sodium:dicarboxylate symporter activity; Cellular component=membrane; Biological process=dicarboxylic acid transport
  Homolog annotation: Hit_ID=A7PA41; Match level="QueryCoverage=100%, HitCoverage=13%, E-value=2e-22, Identity=78%"; Hit description =Chromosome chr14 scaffold_9, whole genome shotgun sequence
MADMEIVLPEKRNPGLTPMDWVKFLASAIVGLVAVASSLDVNTADLRVIGAVLSTVLGYLAKTYFT

SEQ ID NO: 172272 - protein, 960 aa, Glycine max
  Coding DNA Sequence Number=SeqID_80587
  Gene Ontology: Mol. function=DNA binding
  Homolog annotation: Hit_ID=Q9FFY0; Match level="QueryCoverage=99%, HitCoverage=95%, E-value=1e-145, Identity=34%"; Hit description =Genomic DNA, chromosome 5, P1 clone:MAC12
MAADQRRKRVNGANIAGYGSREQHRIKRKNLGLVQNDLNMRPHISVEWDGNHKKVVAKWEQIGISWRQMKPFINLVSNDHKILADVFAVPQEIFELDNLSEVLSYEVWKTHLSENERNLLMNFLPSGFESHQVVEELLGGINFNFGNPFSKWGASLCLGSLHPDMIVDQEQHLKTERREYYSHIHNYHNDMIGFLSKLKKSWQSCKDPEKEIVQKIWRTKHVEKRMLSKVIESRGYDHNGNVTGTSESCSWDAEEKACSSDNQISSLRKDDKLQRRVLEKCIVKGKSRNLMDSLDNMPNVGEKPKTGDKLPKHSIHSSDSDKYMSCIKISKQQHELVKNMKQAGKSIQSRSLNRVLGNLEKIHVQPYNTFVKEEQKKLQEHWLLLVNKDLPAAYLNWTERRIQRHAVRNSLVAEMKDKSNPFMEEEDGVDTGSELKDQDGVNSGSELQDHDEVNSGSELQDQDEDNLGSGDKLKDKNEDNMSSECEPQEQNEDNVTSGSELQDQGEDNVNSGDELQDQVNDGGLNDQSDLKEDEDSFSRSPENQSQHNSYVSGDDEFNRMSVDSERNILLSKSNNTSSISGDHEFNRMNVDSEKNLLLSKSNNTSLNKDEYSRNMNTRDVSIDEEAPFTSSGDVWQGVEMPHSYYDSAVTHEYAASGLSLANPQVSQEQPTRMIDLEADLRREETGKELLSRQLDNGTFSSYQSQDRSVLLESLFKGEGLLPYHHDQKVAELDFQTSNNVMMGGGQFSSHLKEPLQTSLTLDQGRRRATEVYMPENMSENIYSDGGRYLIPRQDPLTAVNMTDWAANNARIAGPSQSHLNTGDFIDHHWFPADHQVRGGGWNGSDGGGLSSQSLGTGASADQSLFSILSECDQLHSGSPYDSVRNTNQFLAPRTYGLADAGTPRVNTVAPPASHPLDYFTRREAPSGLVPDDTVWMSLPPHQNSSLHDQIRKPYLRSWNR

SEQ ID NO: 172273 - protein, 97 aa, Glycine max
  Coding DNA Sequence Number=SeqID_80588
MEISSSYEHCLTFIHTSVVQFSQQTQMNICALIFSQKCFLGIDSKKQQQQQQERKRKLSGPYKTWGSSRKRRGWKGEVGRERVGGRNMGWVSLRGGE

SEQ ID NO: 172274 - protein, 30 aa, Glycine max
  Coding DNA Sequence Number=SeqID_80589
MLTVAAAGGGVVEVVAAVAEKMKNQQQGLV

SEQ ID NO: 172275 - protein, 160 aa, Glycine max
  Coding DNA Sequence Number=SeqID_80590
  Subcellular localization annotation: CTP_CleavageSite=40; ConfidenceScore=5.64e-01
MTLSQLLDNFLHKAHFAATSSCLNAASSFFSKAQTDTAPAAAARAATAYTVTTTVAATTAITTAERDMVEPRTTRRERQSHDSNFAMRRSSCVLTLEGLEQVTEKVWSRGWGSGGHGRGGRRERSRFGWANVGVGGGVNGEVVLARDAGSVLCETQRFCL

SEQ ID NO: 172276 - protein, 34 aa, Glycine max
  Coding DNA Sequence Number=SeqID_80591
MTDLREDGENSIDGEDEEQKQGTYSLLFIGLVKE

SEQ ID NO: 172277 - protein, 591 aa, Glycine max
  Coding DNA Sequence Number=SeqID_80592
  Gene Ontology: Mol. function=aspartate kinase activity; Cellular component=chloroplast; Biological process=amino acid biosynthetic process
  Homolog annotation: Hit_ID=Q9XHC5; Match level="QueryCoverage=88%, HitCoverage=99%, E-value=0.0, Identity=86%"; Hit description =Precursor monofunctional aspartokinase
  Pfam annotation: Domain name=AA_kinase; Domain location=84-325; Score= 208.0; E_value=2.3e-59; Accession=PF00696.19; Description=Amino acid kinase family
  Pfam annotation: Domain name=ACT; Domain location=359-430; Score =18.4; E_value=0.028; Accession=PF01842.16; Description=ACT domain
  Pfam annotation: Domain name=ACT; Domain location=438-500; Score =10.1; E_value=0.66; Accession=PF01842.16; Description=ACT domain
  Pfam module annotation: Pfam domain module=AA_kinase::ACT::ACT; Domain location=84-325::359-430::438-500
  Subcellular localization annotation: CTP_CleavageSite=42; ConfidenceScore=5.58e-01
MASALQQLQGVQGKLAVSMSVRRSLHHCKSQIGFAAFGAPVCARRVWGNRVAFSVTTCKASTSDVIEKNATENGMVSSEGETSFTCVMKFGGSSVASADRMKEVATLILSFPEERPIVVLSAMGKTTNKLLLHLEELEQLLKGIAMMKELTKRTQDYLVSFGECMSTRIFAAYLNKIGVKARQYDAFEIGFITTDDFTNADILEATYPAVAKRLHGDWLSDPAIAIVTGFLGKARKSCAVTTLGRGGSDLTATTIGKALGLPEIQVWKDVDGVLTCDPNIYPKAEPVPYLTFDEAAELAYFGAQVLHPQSMRPARESDIPVRVKNSYNPKAPGTLITKARDMSKAVLTSIVLKRNVTMLDIASTRMLGQYGFLAKVFSIFEELGISVDVVATSEVSVSLTLDPSKLWSRELIQQASELDHVVEELEKIAVVNLLQNRSIISLIGNVQRSSLILEKAFRVLRTLGVTVQMISQGASKVNISLVVNDSEAEQCVRALHSAFFESELSELEMDYKNGNGSVDDLVTVMYQNNVFYLKKYAGLGGMAKHWCITSLGSWYYYAPSKRVLVDLGKCTIEDDDGGVIEAFKSESHGLT

SEQ ID NO: 172278 - protein, 415 aa, Glycine max
  Coding DNA Sequence Number=SeqID_80593
  Homolog annotation: Hit_ID=A7PA18; Match level="QueryCoverage=91%, HitCoverage=93%, E-value=1e-142, Identity=68%"; Hit description =Chromosome chr14 scaffold_9, whole genome shotgun sequence
  Pfam annotation: Domain name=PGAM; Domain location=116-270; Score =72.9; E_value=1.1e-18; Accession=PF00300.13; Description =Phosphoglycerate mutase family
MGASQSVQSLEDSEEEEQEEEEEDDERNLNGPLMGRAQLGNHMVKKVLEQEPEMLPCHASASPLSPQLSSLGTPRLGPSIKVWDPYNVLGPPPPALSRSFSGNGIVTVPDDEALTEVFLISHGECELNLAPDLVGGRCPAAALTVNGKRQARALAVFLKSQGVRFSAVYSSPLNRARSMAVSVCKEQIQSSDALAEISQGNWEGCLRSEIYTPEIQGLIDRFQPDFTAPSGESLRQVEFRMIHFLNGTILALHEKLRFDLSSHQNDSQAFAQHNSHALLTNSIHDQDGPSLPPNQWDLLNRHRPAFSRKKSGKSRLQFVTTTGDEIEDEISSGNVNHQSSLHNSGFNSFSPTVSCIGLFTHSVPIKCLLTGLLGCSPLMSHKFCIEDSSVTVLQHSLRTGWQIKRLNDTAHLRLL

SEQ ID NO: 172279 - protein, 469 aa, Glycine max
  Coding DNA Sequence Number=SeqID_80594
  Gene Ontology: Mol. function=DNA-directed DNA polymerase activity; Cellular component=intracellular; Biological process=DNA replication
  Homolog annotation: Hit_ID=Q9FNY4; Match level="QueryCoverage=99%, HitCoverage=98%, E-value=1e-138, Identity=52%"; Hit description=DNA polymerase lambda
  Pfam annotation: Domain name=NTP_transf_2; Domain location=314-407; Score=20.1; E_value=0.001; Accession=PF01909.14; Description =Nucleotidyltransferase domain
  Subcellular localization annotation: CTP_CleavageSite=55; ConfidenceScore=5.04e-01
MAPKKKPESDPHGMFSGMVVFLVPKGVQSRRFQERLVQMGAVIEERFSKRVTHVFAMHSDALLQQLDRERLSRFKGDCLKSGEILSEDMYLLKLDSQGEHIPEKSLDPGLTNQRTSSDLQQLLNKKSKLSTEDTKIVKNESHDDDGKEKAVFSSTSTISSHGEVDSLSYGNTRQQHLDAENEASSLSYHPPDLNKNITEIFGKLVNIYRALGDDRRSFSYHKAIAVIEKLPFKIESTDQINNLPSIGKSMKDHVQEIMTTGKLSKLEHFETDEKGHRSLDDLRNDDSLTNAQKLGLKYFDDIGQRIPRHEAQEMEHILQKVGEDVLPGVVIICGGSYRRGKATCGDIDIIITHPDGKRQATDSGVDTYFGFCTYPGRELRHRIDLKVYPRDIYAFGLVAWTGNDVLNRRLRLQAESKGFRLDDTGLFPATQGSGGKRGAKGSASLKFNTEKEIFDFLDFPCLEPHERNL

SEQ ID NO: 172280 - protein, 513 aa, Glycine max
  Coding DNA Sequence Number=SeqID_80595
  Gene Ontology: Mol. function=RNA binding
  Homolog annotation: Hit_ID=A2Q620; Match level="QueryCoverage=97%, HitCoverage=96%, E-value=3e-97, Identity=45%"; Hit description =Cyclin-like F-box; Agenet
  Pfam annotation: Domain name=Agenet; Domain location=10-77; Score =58.6; E_value=2.1e-14; Accession=PF05641.3; Description=Agenet domain
  Pfam annotation: Domain name=F-box; Domain location=165-212; Score =36.2; E_value=1.2e-07; Accession=PF00646.24; Description=F-box domain
  Pfam module annotation: Pfam domain module=Agenet::F-box; Domain location=10-77::165-212
MAPKHDLAYTKPGSAVEVSIDDDGFSGSWFSATIVSSWAIDRFLVKYHNLVENELSHTPLQEVVCLHQLRPLPPPEKHRDFKSGDKVDAFHNDGWWEGHITGKLGNGRFRVYFRDTEENMVFSKKQLRTHCKWINHNWVFPTTDHKVSVSGKETEGKKRRRDERDRISELPDCILMHIMSFLDTKDAVQTCILSKRWKDLCKCLTDLTFRSPFRCKCKKYFRKFVSWVLSSRNDSCSLLNVDINNSCIETEELDRVIKYVMFHNVQKLTMYIGLSSRPNLDSLPLVFCSKSLTSLKLCLMHDPSSRIVLPKSLHLPALTSLHLQCVNFTAIDNDCAEPFSNCHLLNTLFLWNCEMHDNAKVLRISNSTLSHLKITSYISFLTTQAFQIALSTPNLSSFTIIGFAPHQLSSSCNLAFLGSVYIGVWFVSSSTFIRCLQVLANVKILKLSWETLQMILYDLSNSNSTMPQPPCFVRLESLHVEKESCQRSDGEINNVVEYLLQNSPKARVDIISA

SEQ ID NO: 172281 - protein, 302 aa, Glycine max
  Coding DNA Sequence Number=SeqID_80596
  Gene Ontology: Mol. function=metal ion binding; Cellular component =integral to membrane; Biological process=multicellular organismal development
  Homolog annotation: Hit_ID=A7PHM0; Match level="QueryCoverage=95%, HitCoverage=75%, E-value=5e-88, Identity=51%"; Hit description =Chromosome chr17 scaffold_16, whole genome shotgun sequence
  Pfam annotation: Domain name=zf-DHHC; Domain location=63-114; Score =65.1; E_value=2.4e-16; Accession=PF01529.11; Description=DHHC zinc finger domain
MALHISCTMSNEVLVLLLLTSGRDPGIIPRNAHPPEPEGFEGSLDVGAGQTPQLRLPRIKEVEVNGITVKVKYCDTCMLYRPPRCSHCSICNNCVERFDHHCPWVGQCIGLNYGGRGDNNLEGNDQNPSLHRVNNIHLRINVTTYENFRYRYDRRANPYNKGVFNNFLEIFCTSIPQSKNNFRAKVPMEPVLPARSVGGGFMSPSMGKAVDDIEMGRKTVWADMGSTALDPSEGQLNERVAVKDGEFGELSPEIRTTVDETSDRAGIHPRRSSWGRKSGSWEMSPEVLALAARVGESNRIAV

SEQ ID NO: 172282 - protein, 314 aa, Glycine max
  Coding DNA Sequence Number=SeqID_80597
  Homolog annotation: Hit_ID=Q9SCT1; Match level="QueryCoverage=73%, HitCoverage=33%, E-value=1e-33, Identity=34%"; Hit description =Putative uncharacterized protein T20E23_30
MKRSDHLRRQAVYLLLACSFSLICKRGEIANHCNNSTLCSSFTTNPDSEHDYFCRKKGSLELFKWILGHLPTAISINHEKYMQMCMNFISSFLQLYLREIHYDHQVLLDYLISKDTGISCAKYLLRCLHLICNSWKLFVEFPLFGEFLDQSSCKRRKIVGDGLHFLADGMPTSIDNSGSIILHIKNYKEDRGGFKYYNIKPFKKAGECLLSLNNSVYNLHQKKLFPYNPKVLLKRYWWHGWTGNREILCWFIVVWSWFTSNPSIILWVWGYMPFLENLVIQAIIALKDVFLADTCLSLGTWSLHSCSYKKACNE

SEQ ID NO: 172283 - protein, 271 aa, Glycine max
  Coding DNA Sequence Number=SeqID_80598
  Gene Ontology: Cellular component=integral to membrane
  Homolog annotation: Hit_ID=A7PI71; Match level="QueryCoverage=100%, HitCoverage=95%, E-value=1e-131, Identity=77%"; Hit description =Chromosome chr13 scaffold_17, whole genome shotgun sequence
  Pfam annotation: Domain name=Tetraspannin; Domain location=4-232; Score=238.3; E_value=1.8e-68; Accession=PF00335.11; Description =Tetraspanin family
MQRFSNTVIGFLNFFTLLASIPIIGAGLWMARSTTTCENFFQTPLLVIGFVVLVISLAGFIGACFHVAWALWVYLVIMVFIIAALLGFAVFGFVVTEQGGGVEVPGRAYKEYRLDRYSPWLRNRIKDPQYWSTIRSCILGSNTCAKLAFWTPLDYVQRDMSPIQSGCCKPPTGCSYNEETVVVTQDPDCYRWNNAPTLLCYDCDSCKAGVLENIRRGWHNISVLNVVVLVFLIGIYSIAFCAFRNARRAQTDYPHGVNRMTKVKPRWDYYW

SEQ ID NO: 172284 - protein, 463 aa, Glycine max
  Coding DNA Sequence Number=SeqID_80599
  Gene Ontology: Mol. function=catalytic activity; Biological process =alkaloid metabolic process
  Homolog annotation: Hit_ID=A7R3A9; Match level="QueryCoverage=94%, HitCoverage=96%, E-value=2e-90, Identity=55%"; Hit description =Chromosome undetermined scaffold_499, whole genome shotgun sequence
  Pfam annotation: Domain name=Abhydrolase_1; Domain location=54-272; Score=26.5; E_value=3.6e-05; Accession=PF00561.11; Description =alphabeta hydrolase fold
MEYLLNSITQEEDTMSMIISGNCIDKKHYVLVHGACHGAWSWYKLKPRLESAGHKITSLDLAASGINMKKIDDVHTFSQYSDPLLRLMATIPKNEKVVLVGHSLGGLNIALAMDKFPKKVTVGVFLAAFAPDTEHQPSYVLEKYNERTPSSAWLDTEFAPSGNKTSMFFGPNFLSNKLYQLSPIEDLELAKTLVRPSSLFVEDLSTQKNFSKEGYGSVPRAYIVCTEDIAIPMEYQLWMIQNAGINDVLKIKGADHMAMNSKPRELFESLEKIPRLESEGHKVTVLNHAASGINMKKIEDVDTFSEYTEPLLQLLDTIPSNEKVVLVGHSLGGMSIAIAMEKFPEKVAVGVFLAAFAPDVEHRPSYVLEKDLELAMTLARPSSYFIEDLSKEKNFSKQRYGSVPRVYIVCPEDLGIPLNYQHWMIQNAGFNDVAEINGADHMPMFCKPQELCDSLQQIAAKYQ

SEQ ID NO: 172285 - protein, 750 aa, Glycine max
  Coding DNA Sequence Number=SeqID_80600
  Gene Ontology: Mol. function=serine-type endopeptidase activity; Cellular component=integral to membrane; Biological process =proteolysis
  Homolog annotation: Hit_ID=Q9FGD4; Match level="QueryCoverage=95%, HitCoverage=94%, E-value=0.0, Identity=66%"; Hit description =Protease-like
  Pfam annotation: Domain name=Peptidase_S15; Domain location=498-720; Score=-112.9; E_value=0.063; Accession=PF02129.9; Description=X-Pro dipeptidyl-peptidase (S15 family)
  Pfam annotation: Domain name=Peptidase_S9; Domain location=534-749; Score=139.2; E_value=1.1e-38; Accession=PF00326.12; Description =Prolyl oligopeptidase family
  Pfam annotation: Domain name=Peptidase_S9_N; Domain location=25-439; Score=8.4; E_value=3.1e-12; Accession=PF02897.6; Description=Prolyl oligopeptidase, N-terminal beta-propeller domain
  Pfam module annotation: Pfam domain module=Peptidase_S15::Peptidase _S9::Peptidase_S9_N; Domain location=498-720::534-749::25-439
MRPLFRLAQVARRHYKASSPPPPSPPKAPKKPQKFSFDGATWEDPYSWMSQLNDKVAMRHMDVCVEQEEKYAEAVMSDSDNLLNKLHFEMASRMPFDLSTPPLRWGPWLYYRRAEEAKPYPVLCRRLASLYEDFISHKYPPAGFDFTTGKTIEQKLLDYNQEAQRFGGYAYEELSEVSPNHQFLAYTMYDKENDYFKLSVRNLNSGSLCSKPQADRVSNLAWAKDGQALLYVVTDKKMRPYRIYYSLIGSTDEDVLLLEESDESVHVNIRHTKDFLFVTVNTFSTTSSKVFLINAADLLSGLKLVWECDALAHCTIEHHRVDDPSSTRKWEEVLVDDPGLIIEDIDFSDKYLALIVREGRKVQLCSVGLPLPFGKGAVKLRKLDLQYLPIPRHVCQITPGPNYDFFSSVMRFIISSPVMPDAVVDYDLATGKWNIIQQQNVLHDRTRILYGKNSASISMESSNSKHSNPVNVNSEDDHLWNDLSEFYACEQYEVPSFDGVLIPLTIVFARNNKIEAKKPGILHGHGAYGELLDKRWRSELKSLLDRGWVVAYADVRGGGGFGKKWHNDGRRTKKHNSINDYISCAKFLIEKDIVHENKLAGWGYSAGGLLVASAINRSPDLFRAAVLKVPFLDATNTLLYPILPLIAADYEEFGYPGDLDDFLAIREYSPYDNIRKDVLYPAVLVTSSFNTRFGVWEAAKWVARVRDLSVYDPKRPILLNLTTDLVEENRYLQSKESALEATFLIKMMEY

SEQ ID NO: 172286 - protein, 61 aa, Glycine max
  Coding DNA Sequence Number=SeqID_80601
MDIYGPENLHLPQRYTEQSLSKFTVEQVYHLYDCEDYLRKNLSALDPEMQDAPVKAGIVVV

SEQ ID NO: 172287 - protein, 78 aa, Glycine max
  Coding DNA Sequence Number=SeqID_80602
MSHHEEEAPKNESHKQEEHKMVKKTSSPYELNFNDDLETRQGKGGIMHTNVMHNDETSANTRISERDSSGLTRLTTEQ

SEQ ID NO: 172288 - protein, 76 aa, Glycine max
  Coding DNA Sequence Number=SeqID_80603
  Gene Ontology: Cellular component=integral to membrane
  Homolog annotation: Hit_ID=A7R353; Match level="QueryCoverage=61%, HitCoverage=29%, E-value=6e-13, Identity=74%"; Hit description =Chromosome undetermined scaffold_484, whole genome shotgun sequence
MEELPGAFGSSASLALRLGQTVFSTASLLFMCLDVDFYGYTAFWHCFFHFSLQCIRIFKEIRKQYRSNRRFVEDIF

SEQ ID NO: 172289 - protein, 57 aa, Glycine max
  Coding DNA Sequence Number=SeqID_80604
MLVFEPIRSSCGGVIVFFEVATMFGQEDLDEGPSDLRKERWERERGRDTLWGKKDEI

SEQ ID NO: 172290 - protein, 239 aa, Glycine max
  Coding DNA Sequence Number=SeqID_80605
  Gene Ontology: Mol. function=protein binding
  Homolog annotation: Hit_ID=A7PV27; Match level="QueryCoverage=94%, HitCoverage=43%, E-value=1e-98, Identity=76%"; Hit description =Chromosome chr4 scaffold_32, whole genome shotgun sequence
MKSIVLKLLRENNSLPSYARSTDICNDTIYRSCRSCLDSLLSLFKQAAEPDKPSEDRDPIAKCIALEADNLSWLLEILVDKQAADEFALMWANQQELALLHTKLPTMLRYHVSCLSGRLYVGIGRGELLPSKDTRRLLLQTWLQPLMNDYNWLQHGCRSFDRKLVEEGIGRTILTLPLEYQQSILLSWLGSFLKTGDSCPNLQRAFEVWWRRTFIRPYVENQGNVAVSDSSLMLPKQHE

SEQ ID NO: 172291 - protein, 120 aa, Glycine max
  Coding DNA Sequence Number=SeqID_80606
  Homolog annotation: Hit_ID=A5B4R8; Match level="QueryCoverage=94%, HitCoverage=8%, E-value=2e-07, Identity=28%"; Hit description =Putative uncharacterized protein
MSNMQCYYWDENDHVQARCKQMKEDLKKLRDMNKDGKNSQASVVKSVEDKDDVFLTTNDKVGKTKWVMNYVASKHICRDREMFDTLKTNGEFDHFKLGNGGKMKVEGIGSVRMKLHDDAI

SEQ ID NO: 172292 - protein, 370 aa, Glycine max
  Coding DNA Sequence Number=SeqID_80607
  Gene Ontology: Mol. function=heat shock protein binding; Biological process=protein folding
  Homolog annotation: Hit_ID=O82368; Match level="QueryCoverage=44%, HitCoverage=53%, E-value=6e-29, Identity=42%"; Hit description =Uncharacterized protein At2g29880
MGDSQENNKGKSRDKDNYESWTMEDTNELLHLLVDAMNRGLRDANGSLSKQNVERIILPQLNAKTKFPKTYSHYLSRMKWFRNQYNMMSTLMRNNSGFGWDPIGKTFTTHEDVWKDYLKSHPSHSKLRGKSMVDYEYLKIVVGGGVSSGNNSISVDPDDTDATTFEPENRTVGIEEFSYDPNSDTFITPNNYEPAYQPSSPNQPSPPSHPPLDSERRRSEYGGSSSAIGINNQGNVLENLSVGIGTIAVNFEKISNMMEKREKDRDRDRELEGIFKSRFTIFKSAPPFLFKTQVELVLACAALHNFLRKECRSDEFPVEPTDESSSSSSVLPNYEDNDHEPIVQTQEQEREDANIWRTNIGSDMWRNANN

SEQ ID NO: 172293 - protein, 197 aa, Glycine max
  Coding DNA Sequence Number=SeqID_80608
  Homolog annotation: Hit_ID=A5C2E1; Match level="QueryCoverage=97%, HitCoverage=50%, E-value=3e-10, Identity=26%"; Hit description =Putative uncharacterized protein
MDGLIEVLNCILEQYLRAFVHDKSVTYGKSPSSIPSYLLGSSPVEAIDSLLATQATIHETLQCHLSKAQATMKRHKVTHRCDVQLSVNDWPYQGPSPPSPDPLPPMATDNHPIIEHMSILDWKWDTTTNPLTKLPLVHWFGLPSEDTTSEHWEDLWASHNLLDKVNFPEKGDDSNIATYTRPKRTQKKRPNYLIDFV

SEQ ID NO: 172294 - protein, 115 aa, Glycine max
  Coding DNA Sequence Number=SeqID_80609
IQRTNRLRILCLNTLEGTSFVVQVEDTYTWVVVTENKRGYISCGSVQVEGTSTWLFKENKGGYIPCGSLLVKVFTRLKEISRIGGCLGTGCRHGLLPNQLFLKVYGRKGLWHLLA

SEQ ID NO: 172295 - protein, 561 aa, Glycine max
  Coding DNA Sequence Number=SeqID_80610
  Gene Ontology: Mol. function=protein serine/threonine kinase activity; Cellular component=integral to membrane; Biological process=protein amino acid phosphorylation
  Homolog annotation: Hit_ID=A7PY45; Match level="QueryCoverage=92%, HitCoverage=73%, E-value=1e-104, Identity=45%"; Hit description =Chromosome chr15 scaffold_37, whole genome shotgun sequence
  Pfam annotation: Domain name=Pkinase; Domain location=2-489; Score= -103.5; E_value=0.021; Accession=PF00069.16; Description=Protein kinase domain
  Pfam annotation: Domain name=Pkinase_Tyr; Domain location=224-489; Score=-158.0; E_value=0.0097; Accession=PF07714.8; Description =Protein tyrosine kinase
  Pfam module annotation: Pfam domain module=Pkinase::Pkinase_Tyr; Domain location=2-489::224-489
MQNGNLQDALLHRKCPELLNWNTRFSIILNVGKGIHFLHSYDPPVIHGDIKPSNVLLDRDFWPRIGDFGLARLSSDTPRFEVEVLECGSVDNDEEKMKTKKKEEEEEVVVVDDCGSVESAHSVFMEEGDMGVEQSPSPEMAAMTSPETNLAVAEASPGFEKGSAQSEKEGVKKINEKGLKSNSVRDWWWKHEDEVGVGEGKKVKDYVMEWIGRDVNKERVKSGIELENVEIGKEEKNKKEKKRRKKELEWWESMEEEKFDGVVKGKRRTVREWWKEECFEENVNAKTTKKKKKEKKKRKGGSVKSDDDENCGDDWWMSDDAMDKRKGKSRSRNNRGNMDCWMDGLSGELWRGRRNNSFDSASGEIPKSGGVSSTPSIRGTVCYVAPECGYGGEVSEKCDVYSFGVLLLVIISGRRPLQVSGSPLSEFQRANLLSWARHCARNGKLVELVDESIELLDKEQALLCIRVALLCLLKSPARRPSMKEVVGMLSGELEPPQLPVEYSPSTPSRFPFKSSRKGSFVPRWKSHVVKPGILPCMQLHVISKIVYFGSPMQNFNNLCKY

SEQ ID NO: 172296 - protein, 222 aa, Glycine max
  Coding DNA Sequence Number=SeqID_80611
  Subcellular localization annotation: CTP_CleavageSite=19; ConfidenceScore=5.38e-01
HMATPPSSPPPHPESAKPSSSTSKKTRKETRLKSLATRLVGAERPMVHVDPAIGKVDDLTFKWALADDKEDEDDKVCEKYDISYDYLEEKLMEDKKKKRLEEATRSGSTHTIVDPPSLIRQHVKWMARTKKSGQMTTEATKKIAYKIDSRKSRPQREALSLKDELSHIYFHGSRRPRAVDTKNQGPAREGLTLPPESEVGPSTNVLAQRKVLSIPWNKTRHG

SEQ ID NO: 172297 - protein, 252 aa, Glycine max
  Coding DNA Sequence Number=SeqID_80612
  Gene Ontology: Mol. function=RNA-directed DNA polymerase activity; Biological process=regulation of transcription, DNA-dependent
  Homolog annotation: Hit_ID=Q8H6Q8; Match level="QueryCoverage=57%, HitCoverage=4%, E-value=3e-23, Identity=38%"; Hit description=CTV.20
  Subcellular localization annotation: CTP_CleavageSite=74; ConfidenceScore=5.75e-01
MPPKAVGTSQRGGRSSSKGFKLALPEPTIKKSSSVSSRSPTQAGSSTQKTKVEGWNLNFGTKNPFKATYKAFPSGFHFKPTAINKTRTFYELILVDSNLVSIKHFKNPKDQSLNAHSTIQILNILQPRHFGQDLNKGKKILVPFDPVGYTYWDYVDAWIKVFWHHNTRYKHSWLIYFKTNTVYNLPNWFFQRWDFFGPIPEIFPEQPAQSLKKAWQRTLKEVLQVLQQEEEGSSSKKEETSSSEEEEEDPFY

SEQ ID NO: 172298 - protein, 136 aa, Glycine max
  Coding DNA Sequence Number=SeqID_80613
  Subcellular localization annotation: CTP_CleavageSite=83; ConfidenceScore=5.16e-01
MPPKVSSSSGRGGRSRSKGKEVLLALPEPIIKKTTSSSSGSLTQTGSSTQKTKIEGSLTQIATIKPESSTQDSPKPVTTKQTVADYAWSIQTLQAFEDMGLTKIPKLAKKTWAEMASESDDDFETDPKDQANQDSL

SEQ ID NO: 172299 - protein, 37 aa, Glycine max
  Coding DNA Sequence Number=SeqID_80614
MMQSYPARALDSRLQVDWIRDVREGPRVLMSLRVGYP

SEQ ID NO: 172300 - protein, 116 aa, Glycine max
  Coding DNA Sequence Number=SeqID_80615
MPGAACCSVIPDKNGRSYGGGCHAHCHDCRMRAVGRQLVPRRSPGQRLGRFAAMRADAAAGLDRSGYDAAAQPDRDSDVGDAGDAVQQPAASLSAAAFLHGAGGRPGGGQPQLQLR

SEQ ID NO: 172301 - protein, 372 aa, Glycine max
  Coding DNA Sequence Number=SeqID_80616
  Subcellular localization annotation: CTP_CleavageSite=25; ConfidenceScore=5.07e-01
MPSLSAASVKLQASATRMNTSRSVRLSNGIDGQFISHFGADTLRLFICWESHYECLTRRRRRKTLAGDLRHRPIHLYRRHGRNAARRAADPDSQHLERIDRPRRAADFPACPVRRAVRPAGGAGRPAHGSPQPADRLSATADRRQPAGRRRYLHGAAVRCAHPAGLLHRRYLGHRRRIGGTSGAAGLRRIGAVRHLRRRSGGLGARRAARGVPRRSAGLAHGVSGRRRPGGADPAPAAVRAAAAAGHAGGELAVVHRAARESPVAPRAAADVSAGRRPLYGLHLCPPAAADGRRHREPLGGAAAVRLRRRRYRREFHRRPGRHQTAAPHPGADRLRAGARRPAAAAAGPRAAERRCLPPAVGHRLRAAFPCR

SEQ ID NO: 172302 - protein, 231 aa, Glycine max
  Coding DNA Sequence Number=SeqID_80617
  Gene Ontology: Mol. function=unfolded protein binding; Cellular component=plasma membrane; Biological process=iron-sulfur cluster assembly
  Homolog annotation: Hit_ID=P0A6Z2; Match level="QueryCoverage=100%, HitCoverage=37%, E-value=1e-107, Identity=89%"; Hit description =Chaperone protein hscA
  Pfam annotation: Domain name=HSP70; Domain location=1-216; Score= -205.3; E_value=3.9e-07; Accession=PF00012.11; Description=Hsp70 protein
MLLLDVIPLSLGLETMGGLVEKVIPRNTTIPVARAQEFTTFKDGQTAMSIHVMQGERELVQDCRSLARFALRGIPALPAGGAHIRVTFQVDADGLLSVTAMEKSTGVESSIQVKPSYGLTDGEIASMIQDSMSYAEQDVKARMLAEQKVEAARVLESLNGALAADAALLSAAERQVIDEAAAHLSVVAQGNDADAIEEAIKNVDKQTQDFAARRMDKSVRVALKGQSVDEV

SEQ ID NO: 172303 - protein, 132 aa, Glycine max
  Coding DNA Sequence Number=SeqID_80618
MRAQPEEEAGLQLRRGGYRTTTMHIGARFRPDRCMEMSADHACHHNSDLPLPKRIVPTRHSVGPEKSNRVLGFPALVTSLCQFYRVPVAPSKVGAGRGIIVAGNRRTATTSKAPQLIYKGWSVAYDTWPTSR

SEQ ID NO: 172304 - protein, 53 aa, Glycine max
  Coding DNA Sequence Number=SeqID_80619
MSISPCRRIVFARHPVDPEKSNKVMGFPTLVTGLCQFYGVLVAPSKVIRPPTN

SEQ ID NO: 172305 - protein, 362 aa, Glycine max
  Coding DNA Sequence Number=SeqID_80620
  Gene Ontology: Mol. function=galactonate dehydratase activity; Cellular component=nucleus; Biological process=metabolic process
  Homolog annotation: Hit_ID=Q6BF17; Match level="QueryCoverage=100%, HitCoverage=94%, E-value=0.0, Identity=92%"; Hit description =Galactonate dehydratase
  Pfam annotation: Domain name=MR_MLE; Domain location=106-211; Score =78.8; E_value=1.8e-20; Accession=PF01188.12; Description=Mandelate racemase  muconate lactonizing enzyme, C-terminal domain
  Pfam annotation: Domain name=MR_MLE_N; Domain location=1-88; Score =139.2; E_value=1.2e-38; Accession=PF02746.7; Description=Mandelate racemase  muconate lactonizing enzyme, N-terminal domain
  Pfam module annotation: Pfam domain module=MR_MLE::MR_MLE_N; Domain location=106-211::1-88
IETDEGIVGWGEPVIEGRARTVEAAVHEFGDYLIGQDPARINDLWQVMYRGGFYRGGPIMMSAIAGIDQALWDIKGKVLNAPVWQLMGGLVRDKIKAYSWVGGDRPAEVIDGIKKLRGIGFDTFKLNGCEEMELIDNSRAVDAAVNTVAQIREAFGNEIEFGLDFHGRVSAPMAKVLIKELEPYRPLFIEEPVLAEQAEYYPRLAAQTHIPIAAGERMFSRFEFKRVLEAGGVAILQPDLSHAGGITECYKIAGMAEAYDVGLAPHCPLGPIALAACLHVDFVSHNAVFQEQSMGIHYNKGAELLDFVKNKEDFNMEGGFFKPLMKPGLGVEIDEARVVELSKNAPDWRNPLWRYEDGSVAE

SEQ ID NO: 172306 - protein, 134 aa, Glycine max
  Coding DNA Sequence Number=SeqID_80621
GLALPPESEVGPSAACVSTKESCVDPLRNDPNTVKVGVEEVRDAYAPILVPTKEGAVGPAKPADRPDHDVDDHLYLMTLTIPQLFLKSLQVMWDATVFGVFNDNFPLYIKHEDVSEIAHGGQCLNISILQLWVL

SEQ ID NO: 172307 - protein, 117 aa, Glycine max
  Coding DNA Sequence Number=SeqID_80622
MKTSSKSHTVVNVSAYQCYSCGFCQTTTLRGLLTGLDDAPRPKSKAPARWIVIKCNRQKGSTECGYYVMHWMSNIILGTFRNNWEAYFNDPRPLEPERLKALRIQWAQYYLRVRDQT

SEQ ID NO: 172308 - protein, 91 aa, Glycine max
  Coding DNA Sequence Number=SeqID_80623
MALKAVTGLFLEPSVKLRSFFGFWCKDWRIGGHLRYISPEVQSRQHCRCCVRGSVAWKAVYPLGSGHYFPQLLLLASKGSALRFQQCTECG

SEQ ID NO: 172309 - protein, 106 aa, Glycine max
  Coding DNA Sequence Number=SeqID_80624
MRGYLTVIHTFGQPGENEPVDARGLTSSSAPFVVLSHEVKGKRARWRPEINIVLGSFFRLTRESCDMRGYLMVTHTVRQPGANEPIGARRLISSSAPFVVLTREVR

SEQ ID NO: 172310 - protein, 223 aa, Glycine max
  Coding DNA Sequence Number=SeqID_80625
  Homolog annotation: Hit_ID=A1RNW2; Match level="QueryCoverage=90%, HitCoverage=68%, E-value=2e-23, Identity=30%"; Hit description =Putative uncharacterized protein
CHELAHFLNHHNYFISSEDEDNRIIEAWADNFGSKIFMVLITFGEKTSDLCKKFEVPEHAGDRVNLIGDAFKKLCNMFYRNESKKYHYRIERMMHICAGISSFLQFYWGRLDIQLTVDIYLRLYESSGMYDIIETDLEFFPPSNDNFDKIIEIHFPLQNNQPAITLGLKKQYRKYIDTAFLKDLSMIKDYRRVFYQTAIAQAEKYEISENLKEFFEDKLKELG

SEQ ID NO: 172311 - protein, 269 aa, Glycine max
  Coding DNA Sequence Number=SeqID_80626
  Gene Ontology: Cellular component=cell projection; Biological process= cell adhesion
  Homolog annotation: Hit_ID=P13421; Match level="QueryCoverage=60%, HitCoverage=92%, E-value=3e-28, Identity=46%"; Hit description =Fimbria A protein precursor
  Pfam annotation: Domain name=Fimbrial; Domain location=28-178; Score =145.7; E_value=1.3e-40; Accession=PF00419.11; Description=Fimbrial protein
MKLNKIMLASVMAFGVVAGAQAAGNGAGTVTFTGSIIDAPCSITPETVDQTVELGQVSKAQLETANKTGSSNPRPFQIKLENCDTATLKTVTTTFTGASSQYDKDLLGMTGTATGASIAITDGSGKKIALGQATDAQTLQDGNNTLSFAAFLQGGGASATINPGGNYESVYHFCPQFSVVVSSDINYRCDARSAQCDPGIFAAPDQLGKSRGLAFSIDDAQSHQLQHYLSSHTVDDSGMALNYIVANNSPRFRLSGAHILSVLISVALF

SEQ ID NO: 172312 - protein, 78 aa, Glycine max
  Coding DNA Sequence Number=SeqID_80627
MSLPSAVNVSSIINRGASGDWENKRGYISCGSVQVEGTSTWFFKENNGGYIPCGSLACKGFYKVERNLKNHRFLGDWM

SEQ ID NO: 172313 - protein, 154 aa, Glycine max
  Coding DNA Sequence Number=SeqID_80628
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=33%, HitCoverage=50%, E-value=4e-24, Identity=100%"; Hit description=LacZ protein
MHALYVGLVFCHGKPENPYHLLNCTHGALCPQMRNPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 172314 - protein, 268 aa, Glycine max
  Coding DNA Sequence Number=SeqID_80629
LTPIIARGFNSTNAGVLQKVCKAWEMVQKRDKKLRGSSNGPIGGYHRWLKAYAQGLDWLPNLRTTKGLEFETPEEDDEVQALKTELEKAQIVKEKFKSKAVRIRKENAKLRDVNMATTKALEQETKRAWDQLRVDSFILKDELRICLRSKRCLSQRLCESETNMLAIISKYQEELNLAMAHEHKVVDEYARVYAKKEARGRVIDSLHQEATMWMDRFTLTLNGSQQLPRLLAKAKAMADAYSAPEKIHGLLSYCQHMIDLMAHIIRNR

SEQ ID NO: 172315 - protein, 159 aa, Glycine max
  Coding DNA Sequence Number=SeqID_80630
MTIIIYAFWVEENFPCRGNGLVCMTRGNPGDLQSFDPEIDRKFHRLVRHSVHPDHFVHFEHSEYSVAGDSEYSDFEHSTTNFHTENMAQPPPRERTLREMTAPDFTYESLCIQYPDFTYVLNTGQMHLLPKFHGLVGEDPHKHLKEFHIVCSTMKPPDV

SEQ ID NO: 172316 - protein, 105 aa, Glycine max
  Coding DNA Sequence Number=SeqID_80631
  Homolog annotation: Hit_ID=A2PD90; Match level="QueryCoverage=43%, HitCoverage=26%, E-value=2e-13, Identity=78%"; Hit description =Putative uncharacterized protein
MVWIYFTPLPGFFSPFPHGTGSLSVDIEYLALEDGPPMFRQGFSCPALLVVTLVPQTGFRIRDYHPLRSDFPFRSTIASAKSNRLFHVRSPLLTESRLISFPLGT

SEQ ID NO: 172317 - protein, 67 aa, Glycine max
  Coding DNA Sequence Number=SeqID_80632
MWDMPIIRLNIGRKCIAFLVFFLENAMNSLSAPAALKLVECTYCAKRVYLLRMNIHPLDTVPVAKRG

SEQ ID NO: 172318 - protein, 79 aa, Glycine max
  Coding DNA Sequence Number=SeqID_80633
SAKRNTHWLSARKNLEEDELYKFAERTASSYYNSAKRTSTNKATYLSLKSDFVRGRPELEEEVVLRALDEFMSGCEILE

SEQ ID NO: 172319 - protein, 63 aa, Glycine max
  Coding DNA Sequence Number=SeqID_80634
MDCPLWMLWSMECNIYGVKIKFDGPTNIGAGSGLRVDVGGITRAEEGTGAVEEEGAGVSGGTE

SEQ ID NO: 172320 - protein, 291 aa, Glycine max
  Coding DNA Sequence Number=SeqID_80635
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLEIKIEAQTSEKNRKLDTDLQLPTASEVLGLLHHFQPGRSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 172321 - protein, 308 aa, Glycine max
  Coding DNA Sequence Number=SeqID_80636
  Homolog annotation: Hit_ID=Q6WAY6; Match level="QueryCoverage=77%, HitCoverage=41%, E-value=9e-08, Identity=23%"; Hit description =Putative uncharacterized protein
MGTRGCISYNPILAIRQLGYPMRGAPLEDELTPVISRGFNKTNVETLQKDKELKGSNNGPIGGYRKWLRAHVQGLDWLLSLRTAKREEVEAPEEDEEVQALRAELEQAQTIKERLKSAALNIRKENAELRDTNIATTKALERETKRARNKFRGALWGSNSELKLQREERDQSRVDSLILKDDLKACSRSKRSLSQRLCETETNMLTIISKCQEELNLAMAHERKVADEYAQVYAKKEAKGRVIDSLHQEATMWMDRFALTLNGSQELPRLLAKAKAMADTYSAPEEIHGLLNYCQHMIDLMAHIIRNR

SEQ ID NO: 172322 - protein, 239 aa, Glycine max
  Coding DNA Sequence Number=SeqID_80637
  Homolog annotation: Hit_ID=A5C169; Match level="QueryCoverage=56%, HitCoverage=11%, E-value=8e-07, Identity=27%"; Hit description =Putative uncharacterized protein
MIIDQSLFFSLTKLPSQGAPFEGTIVDDCKFDYSSHDARRMVCNGHAEMIDRLLVGSLTFDCCIMHYIIVRILLPRSSNLAQASKEDLILMWAFLTGRQIDWAHLVRNRMHKALQANAPLPYPQLVTLFLRHFQIPLDDETFVQVKRSFAIGAGAVTSFGYRKDRDGQWLKKDALPPQEERTPSPPPQQDDSSALMNEELNCHHQKGGDCRSKDFDFGVLMMPYDHDVLMPYEDAILKV

SEQ ID NO: 172323 - protein, 209 aa, Glycine max
  Coding DNA Sequence Number=SeqID_80638
SSVETRGIGRRREPVQAEQYSQQMMERQHGMYYTPTTFSEYPSQMYQYPFAGHHTDTSETSHSFGGVAETQPHFSWPTMTPSQRHDAPIATPNAPFAPQWNRLRKQKRGDNAAAEEILIVKREDGIDHVAHLHDITDTIMTDFDGFEDGLGLEVSGLRVYGLGLEGLWVMFRLEWFKGLGFGLRVYGLGLEFRGLRVLWGLGFGLGFLE

SEQ ID NO: 172324 - protein, 16 aa, Glycine max
  Coding DNA Sequence Number=SeqID_80639
DDYEEPDARGHRNTML

SEQ ID NO: 172325 - protein, 108 aa, Glycine max
  Coding DNA Sequence Number=SeqID_80640
  Homolog annotation: Hit_ID=A7PCC3; Match level="QueryCoverage=99%, HitCoverage=84%, E-value=2e-26, Identity=57%"; Hit description =Chromosome chr2 scaffold_11, whole genome shotgun sequence
MGYRPLTKDKECESLVTVVVGKEKRVFLVDPCILQENPFRVLMDTSTRKEEDHQEDKDHHHLHQSSRVVFVDVDAILFEHMLWLMHNDCSSLFKLNLKEIIDFYAQDI

SEQ ID NO: 172326 - protein, 366 aa, Glycine max
  Coding DNA Sequence Number=SeqID_80641
  Gene Ontology: Mol. function=protein transporter activity; Cellular component=clathrin coat of coated pit; Biological process =intracellular protein transport
  Homolog annotation: Hit_ID=Q3E8F7; Match level="QueryCoverage=93%, HitCoverage=86%, E-value=1e-129, Identity=64%"; Hit description =Uncharacterized protein At5g46630.2
  Pfam annotation: Domain name=Adap_comp_sub; Domain location=115-366; Score=379.0; E_value=7.4e-111; Accession=PF00928.12; Description =Adaptor complexes medium subunit family
MVDAFRTHIMQTKELGTCPVRQIGGCSFFYMRISNVYIVIVVSNNANVACAFKFVVEEPYEFSKLAQIVLYGPIEKRDAVALFRSYFGGAFDEDAIRNNFVLIYELLDGLPGYCGKCKSSNVFKSVLRCDVTGKILMKCFLSGMPDLKLGLNDKIGLEKEAQLKSRPTKSGKSIELDDVTFHQCVNLTRFNSEKTVSFVPPDGEFELMKYRITEGVNLPFKVLPTIKELGRSRIEVNVKVKSVFGAKMFALGVVVKIPVPKQTAKTNFTVTSGRAKYNASIDCLVWKIRKFPGQTESTLSAEVELISTITEKKSWTRPPIQMEFQVPMFTASGLRVRFLKVWEKSGYNTVEWVRYITKAGSYEIRC

SEQ ID NO: 172327 - protein, 107 aa, Glycine max
  Coding DNA Sequence Number=SeqID_80642
MHYVSVKTRMRERKKEETGLPDIVAIEAVDENVAAEVEEVNGGSGNRHLRSTLPEDQSEIVGDGGSAADLWFRDRAEASPPIWWIGFVRTREKVAGEFDNSELLTMN

SEQ ID NO: 172328 - protein, 156 aa, Glycine max
  Coding DNA Sequence Number=SeqID_80643
MRRSARLRRRITSFFFSKFPDEYCEENLWKIFSKYGKMNVNIPKFERPQVAFTIDEGGTSYRGQINTKTKTWKSRCGKQALEEEKKWWEMELNIQRSNLDRLNNCWVGHLIDLSLVDRLEDVYVNENAKKIKFNYLGDDMVLILGCTKEWFNESTK

SEQ ID NO: 172329 - protein, 53 aa, Glycine max
  Coding DNA Sequence Number=SeqID_80644
MTKNKWRMENWRTALGNKFMGLRKKWRMENWRTALGNKFAGLQTRWWRTHEQR

SEQ ID NO: 172330 - protein, 97 aa, Glycine max
  Coding DNA Sequence Number=SeqID_80645
MTFQFEFLKFRYWNSRWKVLFPHPLTIHILSITKGGNNSSSNSKRAFNLNKVHLPVMPYAYGSGLDGPNQFDDRFEGPTIESNLPQKLKLDLLNEEA

SEQ ID NO: 172331 - protein, 433 aa, Glycine max
  Coding DNA Sequence Number=SeqID_80646
  Homolog annotation: Hit_ID=A2Q6G0; Match level="QueryCoverage=20%, HitCoverage=41%, E-value=2e-08, Identity=34%"; Hit description=IMP dehydrogenase/GMP reductase, putative
  Pfam annotation: Domain name=DUF1723; Domain location=115-165; Score =22.8; E_value=0.0011; Accession=PF08330.1; Description=Protein of unknown function (DUF1723)
MVRTRGLGRALVRRQRVHVTEDVTQTLEDVPQLNEDVPHVSDATPEMTGAVDAANTEGVATDGSEGSSAANEGFPGGPCDPSILTGFAEHVAHSIWSGQLVSHGRKVDKFGRPAPEIEGMIAATGLSPLTRETSTFHLLVGELTITLDDMASLLHLPITGTLHTFEPLVTSDTVVLLTELLEVSPEEARAETHQASGPHVWLSWLWDVYESRCQARWDLAQTGGFSWGAAALVHLYEHLNEASQTPTWQMAVLDIRALFDGASAHMMGIKGATYRARMEVLTVTDVSWMPYVEHRARVLRQFGYIQTVPPPHVCDSLMGPDIDDQWLHFLDHLVPFITPNEDSAEPSHPPTPYDKEFVEPPIPKVPVASDLPTHLVVDCQGCEAMAEDLERVINLRMVTEGTNLYDIMARCLRIATGDDADGSLRPRQRRCIG

SEQ ID NO: 172332 - protein, 158 aa, Glycine max
  Coding DNA Sequence Number=SeqID_80647
  Gene Ontology: Mol. function=catalytic activity; Cellular component =cytoplasm; Biological process=multicellular organismal development
  Homolog annotation: Hit_ID=A7PCB4; Match level="QueryCoverage=98%, HitCoverage=47%, E-value=8e-51, Identity=61%"; Hit description =Chromosome chr2 scaffold_11, whole genome shotgun sequence
MAAASGMPEEETAMFPDKSVHPRLDVYVWDMDETLVLLNSLLKSSYAEAFNGLKDVQKGVEIGRTWENLILQICDDYFFYEQIENYNKPFLDALAQYDDGRDLSDYDFNEDELVSPHDDANKRKLAYRHRVIAQKYLQEIQESGLIEEGREREWSDRR

SEQ ID NO: 172333 - protein, 384 aa, Glycine max
  Coding DNA Sequence Number=SeqID_80648
MEICKTHISFLGTEIGNEYNKMKPYNQGVPLLTKASPSGKGYTTFVLLSGPHKGVYTNFKDLCLAKEGIQSLIYKGFYSKEEVEKALELNTTNMNKIKKALEPQNTTIFINIDQTKVNHKTYKDTVNPGISEPINGLNLENFKKIQSLLFKVHNRQTQIQGLYIGMHAYFNQKFICTNKTPYCEDKTNCPCKIKFLFRKARLDLDQFKSFGYEDLAISAKRFEGFNPSINEAINLIQAEMMDYIAIKITTCPSNFTTHNYPCHGNTQYQYSLMRAQIQGYQWFFLESDKCEFDLIRETYDTKIFQPSYNGKFFIPFPVYHNNKLVQFFQKEKKDKEIYEASGCHGQQTPPFPSTDLSMEDSSNIFYSGTVQEEEDVTITKSIKT

SEQ ID NO: 172334 - protein, 102 aa, Glycine max
  Coding DNA Sequence Number=SeqID_80649
MGVSLLLLGIELKLQHGVSLLLLGPTHSEPLIACADASDIIELSPSQAYLNPLASQRALSRVSEGEAHGCAFQRRKDARSRHQRLFVENVGKTEGNRSKLKF

SEQ ID NO: 172335 - protein, 189 aa, Glycine max
  Coding DNA Sequence Number=SeqID_80650
MTTLTQTWMTLLLSNIQPIDHNSDLPLLKCQLVYAILTWMSVHVAQLIADAIYLFAGMSPTRHPLDPDKSNRALGFPTLITGLCQPFGVRVTPSKVIRPPITWAIIEKYCTPRQAQGGDPQAPDALPPPPQADPAGSFDTERAEVAWPEDWPEAQAGEAPAEAPDDGEEAHMDEEMTDMLDFLGGSGAT

SEQ ID NO: 172336 - protein, 116 aa, Glycine max
  Coding DNA Sequence Number=SeqID_80651
  Gene Ontology: Mol. function=nucleic acid binding
  Homolog annotation: Hit_ID=Q2HUJ1; Match level="QueryCoverage=63%, HitCoverage=29%, E-value=3e-09, Identity=44%"; Hit description=H+ -transporting two-sector ATPase, alpha/beta subunit, central region, related
MEEINAYPIQCHLKDNLLWKADPTGMYSTRSAYKLLSNLNSFAPDGRKFQLIWKLKIPPKVAIFTWRLIKDRLPTRANLHRRNVGTCGGLWLIWGVFVCWWGLVMGLYVFFGRLAA

SEQ ID NO: 172337 - protein, 118 aa, Glycine max
  Coding DNA Sequence Number=SeqID_80652
  Homolog annotation: Hit_ID=Q9SVA6; Match level="QueryCoverage=28%, HitCoverage=9%, E-value=3e-07, Identity=79%"; Hit description=GTP -binding-like protein
MSWQEELERNQKASGSKSDGCARQVASYEFTTLTCIPGVITYRGAKIQLSALCSEGPVVDWGGGGGQFIGKYMLLLSIRHNCNFSSAPQHLPQFGGQEPCILHIMSLYIFEAKWGPFL

SEQ ID NO: 172338 - protein, 104 aa, Glycine max
  Coding DNA Sequence Number=SeqID_80653
MIFVSQAQYKPIKSLVIHLKVVRKLQTLNHTLVSRGKHQPCEENIDRCGKDHWKKEELRPLTVLKHSELAWKLFLFLIRKRRLHLAKVAQKGRKKKKFWSRPNP

SEQ ID NO: 172339 - protein, 83 aa, Glycine max
  Coding DNA Sequence Number=SeqID_80654
MRGVATNVYSRKTSEQPERCGLRTLSVKGSGVVFTHGEDRRTMKNERRTMKNGEESSRNRSLKRLRSVTEALRLRENPKYQKG

SEQ ID NO: 172340 - protein, 95 aa, Glycine max
  Coding DNA Sequence Number=SeqID_80655
MKKRDTGHQSVSLENKTGDSTVLKIGNSAKVVIKQDMKGRRHTYGFNNNKREKAEKVRVVDDETGDKHQLDEVLRMPFLRMPCKTKYRCLNQRTM

SEQ ID NO: 172341 - protein, 319 aa, Glycine max
  Coding DNA Sequence Number=SeqID_80656
  Gene Ontology: Mol. function=4 iron, 4 sulfur cluster binding; Cellular component=integral to membrane; Biological process =tricarboxylic acid cycle
  Homolog annotation: Hit_ID=P36683; Match level="QueryCoverage=92%, HitCoverage=34%, E-value=1e-128, Identity=77%"; Hit description =Aconitate hydratase 2
MDVSTLTTGMLIDLYPWKGEIRETESQRLVTTFTLKTEVLLDEVRAGGRIPLIIGRSLTAKARESLKLAPSEVFRQPAAPAPSTAGFTLAQKMVGKACGVAGIRPGQYCEPKISTVGSQDTTGGMTRDELTDLACLTFSADLVMQSFCHTSAYPKPVDVRLHETLPQFITHRNGVALKPGDGIIHSWLNRMLLPDTVGTGADSHTRFPLGISFPGGSGLVAFAAATGIMPLDMPESVLVRFKGEMQKGITLRDLVHAIPLYARKQGLLTVEKKNKRNVFSGRILEIEGLEALSAEQRLNWPTRRLNGRCRLRDAPGGRE

SEQ ID NO: 172342 - protein, 45 aa, Glycine max
  Coding DNA Sequence Number=SeqID_80657
MITWIAYDIIGLPIGTCDLSNNKLNGTISSYFSGLARLQKLKYQE

SEQ ID NO: 172343 - protein, 81 aa, Glycine max
  Coding DNA Sequence Number=SeqID_80658
MRIILGALVDHVSGVFVPLEFIEFLRVVAFHLYNAGLKLVENIIVYHGRWRGIGIFWEWLSPETRSCADHKCVLKKDDGTQ

SEQ ID NO: 172344 - protein, 53 aa, Glycine max
  Coding DNA Sequence Number=SeqID_80659
MASQHNDDKGDKSGEWDDEFRMKMKKKQELFGLALNIASIGTLSVETTGVGTS

SEQ ID NO: 172345 - protein, 122 aa, Glycine max
  Coding DNA Sequence Number=SeqID_80660
MVPLVQDIPTQEEAGCQPSQHSLVVVRSLMWVFLVFDISLDIELSRLSATSKFDVRKIPVPGQLEHRCQSGKGIDHLILLSKNKVKGYVIKVLYQFSDVGLVGYQLMILGLSFSSQLVDYQG

SEQ ID NO: 172346 - protein, 54 aa, Glycine max
  Coding DNA Sequence Number=SeqID_80661
MGIRNTKMSACAVFGTPKCFDVNNKYTLEVHNLGNGPEEACLKEVQEGQGSRRN

SEQ ID NO: 172347 - protein, 132 aa, Glycine max
  Coding DNA Sequence Number=SeqID_80662
MGDQEEIQEQMKADMSALKEQMASMMDTMLGMRQLMENNMATAVAVSSATEADPTLPTTVHHPLPNMVGRERSTLGHISNPYLGYNRVAYPYRLPPNYTPPVMRDDAVMSLPPSLKGLASSTVGRCSRGHRE

SEQ ID NO: 172348 - protein, 158 aa, Glycine max
  Coding DNA Sequence Number=SeqID_80663
  Homolog annotation: Hit_ID=Q5NRP4; Match level="QueryCoverage=39%, HitCoverage=4%, E-value=9e-07, Identity=37%"; Hit description =Putative gag-pol polyprotein, identical
  Pfam annotation: Domain name=zf-CCHC; Domain location=85-102; Score =21.5; E_value=0.00084; Accession=PF00098.14; Description=Zinc knuckle
MKGRHRSHLRPHSHRREKERKPQEVNINLPYFHGKDNVEANFRLGNKDQGQGILGVRPSKPKDDKGKTIEKQPLKASMQEKTSSMKCFKCLGRGHITSQCPTKKTMIMRGQDIYSSQDEATTSPSSSKSEEAKGEESSEEIYPQEEGQPLMVKESVRR

SEQ ID NO: 172349 - protein, 106 aa, Glycine max
  Coding DNA Sequence Number=SeqID_80664
MGLVLLDPPRSLMGGCAEKSTGHPEAKHRPPRVVSRVRVAGAGVTIKQYFGSAPRSSCISSFIPPEELEQLTQQIRDQLEESITEKVIGQLIASFSQMQPQLQSQM

SEQ ID NO: 172350 - protein, 222 aa, Glycine max
  Coding DNA Sequence Number=SeqID_80665
  Gene Ontology: Mol. function=GTP binding; Cellular component =intracellular; Biological process=cell cycle
  Homolog annotation: Hit_ID=P58316; Match level="QueryCoverage=100%, HitCoverage=93%, E-value=2e-93, Identity=81%"; Hit description =UPF0174 protein yaaW
  Pfam annotation: Domain name=UPF0174; Domain location=24-220; Score =498.8; E_value=6.7e-147; Accession=PF03667.4; Description =Uncharacterised protein family (UPF0174)
HCSEEQLANFARLLTHNEKGKTRLSSVLMRNELFKSMEGHPEQHRRNWQLIAGELQHFGGDSIANKLRGHGKLYRAILLDVSKRLKLKADKEMSTFEIEQQLLEQFLRNTWKKMDEEHKQEFLHAVDARVNELEELLPLLMKDKLLAKGVSHLLSSQLTRILRTHAAMSVLGHGLLRGAGLGGPVGAALNGVKAVSGSAYRVTIPAVLQIACLRRMVSATQV

SEQ ID NO: 172351 - protein, 139 aa, Glycine max
  Coding DNA Sequence Number=SeqID_80666
MILHEIRRPNSLKIVPSGVANCRNLPFGGRKMHGVATNVYSRKTSEKSERCGLRTLIVKGSGVIFTHREGISTSRIRHKGRQPLIKRETLRRWTINDLLVFESRETLRRWTINDLLGWSTKAEFLLLRILNCNEEIIPM

SEQ ID NO: 172352 - protein, 116 aa, Glycine max
  Coding DNA Sequence Number=SeqID_80667
MKAYLNPGAEIECKDEFIYEEESCRAVSNLPGNERGDQAMFRYLCVCMDKRQFRAIQVSMHNRVASSFWLIGCKAIIRGFSSASVSSSSSSASISRTRPTGCLISSARCSACESTS

SEQ ID NO: 172353 - protein, 203 aa, Glycine max
  Coding DNA Sequence Number=SeqID_80668
  Gene Ontology: Mol. function=nucleic acid binding
  Homolog annotation: Hit_ID=A7MFL4; Match level="QueryCoverage=88%, HitCoverage=19%, E-value=3e-22, Identity=37%"; Hit description =Putative uncharacterized protein
MHMDNANLHSPMVGNRQYCIYWPRNGKRTQSTALLRQYGEISMPENARTLVDGVYEQKIAAPEGLQTLSDIAFGKVLSQRSIAAQNLLRHDLGYDREASDFLWDKDREFSTRLGEESVDVYLAWLGEAGELHPVVAEGDFRWEMSRLSVRISWWRKQSGEFSLPDDEVLEQFRKKHHRPAAQVILVSPEGEASYYNKQTGLGR

SEQ ID NO: 172354 - protein, 71 aa, Glycine max
  Coding DNA Sequence Number=SeqID_80669
MSQWTDRADWGWVRDVREGPRILMSLRALYLVMQSYPARALGRRLQVEWARDPREGPRVLMTLRIYFEPMD

SEQ ID NO: 172355 - protein, 74 aa, Glycine max
  Coding DNA Sequence Number=SeqID_80670
MGHLSKADISELKAGTIAHDLSPSGWLKWANKAPVKRVRLYCSTTCIFIKGRNPRLSLGETMSTKSRLTLKKPS

SEQ ID NO: 172356 - protein, 140 aa, Glycine max
  Coding DNA Sequence Number=SeqID_80671
MLAWRLQQKTSLQVTCCCSSAPTNETLRSSQAPITRYKNCKEKLGSKCRGHPVVQRQLPPHGDQPRSQGSSKPSDMPSSSRISNMVIAPPCTYTTYIATMKSSTSTSTSSYLNVIIKINIISSQYHHQHQHHLISISSST

SEQ ID NO: 172357 - protein, 91 aa, Glycine max
  Coding DNA Sequence Number=SeqID_80672
MVRFYNDTFMEPHPPQQPVATTAMLEPPAPALADVDMPRQAVEACQRIAERLEHLLNMRMVTARTEAYTVIEECLRITRGATEQQNVYVRG

SEQ ID NO: 172358 - protein, 110 aa, Glycine max
  Coding DNA Sequence Number=SeqID_80673
MSGARMRSKSILPLGFGGGGNGESEAGVGEREESKEFSDCVVLNSLTREKGDTKEFRWLVLRSFGKGRRETQKEFRREPENFRKLLAKEEEEEIQEDVQRDSKDVKDCNQ

SEQ ID NO: 172359 - protein, 129 aa, Glycine max
  Coding DNA Sequence Number=SeqID_80674
MVPKNYDRKLVILSEMDKEVSPTLIDLVGCPFWARVYNVPLNLRIQRVVESIENMLREIKVKISRENIREKKEEIQVEVSVDTTHTKPKESAQPIEEMAGASLSGGEEGRGEVGARREEEDGGRDDASP

SEQ ID NO: 172360 - protein, 71 aa, Glycine max
  Coding DNA Sequence Number=SeqID_80675
MDNSLKVGKDERKERDMKFKPQMSPLIQNQVQDFPLSVLRCHEACKACRTCTKCDYMMWQCGVASKCSPPP

SEQ ID NO: 172361 - protein, 45 aa, Glycine max
  Coding DNA Sequence Number=SeqID_80676
MEEKKKKQLKEAAKSGSTYTVIDCDDKKLKGQSKNECKKDRFKKE

SEQ ID NO: 172362 - protein, 154 aa, Glycine max
  Coding DNA Sequence Number=SeqID_80677
MGGADGVGVEIEKEVDDNETISRDGPSIPLSPPFNLFPMWSFWPKEGSLCRTGGGGDEAQSGRIVDPGRIMEINEEGSSFGKWMIVQRSIMRKKGNLTKKKEDLGGGQIKGNVSKIPVGGNKFGILVENNNDKEISLLDNGGILTKSDDAARAA

SEQ ID NO: 172363 - protein, 355 aa, Glycine max
  Coding DNA Sequence Number=SeqID_80678
  Gene Ontology: Mol. function=DNA binding; Cellular component=nucleus; Biological process=regulation of transcription
  Homolog annotation: Hit_ID=A7QMK6; Match level="QueryCoverage=98%, HitCoverage=99%, E-value=1e-130, Identity=69%"; Hit description =Chromosome chr19 scaffold_126, whole genome shotgun sequence
  Pfam annotation: Domain name=Myb_DNA-binding; Domain location=37-88; Score=47.2; E_value=5.7e-11; Accession=PF00249.22; Description=Myb -like DNA-binding domain
MERMFPPKKPSTMNSHDRSMCVQGDSGLVLTTDPKPRLRWTVELHERFVDAVAQLGGPDKATPKTIMRVMGVKGLTLYHLKSHLQKFRLGKQPHKDFNDHSIKDGMRASALELQRNIGSSSAMIGRNMNEMQMEVQRRLHEQLEVQKNLQLRIEAQGKYMQSILEKAYHTLAGENMATNMKGMGAPLGTTEMGVMKEFGSLNYPSFQDLNIYASGDQQLDGFMPSNNNNETLFVGKKRPNCPYSGSGKSPLIWSDDLRLQDLGTASSCISPQDDPFKGDHKVQISPPSMDSDPISEIYDTKPMILHGESVSDQNKFDASMKVERPSPKRSPLQPDRTSPMINSSSVAQGRSSPFG

SEQ ID NO: 172364 - protein, 134 aa, Glycine max
  Coding DNA Sequence Number=SeqID_80679
VIRSPITRAFIEKYCTQRQAQGDAPQAAGAPPPPHQACPAGSFDTEQYLRHLVRQQAANHQAHVQTHDCLYQMSLSMQSQGFASFSCPTPDQFRAEVAWPRDWPEAQAGEASPEAPGDGEEAHEDEEMVDLLDF

SEQ ID NO: 172365 - protein, 266 aa, Glycine max
  Coding DNA Sequence Number=SeqID_80680
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPACLTQRHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 172366 - protein, 192 aa, Glycine max
  Coding DNA Sequence Number=SeqID_80681
DKESVDDTVCKKYDISKEKWAQFRQTRRDPSREDVRKKAQSIQKQNTAHHVLSRGGYEYLENKLIKEKKKKKVEEAAQSGSTNTVIDPPSPIREHVKRKMARTKKTGQMTSETTKEIADKIDSLEEQASQGSFVAHGQHPGRVRATGAGVTIKKYFGPAPRTSCTSSSMTPEDLEQLTQKIKDQLEDQSQKK

SEQ ID NO: 172367 - protein, 373 aa, Glycine max
  Coding DNA Sequence Number=SeqID_80682
  Gene Ontology: Mol. function=4-hydroxy-3-methylbut-2-en-1-yl diphosphate synthase activity; Biological process=isoprenoid biosynthetic process
  Homolog annotation: Hit_ID=Q2NS40; Match level="QueryCoverage=100%, HitCoverage=100%, E-value=0.0, Identity=92%"; Hit description=4 -hydroxy-3-methylbut-2-en-1-yl diphosphate synthase (EC 1.17.4.3) (1- ...
  Homolog annotation: Hit description=hydroxy-2-methyl-2-(E)-butenyl 4 -diphosphate synthase)
  Pfam annotation: Domain name=GcpE; Domain location=9-361; Score =846.3; E_value=1.6e-251; Accession=PF04551.5; Description=GcpE protein
MHNQAPINRRKSTRIYVGKVPIGDGAPIAVQSMTNTRTTDVEATVNQIKALERVGVDIVRVSVPTMDAAEAFKLIKQQVNVPLVADIHFDYRIALQVAEYGVDCLRINPGNIGNESRIRSVVDCARDKNIPIRIGVNGGSLEKDLQEKYGEPTPEALLESAMRHVDILDRLNFDQFKVSVKASDVFLAVQSYRLLASRIDQPLHLGITEAGGARSGSVKSAIGLGMLLSEGIGDTLRISLAADPVEEVKVGFDILKSLRIRARGINFIACPTCSRQEFDVIGTVNALEQRLEDIITPMDVSIIGCVVNGPGEALVSTMGVTGGHKKSGFYEDGVRQKERFDNEQMIDQLEAKIRAKAAMMDESNRITVNLLEK

SEQ ID NO: 172368 - protein, 49 aa, Glycine max
  Coding DNA Sequence Number=SeqID_80683
MKDDFVGQRRLLYEDIGSLRSRLLYDNCYEGGSCSCGHEGCGDDSCGEE

SEQ ID NO: 172369 - protein, 35 aa, Glycine max
  Coding DNA Sequence Number=SeqID_80684
MEAMKEQMAIMMEAMMSMKKIMPMRLQLPLPALLL

SEQ ID NO: 172370 - protein, 19 aa, Glycine max
  Coding DNA Sequence Number=SeqID_80685
MEYETAPAEMSPMRVVPST

SEQ ID NO: 172371 - protein, 189 aa, Glycine max
  Coding DNA Sequence Number=SeqID_80686
  Gene Ontology: Mol. function=chitin binding; Cellular component =extracellular region; Biological process=chitin metabolic process
  Homolog annotation: Hit_ID=UPI00006A17C9; Match level="QueryCoverage =69%, HitCoverage=98%, E-value=4e-12, Identity=30%"; Hit description =UPI00006A17C9 related cluster
QGWTFSPWVKVYGKLGFWLKACRTTGHDICQGVGLANVVILVRMIRTRLFAAARVKSCPGMHSSCVIATSSSCALTVGPPPASGGVDVEPTESEDAKPSKGEGACSTLKSRTCSPLKARACTPLMARACGPLKARVCGPLKARACSPLKARVCGPLKARACSPLKVRTCSPLKVRTCSPLMARTCGPLK

SEQ ID NO: 172372 - protein, 52 aa, Glycine max
  Coding DNA Sequence Number=SeqID_80687
  Subcellular localization annotation: CTP_CleavageSite=22; ConfidenceScore=5.09e-01
FVCSSRSWSMVMGTAMVGATVASATVVGAVVTGWTWKVGSGKGASNSDVSET

SEQ ID NO: 172373 - protein, 134 aa, Glycine max
  Coding DNA Sequence Number=SeqID_80688
MQEQYVHYDAEEMFMRCMIRMHLRTREPGKSSLLTAHSGAQCPMCAVKKMIWIFRLPTTKDETHIQRMCDNMMQMRKSATGGCIESPVESPTVATCPSRASEGEAHGCTFQRRKDAWSRHQRLFVENVGKTEGN

SEQ ID NO: 172374 - protein, 426 aa, Glycine max
  Coding DNA Sequence Number=SeqID_80689
  Homolog annotation: Hit_ID=Q6WAY6; Match level="QueryCoverage=88%, HitCoverage=75%, E-value=2e-35, Identity=27%"; Hit description =Putative uncharacterized protein
MVSIWDLARVEVSMEPIASLAQYYDQPLRCFIFGDFQLSPMVEEFEEILGCPLRGRKPYLFSGFYPSLARISKKVQISAQELDRQKQVENGVVGIPRKCLEAKARILADTGEWTPFIDILALLIFGGVLFPNVDGLVDLAAIDAFLAYHNHKESPVVAMLADLYDTFDRRCEKSNTRIEGRIGVLISCGGFPNVPLLGTRGCISYNLVLATRQLGYLMRGSPLEDELTPVISRGFNKTNMETLQKVRKAWEVVKKKDKELRGNNNGPIGGYHEWLKAHVQGLDWLPSLRTAKREKDEAPEEDEEVQALRTELKQAQTVKERFKSAALKIRKKNAELRDINIATTKALEQETKRARREEHGRNKFRGALWGSNNELKLRREERDQSRTNMLAIISKYQEELSLATGHEHRVADEYAQVYADQETRGR

SEQ ID NO: 172375 - protein, 201 aa, Glycine max
  Coding DNA Sequence Number=SeqID_80690
MERSMIDAASGGALGDMIPAKARNLIEKMASNSQQFSARNDAIVIREVHEVATNSSTSSETKKLEAYAANIYNRPPQPQQQNQPPQNNYDLSSNRWSNPSQQQQQQQQPYFHNAAGPSRPYVPPPIQQQQQQQQPQKQQTVKAPPQPSLEELVRKMTMQNMQFQQETRTSIQSLTNQMGQLATQLNQQQSQNSDRLPSQSV

SEQ ID NO: 172376 - protein, 196 aa, Glycine max
  Coding DNA Sequence Number=SeqID_80691
  Subcellular localization annotation: CTP_CleavageSite=78; ConfidenceScore=5.64e-01
MACPLACVPKDPSCTSTNICSASLASTHRSSTTSWFLLYRIFPLRKKPVSNFTTFFCRYQRPLAGLPRHLNLMYNKSSCGLKWNMDASMARAHQFMVFGLSFTLQLVNYQGRVPIYLEQLDLEVNCRLDPKGIRLILSYVVYVVETQPSHERRAVKPHNPFVPVFILYFFFEQGHDVIIWEFWMHRLIVIDGLLSQ

SEQ ID NO: 172377 - protein, 152 aa, Glycine max
  Coding DNA Sequence Number=SeqID_80692
  Gene Ontology: Mol. function=unfolded protein binding; Cellular component=cytoplasm; Biological process=response to stress
  Homolog annotation: Hit_ID=P27323; Match level="QueryCoverage=24%, HitCoverage=5%, E-value=6e-10, Identity=78%"; Hit description=Heat shock protein 81-1
MPSKAAIFAWRLIKDRLPTKSNLRRSQIEINDSKCLLCRIQQEDAAHLFFNCTKSLALWWESLAWTGIVGAFPIIPRYHFLQHQNGMNGGKRNNRWKDVDEEKDKEEQNKKKIKEVSHECSLVNKHKAIWMTKPEEITKEEYSAFYKSLTND

SEQ ID NO: 172378 - protein, 68 aa, Glycine max
  Coding DNA Sequence Number=SeqID_80693
MTRARARKAKEALQQVLSILLNTSPSFKEKVQGCVEEKSPEFQESRDLRSNPFQGRGNDAILPRKSIG

SEQ ID NO: 172379 - protein, 201 aa, Glycine max
  Coding DNA Sequence Number=SeqID_80694
MKDKRDEEEKLEKQKKKKDSKALSSKGKGKEKEEKDSSKKIVKKENHFATKGDIKITLLLKQSFYLLLSRETSLSTAIPLELEVIPQVKELLDEGLVRKSLNPYALLVPKIGIIRHQIPDRWNNQHENKEKGMFYSITFLNFLNSDQGLPMDPKRIKVIFEWPTPPSVEERINEFQEPLDLRSSPFQGGGNDAILPPKGIG

SEQ ID NO: 172380 - protein, 137 aa, Glycine max
  Coding DNA Sequence Number=SeqID_80695
MTQELVACEDTLRLSAPRHSSAPFPEMSASSGGDFFKSHKLSRTTHSRVRWHAETNYGHSAPFCHPEATGPMTCRDKLWSFRTPFCHSDTVVSDGTQRQIMVILCPSSIAADKPVDTRRFTSSFALTRSVILTFESR

SEQ ID NO: 172381 - protein, 281 aa, Glycine max
  Coding DNA Sequence Number=SeqID_80696
  Homolog annotation: Hit_ID=A2Q4S5; Match level="QueryCoverage=38%, HitCoverage=16%, E-value=8e-13, Identity=34%"; Hit description=IMP dehydrogenase/GMP reductase, putative
MEMKLELRQYSVMGHMYAYHGYEKFIMANMSQSGSYAWGAAALVHMYDNLNDACKSGSRQLVGYITLLQHFPSIAKAFTNSEYDERSPCAYHRTSTKASTKALPTSMYQKRLDRLTTVDVCWMPYDDHCAVREFDLISCFSGRSRLCFEVIDDKWMHFFDYLAPVGQICVVLGQCAPNYMDWFYMILHPFMRPTQPGDPPRHPLVMQDETYVESDMPEYPVATAAMEEAPTHASSDVEQPRHAVACHAIAERLEWLLNLRIVTKATETYDVMQDCLRIARG

SEQ ID NO: 172382 - protein, 165 aa, Glycine max
  Coding DNA Sequence Number=SeqID_80697
DGVIRSKVHGISMIIDQSLFFSLTKLPSQGEPFEGTIVDDWKFDYSSHDARRMVCNDQADMTVKRSFAIGAGAVTSFGYRKDRDGQWLKKDALPPQDERTPSPPQRDDSSALMNEVLSELRGLRTYVGERFDYLDGCFEGMDTCITQLEEDVTYLRRCFDLPPPS

SEQ ID NO: 172383 - protein, 197 aa, Glycine max
  Coding DNA Sequence Number=SeqID_80698
EEYGREKFQGALWGSNSELKLRREERDQSRVHGMILKEELAACARSKRSLAQHLEATEQSMLVIIGQYKEELNQSVAHEQKLVEDFAQVYAEKEARWRVIDALHQEATMWMDRFALTLNGSQDLPRLLAKAKAMAEVDDMSERASSDVLPKNGGVFCGRKVVGPFLSRQLGRSSCSMVYQSGSFPDPIMEGLGNCLH

SEQ ID NO: 172384 - protein, 95 aa, Glycine max
  Coding DNA Sequence Number=SeqID_80699
  Homolog annotation: Hit_ID=A6FJQ2; Match level="QueryCoverage=40%, HitCoverage=84%, E-value=2e-11, Identity=92%"; Hit description=50S ribosomal protein L5
MRKEKIPHQAPFAIQAAQLLGRAIGAGLFAITPAGERGMCCKAIKLGNARGVATYPSAGGRPEGSRVRLPRKENAQSCQQHFFEENVGKTRKNMV

SEQ ID NO: 172385 - protein, 152 aa, Glycine max
  Coding DNA Sequence Number=SeqID_80700
VAPTRHPVDSEEPKRALGFPTLVTGLCQSYRAPVPPASSCHRGIGVAPTRHPVDPEDPNRALGFPALVTDLYQSYRAPVPPASSCHHDIENSNRVLELPALIIGLCRFYGVSVAPSKVIRPLLIELSSRRTAPPGRRRAKHPSSLGTADNGQ

SEQ ID NO: 172386 - protein, 118 aa, Glycine max
  Coding DNA Sequence Number=SeqID_80701
  Subcellular localization annotation: CTP_CleavageSite=37; ConfidenceScore=5.76e-01
MGSQPASPPPPPPSPPPPPPAPSDASALPFATKRTHKASRLRSLSTRPPGVERPVVHVDPATGKTDGPHRKKLRIYLGIVARDKVDVTYENWKKAEFDIPEATYSRMKRKSLQIVGER

SEQ ID NO: 172387 - protein, 50 aa, Glycine max
  Coding DNA Sequence Number=SeqID_80702
MSRKSVPGYEKKMQLPQEPLNGKPRGLARKSMAETNFVELYGATTEKRHN

SEQ ID NO: 172388 - protein, 130 aa, Glycine max
  Coding DNA Sequence Number=SeqID_80703
  Subcellular localization annotation: CTP_CleavageSite=41; ConfidenceScore=5.28e-01
MAQCFLILSFLVLSFLILSVGGILPCTSASPLFFVSLRLVRSGEGEGTSVQRCGDRWRHMRYAFALGVHSGVPQVVRIKLIRNLRTNQLDQHVNLKDTDQVDTQAIYMRINLIRNLPADQLDPQETYGSS

SEQ ID NO: 172389 - protein, 456 aa, Glycine max
  Coding DNA Sequence Number=SeqID_80704
  Homolog annotation: Hit_ID=A5C9E2; Match level="QueryCoverage=75%, HitCoverage=56%, E-value=1e-40, Identity=32%"; Hit description =Putative uncharacterized protein
  Pfam annotation: Domain name=DUF827; Domain location=157-397; Score= -115.9; E_value=0.087; Accession=PF05701.2; Description=Plant protein of unknown function (DUF827)
MCPHCVVQDLTRLRSSDSVVLVARPQYGSWQNARLLANDGRAVDNNIVLVNIPQKHSSKVKQLHRGTNDIVRYKETKWAVECAKAQAEAELSNAKQIVKDLFSMIGESMYKAKAEMRDIAPLKKYVKPRNDDNQYSQVMTELEHAKRELFQLKLHVGSVLEEKFEEQLVVQLDKMDALNELRDIEKLQNTRNKLKEAIEAIDEAKELEMKLATTLSDIDMLKNEFKFPTKEEIEAAKKDLASITKQGFKFMASIDVTRNQLKHVSAATIHLKNTKSKIGAKVRNLSYKLLRPKSKLEAVSAAEEKAKSIVSNLTQTLDKLKSKTKAAKKEKDLIINGEVAEIKEEIKKALLEIKVSEERFQGAMQELQAVKSSEALTLEKLKILRENAMKDRISNVTKPCNKGDWMVAFGIWEFDPLKLSNPFPDNRISAHIWQGYENKVVASKIQRFVTQKLPSI

SEQ ID NO: 172390 - protein, 125 aa, Glycine max
  Coding DNA Sequence Number=SeqID_80705
MTTDSPPLLMFPWTRWSRQLSQPTLRREGDARAHGCVFHRRKMRGVATNGYSRKTSEKPEKTLSQPTLRREGDAGLMGASSMKGKCTESPPTFIRGKRRKNRKRRGLRTLSVKGSGVVFTHGERY

SEQ ID NO: 172391 - protein, 295 aa, Glycine max
  Coding DNA Sequence Number=SeqID_80706
MSKGQCVHLHPFRRCQHLPVETFSSLTSYLELRRSEFLIGGYVGSKSIAFVGRPTISVILALRSCDMRRQNLVIPHPFAIQTQSCPMARRDKIWSFCTLCHPEAAGPMTCGDKIWSFRTPSPFRHSRVRWHAETRFVYSAPLCHSDTVVSDGTQRQDLVILHPLSSRGGGPDDMRRQNLVILHPLSSRGGGPDDMRRQNLVIPHPFAIQTQSCPMGRRDKIWSFCTLCHPEAAGPMTCGDKIWSFRTPLPFRHKLCPMVRRDKIWSFCTLCHPEAAGPMTCGDLHHLPHSQDLSY

SEQ ID NO: 172392 - protein, 90 aa, Glycine max
  Coding DNA Sequence Number=SeqID_80707
MNVDMEALKDQTASMMEAMLSMKRMMDPGLSSNALLKMKCECPKSHFVVMRNSISMPSFSSFTNWVPASGQSDALGPIRKLRAEVTSSPG

SEQ ID NO: 172393 - protein, 371 aa, Glycine max
  Coding DNA Sequence Number=SeqID_80708
  Gene Ontology: Mol. function=metal ion binding; Cellular component =integral to membrane; Biological process=ubiquitin cycle
  Homolog annotation: Hit_ID=A5BPX2; Match level="QueryCoverage=74%, HitCoverage=82%, E-value=1e-78, Identity=57%"; Hit description =Putative uncharacterized protein
  Pfam annotation: Domain name=PHD; Domain location=141-183; Score= -5.5; E_value=0.059; Accession=PF00628.20; Description=PHD-finger
  Pfam annotation: Domain name=zf-C3HC4; Domain location=139-180; Score= 37.3; E_value=5.7e-08; Accession=PF00097.16; Description=Zinc finger, C3HC4 type (RING finger)
  Pfam module annotation: Pfam domain module=PHD::zf-C3HC4; Domain location=141-183::139-180
  Subcellular localization annotation: CTP_CleavageSite=35; ConfidenceScore=5.73e-01
TDAINNPSSICSSSSSASLPYSSGYKKQLASPPPLASSSGTRISPALVFIFVILAIVFFISGLLHFLVRFLIRHRSSSSSSISQSNRYPDDMSESDDPYQRQLQQLFHLHDSGLDQALIDALPVFLYKDIIGLKEPFDCAVCLCQFSEQDMLRLLPLCNHAFHIDCIDTWLLSNSTCPLCRGSLYDPGFAFENPVYDLEGVREEDGVSGSVPGEGVCDNKHAENHTISGKRVFSVRLGKFRSSNIVEGVETGGGGESSTSNLDVRRCYSMGSFQYVVADSDLQVALCPNRGDGGGVSDSSMRQLKGRLTNYGNSSTDDVEGKKINITRKGESFSVSKIWQWSKKDKVSISQENHLGGSNVTAALPWVNRAL

SEQ ID NO: 172394 - protein, 75 aa, Glycine max
  Coding DNA Sequence Number=SeqID_80709
MTWTLGLGLSCLLGLVIGIAVRPYIIPNTERYQSLPLHRDMEALPNQSGEASYRCCSSAPKAQLLAAVAPLFTQS

SEQ ID NO: 172395 - protein, 296 aa, Glycine max
  Coding DNA Sequence Number=SeqID_80710
  Gene Ontology: Mol. function=diphosphate-fructose-6-phosphate 1 -phosphotransferase activity; Cellular component=6-phosphofructokinase complex; Biological process=glycolysis
  Homolog annotation: Hit_ID=Q41141; Match level="QueryCoverage=37%, HitCoverage=23%, E-value=4e-41, Identity=66%"; Hit description =Pyrophosphate--fructose 6-phosphate 1-phosphotransferase subunit beta
MPVCVSSSAPSKVLDLEVAVNKEEYQVFEELGRGHFGTVFRCFQHRGLRLHQNGGLGGWWRGGGGCRQRGDGKEAAPGEEVIVIVVGEEVAECIDPAKKKELDGLRAEMPVALAEGDRKAVSEPVRATVGGFGAERFPRAACKLEAEDWRGSIRWSGSRRSQYYLQDLAEGSTLYGFRGGPAGIMKCKYVELTSDYIYPYRNQFKQAEETVQELDLGGLVVIGGDDSNTNACLLAEHFRSKNMKTRVIGCPKTIDGDLKCKEVPTSFGFDTACKLGVHMEYPGAGTSSNTRVWSWA

SEQ ID NO: 172396 - protein, 110 aa, Glycine max
  Coding DNA Sequence Number=SeqID_80711
MAGTFFLLKKQNSLEIMNVINLGTPQFSLSSSKSDIQYDHISTSTPYGLDKPRKFLGKYNEYRQQGGGLLAIMHHKKRKTLKRFSLSLSKSDIQYDHRSTSTPYGLEKPG

SEQ ID NO: 172397 - protein, 235 aa, Glycine max
  Coding DNA Sequence Number=SeqID_80712
MAPKKLLTKRARKTTTGEGSSASLQAESEFDGHHFRSEEHQCRFKAIKALRGQWIPYDEDAINQFLGYPLVLEEGQCCEYTERKSQVSGFDEEIIGQLLCSPGQDFARSVTRRRVQIMHNSMTTLTQIWMTLLLGNILPSIATPRHLVDPENFNRTLGFPTLITVPHAKTSTAAGVGPAAAAGRRRSTATSIASLESISAHMPNFQAGAGPTEASRDENKAEEDGDMADVMDFFL

SEQ ID NO: 172398 - protein, 135 aa, Glycine max
  Coding DNA Sequence Number=SeqID_80713
MRPRRKAPKKGERRATSPKNVWRDSADLARFKPRRKKARGEKSSVDVQHPSSVNGRAGRSSRVNGEGILFSVESAVDEIKKDEIKKDEIGGKWLFATLPLDLGLGEGRGSEFDLVKLEVVSDGLFEVIDDDVVLG

SEQ ID NO: 172399 - protein, 79 aa, Glycine max
  Coding DNA Sequence Number=SeqID_80714
MTAEWRRKKERKSHFKEKMSLEEAHHHRRPWIRAWRKKEMNEGRGREEHEILCSKRALKSEPTNPRSSPRFSTKCASVS

SEQ ID NO: 172400 - protein, 129 aa, Glycine max
  Coding DNA Sequence Number=SeqID_80715
MSQPTLRREGDARAHECVFHGRKMREVSTNAYSRKTSEKWEKTLSQHTLRREGDARAHGCVFHERKMCGVATNVYSRKTLEKPEKTWSTNFECERFGSCIYARGKGVSLAPTYSSIVIRKSDLRSSSEN

SEQ ID NO: 172401 - protein, 207 aa, Glycine max
  Coding DNA Sequence Number=SeqID_80716
  Gene Ontology: Mol. function=motor activity; Cellular component=cell projection
  Homolog annotation: Hit_ID=UPI00016621D1; Match level="QueryCoverage =97%, HitCoverage=41%, E-value=3e-18, Identity=31%"; Hit description =UPI00016621D1 related cluster
GLQVLTFRGLHALAFKGLHVLTFRGPQVLTFRGLHALAFRGQHVLTFRGLHALALRGQHILTFRGLHVLAIRGLHALTFRGLHVIAFKGLHVLTFRGLHALTFRGLHVLAIKGLHTLAFRGLHVLAFIGLHALTFRGLHVLAIGELHALTLRGLHILAIRGLHALTLRGLHVLTIRRLHVLTIKGLHALAFRGLYVLTLKRTARPRL

SEQ ID NO: 172402 - protein, 36 aa, Glycine max
  Coding DNA Sequence Number=SeqID_80717
MPKEVKSYFSPLSRKSKCTGEKFLWRKIQVFLWRKR

SEQ ID NO: 172403 - protein, 227 aa, Glycine max
  Coding DNA Sequence Number=SeqID_80718
MEAIKEQMATMMKAMMSMKKIMEANAVIVAAISAVAKVNPMLPSGLKQMNHPTSNMVGKDLGSTDDPMMCKFKTSTPSHHMACLPTIHHPMWHTLSMKISITPLRYSLRTNNLIRHISLKPWGETHEIPHHNLADFEPWLGYATEGKAVGGIPFENTLEGPQFRPQPQPLHFAVGRAPPAMAEKGKADHLKERLRAIEGGEDYAFANLEKLFLIPKHGHSQVQGAGL

SEQ ID NO: 172404 - protein, 181 aa, Glycine max
  Coding DNA Sequence Number=SeqID_80719
  Gene Ontology: Mol. function=beta-lactamase activity; Biological process=beta-lactam antibiotic catabolic process
  Homolog annotation: Hit_ID=B0HC01; Match level="QueryCoverage=19%, HitCoverage=74%, E-value=5e-12, Identity=100%"; Hit description =Putative uncharacterized protein
LGPDGKPSRIVVIYTTGSQATMDERNRQIAEIGHHFKNSVAPPTYLALLILLPVAAASGDKSCLTGATLPEGRKADRYPVSGRVGTESARGASRGNAGIFIVLSGFATSDLSVDFCDARQGGGAYGKTPATRPFYGSWPFAGLLLTCSFLRYPLILWITVLPPLSELIPLAAAERPSAASQ

SEQ ID NO: 172405 - protein, 172 aa, Glycine max
  Coding DNA Sequence Number=SeqID_80720
MAENLHGFAYGNVTDELRKRLDLDFLHGNDFFTDFKKIGEELATQLAQASQVTSSISNLLLEEHLGRPKVPSTSKRSNKGCMPSNNGPRTKLGYDTTSATNLVTSKKIVPQSSNGLRRMRRKVMKKEDPRRHILHRMTITHPMVRRRRSTFYPRTMRAMTTSLKKIKQKAKV

SEQ ID NO: 172406 - protein, 179 aa, Glycine max
  Coding DNA Sequence Number=SeqID_80721
  Homolog annotation: Hit_ID=Q5QJQ3; Match level="QueryCoverage=58%, HitCoverage=82%, E-value=3e-57, Identity=100%"; Hit description =Putative uncharacterized protein
VDSRGLGRSAAASGISSLKGGSAPLTSITKIDAQVRGGETRQDYKDTRRFPLEAPSCALLFRPCRLPDTCPPFSLREAWRFLIAHAVGISVRCRSFAPSWAVCTNPPFSPTAAPYPVTIVLSPTRISRARYVGGATEFLKWWPNYGYTRRTVFGICALLKPQITRRKKDLRDPLIFFYG

SEQ ID NO: 172407 - protein, 35 aa, Glycine max
  Coding DNA Sequence Number=SeqID_80722
MREDDDKDEEEEEDSVGSSGLRIIKKGVELIINVS

SEQ ID NO: 172408 - protein, 104 aa, Glycine max
  Coding DNA Sequence Number=SeqID_80723
  Subcellular localization annotation: CTP_CleavageSite=59; ConfidenceScore=5.64e-01
MAESSKKQKGYSSTTAAAGHRRQGTSRDPPAPVPPFHSSPRPSTLFSSVDQCQRSFSIGAGAVTSFGYRKDVDGQWVRKQDLPLPIPEEVPHLLHHNGVIPLLF

SEQ ID NO: 172409 - protein, 351 aa, Glycine max
  Coding DNA Sequence Number=SeqID_80724
  Subcellular localization annotation: CTP_CleavageSite=73; ConfidenceScore=5.69e-01
MAESSKKRKGSSASASASRAHPSGATSASTAPIPPSLSSSPVFSSDEQQKRYSNLFSSHSIIDPKFIDMEFFSAETFDCIQAFQNLCLLPFMSLQLPIYPELVKAFYCNLEIQDSTLISEIFGIKMVIDQSLFHDLTKLPSDGVPFEGTLNDDWKFDFSAHDARQLVCTNNADMTGHLLAGVSEEDLIIMWAFHTGRQLDWAHLVRYRMHKALRLNAPLPYPQLVTLFFRHFQIPLDSKPYVPIKRSFLIGAVVIASFGYRKEHDGSWVKKGAPPADDEGNQPVEDNSSLLRKLLEKFDGLQTFVGDKFDNMELQVDMRFDAMESRITKVEEDVSFIRTCFDPPPPPPSSS

SEQ ID NO: 172410 - protein, 89 aa, Glycine max
  Coding DNA Sequence Number=SeqID_80725
MSMTRQAVCRSYSPGQCKPCGGHHDWSNQTSNHQTRESDQCFETLDSNQMFPHQRILGQDIWDQEFDEIERERSTGYAVHQGCSDGSGT

SEQ ID NO: 172411 - protein, 115 aa, Glycine max
  Coding DNA Sequence Number=SeqID_80726
MVKEECKEVSVSSKSLAKKESHFAIKTNIKETSLLRQPPHLLFCKRTLVSTAIPLELEVIPQVKELLDEGLVRKSLNPFALLAPKIGIMRHHIPMISGMMNVLSGGTLFCKITHA

SEQ ID NO: 172412 - protein, 138 aa, Glycine max
  Coding DNA Sequence Number=SeqID_80727
MATHPRLQRTARPRLQRASRPHLERTTGPPLQRTTRPCLHRVAQGYTSSPLEDYTSSPSEGYTPSPLDDYTSSSSKGYMPSPSEDFTSSSSEGYAPSPSEDNMSSPSDGYTPSHSEHYTSSPLEGCTSSPLDDYTSSP

SEQ ID NO: 172413 - protein, 83 aa, Glycine max
  Coding DNA Sequence Number=SeqID_80728
MSLEEAHHHRRPRIRAWRKKEVLSQPTLRREGNAGLTGASSMGGKCAESPQTFIRGKRQKNRKKCGLRTLSEKGSGVVFTHGE

SEQ ID NO: 172414 - protein, 298 aa, Glycine max
  Coding DNA Sequence Number=SeqID_80729
  Homolog annotation: Hit_ID=Q2JIC4; Match level="QueryCoverage=51%, HitCoverage=23%, E-value=5e-10, Identity=41%"; Hit description =ISSoc9, transposase
PRPSEELHVLAFRGLHALAFRGLHALAFRGLHVLAFRGLHVLAFRGLHVLAFRGLHVLTFRGLHVLAFRGLHIIVFRGLQAFAFRGLHTLTFRGLHTLAFRGLHVLAFRVLHICAFRELKFLGHLPDFGGGPTVRAQPKREAIMQLLCVSGQDFTQTAIGRRVRIMRTTTTPFSPYRSVSWDRAHKTPSGPGEVQQDSGFSNFGYEPLDRTRKTPSGPEEVQQGPGVSNSDYEPPSVLRSARHPQQGHQAPINRAFIEKYCVPRSATRRQPRIGYEEAHHEAVQEGHCDILEFLPGIL

SEQ ID NO: 172415 - protein, 92 aa, Glycine max
  Coding DNA Sequence Number=SeqID_80730
  Subcellular localization annotation: CTP_CleavageSite=56; ConfidenceScore=5.07e-01
ITPAIHLVNPEKSNRVLGFRALITSLCQFYGVPVTPSKVIKPPINRLSSRSTALPRQAQGETPQQPGDGRQREGSENTLDMHVERYLGYACI

SEQ ID NO: 172416 - protein, 37 aa, Glycine max
  Coding DNA Sequence Number=SeqID_80731
MGEWCLVLDVQQVDFVADLGVTFVDDWAFLVRKVVEY

SEQ ID NO: 172417 - protein, 166 aa, Glycine max
  Coding DNA Sequence Number=SeqID_80732
FHQFPNESLSEALERFELLDASIGGKIKLKTPEEATELIENMSVVPFMVRLMNQVIAFPLKSTLRKFITREINRDKDTTKEDFRGSNKATSTRAKYFSEDHQTGGDTSSVYASDHLAEKSFSNFGANIKKNRKEECKAVITRNRKHVVAEDKDVVALKGTTDKKRM

SEQ ID NO: 172418 - protein, 82 aa, Glycine max
  Coding DNA Sequence Number=SeqID_80733
  Subcellular localization annotation: CTP_CleavageSite=19; ConfidenceScore=5.09e-01
MPPPVATPRSSKAPLISPVSFLNKNMVERISIGACRPRIFFINGFLCFLEDEWQRNGERKRERRRHFKEKMSLEEAHHHRRG

SEQ ID NO: 172419 - protein, 71 aa, Glycine max
  Coding DNA Sequence Number=SeqID_80734
THLLLEVASPLSFPFSIPLSFIFQEAKESIDEEDPRLTSSNGACTTNPKNEHAYAHLLITMNIKTSRIPVF

SEQ ID NO: 172420 - protein, 44 aa, Glycine max
  Coding DNA Sequence Number=SeqID_80735
DDDWDDKFRMKMKRKQGEVQKNKLDRYLEDDVEDDHAEFDILNW

SEQ ID NO: 172421 - protein, 137 aa, Glycine max
  Coding DNA Sequence Number=SeqID_80736
MLHVSKCYMSPDAPIPVPTDEAVVSLEKPPQKSDPEVDDLLYLMILTIPKLFLRPYQVTWDATVFGVFNPDFPLYIKHEDLSEIAHGDQCLSISVLQLWILHLTETSMRVGFLICMDSSSHNPFRGLGNHSLSLKVT

SEQ ID NO: 172422 - protein, 194 aa, Glycine max
  Coding DNA Sequence Number=SeqID_80737
  Homolog annotation: Hit_ID=A7QF25; Match level="QueryCoverage=42%, HitCoverage=10%, E-value=1e-13, Identity=46%"; Hit description =Chromosome chr16 scaffold_86, whole genome shotgun sequence
MGRKELHHQDEPWIRSLEGCFNGGKERERGEHEIEGLKEGEKWNFEDCIRKQAEQETQRWKVVSEGKHERQSLKSMVVNLSSRMDVFPEMETYEPETEIEEEKSISGEDSPTTPMQNQTPSKVEADAFEKIASISQTLTTTKQSLWKMDLHALGISYKIKRLKQQLVLVERLTRRQANDELAEITNDSKVGIKE

SEQ ID NO: 172423 - protein, 57 aa, Glycine max
  Coding DNA Sequence Number=SeqID_80738
  Homolog annotation: Hit_ID=A7QF25; Match level="QueryCoverage=68%, HitCoverage=5%, E-value=2e-09, Identity=84%"; Hit description =Chromosome chr16 scaffold_86, whole genome shotgun sequence
MSQKLSLEITKFHKDLEQKDKILSAMLRKSKLDTVEKQMLLKEVSATKNNRTKLKGT

SEQ ID NO: 172424 - protein, 177 aa, Glycine max
  Coding DNA Sequence Number=SeqID_80739
ILLNELVSLSETPLLALNQHFAPRELPPRVGIVLSVLVSLNKLSKGDPTVNESEIMVLLKQVFGSNLTSHESNTGSVTGGLRSDDGCTREWGCRGCEGVALVAHEVVMVARGSDVGGSWGGKERWLPNKKKEKEEEEEGNRGRKRSQRNKKMTELGSENGKGRRRNGRCGVFFYEGG

SEQ ID NO: 172425 - protein, 183 aa, Glycine max
  Coding DNA Sequence Number=SeqID_80740
MSSFLSDSTIDLGGSDFGGSTKQPIMDRDVISICSSSFEDTRYGAPDSESSSSKRVRASHQTSGSSSRPREGVRPSVAVGEPIPLTMILPPSAFGGVRRSSSGGDVRVFRHVSDDFPFLRAALGRPPFFFMYRCLFECALLEHLNVAPSQLHPNSWAMVRASRFYVLSSTSDLVCRSSSSSFK

SEQ ID NO: 172426 - protein, 85 aa, Glycine max
  Coding DNA Sequence Number=SeqID_80741
MMITKDDDKGDDKKLKESRFKDQASRIKIKIQDSRFKNSREDLMKISMKRIFQKLSSTWIFHKTCLPKSFYSLVIDYHIAVIDYQ

SEQ ID NO: 172427 - protein, 164 aa, Glycine max
  Coding DNA Sequence Number=SeqID_80742
MGTRGCINYNCILAIRQLGYPMRGAPSEESITPFIAWGSSDPNVRILQGVYKSWGVVQKKDKELRDGIVGGYHKWLKAPTQEFDWFPKLKVSNEEEAKTPKESEEVQALKAELERAQVVKEKFKTTAIKVRKECDELRDVNVAIAKALERETKRLRETSQGSKA

SEQ ID NO: 172428 - protein, 447 aa, Glycine max
  Coding DNA Sequence Number=SeqID_80743
GKFDIPEGDNAKKKGQQKDDPSAKYGIDAATWAEFAKKENVDGSPYPISRHVKWKMTRTKRYGQMTSTAAQQISDKIASHEDILNTAIGRPEHPGRVRVAGTDVTISQYFGQVSYGSNTSSTSITQQQLAEIIGNLKEEWKKEVEEENKNLQEAWRRKVEEENKCTLEIIKQELKQAIKFKLSQIASQHSPPLYPSDIQVLAARVSIKRSCVEADTNPLGKETFDVHVDTMDLYVVVEQSTQLVVLGKVHDNSSTIHNVPYVDDAVRAVGTFVGWSTHLVKPVSDECLPKLVKSAEMDNVVVADDPLGELVKNLFDIDQKSIELSWDGAKFGLPNVKDGFLITHADKSDVNIKTAVNSAMKTLTTTLEGKPDQAVSRWIKSKSHVQTGGYECRYYVMHWMWCIVSGGLKNEWNRWFYDGTPLDKEAMTTLHNKWAAYFLQIKNMEFR

SEQ ID NO: 172429 - protein, 84 aa, Glycine max
  Coding DNA Sequence Number=SeqID_80744
MEYLPIHLAYEARLGGPVQNRWMYQFERNQIAIETERHPPMLSMFDQQGHLSGNEFIHWLTDDEKDSVHVYVLINCAEVKPYLE

SEQ ID NO: 172430 - protein, 70 aa, Glycine max
  Coding DNA Sequence Number=SeqID_80745
MYKTSNLLLNGLGRPNLGAQLSKSPHVWHLLSMSGFTRDSPQISASPHQLDLAPYASGPTMLNGTPGASP

SEQ ID NO: 172431 - protein, 158 aa, Glycine max
  Coding DNA Sequence Number=SeqID_80746
DPVSCDDLDVELPGCWGSLGGLMGTRGWWVYARFVDVENLLWTIARPPPSTTCDGVVPGDMSRGSGDLGDVRRAPGSQQIKGTKTTKQGGLCGGWPAVNLVLQKGNWEIVEASGNRLPVCVIDYTEEWVTGNRLPEMKSLKIPLLLECSGYETHCVAA

SEQ ID NO: 172432 - protein, 96 aa, Glycine max
  Coding DNA Sequence Number=SeqID_80747
MATIALSSRYGSKLAYGTGIWGESYRLFAAKFLFGLRYRWCLGIGRVVSRHVADLGMAFVDDWVMGNEKGRYWLSDDIVGLTRFDPFPDEDQIRKA

SEQ ID NO: 172433 - protein, 314 aa, Glycine max
  Coding DNA Sequence Number=SeqID_80748
  Gene Ontology: Mol. function=beta-lactamase activity; Cellular component=plasma membrane; Biological process=beta-lactam antibiotic catabolic process
  Homolog annotation: Hit_ID=P62593; Match level="QueryCoverage=84%, HitCoverage=93%, E-value=1e-134, Identity=92%"; Hit description=Beta- lactamase TEM precursor
  Pfam annotation: Domain name=Beta-lactamase; Domain location=60-309; Score=186.5; E_value=6.7e-53; Accession=PF00144.15; Description=Beta- lactamase
  Pfam annotation: Domain name=Peptidase_S11; Domain location=58-292; Score=-122.5; E_value=0.033; Accession=PF00768.11; Description=D -alanyl-D-alanine carboxypeptidase
  Pfam module annotation: Pfam domain module=Beta-lactamase::Peptidase _S11; Domain location=60-309::58-292
MAPDAVFSPYASVRYFTPHMTSCDRLRELHVSEVFTVITETRETKGPRDTPIFIETLVKVKDAEDQLGARVGYIELDLNSGKILESFRPEERFPMMSTFKVLLCGAVLSRIDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPVAMATTLRKLLTGELLTLASRQQLIDWMEADKVAGPLLRSALPAGWFIADKSGAGERGSRGIIAALGPDGKPSRIVVIYTTGSQATMDERNRQIAEIGASLIKH

SEQ ID NO: 172434 - protein, 67 aa, Glycine max
  Coding DNA Sequence Number=SeqID_80749
MAAQVAPPMMERELIAMIVDTLPVSYYEKMVGYMPLSFVDLVFASKRIKVGLRRGQFDCLALTSKKP

SEQ ID NO: 172435 - protein, 240 aa, Glycine max
  Coding DNA Sequence Number=SeqID_80750
  Gene Ontology: Biological process=transposition, DNA-mediated
  Homolog annotation: Hit_ID=Q1J7G7; Match level="QueryCoverage=12%, HitCoverage=42%, E-value=6e-10, Identity=100%"; Hit description =Transposase
MVKVGTLRADQRLIFAKSWPRASRYQQGHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPGELELHRGGGRSRTSGSPGLQEFDSDTVAKLYSKNLTTIYQAYRYRRPRGGARYQLLFPLVRVNFELGVIMVIAVSFGKPVVPAALMNRPTRGERRFAYWALAECILAYYVGTDE

SEQ ID NO: 172436 - protein, 177 aa, Glycine max
  Coding DNA Sequence Number=SeqID_80751
  Subcellular localization annotation: CTP_CleavageSite=23; ConfidenceScore=5.06e-01
MCVIKCLSPGQDFSRTAVGRRVRIMRTSMTTLTQMWMTLLLSNVLPSDHNSDLPLPKCQLMYAILTRMSVHVAQLIADAIYLFAGMPPTRHPLDPDKSNRALGFPALITGLCQSFGVSVTPSKVIRPPITRAFIEKYCTPRQAQGDAPQDADAPSPPHQADPSGSLGMERYLQHLVR

SEQ ID NO: 172437 - protein, 133 aa, Glycine max
  Coding DNA Sequence Number=SeqID_80752
MPISPCGRIVTTRHPVDPEEPNRALGFPALATGLCQSYRAPVPPACSCHRDIGEYAHLSTDFRCHLLFVGITLARHSVDPEKSNRVLGFPALITGLCQFYGVPVTPSKVIRPPTNRAFIKKYCAPRQAEGETP

SEQ ID NO: 172438 - protein, 91 aa, Glycine max
  Coding DNA Sequence Number=SeqID_80753
MSGFTSDSPKISASPHQLDIAHYASGSYNAQWNAPRPLHDKHMLRSSRIHGKMEVEEPWLGLWQQLNYRVDMGASQHRTPKLRWCLALVLW

SEQ ID NO: 172439 - protein, 74 aa, Glycine max
  Coding DNA Sequence Number=SeqID_80754
MRSFAKRDTQWLSARKNPEEDELSGSLSTPLQVIKCTASAYSLRERSALSQNPLMRAKQFRFALSVRAWTNPLI

SEQ ID NO: 172440 - protein, 162 aa, Glycine max
  Coding DNA Sequence Number=SeqID_80755
MPIDGTPKKGREWRIASKQCLHACMVDSSGGCMNENPQFMWAPKRGCMNENAIHGAPKKGSRMENCTKQSLRMAPNSWGGCMNENAIHGAPKKGREWSNCTKQSLRMAPNSGGGCMNENAFHGLRKRGREWRIALSNHYTWLQTRGWRMHERKRNSWGSEKG

SEQ ID NO: 172441 - protein, 322 aa, Glycine max
  Coding DNA Sequence Number=SeqID_80756
  Gene Ontology: Mol. function=peptidyl-prolyl cis-trans isomerase activity; Cellular component=plasma membrane; Biological process =protein folding
  Homolog annotation: Hit_ID=Q1H039; Match level="QueryCoverage=72%, HitCoverage=85%, E-value=3e-79, Identity=62%"; Hit description=PpiC -type peptidyl-prolyl cis-trans isomerase
  Pfam annotation: Domain name=Rotamase; Domain location=192-276; Score= 134.1; E_value=3.9e-37; Accession=PF00639.12; Description=PPIC-type PPIASE domain
MMTRSYMLAFMGRSWSNHLEKPCHKCYAQKLNNVYRHWPLKLWKFKMTVSFTADTQETQAAGTTPSSALPHVYAADADAVATVNGKPIKKSWVDFILKDAEARTGQKANDGMKAAVVNELVGSELAYQEAQKAGIDKQPDFIASEELARRKLLVNAFLADFIRKNPVTDAEKKEGYEQYKKELGDKEYNARHILVKTEAEAKAIIADLKKGTDFAKIAKEKSQDPGSKDKGGDLGWFSPAGMVKPFAEALVGLKKGETTPEPVQSQFGWHVIKLVDTRALQAPPYEKVQEGIERTLQQRKLEKYMLGLKDKAKIDVSGLEKK

SEQ ID NO: 172442 - protein, 154 aa, Glycine max
  Coding DNA Sequence Number=SeqID_80757
MSALKEQMASMMDAILGMRQLMENNVATAAAVSSTAEADPTLPATARHPIPNVVGRERSTLGHIKNPHLGYNRVAYPYGLPLNYTAPVMRDDAGHIPFPILEGEPPRQSDEVHEDHREHAQEDIDSYSSVLVEGPTLYTLPQAKLTGEPRNLPA

SEQ ID NO: 172443 - protein, 95 aa, Glycine max
  Coding DNA Sequence Number=SeqID_80758
MQSVDKEGPKKPKPLVIHFTRDTAPPRPQHPSAVSGGRPIPFPYENNHAVPWRYAPLGGRKEEAIDIGSLSAKVTNITGLSGITRSGRVFAPLPC

SEQ ID NO: 172444 - protein, 112 aa, Glycine max
  Coding DNA Sequence Number=SeqID_80759
  Gene Ontology: Mol. function=aminomethyltransferase activity; Cellular component=cytoplasm; Biological process=glycine decarboxylation via glycine cleavage system
  Homolog annotation: Hit_ID=A8GIS1; Match level="QueryCoverage=100%, HitCoverage=30%, E-value=1e-59, Identity=98%"; Hit description =Aminomethyltransferase
  Pfam annotation: Domain name=GCV_T; Domain location=46-112; Score= -52.8; E_value=0.012; Accession=PF01571.12; Description=Glycine cleavage T-protein (aminomethyl transferase)
MAKQTPLYDQHVACGARMVDFHGWMMPLHYGSQLDEHHAVRQDAGMFDVSHMTIVDLHGARTREFLRYLLANDVAKLTQPGKALYTGMLNASGGVIDDLIVYFLTEDYFRLV

SEQ ID NO: 172445 - protein, 99 aa, Glycine max
  Coding DNA Sequence Number=SeqID_80760
MVEFSPTRGICGRCLIRIRLDYHEESGFNISRDTIEHISILIHHHQGNPLLNCLKSLSWQTSNTRGSPLRIIQAAQYRNSLLALHLLKCKLTTSTTRIL

SEQ ID NO: 172446 - protein, 60 aa, Glycine max
  Coding DNA Sequence Number=SeqID_80761
MPISPCESIGWGSAHKTPSGPREAQQVPGVSSSGYGPLGSAHKTPSGLGGVQQGPGGFQL

SEQ ID NO: 172447 - protein, 129 aa, Glycine max
  Coding DNA Sequence Number=SeqID_80762
MNLRRSERALRVGVNDILGHRKRQSLCQTKVYHLKVHLCFDDNKDDDKGDYKNLKAQSKNEFKMFKIESRTLQDSRGKLKNTSRLRRKVDFKNQESRFKDQASKNQDQDSRVKRRLNQDKYEKVFSKTE

SEQ ID NO: 172448 - protein, 99 aa, Glycine max
  Coding DNA Sequence Number=SeqID_80763
MHFGYFGQKTRFREEKSSRSAFVSDSVEILHRSSPFFVHSSSFFSLQPNYVGLISSSQLRIRRSKSPAFVDHPKRSLMVQRLNVSLLSKNKRSLNGPTS

SEQ ID NO: 172449 - protein, 69 aa, Glycine max
  Coding DNA Sequence Number=SeqID_80764
HRTRGNHFLTTVLGVTCNSLSGARSPYETVVATTESPREAMTKKDAKKMADRVPGNGRFDDGDGGHQCR

SEQ ID NO: 172450 - protein, 197 aa, Glycine max
  Coding DNA Sequence Number=SeqID_80765
  Homolog annotation: Hit_ID=A5BSR3; Match level="QueryCoverage=56%, HitCoverage=35%, E-value=6e-12, Identity=36%"; Hit description =Putative uncharacterized protein
MAEKAKKRLEEAAQSGSTEGIIDPPSPFRRHVKWKMARTKKTGQMTSEAAKEIADRIDSLDEQASQGSFVPHGRQDILTAAIGRPEHPGRVRAVGAGVTIKQYFGSASRTSRSSSSMPLEDLEQLTQQIRDQLEESITEQVTRKMMESFSQMQSQVSVSDAITGNCTTSRARGWSLRSSCQYKGELCCSLREQSRDG

SEQ ID NO: 172451 - protein, 113 aa, Glycine max
  Coding DNA Sequence Number=SeqID_80766
RGQRLAVAAAEPVIAVAHCAAAAEIDEAQVLIFLPCHQPAAIAQIMAARRMEKRAHQSFVPLHQPARRASPAAASARPGKVLRRWITRCCQGANPGRDHTDTTPPAAACQTAD

SEQ ID NO: 172452 - protein, 152 aa, Glycine max
  Coding DNA Sequence Number=SeqID_80767
SNRALGFPPLITGLCQSFGVPVTPSKVIRPPITRAFIEKYYTPRQVQGDAHHAADAPPPPHQADPAGSLGMERYLQHLVCQEAANHRGQVQIHECLYRFNLKQFGAEVAWPGDWPEAQVGEAPAGSPGEAEEAHMDEEMTNLLGFLGGSGAT

SEQ ID NO: 172453 - protein, 145 aa, Glycine max
  Coding DNA Sequence Number=SeqID_80768
MAPTRHRGDPDKSNRAMGFPALITGLCQSFGVPIAPSKAADAPPPHQAGPAGSFDTEQYLRHLVRQQAANHRAHSQGFTSFPCPTPDQFRAEVAWPGDWPEARAGEAPAEAPAEAPAEAPNEADEAREDEEIADLLDFLGGSGAT

SEQ ID NO: 172454 - protein, 297 aa, Glycine max
  Coding DNA Sequence Number=SeqID_80769
  Subcellular localization annotation: CTP_CleavageSite=91; ConfidenceScore=5.69e-01
MAPRKLSFPQDSYRTSKKPKIEQHSQPSNAKKMQQSRGSSSGNISNNNPSRIFHRTRTNSSRGYTHTIPKDMPCCFKPTVDMNLTFKETRVCAYVFNPNVDPSGNEILYREGNNLGTRKTFQSLCPNKPVREEIILFMALKVAYSQLYCTRSVWCMPPAFAVDVINGCPVETLIQHYGKDWMPPFSNLNLTNVMLSVLEIVFPTQEFVIGFDGMDCWDIAEARGIPNCGSSEKSALWVLEWMQMEELFISLLYGVLEEKAVRMKVAMILLLGTHNQHKGDLIRNAEHKWHDCIHAKH

SEQ ID NO: 172455 - protein, 138 aa, Glycine max
  Coding DNA Sequence Number=SeqID_80770
MQKENYNRLRHTLLQVIHVGGKGGCGSGDLPPKLHQPGISFVLCFNRPQWTQRSSSIVLLRRRQRSARIATSATFFKRLFPLLLKKPFVIALSRVVYDRESKTVVKGCFETSKARGGIADTQVEASIYYQLQGKNKDR

SEQ ID NO: 172456 - protein, 68 aa, Glycine max
  Coding DNA Sequence Number=SeqID_80771
EDNYHYNESSLFPKDLLMQAPLELVGLGSSSSMDSFASWKINSSGMEKEEREEMPLQGEDESRRSSPP

SEQ ID NO: 172457 - protein, 396 aa, Glycine max
  Coding DNA Sequence Number=SeqID_80772
  Gene Ontology: Mol. function=protein binding; Cellular component =nucleus; Biological process=cell division
  Homolog annotation: Hit_ID=A8Y924; Match level="QueryCoverage=70%, HitCoverage=85%, E-value=1e-66, Identity=45%"; Hit description=D7 -type cyclin
  Pfam annotation: Domain name=Cyclin_C; Domain location=175-308; Score= -0.2; E_value=0.042; Accession=PF02984.10; Description=Cyclin, C -terminal domain
  Pfam annotation: Domain name=Cyclin_N; Domain location=42-173; Score =83.3; E_value=8e-22; Accession=PF00134.14; Description=Cyclin, N -terminal domain
  Pfam module annotation: Pfam domain module=Cyclin_C::Cyclin_N; Domain location=175-308::42-173
MAYVCMDNLLCDEVWLSKSSNTFEEVSDPVALKSYENEEFEEAFAVCLEKEVSFLPESDYTKYLHSNNLIFPRCRVIQWFIKCRSRFNISFGTVFLAVNYLDRFVSICQCHDWEYWMLELISIACLSIAIKFNEMSALSLHEIQVENLDYSFQSNVILKMELILLKVLGWRLNSVTSFSFVEMLSVGFLEPHLHEKFISRVIDLLIQATLDQKMLEFRPSIVGISALWCTLDQLFPPKSDTYIAYIMSILNQSQKDDIIKCHKLMETQTSMRCENHHCYCPLSPTTAFYIGSNDLSTSVMTRGGNSGSLNHNIGFMTVFEGWLFHIGCIATTDVECVGFYSGSKAENGVEWNGYEWKGFYIGLQSTDVEFEEFLHRLSPNRCRMRIFSTSFIIEPM

SEQ ID NO: 172458 - protein, 251 aa, Glycine max
  Coding DNA Sequence Number=SeqID_80773
  Gene Ontology: Mol. function=protein binding; Cellular component =nucleus; Biological process=abscisic acid mediated signaling
  Homolog annotation: Hit_ID=A9PG77; Match level="QueryCoverage=35%, HitCoverage=27%, E-value=5e-32, Identity=78%"; Hit description =Putative uncharacterized protein
  Pfam annotation: Domain name=Pirin; Domain location=166-242; Score =21.9; E_value=5.8e-07; Accession=PF02678.7; Description=Pirin
  Subcellular localization annotation: CTP_CleavageSite=27; ConfidenceScore=5.22e-01
MPNLSPLALMAVSSGFSEWKNSEAAVRCKRFKSFTHKSPNVAGGAKAFEVASKFFHGINVEFTLYKQSSIIKGETIYPWVKTVITTEEEIKVHRREVPMEKGTSLPMEKAISHHLLVSLLDWRISTSRSLFSLRTIMSQSDHSSAFTTPRLVLKKVLAKSQHEGDGAVVRRGIGRSELKNLDPFLMLDHFSVSPPAGFPDHPHRGFEIVTYMLELAGILLDTANLRDPRCSSKDKYMASLLINGAPIITRY

SEQ ID NO: 172459 - protein, 164 aa, Glycine max
  Coding DNA Sequence Number=SeqID_80774
MALKKLPAKRLRKDAAGEGSREASQVDMDFDGHKFQSEEHQRRFETIKGWSFLKERRVQLKDGEYAEFQEEIAWRQWAQLVSPMAKYDLEIWIPFDKDAINQILGHPLVLEEGQRYENSQRRSQALGFDEEAISQLLCVSGQDFAWSVAGRRVRIMRTSMTTFT

SEQ ID NO: 172460 - protein, 351 aa, Glycine max
  Coding DNA Sequence Number=SeqID_80775
MSLSDNVLGRHILPEKKVEKYHTELDEFKAELERRNFHKHLTNLVDNSIDLALVKEFYANLYSSEGPSPKQVRVRGHLVKIDADSLNTFLETPVVLAEGETLHAYSKYCKLPTDIREIEVALCIPGWGFALNVEGHPGKILKKDLTNLAQVCSVLSYSNLAPTSHTSDLTVDRARLIFGLVSQMDMNVGALISSQITSMAQSNSSRLGFPALIIALCKSKGVASDSLVFERLSPIINLAYIRKNCWNPDDLTVTIRGARRARTRSAEAPSTSTAPPPARTLAAPSAPVPADFQRLEAMFQSIHQGQIILLQSLQMVAPPVSIPSVEQFNEWVAWPETQSSLHREDEGPTAQ

SEQ ID NO: 172461 - protein, 96 aa, Glycine max
  Coding DNA Sequence Number=SeqID_80776
  Subcellular localization annotation: CTP_CleavageSite=52; ConfidenceScore=5.67e-01
QMVTPPSSPPPPPPTGAASQSPSTLKRIRKATRLRSLATRPIGAQRPLVHVDPATGKADSPHRKKLRTYLGIVARDKVDVTYENWKQVPAAQKDLI

SEQ ID NO: 172462 - protein, 90 aa, Glycine max
  Coding DNA Sequence Number=SeqID_80777
  Gene Ontology: Mol. function=nucleic acid binding; Biological process= DNA integration
  Homolog annotation: Hit_ID=A5AV98; Match level="QueryCoverage=96%, HitCoverage=11%, E-value=3e-19, Identity=54%"; Hit description =Putative uncharacterized protein
MTVADSIKTTLPKIDNAKKFMGLVRERSQTADKSLVGTLISTLTTMKFDASCTMHEHVTEMINIATRLKTLEMTVNENFLVQFILNSLSS

SEQ ID NO: 172463 - protein, 481 aa, Glycine max
  Coding DNA Sequence Number=SeqID_80778
  Homolog annotation: Hit_ID=A2Q6B4; Match level="QueryCoverage=35%, HitCoverage=86%, E-value=1e-15, Identity=27%"; Hit description =Ribosomal protein L33; Nucleic acid-binding, OB-fold
  Pfam annotation: Domain name=DUF223; Domain location=36-129; Score= -5.1; E_value=0.0089; Accession=PF02721.5; Description=Domain of unknown function DUF223
  Pfam annotation: Domain name=Rep_fac-A_C; Domain location=262-379; Score=-44.0; E_value=0.0012; Accession=PF08646.1; Description =Replication factor-A C terminal domain
  Pfam module annotation: Pfam domain module=DUF223::Rep_fac-A_C; Domain location=36-129::262-379
MARTPDKIKSIDGSRETLKLAVRITDLWFVGTPNKSEQAEMGDEIHALCKADQLNSWKDYLKENSTYVMHNFKVMKNDGQFRVCEHQYKLVFTGVTVVRKSNLDDLPFKEFRFVEFSNVIAGDFQAGLLVDIIGIVDDALPPCLIKKYQAYLNETENDGPMVIILTHARIKEGQGSYPSSVSKSLKASKLLINEPVLEIQEFRERLSDLGIEVRPVLTPHGHGSSQLSGSSQLSSKDAFLSKVEAKTISEINAISEDIVCVTVGTISIIVMDNHSCCYPACIQCHRKTDIEAASFTCGCGKENDQLVLRYRLEVMDRECAELIGQSTDEVNRAKIEEGDVDLNASPLALDRLLGHVLAFKVRVQSKFRNVVVLRYSNELDLINDVLDMLPDTENYQHAKRSNSAKAKINRKRIMQQKRHPQTQSPSHPTMDCTSQYAEYDLIVSDSSEGVNSESTQGSNSNFFTKNQHCESPANHPAINTE

SEQ ID NO: 172464 - protein, 123 aa, Glycine max
  Coding DNA Sequence Number=SeqID_80779
MAVEWRRKRERRCHFKEKMSLEEAHHHRRSWIRAWRKKEMNEERGREEHEILCSKRALKSEIIGPNLGPWGQKSTLRFMRTLGPSSIALAQSSWSLLLMALVNGPSLGRIASSVFGIYEVAHI

SEQ ID NO: 172465 - protein, 127 aa, Glycine max
  Coding DNA Sequence Number=SeqID_80780
MHPRCPSTSGNFMTILRKYGPLLQWNVVTLDPGIGDRSIVRPWYVFLNESDFDHGDEVSFYYQCHEKNWEIVIRRQKHWENSEQIKGRFFKDQLSQFRCECVLGADHLIQAMEIWMTPLPVKEAKSG

SEQ ID NO: 172466 - protein, 56 aa, Glycine max
  Coding DNA Sequence Number=SeqID_80781
GTSTWVVVTENKRGYISCGSVQVEGTSTWLFKENKVNGKGMEKEEREETPLHGDTT

SEQ ID NO: 172467 - protein, 115 aa, Glycine max
  Coding DNA Sequence Number=SeqID_80782
MYNQQELAHNRPIISMEHFLEKVAWPEAQLPLEKFHEVVPPEPAPARTEPIPAEPQPPVVDAPPSLELEILSPPPAPAPPLIIISDLSSDEDAAPLDSPSCNIDDGSDFSDWMNC

SEQ ID NO: 172468 - protein, 56 aa, Glycine max
  Coding DNA Sequence Number=SeqID_80783
MSYTGSLSAPLHLTKHTASVHLLSEKDALSQKSLTCAKRSINLQRPELEAGAGLRA

SEQ ID NO: 172469 - protein, 57 aa, Glycine max
  Coding DNA Sequence Number=SeqID_80784
MDEKRKKKLEETAQSGSTDTVIDPPSPIRRHDSLEEQASQGSFVAHGRQDVLTATIG

SEQ ID NO: 172470 - protein, 16 aa, Glycine max
  Coding DNA Sequence Number=SeqID_80785
MQWKFVMTLLRGWSAI

SEQ ID NO: 172471 - protein, 88 aa, Glycine max
  Coding DNA Sequence Number=SeqID_80786
MEQYQRHMVRQQAANHHRQGKGSTHFVCPTPEQFRAEVAWPGDWPTEEGTRPAGSPGEAEEAHMDEDMTDLLGYLGEGRATRPRSPHL

SEQ ID NO: 172472 - protein, 157 aa, Glycine max
  Coding DNA Sequence Number=SeqID_80787
MLFIGCIAHCIPYRMRARARVMGEVDEVKEWIKADIEALKEQMATMMEAMMSMKKIMEVNATAVAATSVVAENQHAFLPDGLPPNYAPPNVVHTPDKNVNNSTTILPCLGYATEGQAVGGVPLPNTLEGPQLRPQPQPLHFSVGRAPPAMVEKGKFD

SEQ ID NO: 172473 - protein, 130 aa, Glycine max
  Coding DNA Sequence Number=SeqID_80788
MGEVDEVQEQIKVDIEALKEQMATMMKVMMSMKKIMEVNVATVAATSAIAEVDPTPPFGLNQINHLISDMVGQRGKELGSAGSAHFVQVQNKHMFSPYGLPPNYTPPNVAHAPDENVNNSTHILIESQQP

SEQ ID NO: 172474 - protein, 111 aa, Glycine max
  Coding DNA Sequence Number=SeqID_80789
MKLKVENKNEAKGRRRNKNEIAIRSRKSKNAFTSTDLEAVATLGEEPQSSEASSSFPIPGQSHTDLIEEVIMAEEPKRVTREDYSNSAVPQFFSSIERLEFRHKQSLTLLL

SEQ ID NO: 172475 - protein, 47 aa, Glycine max
  Coding DNA Sequence Number=SeqID_80790
ENNVDDLGDEREGGTGAGGFPEVPWWQWPAAVVVEEDPFHFFDDSAI

SEQ ID NO: 172476 - protein, 44 aa, Glycine max
  Coding DNA Sequence Number=SeqID_80791
MGFAGGSGSKPTTFSTQITCYKCDRKGIFKEIAYIPRRSRMVGV

SEQ ID NO: 172477 - protein, 323 aa, Glycine max
  Coding DNA Sequence Number=SeqID_80792
  Gene Ontology: Mol. function=motor activity; Cellular component=cell projection
  Homolog annotation: Hit_ID=P15305; Match level="QueryCoverage=90%, HitCoverage=96%, E-value=7e-27, Identity=26%"; Hit description =Dynein heavy chain
VDSRGLHVIAFRGLHGLTLRGLHALTFRGLHVLAFRGLHVLDFKGIHALTFRGLHVLAFRWLHVLAFKGLHALAFGGLHVLAFRGLHVLTISGVHVLSFRRTARPCLRGLHALAFSGLHVLAFRGLHVLTFSGVHVLSFRVLHVLAFRGVHVYAFRGPHVLTFRGLHALTFRGYHVLSFRGLHVLALRGLHILAFRGLHALAIRGLQILSFRGLHVLAFIGLHALTFRGLHILVFSRVHVLTFNRVHALNFRGLHVLAFRGLHVLAFRGLHVIAIRGLHALAFRGLHVHTFRGLHALALSRLHVLAFSGLHVIAFRGLHVIAA

SEQ ID NO: 172478 - protein, 90 aa, Glycine max
  Coding DNA Sequence Number=SeqID_80793
MEEMNMHKITRGGGAPLRAKGHFGAVAARPGELKISAKAISLPRRAGARPGHKHIKEYHVVCSTMQPHDIHEDYVKMKTLPFSLDDVAKD

SEQ ID NO: 172479 - protein, 123 aa, Glycine max
  Coding DNA Sequence Number=SeqID_80794
MVQLCLARCFPCMFIQKLKVGILPFILDYKEDYPWHKWKDLVDRSVLPTNPFSEPMNCIFIHVSPTFEFGAMHSDCLVQFSILNPFSEPMNCVFVHASSTFEFGAMRSDCLVQFSILNLFQSP

SEQ ID NO: 172480 - protein, 201 aa, Glycine max
  Coding DNA Sequence Number=SeqID_80795
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=25%, HitCoverage=50%, E-value=9e-24, Identity=100%"; Hit description=LacZ protein
MKHFTDTLISANIGTKAGTGPPLEVDGIDKLDFLTAVLEKPASLITLLTLGSSRIDMMRCSSSTLMVSRGCCCWCSMQPLLCPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 172481 - protein, 60 aa, Glycine max
  Coding DNA Sequence Number=SeqID_80796
MHTKRCSVKRVQKLEAELNKLESEAELSGLKINFAKSRFGAFGISDQWKHDVAKYLTAAA

SEQ ID NO: 172482 - protein, 83 aa, Glycine max
  Coding DNA Sequence Number=SeqID_80797
MSPPPLRVSVLPNLNLLKLELVKETANAKDTGLSCSDVLCLFSAGKGQRSVGRDPSPTCIRPYVPASKKQQGVANLDRVVVLP

SEQ ID NO: 172483 - protein, 58 aa, Glycine max
  Coding DNA Sequence Number=SeqID_80798
MPLIAPVKGLELGTYWVRTSNLPLGSLEKQDVLMMLKDQVLLSFIQDKNPRIQENQDI

SEQ ID NO: 172484 - protein, 312 aa, Glycine max
  Coding DNA Sequence Number=SeqID_80799
  Homolog annotation: Hit_ID=A7UQU7; Match level="QueryCoverage=46%, HitCoverage=24%, E-value=3e-22, Identity=40%"; Hit description=IMP dehydrogenase/GMP reductase, putative
ALRDLSQTRSYAWGVTTLVHMYDHLNDASISTSRQLGGYITLLQCRIYEHFPSVTESTTDPDYDEDSLCACRWIATKKTVKSIRTPTYRERLDRLRIPNVCWIPYGEHRPVRDFHMISCYSGLLRWGPVVVYYRLERVMQQFGYTQTIPAPPANSWVSFDDIHDRWMHYSDHMAATGDNCVVPGQCASDYMDWFFCILHSFMTPGQPSDPRADGHATQPRVATQDLDTDIRPVMEPATPSTSARSDVAEPRHAVEACHAIAERLESHLNLGVVTPGTSTHELIEECLRIARSVTQDELVYVSSRCRQRTDQS

SEQ ID NO: 172485 - protein, 143 aa, Glycine max
  Coding DNA Sequence Number=SeqID_80800
MLLSGNAIYICVRVVMLVHMIRTRLFVTERVKSCPSMHSGYTIASSSSCARTVGPPPGSGGKRTLNSLKVRMWSPLKVRTRSPLKSGTCHPLKAGASGPLKARACSPLKEKVCSPMKVRTRSPLKARACSLLKERVCNPLKAR

SEQ ID NO: 172486 - protein, 37 aa, Glycine max
  Coding DNA Sequence Number=SeqID_80801
MRKLRSMEAEWRWKKDDWRCHFKEKISQEEAHHHRKP

SEQ ID NO: 172487 - protein, 140 aa, Glycine max
  Coding DNA Sequence Number=SeqID_80802
  Homolog annotation: Hit_ID=A2Q377; Match level="QueryCoverage=94%, HitCoverage=28%, E-value=8e-08, Identity=29%"; Hit description =Nucleic acid-binding, OB-fold
MHRVRSYPASVSNSFKALKLLINDPILEIQEFKERLLDLGVEVSEFCYLAIKQAHKFQGGDDVCVTVGTISKIVMDNHSWCYPACAQCHRKTDIQTGPFTCGCGKDNDQSVLRYRVEVMVTQNNESNKFLLWDRECAELI

SEQ ID NO: 172488 - protein, 464 aa, Glycine max
  Coding DNA Sequence Number=SeqID_80803
MASRKRKSIGSRPTTQYDTRRFSSIDAWNRYTYNVLGRNILPKRKVELYHTELDDFKIELERRNFHKCLTNLVDGSIDLALVKEFYANLYNFEGPSPKQSRVRGHLVKIDADNLNTFLETPMVLAEGETLPIYSRYCRLPTDYKEIEAALCIPGRGFILNTEGHLGKILMKDLTTLAQVWSVLSYSNLAPTSHTSDLIVDKARLIFGLVSRMDMNIGALISGQMTSIALSNTFRDGFLALITALCRARGVVSDSLTFERLSPDLTVSIRGARRVRARPAELPSTSAAPTPTSTSAAPSVPAQTDSQRFEAMLQSIHQGQIILLQSLLMVMPPGSIPSVEQFRQMVAWPGTQPSLHREDEGPTAQVPQHVEDESFEATIPEPFVIGEEAGETQVRQVVVATPKRSLEATSEPPAPVVDLPKRTQPEDPTTPVLAMDISPSATQVLHLTDEEDVQTKDTQDQSQEF

SEQ ID NO: 172489 - protein, 131 aa, Glycine max
  Coding DNA Sequence Number=SeqID_80804
MGVKYLEVGSKDKTLISFEWNTIRPVNLRASGTCKNFENDQHRMTNIILMLPNLFLLVDTRRRMTIICLRVPSDTIVSGWQKVRNDHNLSLRAIGHDRIWMAKDTIVSEWRKGERNDHNLSPHVIELAASG

SEQ ID NO: 172490 - protein, 167 aa, Glycine max
  Coding DNA Sequence Number=SeqID_80805
  Homolog annotation: Hit_ID=A8GCM5; Match level="QueryCoverage=76%, HitCoverage=62%, E-value=3e-13, Identity=37%"; Hit description =Putative uncharacterized protein precursor
  Subcellular localization annotation: CTP_CleavageSite=43; ConfidenceScore=5.26e-01
MKLSLAVTALSWSAVSISFCFAWINPAPMPPHFRSELMIVTFTADAHSVAIRLPALNNRRERSLFDKSLNFQLIDERGNEIASIRDRLPGESSGNVEQAMINYNRTAQAASVPRFALQAASVPDASLSLDMVWQDASNMPALQRWLQRVDAATRQRFISWVKTLRAS

SEQ ID NO: 172491 - protein, 60 aa, Glycine max
  Coding DNA Sequence Number=SeqID_80806
MVTKGWSFNGGFNGEEEERKSNVREREKASEIFCRSLAFLCARRGQFSKVGNIIISKCSE

SEQ ID NO: 172492 - protein, 161 aa, Glycine max
  Coding DNA Sequence Number=SeqID_80807
  Subcellular localization annotation: CTP_CleavageSite=2; ConfidenceScore=5.03e-01
MSAPLGAQRNFLSVGITFSTPFALRERPQVVIFRIPTVGLWQHILGSFRQNLKTIQRQALQTFITWPTNLVKIVSQKSYITPKKLPEPVQRANNVFEDDPLHQLIKSLYDIYEKPVELMWDSNKFWIPNVDASFFLTYYDVNEIIEGDKCLNIAILQLWMM

SEQ ID NO: 172493 - protein, 296 aa, Glycine max
  Coding DNA Sequence Number=SeqID_80808
  Gene Ontology: Mol. function=pyridoxal phosphate binding; Cellular component=mitochondrion; Biological process=photorespiration
  Homolog annotation: Hit_ID=A7QFJ9; Match level="QueryCoverage=34%, HitCoverage=22%, E-value=8e-35, Identity=65%"; Hit description =Chromosome chr8 scaffold_88, whole genome shotgun sequence
MASRGGNSYFEKSVQLVLKEPMNDMDHADGFSGEPMDGRIEDDALHDLFSAKRKMRFISELELKVQTLQTETTTLSTQFTKLQGTVKTLAAKPWLKKIQQARPLISMVNKVASLSTPMAAPNVDVRNLDLDLALERVSTVGRCRFIAKSPNSKELQKSGVHHAVNPQPYRGIFGSNGEKYARDVQDIINFGTSGNECPEQRGGIIELAPGYLLDVYNTIKKARGLFTTDEVQAGFGRIGSHFWGFKAHNFVPDIVTIAKITFLLVSGTDVATIGVIVWLWRIQDPSCSYMKDLGSK

SEQ ID NO: 172494 - protein, 387 aa, Glycine max
  Coding DNA Sequence Number=SeqID_80809
DSLEEQSRQGSIVPSGRDDILNMAIGRPEHPGRVRGAGIGVTIMQYFGPASRRSTTSSNITVEQLADIIGNLKEEWQRQVEQENIKREEVWMRRVEEEKQRTMDTFKGQIQEAIKLELSQIASQHSAPLQPNDIQVLAARVSTKGSCAATETNALAKKPSKLNGDNVGLHVTAENSNKLVAVGKQCDSFGTIHNVPYADDVVPVSMVEVIFGDAEVPIPTSEIKFVKEALEKDVSSPLKTVEEEKVAEVIDPLGELVKNLFDIYQRPVEVSWDVRALVMDHCMGSLNLSVSTMQAVDVKSVKITLEGDNVVVWFCSLKKKPDAAIKGAVNSAMKLVTKTAEGKPPQHGPQWIEAKSHVKTGNYECGYYVMQWIWCIVSGGLKDDWIH

SEQ ID NO: 172495 - protein, 304 aa, Glycine max
  Coding DNA Sequence Number=SeqID_80810
  Subcellular localization annotation: CTP_CleavageSite=41; ConfidenceScore=5.06e-01
MEEGGSSITFTVPNFSKTLFKSSRETTSMLSLVEGRIGRVSVERVEELKGLLEVVVVCVKGDDGVPNDDVSGGGEEGEVEGSAGLEGKGEEVKEALEKQNNPRRFGGRSKSKEDVIPWRNGGQCRVNPKVIGRFSSTGCQWNCLVDKDTGHHEVCYDDEDNHRIVLVDALEVPEVVAHAVVLGVFLCFDFLLFFYLLPSSCSAPLDVLMPSSLQCCDQYCGDTSNDRLRLTLAWEVSFGVAAWVPPERLMLVWLVPLIRLVRVGLDFILESGHFFHLDVALGSFAQFIHATEWFFAEVVYELAR

SEQ ID NO: 172496 - protein, 185 aa, Glycine max
  Coding DNA Sequence Number=SeqID_80811
  Homolog annotation: Hit_ID=A5AHF4; Match level="QueryCoverage=40%, HitCoverage=13%, E-value=3e-08, Identity=45%"; Hit description =Putative uncharacterized protein
MFFPSGGVQKDIAASGFVPCNSDSKDCLDIEDHAVKVLDTFEQSNGDDTMLEQLSLEEYTLQAFEMLIAQEMPDSVYHETMRSEDNKPMESESNSVDRAVANLMFNKMEINILDLPLTTLVNLKQEVIGTSIQGLAVSIQLHLDFDWNLSNQVKSNFQGSLCEKPKSSKKSEGGIFLSWDKQQYI

SEQ ID NO: 172497 - protein, 166 aa, Glycine max
  Coding DNA Sequence Number=SeqID_80812
  Homolog annotation: Hit_ID=A7PKQ3; Match level="QueryCoverage=77%, HitCoverage=25%, E-value=8e-36, Identity=55%"; Hit description =Chromosome chr7 scaffold_20, whole genome shotgun sequence
  Subcellular localization annotation: CTP_CleavageSite=59; ConfidenceScore=5.19e-01
MGADTTGSKTGHSSYKQSTTCNLHCNKGQRQDQAAQQQKRSWLWRRMSSKKNLGEIESSGSMSSHSERFSDDQVYPTQTTPSPEGTKITAALLNSSAKEDLAKQHAKVAEEAVSGWEKAENELLILKQQLDNAKQENSVLEDQFSHLNDALKECMRDLQQAKEEQE

SEQ ID NO: 172498 - protein, 47 aa, Glycine max
  Coding DNA Sequence Number=SeqID_80813
VKKRLSFEMPKVPSARLSARLALSPIPLTYAKREGGAKRKVANSKPI

SEQ ID NO: 172499 - protein, 269 aa, Glycine max
  Coding DNA Sequence Number=SeqID_80814
  Homolog annotation: Hit_ID=Q6WAY6; Match level="QueryCoverage=92%, HitCoverage=41%, E-value=9e-09, Identity=24%"; Hit description =Putative uncharacterized protein
MEGRKNRSSYFMRRISKCSLDGDEGCISYNPVLAIRQLGYRMRGAPLEDELAPIISRGFNKTNVETLQKVCKAWEVLQKKDKELRGSNNGPIGGYRKWLKAHVQGLDWLLSLRTAKREEVEAPEEDEEVQALRMELKQAQTVKERFKSATLKIRKENAELRDINIATTKALEQMTKRARREEHGRNKFRGALWGSNRDQSGVDSLILKDELNVCSRSKRNLSQRLCETETNMLAIISKYQEELNLATAHEHRVADEMPKCTRRRRLEEG

SEQ ID NO: 172500 - protein, 165 aa, Glycine max
  Coding DNA Sequence Number=SeqID_80815
  Homolog annotation: Hit_ID=A5C693; Match level="QueryCoverage=34%, HitCoverage=25%, E-value=5e-09, Identity=45%"; Hit description =Putative uncharacterized protein
RFASWLIIGLKRLIAFGFIARSGYNFMVVITGLKILTAIGFIARRFYKDSRNLKRVAWGLDLGTEGNSMVAAIIESKNLSTMSLATLFEELQEHELELQRLNQNEKEQANVCLMTKNHESDEQEPLKKKWYIDNGCSKHMKGDASKFTTISPKKNGHVTYGDNNR

SEQ ID NO: 172501 - protein, 123 aa, Glycine max
  Coding DNA Sequence Number=SeqID_80816
SFGVLVTPSKVIRPPITRAFIEKYCTPRQAQGGAPQAPDAPPPPHQADLAGSFDMERYLRHLVCQQAANHRAHVQTHDSLYQLSLSLQSQGFAPFPCPTPDQFRAEVACDGSLLVEILWRLDL

SEQ ID NO: 172502 - protein, 175 aa, Glycine max
  Coding DNA Sequence Number=SeqID_80817
  Homolog annotation: Hit_ID=A5C702; Match level="QueryCoverage=63%, HitCoverage=17%, E-value=9e-07, Identity=27%"; Hit description =Putative uncharacterized protein
MTRGNPCDLQPFDPEIDRTFHRLLRHSVHPDHSVHFEHSEYSVAGNFEHSDFEHSTNNFHTENMAQPTPRERTLREMAAPDFTYESLCIQYPNEGEDPHKHLKEFHIVCSSMKPPDGVAKDWLYYLAPRSITSWDNLKRVFLEKFFLHLGPLPLEKTFKALGNLVERACMSTGKD

SEQ ID NO: 172503 - protein, 62 aa, Glycine max
  Coding DNA Sequence Number=SeqID_80818
AGFRSFACPTPEQFRAEVAWPRDWPEAQAGEAPAGSSGDVEEALMDEEMTDFLGFLGGSRAT

SEQ ID NO: 172504 - protein, 183 aa, Glycine max
  Coding DNA Sequence Number=SeqID_80819
  Homolog annotation: Hit_ID=Q2HTA0; Match level="QueryCoverage=39%, HitCoverage=10%, E-value=1e-12, Identity=54%"; Hit description=IMP dehydrogenase/GMP reductase, related
  Pfam annotation: Domain name=DUF1723; Domain location=31-80; Score =50.3; E_value=6.7e-12; Accession=PF08330.1; Description=Protein of unknown function (DUF1723)
EVEKFERSTPKIEGLVAATRLTPLIVCSIDTGDRGVISTFVERWHKKTSSFHLPVGELTITLDDVASLLHLPIIGAFHSFELLHVDEAMIMLVELLEAKTAQYTFRDLAQSGSYAWGAATLVHIVHESVTDEKYDETSPRACQWLTMKAYSKGFPASTYQTRIDALTIPDVCWMPYGEHRGVR

SEQ ID NO: 172505 - protein, 165 aa, Glycine max
  Coding DNA Sequence Number=SeqID_80820
  Homolog annotation: Hit_ID=A2Q517; Match level="QueryCoverage=54%, HitCoverage=28%, E-value=8e-07, Identity=31%"; Hit description =Putative uncharacterized protein
MAEMQRVVVANIYAPCDLEGDFNCIKHPSERLGNNHSNSNSNLITEFNDWLHDMEADDIPCVDYHKVVRDCWSESQPTGWGGYVLKCKLQTLKQRLKNWSKENFGDLGNKVKQIQQKLNDLENSLSAQPFDQQIQELKKTQADLWEKATIHESFQKEKCCEGTAD

SEQ ID NO: 172506 - protein, 161 aa, Glycine max
  Coding DNA Sequence Number=SeqID_80821
DRDHKTPSETQRKPNRSPGVSSSGYGPLDHARKTLCGPEEVQQGPGVSSSDYGPLSVLRSACHPQQGHQAPYQLSFHQEVLRPQAGAGRDTTTARGWLTAGNRRTGATSRAPQLIYKDWSVAYDPLPTSGRPSPKLKISKSTRSVTDKSSCIQLNTLKKRS

SEQ ID NO: 172507 - protein, 90 aa, Glycine max
  Coding DNA Sequence Number=SeqID_80822
MDSRITKVEEDVTIIRECLDLPPPPPDCHHQKGGDYGSNVFQGYFDDAKESRVKKIPKIQESSFKNQDSRIIKIKIQDSRFEKQEKTQSR

SEQ ID NO: 172508 - protein, 77 aa, Glycine max
  Coding DNA Sequence Number=SeqID_80823
MNAKTDFPKKGKGEVGRKGRNEKKRKKKNNKKERKERFPIEDRKEVKMEKIGGKQSNSRSMKEREWKVFRPDKFSEK

SEQ ID NO: 172509 - protein, 98 aa, Glycine max
  Coding DNA Sequence Number=SeqID_80824
MLESFKQQQEMLVLELYIEKDVAGGSMFHSANSLTSCEIYLSNDEPQPPTNMSNLHLHEDDDDDYFVSNSYVEESLDEDDSVDGISDTDNEVPEMIPP

SEQ ID NO: 172510 - protein, 162 aa, Glycine max
  Coding DNA Sequence Number=SeqID_80825
MIRGDTLRLSAPFCHPEQMTSRDQVWSFCTHDTRRYLTVIRTPLPFRHSRVRWHAETKFGHSAPMIRGDTLRLSAPFCHAEQMTSRDQVWSFCTHDTRRYLTVIRTPLPFRHSRVRWHAETKFGHSAHMIRGDTLRLSAPLCHSDTVVSVGTQRPSLVILHP

SEQ ID NO: 172511 - protein, 451 aa, Glycine max
  Coding DNA Sequence Number=SeqID_80826
  Gene Ontology: Mol. function=helicase activity; Cellular component =chromatin; Biological process=protein amino acid phosphorylation
  Homolog annotation: Hit_ID=Q9LX60; Match level="QueryCoverage=99%, HitCoverage=25%, E-value=1e-77, Identity=38%"; Hit description =Putative uncharacterized protein F4M19_60
  Pfam annotation: Domain name=DUF889; Domain location=375-449; Score= -94.4; E_value=4.5e-05; Accession=PF05970.5; Description=Eukaryotic protein of unknown function (DUF889)
MFTAWMHSNKICSYGRDLTYHQYISRFVYVARKRCWQPRKQGNTIGRLIWVPPSAGELFYLRVMLSTAKGAQSYNDIRTVNGLVYPTFREPCFAKFFLGNDQEFISALREANNWGTAHYLRKLFVKLLFMNTMDKPEYVWQQTWQWMADDIIFNHRKQDEQKTIVDTIMSVVNTQSAAVYFLYGYGGTGKTFVWTTLSSGIRSNGGIVCTVASSGIASLLLPGGRTAHSKFAIPVPATKNSTCNIHQGSELAELLKVTKLIVWDEAPMCHKFAFEALDKSLKDIMQNNLPFGGIASLLLPGGQTAHSKFAIPVPATENSTCNIHQGSELAELLKVTKLIVWDEAPMCHKFSFEALDKSRKDIMQNNLPFGGKIIVFGGDFRQILPIVPKGNRSDIIHATINASYIWDHCQILKLTKNMRLLSNALQQPNNEELKQFSLWLLDIGDGKNWII

SEQ ID NO: 172512 - protein, 69 aa, Glycine max
  Coding DNA Sequence Number=SeqID_80827
MSEWIVIIKKGEIVEAMPSKIILMMPKNQESNKFQESRIIKIKIQESRFKIQVKNQDSRLKNQEKTQSR

SEQ ID NO: 172513 - protein, 39 aa, Glycine max
  Coding DNA Sequence Number=SeqID_80828
MQPEETKQPEETKQKKAKGIPEEGSSGNFRKKVLPETSG

SEQ ID NO: 172514 - protein, 79 aa, Glycine max
  Coding DNA Sequence Number=SeqID_80829
  Subcellular localization annotation: CTP_CleavageSite=43; ConfidenceScore=5.27e-01
MSCTGSLSAPLHLTNRTALVHPLSEKGALSQNSLACAKRSIKLCMSRVSRERKVQVTENFERCEDLQRPELETEAGLKA

SEQ ID NO: 172515 - protein, 183 aa, Glycine max
  Coding DNA Sequence Number=SeqID_80830
MILEDELKACQRSKRSLTKQLSRMEENMWTIIDQYKEKLNLAARHEQRLEDEHTKVSTLQAGKEARKKVIDSLHGEAMMWMDRFAFTLNGSQELPRLLAKAKEMADVYSSLEEVHGLFDYLVVVKVNVITKRNERALWHPYQTHAKTKIMSEIEEVKEQMKADMEAMKDQMSRDKKLLMHFFQ

SEQ ID NO: 172516 - protein, 96 aa, Glycine max
  Coding DNA Sequence Number=SeqID_80831
MDAHFEGMDTWITQLEDDMGFIHRCFDPPDIVINKKGEIVEARYFDVLMMSKDKALLKFYSRQESKNLRKSRYMIKLISRILGRSFQIEKAKGLAK

SEQ ID NO: 172517 - protein, 96 aa, Glycine max
  Coding DNA Sequence Number=SeqID_80832
  Gene Ontology: Mol. function=nucleoside-triphosphatase activity; Cellular component=nucleus; Biological process=mRNA processing
  Homolog annotation: Hit_ID=Q9C7G2; Match level="QueryCoverage=68%, HitCoverage=12%, E-value=8e-21, Identity=61%"; Hit description=ATP -dependent RNA helicase, putative
MHNLTHDFKSLCDNLKARKHILDELNSTGQKHQVYIHIREPEGDILIFMTGQDDIEKLVSKLEDKVCVFSPPPPNCRRIIVATNIAETSLTVDGVV

SEQ ID NO: 172518 - protein, 315 aa, Glycine max
  Coding DNA Sequence Number=SeqID_80833
  Pfam annotation: Domain name=K-box; Domain location=64-158; Score =8.0; E_value=9.7e-05; Accession=PF01486.8; Description=K-box region
  Subcellular localization annotation: CTP_CleavageSite=29; ConfidenceScore=5.49e-01
LPSLGTDVWGANTFPVRKYNSRTFHLKVRRSRLFRFFRRFPQINVGGDSARIPFVEHASRESRVALPPKAFEARGSKHDEEDWPSLSCKTSLRKFLGEGLGACSIEELQWIQQQLERSLSNVRARKIEVVANYQGDSYMGKPVRINCQKAILMMKCSALFSRPLSTSPNQLDGDKITGATNHKSVNFEGSLLVQHLFKDHRRCSYMIANALDKDGKFTTAQVSRKLKQLGLYLPLPKDGKFTSAQGWECHYINAEYLLSELGHLKKESANWNNTLGDEEIGSSPAKVWTQDIKNKLDVIKGFAPTFGSNSDKDDH

SEQ ID NO: 172519 - protein, 162 aa, Glycine max
  Coding DNA Sequence Number=SeqID_80834
DLAAQVLLLMMEREMITMIVDTLPVFYYEKMAGYMPLSFVNLVFAGERIKVGLRRGKFNYATLMNRKPEANGENKNEGETHAVTLAPTWPNFPLVQQYQYSTNISPSHYPPLYQLRTSNHQQSDTDAILPRKGPITRAMSKRLQEDWARAAEEGPRVLMNLK

SEQ ID NO: 172520 - protein, 117 aa, Glycine max
  Coding DNA Sequence Number=SeqID_80835
MTPTHDTLLYYNGRWNMPRQNNFVGYAFTGKNPKKFDIPSGCTIDELKDLIKQVAPQWIPLDGIHESQMVKRLFFRQPGHFEYSDKVIKFEIIELKTNDDVLKVMEIEDDVATSLQD

SEQ ID NO: 172521 - protein, 643 aa, Glycine max
  Coding DNA Sequence Number=SeqID_80836
  Homolog annotation: Hit_ID=Q2HTA0; Match level="QueryCoverage=17%, HitCoverage=18%, E-value=2e-14, Identity=44%"; Hit description=IMP dehydrogenase/GMP reductase, related
  Pfam annotation: Domain name=DUF1723; Domain location=327-376; Score =51.1; E_value=4e-12; Accession=PF08330.1; Description=Protein of unknown function (DUF1723)
MEASFSSLNRQKLRTRWSEWVEDPKRVIEEVKNFFEQRFQDENERCCSLDGVAFERITFEESCGLKSFFEEREKRCGVLVVTKAQAGGCHSSFITLIPKVENPQSLKEFRAISLFGCMFKIVAKEKYGGWRGLLKEESLRGASIWWRDLRKVFRGENQMEWFNSLVEWKATMLTIMVRTRGLGRAFARVISRGMGRQDEHHADDVPWRCRPTASTRRQWIHVVVADDVPHMTEDVPQMTADVVAPGVEGLAGDGAEGSPADDAEGFPMLTSFADHVAHSIWTGEECPKLKLVSHGRKVEKFWRPTFEIEGLVTATGLTPLIGCSVVTGDSGVISAFVERWHRETSTFHLLVGELTITLGDVASLLHLPITDSFHNFEPLPVDEAVVLLMELLEVSGEEARAETSGGYAWVAVALVHMYDQLNEASQTTTRQIAGYLTILQIYEHFPSVHDCVTDDGYDKTSPRASRWLTTKAHMKGITGASYRTRLDALTIIDGQRRWGPIVVHVRPKRVVRKFGYIQTIPLPPVSASLSYEDIDDRWMHFSNHLAAVGEICLVSGHPPTPQHEEYVEPNIPEVPVASDPHMHAVVRLVGCEAIAERFERVLNLRMVTEGTELHQIMEDCLRIARGDTSDGNVRARQRRCTDH

SEQ ID NO: 172522 - protein, 59 aa, Glycine max
  Coding DNA Sequence Number=SeqID_80837
MKNKIMGQGNSAYIVTMNDKNHATTVCFFGHQETRLGPKNTQAPDVDLLSSGSEAQSAS

SEQ ID NO: 172523 - protein, 98 aa, Glycine max
  Coding DNA Sequence Number=SeqID_80838
  Subcellular localization annotation: CTP_CleavageSite=57; ConfidenceScore=5.45e-01
MNESLVRHNSKFNFSPSFTPSIFVLPPSLSLALSFPPLKHPLQASYPRHILSGEAPSSKAYSSGWRLFSPLLRCLPLHLHGGKSPLKDLIEAQRSSLH

SEQ ID NO: 172524 - protein, 144 aa, Glycine max
  Coding DNA Sequence Number=SeqID_80839
MRSRARVMSEIEEVQEQMKADMEAMKEQMTTMMEARMSMRRMMEVNAATIVATSTTTELDPTHPPGLNQVGEPLGSTGSPHFVQVQNKHSFQPHGLPPNYTPPNVAHTPDENVDNSAPIPIESQHPQFGHEQVSQPMGKTPEAP

SEQ ID NO: 172525 - protein, 141 aa, Glycine max
  Coding DNA Sequence Number=SeqID_80840
MRGGGCTVARPGKLVTLALSLLVGPGAEKCPKRDPFALLLGYFAHFLLKHLKTLWITRQLVLRSSIRLARIQMFANDHPQMKLGVGDIDGIRKTTDFDSLGKVKKADDHDCLCMTTDFDSLENANGLDSWSTAGKCTRSRK

SEQ ID NO: 172526 - protein, 103 aa, Glycine max
  Coding DNA Sequence Number=SeqID_80841
MKNVEERLKACEIPHGKRYGNVSEAPRLRFSSRKQFFQANSKEREGRWLPPSSPRRAQLAQASRVASSRSNRLLEESSGGPKWAWVLFAPPFLLSTPPSAIFW

SEQ ID NO: 172527 - protein, 96 aa, Glycine max
  Coding DNA Sequence Number=SeqID_80842
MTDKRNVLGKNNEETRSYFTWNLKMECVLADILRDKGIWATRVTEVGKDNVKNRIKLWKSWYDIVYRLSMQKERKSRKRNDVYKQVEDMLVFLIGA

SEQ ID NO: 172528 - protein, 98 aa, Glycine max
  Coding DNA Sequence Number=SeqID_80843
RISGPTHSATKVYVRRNEVLRSNGKAQQFKEPVVDSNSVSKIDSMPSIQQDPIELQCALLKEMGLTYREDANKVKGLILDTENRDDMMAAERGIKKDQ

SEQ ID NO: 172529 - protein, 251 aa, Glycine max
  Coding DNA Sequence Number=SeqID_80844
MEVDREELPLDVHRNTSTKAMTLNFVTFFDQDPKWGVKADMALRGAHIFCNSGNGSEKGGSSSRSSSSSAMRPFLWRGANSSGDKCLKGTDNDLDGVAKREMTDVEFGRMVAREKKEEAFRKKNVKGRETSSPANEPSPRPGLVLVAITPPWGHRIETAQNGPPKDAMVKRHGMILKKLGNVKDPTQWIRPIKMRYFKLHAMKVVGSGTDVRRELVGGKFCNGILNTVHIELGAGRVSHEGNSMKAPDDMN

SEQ ID NO: 172530 - protein, 174 aa, Glycine max
  Coding DNA Sequence Number=SeqID_80845
APLDPDKSNRALGFPALITRLCQSFGVPVAPTKVIRPPITRAFIEKYCTQRQAQGDAPQAAGAPPPPHQAGPAGSFDMEQYLRHLVRQQAANHRAHVQTHDCLYQMSLSMQSQGFTSFSCPTPDQFRAEVAWPGDWLEAQAGEAPPEVPGDGEEAHEDEEMADLLDFLGGSGAT

SEQ ID NO: 172531 - protein, 61 aa, Glycine max
  Coding DNA Sequence Number=SeqID_80846
MEEDHKKTLKSLDFTNATNLVTSKLIVLQMKNDLRKVIRKEKEINLLTKDYESDENISQEG

SEQ ID NO: 172532 - protein, 124 aa, Glycine max
  Coding DNA Sequence Number=SeqID_80847
IYGEVSRSFVVRWKDVLDRLWHFIDKDGNFHTVVYNQDLDKSAIIARWTTLRDFYHLTGDHQVSLTHYGVSHSAQSYLQQPDKGWTYLHLEDVAECRLVFNHWRKIVKIGAGWKYFCETLSFKA

SEQ ID NO: 172533 - protein, 191 aa, Glycine max
  Coding DNA Sequence Number=SeqID_80848
MALLTELLEVTPNEAIAETRQAGGPHVRLSWLRDMLSGTWSTCTIILTRRRRPLHGRWPITFHYFSAGFTSTFRRSIDVSSMMVMLRLAHVPVGGLRGVRSYKLISSYTGQVRWGQIIVYIRPERVVRQFGYIQTVPPPSISHLFVTPTEETAEPRPAPPPPPHDDDFVEPPVPEVPVALDLPTHSVVDCT

SEQ ID NO: 172534 - protein, 117 aa, Glycine max
  Coding DNA Sequence Number=SeqID_80849
MFISFGYGLDQPIRHLVDPEKSNRALGFQLWLWASVSPTGCPSPQQGIAPIRHSVNPEKSNRVLGFPALITSLCQFYGVPIAHNKVIRPPTNRAFIRKYCALRQAQGETPQQTGDGR

SEQ ID NO: 172535 - protein, 392 aa, Glycine max
  Coding DNA Sequence Number=SeqID_80850
  Homolog annotation: Hit_ID=A5BSR3; Match level="QueryCoverage=50%, HitCoverage=65%, E-value=2e-12, Identity=29%"; Hit description =Putative uncharacterized protein
  Pfam annotation: Domain name=Transposase_23; Domain location=277-347; Score=4.7; E_value=0.00036; Accession=PF03017.5; Description =TNP1ENSPM transposase
  Subcellular localization annotation: CTP_CleavageSite=35; ConfidenceScore=5.48e-01
MATLPSSPPSPPESTTPFSLFTLKKTRKATRFRLLATRPAGVERPVIHVDPVTGKADGLHKKKLRIYLGIVACDKVDVTYDNWKQVPVTQKDLIWEDIQIVGERWRQFESYLTSKWGLAHDRECEDDKVCEKYDISKEKWAQFCQSRRDPSWEWKMACTKKSGQMVSEATNEIAERIDSLEEQVSQGSFVAHGRQDVLIATIGRLEHLGRVYAAGAGVTIKNYFGLTSRGFCTSSSMAAEDLEQGIALPFQAKVGPFVAHVSTKESCVDPSGHDPEMEDSDKCGLYVDDSPPRLVALRRVYEGSMTIHNVPLGNDQVKVGVEEVRHADARVPVPTQEVQLMGQTLNTFLIWPTHLVKPFLEQNKQVAKGLTKPIDMLDPDVDPLYLMILTIP

SEQ ID NO: 172536 - protein, 176 aa, Glycine max
  Coding DNA Sequence Number=SeqID_80851
MNCVFVHASSTFEFGAMRSDCLVQFSILNPFLGPMICVFIHASSTHEFGAMRSDCLVQFSILNLFRSPMNCVFVHASSTFEFGAMRSDFLVQFSILNPFSEPMNCVFVHASSTHEFGAMRSDCLVQFSILNPFLGPMNCVFVHASSIFEFGAMRSDCLVQLSILNLFRNPMNCVFV

SEQ ID NO: 172537 - protein, 166 aa, Glycine max
  Coding DNA Sequence Number=SeqID_80852
GTSFVVQVEGTSTWVVVTENKRGYISCGSVQVEGTSTWLFKENKGGYIPYGSLLVKDFTRLKEISWTPCIVIVKGDLEPSNREKNEREPRRRRRKGKVEPRRYRVVTWITSFIISLVSLVLYTMIGSKCKGSTWDNCHTLISSGDHCLVACNLHMTASRYLTLIVK

SEQ ID NO: 172538 - protein, 191 aa, Glycine max
  Coding DNA Sequence Number=SeqID_80853
  Subcellular localization annotation: CTP_CleavageSite=50; ConfidenceScore=5.82e-01
MGSPPASPPPPPPPPPPPAPAPSNASASSSAVKWTRKASRLRSLSTRPPSAERPVVHVDPATDKADNPHRKKLRTYLGIVVRDKAEFDIPEASDSRTKRKLLQTMGERWRQFKLDLTRKWALAADQDGVEDTVYVRKKAQAIQKQNIAPHVLSRGGYDYLEQKLLAEKTKKKLEEVTQSRSVDGVIDPPSP

SEQ ID NO: 172539 - protein, 440 aa, Glycine max
  Coding DNA Sequence Number=SeqID_80854
PAYRRRRQGIDVHRRRDVAGADVTRRIGHRGAQRVRAVRQRGGGEAPAAITPRGHRTNGAGTVVDGDHGTRFRGAAQRWRGIARKGAVRQRHRRTADVINDGQRTGDRHHGVDDQRGRHLRADVARRVGLRHVQRVAAVAQRVTYHEAPAAVAAHRGGAQKCGAVVHRDARARLAIAAQQRRAVVGDAIIRNGHRRAAVVVERQQIGDGRRCRGIDDHRGRGGTADVTCGIRYRHRDRVRPDAQRCQWREAPAAVRLHNRRAQCQTVVQNGDACPGLRRADAAAQRWRGVVGRTTVDDGGTGRIINNGETGVRWRHRIHGEVNHLGTGTDVARAVGHRHAQRMGGIAQRRRDEAPAAAGVSLHRSEQRVAIVNRDNRVRFRRALQRRRAVVGDSVINDSHTGDVVGQRQSGCRQRRRGVDGQRKGRCGNRNCRPHRWPSR

SEQ ID NO: 172540 - protein, 50 aa, Glycine max
  Coding DNA Sequence Number=SeqID_80855
  Subcellular localization annotation: CTP_CleavageSite=31; ConfidenceScore=5.31e-01
MILSSWQNKLNRPMATPPASPPPPPLPPSPPAVASQSLSTLKRTRKATRL

SEQ ID NO: 172541 - protein, 140 aa, Glycine max
  Coding DNA Sequence Number=SeqID_80856
MKGRIKISFSTETASQVESSLWWLKVAVGNGERAWNIGNGFGRKKGEEMAFFPKLLGPQGSKRTSEQCSRERKCRAHSKHLLRDPNGEIVDKCSLKMQTKFREDPTVKEGWAVFLPRQLHVASLRSFIKRLPREVFSWLL

SEQ ID NO: 172542 - protein, 54 aa, Glycine max
  Coding DNA Sequence Number=SeqID_80857
MEKGEEVAAQLAQASWVASSRSNPTSKNTLIDPLQNFKIAIRTPYLDMFTPFLS

SEQ ID NO: 172543 - protein, 109 aa, Glycine max
  Coding DNA Sequence Number=SeqID_80858
MKTLDEAMDLIESMAASDIAILRDRAHIPTKKSLLELTSQDALLAQNKLLFKQLEALTETLRCIICGGAHDSGCCIPNEEQIANEVNYMGNQSRGNFNTRGFPGFQNNQ

SEQ ID NO: 172544 - protein, 123 aa, Glycine max
  Coding DNA Sequence Number=SeqID_80859
GQDHLGLPSGVETKHERQKPIKVLKDERGRGWGHDRPIVALLCAKQAENVAARQPRMAPRKLASKRSRKDKAAEGTSSAPEYDSHRFRSAGAGEWAPLVTPMAKFDPEIVLEFYANAWPTEEG

SEQ ID NO: 172545 - protein, 238 aa, Glycine max
  Coding DNA Sequence Number=SeqID_80860
  Gene Ontology: Mol. function=transcription factor activity; Cellular component=cytoplasm; Biological process=regulation of transcription, DNA-dependent
  Homolog annotation: Hit_ID=A5B445; Match level="QueryCoverage=47%, HitCoverage=44%, E-value=2e-22, Identity=43%"; Hit description =Putative uncharacterized protein
  Pfam annotation: Domain name=AP2; Domain location=12-63; Score=49.0; E_value=1.7e-11; Accession=PF00847.11; Description=AP2 domain
MRKKIIDPSSGKKFCGIRQRPWGKWATEIWDLARRMCLWLGTYETAEEAIMVYDDTIIRLRGSDALTNFMLPQRDSPSPLSVVAETPTEFRSNSSKEKFESQQKVEEVLRECEGETETSLFEETKEENLNLLHQSQMLGETVLFSSEEGFSDESSITLANWLIDFDRACPSPSSLCQVDDFFQDILLASDPVTTTNMGDAEHGTATVAFTATPTGTHSMWRLLTRPSEADRHQRSSVT

SEQ ID NO: 172546 - protein, 88 aa, Glycine max
  Coding DNA Sequence Number=SeqID_80861
MKAVIRYFQEWTREGSRQFVKFQDMPKNQKNIDAQSHPGPLGPSRIFLQKAVASGGSNLARLGELCGNHLPYFAINRGASEEDKGSAP

SEQ ID NO: 172547 - protein, 94 aa, Glycine max
  Coding DNA Sequence Number=SeqID_80862
MECTFPLGTGPRPLTLVGAGAQVVTPLVIVLGDDEKEKNKRGYISCGSVQVEGTSTWLFKENKGGYIPCGSLACKGFYKVERNLKHRWLLGDWM

SEQ ID NO: 172548 - protein, 36 aa, Glycine max
  Coding DNA Sequence Number=SeqID_80863
MKRCMMRSRKPDMVQRYTPRSNNAAKVIYIYEKNNE

SEQ ID NO: 172549 - protein, 140 aa, Glycine max
  Coding DNA Sequence Number=SeqID_80864
MGSKIYPKVHENPRAFFSSSSPRLLESSIQYPWGVGLHQVAWPGAQPSIVRTGGSFAAQAPQQERSNEATAPPEPTPAQVEPVPADPHSPVADPSSPKLEAAPPSSPIIIISEDPTKSTPGEVVALSDSPIFHLIDKEES

SEQ ID NO: 172550 - protein, 154 aa, Glycine max
  Coding DNA Sequence Number=SeqID_80865
RRKDKELKGSSNGIIGGYHNWLKSRMQGIKWLPKLKSLSGKEAEIPEESEEVQALKAELEKARVVKEKLMTAVTKVRKENKFRGALWGNSNELKLRRAERDESRMESMVLEGLGSSSSMDSFASWKMNGRGMEKEEREETPLQGEDESRRSSPP

SEQ ID NO: 172551 - protein, 107 aa, Glycine max
  Coding DNA Sequence Number=SeqID_80866
MAKIQGPKEGKTYFNIYKEEWTQPWPMGSKINPDVHENPRTFFSSSSQILSESSIQYPRESYKLVVATYPSAGGRRETHGCVFQERNTRGVATNVYLRKTSKKLEKT

SEQ ID NO: 172552 - protein, 140 aa, Glycine max
  Coding DNA Sequence Number=SeqID_80867
MPSKVVLMMPKNQELSKFQRFKNLVSRIKIQDSRIKFQESRFKNNHDQDSRLKIQESREDSIKIRYILCGTSRGYIYLGIVILRTREGTSLVDQFKWMVHPLGFFKENKGGYIPCGSLACKGFYKVERNLKNRRLLGDWM

SEQ ID NO: 172553 - protein, 83 aa, Glycine max
  Coding DNA Sequence Number=SeqID_80868
  Subcellular localization annotation: CTP_CleavageSite=45; ConfidenceScore=5.17e-01
MNVLFRAVHVSSTFEFGAQLHDCLSADPQGNPPYSTFVQSTMNIRSFAKAGRTKSVSYLCFPLISDERLARSVKFRNVAEVEK

SEQ ID NO: 172554 - protein, 109 aa, Glycine max
  Coding DNA Sequence Number=SeqID_80869
MVEQEEREVKPHQEETEVVNLGVGEERKEVKVGTGMLANIRDELITSKSQVLPSKAEAEEDEARDVPEDKRRNSTLDSWSYLDTRNRLPTWCQSLKWMERCECVWTIGI

SEQ ID NO: 172555 - protein, 211 aa, Glycine max
  Coding DNA Sequence Number=SeqID_80870
  Homolog annotation: Hit_ID=Q5NCP6; Match level="QueryCoverage=89%, HitCoverage=11%, E-value=2e-07, Identity=23%"; Hit description =Benzodiazapine receptor associated protein 1
MVEAKVPEERKEVQALKAELERTRVVKEKLKTTITRVRKECDELRDVNVTMAEALEREPKRAHKEEWSRNKFRGALWGSNNKLKLRRTERDESRVESMVLEDKLKACQRSKRSLTEQLSITEENMLTIIDQYKEKVNLVATHEQKLEDEHAKVSALQVEREARERVIESLHGEAMKWMDRFALTLNESQELPRLLAKAKAMADIYSAPEEV

SEQ ID NO: 172556 - protein, 182 aa, Glycine max
  Coding DNA Sequence Number=SeqID_80871
MANKLQLIFRLTDPNMASYLVLIGPKQCQIPRASSKWQSDDMVVLPAAAIVKLHLHHNALTQSHEEDKGEGKGEIRKFGRRWNKKEKREEGLGGWGRGKGGQIYPPLPLAARLNPPYPLAAKVERGECRQEQERYKPRRRERGQCRQCKWRHPSYVGLAHSDGEIGPRGTRPQCWRDRPGFT

SEQ ID NO: 172557 - protein, 78 aa, Glycine max
  Coding DNA Sequence Number=SeqID_80872
KRSIWILEEIIAIKESFNLLFPIRIIVGKKFGDIGESDASKGFGWLMGVGNEGVVVGHGRQGWGTTSLIEEIGNGWIV

SEQ ID NO: 172558 - protein, 133 aa, Glycine max
  Coding DNA Sequence Number=SeqID_80873
MAAQLIHDRETLEGNERCRFRGTIRLTATSLVHPEEPAHTLQQPVEWIPPTPTPYRLVEPVQVIEVSSSEEDLEEDPEELPPEPAVDALDFPEDDEDPLPDVDSPEDVMSASEADSTEESGPRGTANSDDSSS

SEQ ID NO: 172559 - protein, 95 aa, Glycine max
  Coding DNA Sequence Number=SeqID_80874
  Gene Ontology: Mol. function=binding; Cellular component=nuclear pore; Biological process=protein import into nucleus, docking
  Homolog annotation: Hit_ID=A7Q9N9; Match level="QueryCoverage=93%, HitCoverage=9%, E-value=4e-32, Identity=75%"; Hit description =Chromosome chr5 scaffold_67, whole genome shotgun sequence
MSIQKDLYSPRTASMDFMGELARKHKKENLQKFIQFIVEIFRRYDEASVEYKPYRQKDGALLAIGALCDKLKQIEPYKYELECMLEFSIPIINVD

SEQ ID NO: 172560 - protein, 109 aa, Glycine max
  Coding DNA Sequence Number=SeqID_80875
MNFAVKKPVEFTPIPVSYANLIPYLLDNSMVAITPAKVHQPPFLREYDSNATCACHGEAPGRSIEHCRALKSKVQAIGLFAQATYALEFGLPRPFNQRLLVLHVGVGVP

SEQ ID NO: 172561 - protein, 155 aa, Glycine max
  Coding DNA Sequence Number=SeqID_80876
  Gene Ontology: Mol. function=ubiquitin-protein ligase activity; Cellular component=ubiquitin ligase complex; Biological process =protein ubiquitination
  Homolog annotation: Hit_ID=A7PI07; Match level="QueryCoverage=44%, HitCoverage=10%, E-value=2e-21, Identity=75%"; Hit description =Chromosome chr13 scaffold_17, whole genome shotgun sequence
LRQGDPLAPLLFHLVGEGLTGLMRVIRTGSPRNRENFAAVLWSLCTGDPLQLKLAKEHGVEAALQELLENGTDRAKIKAGSILELLQRMEGGPAIKSAATTEPGSQNGKKLEGGSNGGWEWKLSWRMALFDGEIQMADNFLGELSQQQIQPNRED

SEQ ID NO: 172562 - protein, 105 aa, Glycine max
  Coding DNA Sequence Number=SeqID_80877
  Homolog annotation: Hit_ID=A5AZ88; Match level="QueryCoverage=65%, HitCoverage=6%, E-value=4e-09, Identity=34%"; Hit description =Putative uncharacterized protein
MPLSMCVSLGEIEIMPTPDFVVIDIEEDVNIPRILGRPFMSTASCVVDMGKKILQMGIEDQKISFDLFHEYKDPLSQNVCLKVHVMEEKRPEKKVLEVGTLLDPG

SEQ ID NO: 172563 - protein, 120 aa, Glycine max
  Coding DNA Sequence Number=SeqID_80878
  Homolog annotation: Hit_ID=A6FJQ2; Match level="QueryCoverage=31%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVHQVKVKYGSNQLAKIRAKDESSYIAPLSTANT

SEQ ID NO: 172564 - protein, 152 aa, Glycine max
  Coding DNA Sequence Number=SeqID_80879
MTTLVYTCQSDLGSPNGEVRITGRCLHLLPDSWVMIAKGGVVDKSGAFAPTYTQFVMRNSDLRSSCKIVGNTGSNKIEENHSKCINLTHRVSSSTVSDPSFLGDPTVPPSEGKDGNSHPRSRFMVSSDFGSRLVERLDMMYVRVLVWPTFQG

SEQ ID NO: 172565 - protein, 157 aa, Glycine max
  Coding DNA Sequence Number=SeqID_80880
MRSWVRGQWIPIDADALSQFLGDPLVLEEGQQWRRVRIKRTSMTTLTQTWMTLLLTNVLPIDHNSDLPLPKCQLVYAILTRMSVHVAQVIADAIYLFAGMPPTRHPLDLDKSNRALGFPTLITGLCQSFGVPVTPSKVIRPPITWAFIEKYCMPRQA

SEQ ID NO: 172566 - protein, 147 aa, Glycine max
  Coding DNA Sequence Number=SeqID_80881
MEVSVGLCHCDIGIAPIRHRVDPEESNKALGFQLWLRASVSPIGCPYPLARSCHHDIGVALARHLVDPEKSNRFYGVPVAPNKVIRPPINRAFIKKYCAPQAGARQDTTAAWGWPAVGNRLTAATSRAPQLIYKAWRVAYDPWPTSR

SEQ ID NO: 172567 - protein, 134 aa, Glycine max
  Coding DNA Sequence Number=SeqID_80882
MARTRGLGRAIGKVVGRDRPADEDAADVPERRRPTASARRLRVHQMTTEGRDMAEDVADMIDDVDDAAEGFPGGPRDPSVLTSFAEHVAHAVWSGRERPDLKLVSHGRKVTLIGRPVPEIEGLVAATGIKSTDR

SEQ ID NO: 172568 - protein, 159 aa, Glycine max
  Coding DNA Sequence Number=SeqID_80883
MAPRKLALKRSRKDKAAEGTSSAPEYDSHRFRSAVHQQRFEAIKGWSFLWERRVQLRDDEYTDFQEEIGRWRWTSLVTPMAKFDPEIVLEFYANAWPTEEGVRDMRSWVRDQWIPFDADAIGFCPDCCREASANHAHQHDHPDPDMDDVAPQQHPAQRS

SEQ ID NO: 172569 - protein, 128 aa, Glycine max
  Coding DNA Sequence Number=SeqID_80884
  Homolog annotation: Hit_ID=O69419; Match level="QueryCoverage=46%, HitCoverage=93%, E-value=2e-13, Identity=70%"; Hit description =Putative uncharacterized protein
LGHHFKNSVAPPTYLALLILLPVAAASGDKSCLTGATLPEGRKADRYPVSGRVGTGERTRELPGGNAWGAEPMEKRQHAAFYGSWPFAGLLLTCSFLRYPLILWITVLPPLSELIPLAAAERPSAASQ

SEQ ID NO: 172570 - protein, 84 aa, Glycine max
  Coding DNA Sequence Number=SeqID_80885
MSTIVFSIQSLNNIWMMSIIDEDMFKSNGNDPLEGLGGPMTRARARKAKEALQQVLSILFEYKPKFQGEKSKVVSCIMAQMEED

SEQ ID NO: 172571 - protein, 222 aa, Glycine max
  Coding DNA Sequence Number=SeqID_80886
MAPNRTQLQNMFKKEVGRLHAFQLRGLSIRRGKNRSRVEKREVRLLFSTSANAKIIRATGAKRKEGDTHAVTSAPAWVKPPQTSHGTHQYAQHHPSFSARAGNPSNSAPVQPRVPAPIPREAPQTPAPTTTRSADNAHFGAGPNAMRNFPPRPIPEFTPLPMMYEDLLPSLIANQMVVINLGKIYQPLSQSGMILTQLARTMGIPRAIPSKNAWPLNTRSNI

SEQ ID NO: 172572 - protein, 87 aa, Glycine max
  Coding DNA Sequence Number=SeqID_80887
  Subcellular localization annotation: CTP_CleavageSite=12; ConfidenceScore=5.18e-01
MLAAQLAQVSQVASSRSNSLLEESSGGPNTLQGPNKGRMSSSKGPRTKLGYDKLQQQAFCKAYGKIRDLAMAEVSAEAIASLAQYYD

SEQ ID NO: 172573 - protein, 192 aa, Glycine max
  Coding DNA Sequence Number=SeqID_80888
  Homolog annotation: Hit_ID=Q84VH5; Match level="QueryCoverage=60%, HitCoverage=21%, E-value=4e-53, Identity=76%"; Hit description =Envelope-like protein
  Subcellular localization annotation: CTP_CleavageSite=75; ConfidenceScore=5.04e-01
IPRVQHWPRKGKLSAGKLSVKYAILHRIGAANWVPTNHTSTVATESFAVKLPIAFPTVLCGIMLSQHPNMLNYTDSVMKRESPLSLHYKLFEGTHVPDIVSTSGKAASGVVSKDALIAGHMQDSGIDDGEAAEEEEDPAEQEEAAEEEGEAAEEEEEAAEEEEDAAEETESDDDSEGELYDVEGETAAADDD

SEQ ID NO: 172574 - protein, 143 aa, Glycine max
  Coding DNA Sequence Number=SeqID_80889
  Homolog annotation: Hit_ID=A2Q1D6; Match level="QueryCoverage=78%, HitCoverage=17%, E-value=1e-14, Identity=41%"; Hit description =Ovarian tumour, otubain, related
  Pfam annotation: Domain name=AFT; Domain location=34-130; Score= -39.3; E_value=0.012; Accession=PF08731.2; Description=Transcription factor AFT
  Pfam annotation: Domain name=FAR1; Domain location=48-132; Score= -23.0; E_value=0.017; Accession=PF03101.6; Description=FAR1 family
  Pfam module annotation: Pfam domain module=AFT::FAR1; Domain location= 34-130::48-132
MSKQADMDYENEEACGANEPHVDCSDAFNTSQVFECREDVLWWARSVAHENGFVAVILRSDTNTGSRGRTTFVLIGCERSGEYKCRKKEFIRRDTGTRKCGCPFKLRCKPVVGGEGWMVKLICGVHNHEFVKSLVGSICEAID

SEQ ID NO: 172575 - protein, 160 aa, Glycine max
  Coding DNA Sequence Number=SeqID_80890
  Homolog annotation: Hit_ID=Q6UUU1; Match level="QueryCoverage=37%, HitCoverage=40%, E-value=1e-18, Identity=78%"; Hit description =Putative uncharacterized protein
MRGMPPVRILTGIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPGVSPGGSLVRSLFCFRFTGVIPLYA

SEQ ID NO: 172576 - protein, 152 aa, Glycine max
  Coding DNA Sequence Number=SeqID_80891
MRCFTFRDFQLVLMLEEFEKIVGCLLGGTKPFFPLGHSSSIPRLSKVLGIPMIELREKEMNRNGVKSFPKKFMEDKAGECASKGWRGPTCPLEDFCMAPDKSKINWEELLASLTGSTICWFPRWEEVPNVLCRCGVFPNLPLMGTKGYVNYC

SEQ ID NO: 172577 - protein, 94 aa, Glycine max
  Coding DNA Sequence Number=SeqID_80892
  Gene Ontology: Mol. function=aspartic-type endopeptidase activity; Biological process=proteolysis
  Homolog annotation: Hit_ID=A7Q2C1; Match level="QueryCoverage=96%, HitCoverage=37%, E-value=7e-22, Identity=50%"; Hit description =Chromosome chr1 scaffold_46, whole genome shotgun sequence
MDLNGKVITNDDNKKIHDAVNTLIFTIAQHYIGDPTLWKDRSAELLSNLKCRILADLRWYMDTFLTRVYTREDGQQPFWKEKFLAGLQRLLGDK

SEQ ID NO: 172578 - protein, 160 aa, Glycine max
  Coding DNA Sequence Number=SeqID_80893
  Gene Ontology: Biological process=transposition, DNA-mediated
  Homolog annotation: Hit_ID=Q1J7G7; Match level="QueryCoverage=23%, HitCoverage=67%, E-value=8e-11, Identity=72%"; Hit description =Transposase
MVKVGTSYVPINVSFSPKVGPGLPRYQQGHQDLFILRSDLPSQWLLFLSAVPPVQLLTGWCVTAKAPPDISAGKCSGRVPFAIQAAQLLGRAIGAGLFAITPAGERGMCCKAIKLGNARVFPEFDDDPLSPRKQLEQSTDSRRVRDWDPRAQPSEPILFP

SEQ ID NO: 172579 - protein, 103 aa, Glycine max
  Coding DNA Sequence Number=SeqID_80894
MEPGNTYFSHEMRRVHYYSSRCICFIRSPCGCVTINWADLCGELLGVERFTGAWILRFIGGVLFVDKGSNKVFLREMCSATDYKIKSIGGGCDGKINISAKMI

SEQ ID NO: 172580 - protein, 312 aa, Glycine max
  Coding DNA Sequence Number=SeqID_80895
  Gene Ontology: Mol. function=kinase activity; Cellular component =cytoplasm; Biological process=D-ribose metabolic process
  Homolog annotation: Hit_ID=A4WCJ7; Match level="QueryCoverage=100%, HitCoverage=100%, E-value=1e-162, Identity=90%"; Hit description =Fructose-1-phosphate kinase
  Pfam annotation: Domain name=PfkB; Domain location=8-298; Score =243.6; E_value=4.5e-70; Accession=PF00294.15; Description=pfkB family carbohydrate kinase
MSRRVATITLNPAYDLVGYTPEIERGEVNLVKTTGLHAAGKGINVAKVLKDLGIDVTVGGFLGKENQDGFQQLFSELGIANRFQVVQGRTRINVKLTEKDGDVTDLNFSGFDVTPQDWDRFTADSLTWLGQFDMVCVSGSLPAGVAPDAFTKWMSDLRTHCPCIIFDSSREALVAGLKAAPWLVKPNRRELEIWAGRKLPTLQDVIDAAHQLREQGIAHVVISLGAEGALWVNASGEWIAKPPACEVVSTVGAGDSMVGGLIYGLLMRESSEHTLRLATAVAAMAVSQSNVGVTDRTQLAAMMARVDLQPVN

SEQ ID NO: 172581 - protein, 209 aa, Glycine max
  Coding DNA Sequence Number=SeqID_80896
  Gene Ontology: Mol. function=RNA binding; Biological process=response to stress
  Homolog annotation: Hit_ID=A7QKJ5; Match level="QueryCoverage=83%, HitCoverage=24%, E-value=3e-37, Identity=47%"; Hit description =Chromosome chr2 scaffold_112, whole genome shotgun sequence
MAIDFYSYVNARGLEQHEQRQLEFHEEPNDLCQLSDLKSDDSRVELSAEAALQAKPKRLDKYVKQTSKFVGEEGASRNIGGHTNNDDLGKIVDMSDFQESEDADWTRTRDLIKTGDREDVELVSCNTKGFIVSFGSLAGFLPYHNLASKWKFLASESCKTQAPITSFDAEIKNLSPDSPPSLEIDGKVEDRISPDMKLEDLLRIYDQDS

SEQ ID NO: 172582 - protein, 200 aa, Glycine max
  Coding DNA Sequence Number=SeqID_80897
  Gene Ontology: Mol. function=ubiquitin-protein ligase activity; Cellular component=ubiquitin ligase complex; Biological process =protein ubiquitination
  Homolog annotation: Hit_ID=A7PI07; Match level="QueryCoverage=89%, HitCoverage=51%, E-value=1e-47, Identity=51%"; Hit description =Chromosome chr13 scaffold_17, whole genome shotgun sequence
  Pfam annotation: Domain name=Arm; Domain location=127-167; Score =14.7; E_value=0.15; Accession=PF00514.14; Description=Armadillobeta -catenin-like repeat
  Pfam annotation: Domain name=Arm; Domain location=86-126; Score=6.9; E_value=1.5; Accession=PF00514.14; Description=Armadillobeta-catenin- like repeat
  Pfam module annotation: Pfam domain module=Arm::Arm; Domain location =127-167::86-126
MRVCVCVFLCVCVCVCVFLSVTCPKTQQTVVHTALTLNYVLKSLIALWCESNNIELPKRQGNCRTKKCGGNSKKDVVTAIFNLSIYQGNKPRAVKVGIVAPLIQFLKDAGGGMVDEAVAIMTILAIHHEGRVAIGQAKPIHILVEVIRTGSPRNRDHATAVLWSLCTGDPLQLKLAKEHGAEAALQELSENGTDRAKIKA

SEQ ID NO: 172583 - protein, 518 aa, Glycine max
  Coding DNA Sequence Number=SeqID_80898
  Gene Ontology: Mol. function=transporter activity; Cellular component= integral to membrane; Biological process=transport
  Homolog annotation: Hit_ID=A7PJ21; Match level="QueryCoverage=77%, HitCoverage=75%, E-value=2e-43, Identity=30%"; Hit description =Chromosome chr12 scaffold_18, whole genome shotgun sequence
  Pfam annotation: Domain name=Ank; Domain location=106-138; Score =25.0; E_value=0.00028; Accession=PF00023.21; Description=Ankyrin repeat
  Pfam annotation: Domain name=Ank; Domain location=152-184; Score =22.2; E_value=0.0019; Accession=PF00023.21; Description=Ankyrin repeat
  Pfam annotation: Domain name=Ank; Domain location=186-220; Score=9.4; E_value=1.4; Accession=PF00023.21; Description=Ankyrin repeat
  Pfam annotation: Domain name=Ank; Domain location=253-289; Score =15.7; E_value=0.18; Accession=PF00023.21; Description=Ankyrin repeat
  Pfam annotation: Domain name=Ank; Domain location=290-323; Score =25.3; E_value=0.00022; Accession=PF00023.21; Description=Ankyrin repeat
  Pfam annotation: Domain name=Ank; Domain location=72-105; Score=10.7; E_value=0.95; Accession=PF00023.21; Description=Ankyrin repeat
  Pfam module annotation: Pfam domain module=Ank::Ank::Ank::Ank::Ank::An k; Domain location=106-138::152-184::186-220::253-289::290-323::72-105
MDQLRIDVDFPSPDAASQVGLLHKEIVRKAMIYKLYQVDEEGDADKFGEELKQQCEENKLRLPDVFDKVTLTGDSLLHVAADLGQERMVEMICDLFPVLLTRRNVRGDTPLHIAVRSKNTSMVNLILSQYATKKSTHDEMKDKEITRETNECGDTPLHEAVYSGDVDVVKDIFDQDKDVVHCLNKSKRSPLCLAVVNGNEQILKLLLQIPLPADQPLSQCRRSSPLHTAIQHQKEEFLELEWPINPYIVLNQKGQNILHIAAKNGRGGVVEYLLRNCKTYDLSITQKDYDGNTPLHLASKNLFPEIIHLITEYYRTGLNLTNKDGLTARDISETFEHPMLRKRKPGKDIREAFLIVAALLVTVSFAAAFTVPGGVYSSDDPNPKIRGTAVFARKPLFWIFTIFNIITMYSSAMACGFLSLGIFLQSELTLTIQPSFLYLSSAFFTAPVAFIAAVVLVVANNRLLTIVTSVIGCLLTFYTVLLMLLSLLVSPLDGTSTTKANKDKDKDNGLEEHVQQGN

SEQ ID NO: 172584 - protein, 191 aa, Glycine max
  Coding DNA Sequence Number=SeqID_80899
  Homolog annotation: Hit_ID=A5B7R6; Match level="QueryCoverage=58%, HitCoverage=20%, E-value=7e-09, Identity=33%"; Hit description =Putative uncharacterized protein
  Pfam annotation: Domain name=Ank; Domain location=144-174; Score =13.3; E_value=0.39; Accession=PF00023.21; Description=Ankyrin repeat
  Pfam annotation: Domain name=Ank; Domain location=97-129; Score=24.5; E_value=0.0004; Accession=PF00023.21; Description=Ankyrin repeat
  Pfam module annotation: Pfam domain module=Ank::Ank; Domain location =144-174::97-129
MDPDHLKFPIEDDASWKERRSKRMEELKNTQFSGQDAALDPGLLHKELVGEKTILISELYEAVDEKGNVDNFVDVLKQECRQRKLNLSDIFEQRNVRGDTPLHVAVRSKNTTMINLILSQYALVKSTHDDVMKDIEITREKNELGDTPLDEAVQSGDLSVVEVILQRDKDMVHELNMSRCSPLFLAAASEN

SEQ ID NO: 172585 - protein, 171 aa, Glycine max
  Coding DNA Sequence Number=SeqID_80900
  Homolog annotation: Hit_ID=Q6L477; Match level="QueryCoverage=62%, HitCoverage=17%, E-value=8e-10, Identity=26%"; Hit description =Putative uncharacterized protein OSJNBa0009L15.8
  Subcellular localization annotation: CTP_CleavageSite=49; ConfidenceScore=5.47e-01
MATPPSSPPPPTEAASQSSSTLKRTRKTTRLRSLVTRPAGADRLVVHVDPATGKADGPHKKKLRTYLGIFARDKVSVTYENWKQVLAAQKDLIWEDIQDKFDIPEASDIRTKKKVLQTAGERWRQFKYDLTSKWTLAADKDNVDETVYEKYGISKEKWTQFCQSCRDPSWE

SEQ ID NO: 172586 - protein, 68 aa, Glycine max
  Coding DNA Sequence Number=SeqID_80901
  Subcellular localization annotation: CTP_CleavageSite=41; ConfidenceScore=5.19e-01
MILHEIRRPYSLKTAPSGVTNYCNLSFGGRATRGSRVCLPRKEGARSCYQRLFKENVRKTGMRVVYEL

SEQ ID NO: 172587 - protein, 68 aa, Glycine max
  Coding DNA Sequence Number=SeqID_80902
MKTHKKMITKDDDKGDDKKLKGQSKNEFKIFKIESRTLQDSNQESRFKRSRFQESIFKRSRFKNQEKA

SEQ ID NO: 172588 - protein, 45 aa, Glycine max
  Coding DNA Sequence Number=SeqID_80903
MEIRMDKSYNLFDPFIGAHNVRQCIMCHIQQQEGTNMVDMSSGGV

SEQ ID NO: 172589 - protein, 111 aa, Glycine max
  Coding DNA Sequence Number=SeqID_80904
MEIPENRRWMYQRLDDNKRWTNEFREGVFEFVQFVISQDMFQMQGERTRCPCKKYKCKVFKFVDGSMTSPVNLLRNINIVEMKSYNIRQRKAHLHRIPLTLLLLLMIMKYI

SEQ ID NO: 172590 - protein, 99 aa, Glycine max
  Coding DNA Sequence Number=SeqID_80905
MHKLQWLSARKNPEEDELSSLLSAPLQDIKCTTSAHPLSETSALSQNPLMRAKRSRSALSTKARTRPRSFNSGNWSDSKVLDSTGLSCCAITRNQGTRT

SEQ ID NO: 172591 - protein, 68 aa, Glycine max
  Coding DNA Sequence Number=SeqID_80906
MARRDKIWSFCTLLSSRGGGPDDMRRQNLVIFRTHKICHTDFGVTLTGGNTRVVIRINILLLSVRQNA

SEQ ID NO: 172592 - protein, 198 aa, Glycine max
  Coding DNA Sequence Number=SeqID_80907
METRGCINYYPVLAIRQLGYPMRGAPSEEGIAPFIARGFSDLNAKMLQRVRKAWNAVQRNDKELRGSNNGVIGGFQVRKRLKSLSNNKLKLRRAERDESRLESMILEDKLKYKEKLNLAASREQRLEDNHAKVSVMQWEREVRERVTNSLHREAMMWMDRFAFTLNGSQELPRLLAKAKAMADVYSAPEEVHGLFDYC

SEQ ID NO: 172593 - protein, 301 aa, Glycine max
  Coding DNA Sequence Number=SeqID_80908
  Gene Ontology: Mol. function=recombinase activity; Biological process= DNA recombination
  Homolog annotation: Hit_ID=A6EBF3; Match level="QueryCoverage=99%, HitCoverage=57%, E-value=1e-88, Identity=56%"; Hit description=Site -specific recombinase
  Pfam annotation: Domain name=Recombinase; Domain location=177-266; Score=18.8; E_value=0.00061; Accession=PF07508.4; Description =Recombinase
  Pfam annotation: Domain name=Resolvase; Domain location=4-153; Score =127.4; E_value=4.2e-35; Accession=PF00239.12; Description=Resolvase, N terminal domain
  Pfam module annotation: Pfam domain module=Recombinase::Resolvase; Domain location=177-266::4-153
MKKADLYIRVSTDEQADKGYSQRDQEERLKRYCENNNIKVGQIIYEDYSAKTFIRPEWIKLLDMLKKKSSKTDLLLFTKWDRFSRNAGDAYQMINILRKINVEPQAIEQPLDLSIPENKMMLAIYLAAPEVENDRRALNTYYGMRRAKKEGRLMGRAPYGYANRITENGEKYVIPKEPEASNMKWAFNEMSKGVYSASQIMDMMNRKEGKSVKISAFLASLRNTAYCGKIYVEQFNEEEAHFVKSIHEPLISEELFEKVQCIMDGNVNPARPNVKVLSDDNLPLRGFLVCPECGHLITGIL

SEQ ID NO: 172594 - protein, 193 aa, Glycine max
  Coding DNA Sequence Number=SeqID_80909
  Gene Ontology: Biological process=transposition, DNA-mediated
  Homolog annotation: Hit_ID=Q1J7G7; Match level="QueryCoverage=21%, HitCoverage=71%, E-value=4e-12, Identity=74%"; Hit description =Transposase
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTFAVPLSSTLKYYPEPHEMLIIHASSTIESGAPRIDCLAFAVHAILRYKHGASGDWEIWLFVIFPIGSFAKH

SEQ ID NO: 172595 - protein, 196 aa, Glycine max
  Coding DNA Sequence Number=SeqID_80910
  Homolog annotation: Hit_ID=A5B939; Match level="QueryCoverage=36%, HitCoverage=52%, E-value=9e-23, Identity=69%"; Hit description =Putative uncharacterized protein
MESRAPSGPFLVSRNWRCGMNRKLGYGAQLRANLDPTKGVGRLRQQDGGHGSRNPLRSVLPTLETAQPEVGSSGWKSTARRVVSGAPPAALENPEDRVPPTPGKGSRQNGSVTSGKGLALRAGHGGPSPEPVGCRWTARAASAARAGRRVPVGGRIGNGPFGASSPGVEQSTQNWYGQGESDCLIKTKHCDGPCGC

SEQ ID NO: 172596 - protein, 129 aa, Glycine max
  Coding DNA Sequence Number=SeqID_80911
  Gene Ontology: Mol. function=binding; Cellular component=Golgi apparatus
  Homolog annotation: Hit_ID=Q84XT8; Match level="QueryCoverage=58%, HitCoverage=40%, E-value=3e-34, Identity=94%"; Hit description =Putative uncharacterized protein
  Pfam annotation: Domain name=DUF1068; Domain location=1-128; Score =99.7; E_value=8.8e-27; Accession=PF06364.3; Description=Protein of unknown function (DUF1068)
MRKEKIPHQAPFAIQAAQLLGRAIGAGLFAITPAGERGMCCKAIKLDCAKPDPEVSGDTEKNFAELLTEELKLQESQAVENQQRADMALLEAKKIASQYQKEADKCNSGMETCEEAREKAELRVPSSNS

SEQ ID NO: 172597 - protein, 118 aa, Glycine max
  Coding DNA Sequence Number=SeqID_80912
MVNQTFIIDSSLFVEAKLHDESRLIQRCFDDNKDDDKGDDKKLKGQSKNEFKMFKIESRTLQDSRGKLKNTSRFKRKVDFKNQESRFKDQASKNQDQDSRIKRRLNQDKYEKVFSKTE

SEQ ID NO: 172598 - protein, 56 aa, Glycine max
  Coding DNA Sequence Number=SeqID_80913
MGWLEYQGNVKKQKQESWQPIYMTPSTEDVKRIVQGLFAVLWPSTYGWFHTFSTKR

SEQ ID NO: 172599 - protein, 79 aa, Glycine max
  Coding DNA Sequence Number=SeqID_80914
MLVRMIRIRLFAAARVKSCPGMYSSCVIASLSGCALTVGHPPISGGVDMEPIECEDTQPSKVGDVSPFEGVQSSGGEDV

SEQ ID NO: 172600 - protein, 39 aa, Glycine max
  Coding DNA Sequence Number=SeqID_80915
MVLLMNGSGMEKEDDWRCHFKEKMSQEEAHHHRKPWIRA

SEQ ID NO: 172601 - protein, 125 aa, Glycine max
  Coding DNA Sequence Number=SeqID_80916
MGEAEEVQEQMKADMEAMKKQMAIMMEAMMSMKKIMEVNAAAIAATSTIAEVDLTPQYGLNQINHPTLDMVGFRRQRVGRYGRPSFSVKNKHAFCHTLISSGDYYLMTCNLWLAALRYLASFVAQ

SEQ ID NO: 172602 - protein, 67 aa, Glycine max
  Coding DNA Sequence Number=SeqID_80917
MVAITPAKVPQPPFFQGYNSNTTCAYHGGVLGHSIEHLTCAPEFDFQVCSIRNCSFYMFGEGAVNDE

SEQ ID NO: 172603 - protein, 31 aa, Glycine max
  Coding DNA Sequence Number=SeqID_80918
MLMMLKMHCDDVMLLTWLDIPGGRNRMVKEF

SEQ ID NO: 172604 - protein, 106 aa, Glycine max
  Coding DNA Sequence Number=SeqID_80919
  Pfam annotation: Domain name=Transposase_23; Domain location=1-63; Score=-16.1; E_value=0.069; Accession=PF03017.5; Description =TNP1ENSPM transposase
LYIEENPPHLVALGRLYKRSTIVHNIPLFHDQVKVGVEEVRDADALIPVPTKEVKLVGQTLNTFLAWSTHLVKRLSEQGAVGPAKPTIKSDHDVDDPLYLMTLTIP

SEQ ID NO: 172605 - protein, 79 aa, Glycine max
  Coding DNA Sequence Number=SeqID_80920
  Subcellular localization annotation: CTP_CleavageSite=50; ConfidenceScore=5.26e-01
MGVHCYQASRRPSMTTDSPPLLMFPSTRWSHQLSQPTFRREGDAGLTGASSMKGKCAKLPPTFIRGKHRKNRKGVIYEL

SEQ ID NO: 172606 - protein, 931 aa, Glycine max
  Coding DNA Sequence Number=SeqID_80921
  Gene Ontology: Mol. function=metal ion binding
  Homolog annotation: Hit_ID=A5B3L6; Match level="QueryCoverage=95%, HitCoverage=68%, E-value=1e-144, Identity=43%"; Hit description =Putative uncharacterized protein
  Pfam annotation: Domain name=PHD; Domain location=253-302; Score =29.2; E_value=5.1e-06; Accession=PF00628.20; Description=PHD-finger
MIQNIDMRLESGTCNVCSAPCSSCMHLNHALMGLKAEEFSDENCRIGEANSMDEDNEYSLRSRACESSQHTVSEASNMQSVNSSHDALSENADSRQIILNKYQDSKHLEGLDDNTSCISRASDANLVNDSHQRNEERIIMNVERDSFSHVPEKLSECSIENSSSSLTKEREPVVSGEKYIAVIESTSKISLKVCPKSEADTDVCDANNEDPKYAVQDGQCEKAQELVKSPGKQEPQSDDESDESDVVEHDVKVCDICGDAGREDLLAICSRCSDGAEHTYCMREMLEKVPEGDWLCEECKDAEENENKRLDVDDKKMVEVSSTSQVSGKRLSDNIEVAPAAKRQALESSIGSPKTSSPKRLVPLSRESSFKSLDKSKVKPGLLMPIRNHSGGIDTEIARSPSIGPRGQNPKGMLLKSNSFNNLNSKPRVKLVDEVVPPPKKGGNEHTSKNMEMPARVTGKSTLFKSSSLGRSNATESKVKMLSPKSATTQDLKGSRHLKESGAFDRKFPSRIDRPVASLVVSTPKGDQKLTPHAESSKASAMNNNRELKVNQDGKSCALPRSMSNISRKSLEPQVSSERTSTRVDETQQDVLSQSRETANQVERSRDSSSDRGRPAVPTSKNPLCQKCKEFGHALECCTAGSTQESGAEISVTASSSSKEEMHKDNILKVAIQAALLRRPEIYKKKEVSYQTDEVSTSGTELNCEVTSKDQVLVSSTLKNSISADETQEQQEILENSTSDSSKCSSANDLKQLNSCPTDFRSKPGKSDSIGLAAGKPVVRDLSDKAVTMSSVPLKMLAFPEYEYTWQGVFEVHRNGKPPDLYTGFQAHLSSCASPKVLGVVNKFLPKVSLSEVSRLSMWPSQFLHGGVSDDNIALYFFARDVERQAYGYYSYIDSVDHEMQKFHFSLLQELTFYLCSVTVMRDTTRVYWIT

SEQ ID NO: 172607 - protein, 869 aa, Glycine max
  Coding DNA Sequence Number=SeqID_80922
  Gene Ontology: Mol. function=nucleic acid binding
  Homolog annotation: Hit_ID=A7NX16; Match level="QueryCoverage=51%, HitCoverage=73%, E-value=3e-93, Identity=42%"; Hit description =Chromosome chr5 scaffold_2, whole genome shotgun sequence
  Pfam annotation: Domain name=zf-CCHC; Domain location=681-698; Score =16.8; E_value=0.0044; Accession=PF00098.14; Description=Zinc knuckle
  Pfam annotation: Domain name=zf-CCHC; Domain location=722-739; Score =13.4; E_value=0.014; Accession=PF00098.14; Description=Zinc knuckle
  Pfam module annotation: Pfam domain module=zf-CCHC::zf-CCHC; Domain location=681-698::722-739
  Subcellular localization annotation: CTP_CleavageSite=43; ConfidenceScore=5.02e-01
MTLAATDPLSEIVWSPDKGLSLKCADSSFAHKNSSLLRDVGTSCMVFAPPQNFTGGSSTTDKPLDDDFLKPIAVVCAKSDIAEADAPTMPPTGDSGVKAKCKAYEEDDIGSVGNKEKVNTAATAPNLPNEQNGNLTNNWEKITGDQANSGTDKVSGIEGNRISAISGQADQGPFDHLLLQSDENKPSMDQNPSPGRHSDGSVNIGLEKKAVVTDDDLHTAVEPIIEYRGSGAHETNLASSSKNPLEKLEYSAENDLQTFNCEAACAGTSRVNVSETENKFQDTEMMLPCDKILPVLHSPCHSRIHMAINKGKEKSLSDGDANVMLSREENDSHSSVESCNSTGFFSTGKKRRNFQQQLIIGSKRVKKQIEESSGPKSYVKQDNSFMNWISNMVKGLSPSIQNDSNTLALTLANPDHHNLQPDEKLIACNMNQDPEPKNTGFKSIFQSICCPSLKNVGTRMSHQEGKSSQDLVPGNMEHGIDATPITCWAENNSLSKLCLQSNKFEVSTGGNDAGLSSQPKIKPLNFFNCHESSKNNPVETKNYSILGHSKDKEEVASHSSSTKQNTDNNDNIDSNVLCDRKEEENICHRRDNLGSLWITRFSPKFTAPLREQPANDTEVSTDLKEDKGNNDHKSMYLFKPLSSSPGFRNLEPTASMFGRRFGAIKQIIPTNATDTTTQVNMLCFFCGTRGHQLSDCLAIAENKLEDLQKNIDSYGGLEEHHCLCIKCFQPNHWAISCPTSISTRKHELKANALVNDCGKHLISSNEGSARLLTDEDDRVLSGGSINDETDQRAGQNINLKWKSNEIITHKVGCNASFKKYRGLSSEENKFRENPTLSPSKLAERQISQVPKEIFEAVKKLQLSRTDILK

SEQ ID NO: 172608 - protein, 595 aa, Glycine max
  Coding DNA Sequence Number=SeqID_80923
  Gene Ontology: Mol. function=nucleic acid binding; Cellular component= mitochondrial matrix; Biological process=DNA duplex unwinding
  Homolog annotation: Hit_ID=Q0WMU8; Match level="QueryCoverage=88%, HitCoverage=87%, E-value=0.0, Identity=65%"; Hit description=RNA helicase like protein
  Pfam annotation: Domain name=Helicase_C; Domain location=285-371; Score=57.3; E_value=5.4e-14; Accession=PF00271.22; Description =Helicase conserved C-terminal domain
MASFLLRRNRNLFARSLLGNKEPFRPYFQLKFLSLGGAANKVHPYSSSNGPIRNDFTDLTCPHTWYPQARRKHRRVILHVGPTNSGKTHHALKQLESSASGVYCGPLRLLAWEIAKRLNKAQVPCDLITGQEREEVDGANHKAVTVEMADLSADYQCAVIDEIQAIVLLIENWSNCFMTETSAFEEELMALWALMIGCTTRGYSFTRALLGIAADELHLCGDPAAVPLIQEILKITGDEIEVQFYERLSPLVPLNVPLGSFSNVRNGDCIVTFSRQEIYKLKKRIEKEGKHLCSVVYGSLPPETRTRQASMFNDASSEFDVLVASDAIGMGLNLNISRIIFSTMKKFDGFEVRDLSVPEIKQIAGRAGRYGSNFPVGEVTCMDEEDLLLLHSSLNSPSPILERAGLLPTFDLMYMYSRLHPRNGFYQILAHFLDHAKLSENYFIVNCEQLLKVAAVIDELPLGLHEKYLFCISPADMDDEISSQGLTQFAENYAKKGLVRLREIFTPGSLKVPKTPAALKELESIHKVLDLYVWLSFRLEESFPDHELAVSQKAICSMLIEEFLERLGWQKPMARRLASHKMSSPLLSQHMRKCL

SEQ ID NO: 172609 - protein, 84 aa, Glycine max
  Coding DNA Sequence Number=SeqID_80924
MGIKAADEDPIVRFHRSGLWLIPIGPKHDTLWFSGILFLEVVVDQVRSLVAPNIKLSEQLKQVLKTDQLELCPIWQVQDMVKQA

SEQ ID NO: 172610 - protein, 122 aa, Glycine max
  Coding DNA Sequence Number=SeqID_80925
  Homolog annotation: Hit_ID=A7NWS4; Match level="QueryCoverage=39%, HitCoverage=3%, E-value=5e-10, Identity=66%"; Hit description =Chromosome chr5 scaffold_2, whole genome shotgun sequence
MKQIGIYDQLAKDTEECTSSSSDTSTMQLEKQGGQTQRKKLTEQARRGSEQIGRLQFEVQNIQYILLKLADVKNNKCKNKNSRPTGKIAEGAVRGVFVDVQGLQLMRTKSDTLVKLKVCHKK

SEQ ID NO: 172611 - protein, 110 aa, Glycine max
  Coding DNA Sequence Number=SeqID_80926
MGIMTILGIGIDHNIPGNDISMRHFIKHQTGIHDASTCIIHGNQGSLNKWVSVEEAELGSEAVNLQAETEGRKFRDGLEQWGEAEPIERAVWGRERIDGWRNGWEKRERA

SEQ ID NO: 172612 - protein, 261 aa, Glycine max
  Coding DNA Sequence Number=SeqID_80927
  Homolog annotation: Hit_ID=A7NWQ3; Match level="QueryCoverage=98%, HitCoverage=92%, E-value=8e-68, Identity=55%"; Hit description =Chromosome chr5 scaffold_2, whole genome shotgun sequence
  Pfam annotation: Domain name=DUF581; Domain location=191-249; Score =85.1; E_value=2.2e-22; Accession=PF04570.5; Description=Protein of unknown function (DUF581)
  Subcellular localization annotation: CTP_CleavageSite=40; ConfidenceScore=5.37e-01
MAFSSSSPSIPEKYKKLVSSFFCSPKLFANFTSKVLCETEAMMSPTYILDTKPFSGLKNPFRSETNSPRTPVGEHKRCWDKLDSKGLVDALGEITSKSQSRMILFGSQLKIQNHPPLPHATLSPKSAFGCANSAFETSKSPRVFSASEMDLSEDYTRVISHGPNPRTTHIYDNCIVESGCFDVGCSSSPLENVFLPPHISYPSESFMSFCFYCNKNLGQDMDIYMYRGERAFCSRECRNQGMLLEEGMIKLEGGDMYMGHS

SEQ ID NO: 172613 - protein, 1102 aa, Glycine max
  Coding DNA Sequence Number=SeqID_80928
  Gene Ontology: Mol. function=metal ion binding; Biological process =metabolic process
  Homolog annotation: Hit_ID=A7NWM7; Match level="QueryCoverage=84%, HitCoverage=67%, E-value=0.0, Identity=49%"; Hit description =Chromosome chr5 scaffold_2, whole genome shotgun sequence
  Pfam annotation: Domain name=PHD; Domain location=515-558; Score =65.0; E_value=2.5e-16; Accession=PF00628.20; Description=PHD-finger
MNKDGAQVPPLSQREKFNSDESIRVQGKNGVLKVMVNKKKVGGPSEQYYDHHKPLESRLRLKTEEMAKRLKTEEAAKRLKTEGTSKRNIPIRPSSYIDKKPVDKPALHKRPEKKRIASRKSLSSKDSKGDEGDSDNSDTSLNPRIRNTEARKSVKKIISEDEQTPVHQKTPTTRTKEGKLKRGSGTEKQKLREQIREMLLNSGWTIDYRPRRNRDYLDAVYINPAGTAYWSIIKAYDALQKQLNDDADEVKPKGDSSSFAPIADEVLSQLTRKTRKKMEKELQKKKKRHDSESDSEKEPQRKRSASNKHNMNSMDSDSYEEKLSSFIKQGNKSMKNKMFENTSISARSKIQNATHHSSDGIEKSLFGCDPHIHGRKSKKHGRCTLLVRSSNKGSNSESDGFVPYTGKRTVLAWLIDSGTVELSQKVQYRRRKKVMLEGWITRDGIHCGCCSKILTVSKFELHAGSKLPQPHHNIYLESGVSLLQCQIDAWNRQEHAEKIGFHAVDIDGNDPNDDTCGICGDGGDLICCDGCPSTFHQSCLDIQMLPPGEWHCPNCTCKFCGIASGTSDKDDASVNILQTCILYHNSCTKEMNTLPNKINSSSLSFCGKECKELSEHLKKYLGTKHELEAGFSWCLIHRLDEDSEAACRGLTQRVECNSKLAIALTVMDECFLPVIDRRSGINLIRNVLYNSGSNFSRLSYSGFYTAILERGDEIIAAASIRFHGTKIAEMPFIGTRHIYRRQGMCRRLFSAIELVNLEAMALCSLKVEKLVIPAIAELTHTWTTVFGFTYLDESLRQEMKSLNMMVFPGIDMLQKLLVEQGNREGSEKMENGNNDFIKTKMGNRSDMGFSTPQGPRGSDDVSSNPANETNDECSDASQELYNQVLVDGIICSQSHSEEMMSDPISDKCDSPSRTSHSELEMKNKVAAAPPVDRLDSSTKCQSIYPIDSHPVDILKVQALVQETACSDPCPAEENLDKKCHSSTAMNCDSSELDINPVLDSEMADNTLPTKEVCMNDVLEVVPSGNISEDNITKGNNRNVDESSSALNHADESLFQVGSDSNGEIGCENEKDLLLNPGVASNETDFDESGVNASGDSSETVIV

SEQ ID NO: 172614 - protein, 120 aa, Glycine max
  Coding DNA Sequence Number=SeqID_80929
  Homolog annotation: Hit_ID=Q94F64; Match level="QueryCoverage=97%, HitCoverage=24%, E-value=7e-35, Identity=55%"; Hit description=CDPK adapter protein 1
MPWDICCSEPGFCRDCVCSLCCKTVSSAYGGYSYIKCKVNVGGGICGHVSHMECALESLLAGKVGGSIGLDAQYHCRHCDGRSVIISQVNNLLQTCRAADLDDEIRNKILNLGACLLRGS

SEQ ID NO: 172615 - protein, 111 aa, Glycine max
  Coding DNA Sequence Number=SeqID_80930
MEREEIGKIHDVFLDASRRTLKHAVLIYLSGWLQVVMFPIDRLSSHHVASATTTFWIMQLYLMYKRIIKNYFGSVEKTEEARIRKKEPILASIGVIRGLRTQLEAKTLDMR

SEQ ID NO: 172616 - protein, 76 aa, Glycine max
  Coding DNA Sequence Number=SeqID_80931
MQLVECVMERTLLVSGMHLEPKLLEWRDEGLQPPHLVKWVWLMQAHEALFLVISTCSSRVPYKSEDNTQECLGDSA

SEQ ID NO: 172617 - protein, 246 aa, Glycine max
  Coding DNA Sequence Number=SeqID_80932
  Gene Ontology: Mol. function=transition metal ion binding
  Homolog annotation: Hit_ID=O23350; Match level="QueryCoverage=98%, HitCoverage=24%, E-value=2e-29, Identity=68%"; Hit description =Putative uncharacterized protein dl3515w
MGAGLREKHHWELENLTLTSQPFKTLKFFTLAVIQYIKKTSLYLLAKGGWVMLFSVAVGTLGIVLMTLGCLHEKVFVFSHPHALATCGTCTAALSAGHAAWSIARKTFETKGSPSQDPSSPSYSSEPTSKMAVMDLGLGDPLYQKSSWRWVQAACPADRAVVQVARASVQCGRVDLKSAPYDTTQLSRSASWLDKNCSEFGPPLFQSVYDSQVPLSSILPQVQLEAILWGIGTAIGELPPYFISRA

SEQ ID NO: 172618 - protein, 667 aa, Glycine max
  Coding DNA Sequence Number=SeqID_80933
  Gene Ontology: Mol. function=voltage-gated chloride channel activity; Cellular component=integral to membrane; Biological process=chloride transport
  Homolog annotation: Hit_ID=P92943; Match level="QueryCoverage=97%, HitCoverage=97%, E-value=0.0, Identity=67%"; Hit description =Chloride channel protein CLC-d
  Pfam annotation: Domain name=CBS; Domain location=496-637; Score =22.0; E_value=0.00039; Accession=PF00571.19; Description=CBS domain
  Pfam annotation: Domain name=Voltage_CLC; Domain location=130-462; Score=214.7; E_value=2.1e-61; Accession=PF00654.11; Description =Voltage gated chloride channel
  Pfam module annotation: Pfam domain module=CBS::Voltage_CLC; Domain location=496-637::130-462
MLSNHFQNGIETARLVWSRIPNSEESQLLDDAVGILKKNDGGGVESLDYEVIENFAYREEQAQRGKLYVSYLLVVKWFFALLIGICTGLAAVFINIAVENFAGWKFSVTFNIIQKSYIAGFVVYVLINLALVFSSVYIITQFAPAAAGSGIPEIKGYLNGVDIHGILLFRTLIGKIFGSIGSVGGGLALGKEGPLVHTGACIASLLGQVTCGCAAGVAAAFRAPVGGVLFALEEVTSWWRSQLMWRVFFTSAVVAVVVRAAMGWCSLFNQLTLYITTWRRNHLHKKGNRVKIIEACLVSILTSAISFGLPLLRKCSPCPDSDPASGIECPRPPGMYGNYVNFFCSKDKEYNDLATIFFNTQVMFYALAVVTFGTAVPAGQFVPGIMIGSTYGRLVGMFVVKYYRKLNIEEGTYALLGAASFLGGSMRMTVSLCVIMVEISNNLKFLPLIMLVLLISKAVGDAFNEGIYEEQAQLRGIPLLESRPKYEMRNMTAKEACGSGRVVSFPRVVKVSDVVSILRSNKHNGFPSKVDFQHSPLPSDPRGGGRSIRHDSGEFAKPVSSKGICIDDIHLSSDDLEMYIDLAPFLNPSPYIVPEDMSLTKVYNLFRQLGLRHLFVVPRPSRVLGLITRKDLLIEDKENVNTLELQSTSVRSLMLYSLYFLYSFFKF

SEQ ID NO: 172619 - protein, 68 aa, Glycine max
  Coding DNA Sequence Number=SeqID_80934
  Homolog annotation: Hit_ID=A7QH26; Match level="QueryCoverage=82%, HitCoverage=13%, E-value=8e-13, Identity=64%"; Hit description =Chromosome chr3 scaffold_95, whole genome shotgun sequence
  Pfam annotation: Domain name=DUF1005; Domain location=1-59; Score= -33.7; E_value=1.3e-06; Accession=PF06219.3; Description=Protein of unknown function (DUF1005)
MVSGEGKCSKPEVEVGVQHVTCTEDAAAFVALAAALDLSIDACKLFSQKLRKELRHEDVQLGNYLAFA

SEQ ID NO: 172620 - protein, 325 aa, Glycine max
  Coding DNA Sequence Number=SeqID_80935
  Gene Ontology: Mol. function=acyltransferase activity; Cellular component=cytoplasm; Biological process=lipid A biosynthetic process
  Homolog annotation: Hit_ID=A2Q2M3; Match level="QueryCoverage=88%, HitCoverage=96%, E-value=1e-115, Identity=74%"; Hit description =Trimeric LpxA-like
  Pfam annotation: Domain name=Hexapep; Domain location=101-118; Score =20.5; E_value=0.0061; Accession=PF00132.15; Description=Bacterial transferase hexapeptide (three rep
  Pfam annotation: Domain name=Hexapep; Domain location=130-147; Score =16.5; E_value=0.1; Accession=PF00132.15; Description=Bacterial transferase hexapeptide (three rep
  Pfam annotation: Domain name=Hexapep; Domain location=168-185; Score =18.8; E_value=0.02; Accession=PF00132.15; Description=Bacterial transferase hexapeptide (three rep
  Pfam annotation: Domain name=Hexapep; Domain location=190-207; Score =18.7; E_value=0.022; Accession=PF00132.15; Description=Bacterial transferase hexapeptide (three rep
  Pfam annotation: Domain name=Hexapep; Domain location=208-225; Score =16.6; E_value=0.096; Accession=PF00132.15; Description=Bacterial transferase hexapeptide (three rep
  Pfam annotation: Domain name=Hexapep; Domain location=232-249; Score =8.2; E_value=15; Accession=PF00132.15; Description=Bacterial transferase hexapeptide (three rep
  Pfam annotation: Domain name=Hexapep; Domain location=83-100; Score =1.7; E_value=92; Accession=PF00132.15; Description=Bacterial transferase hexapeptide (three rep
  Pfam module annotation: Pfam domain module=Hexapep::Hexapep::Hexapep:: Hexapep::Hexapep::Hexapep::Hexapep; Domain location=101-118::130 -147::168-185::190-207::208-225::232-249::83-100
  Subcellular localization annotation: CTP_CleavageSite=39; ConfidenceScore=5.50e-01
MAVTVRRVLAFASSSSAPFFNLNQNANLRYILPSPRHLSAFSVDSILRLTCVSSLEDGSVADKFHKWHNGGGTLHESASIDSTALVEVGAVVHSESIVGPNVRIGSGTIVGPSVTIAHSTNIGYNVALSNCCIGDSCVIHNGVCIGQDGFGFYVDGDGNMIKKPQMLNVIIGNNVEIGANTCIDRGSWRDTVIGDNSKIDNLVQIGHNVVIGKNCLLCGQVGIAGSATIGDYVTMGGRVAIRDHVSIISKVRLAAASCVTKDIKEPGDYGGFPAISIHQWRRQVASRCQALEPSDTKPVLVSAYTRGRSKDMSHVQWNQESFKVL

SEQ ID NO: 172621 - protein, 736 aa, Glycine max
  Coding DNA Sequence Number=SeqID_80936
  Gene Ontology: Mol. function=sequence-specific DNA binding; Cellular component=nucleus; Biological process=regulation of transcription, DNA-dependent
  Homolog annotation: Hit_ID=A7QUM2; Match level="QueryCoverage=99%, HitCoverage=99%, E-value=0.0, Identity=79%"; Hit description =Chromosome chr10 scaffold_179, whole genome shotgun sequence
  Pfam annotation: Domain name=Homeobox; Domain location=58-114; Score =80.4; E_value=5.8e-21; Accession=PF00046.20; Description=Homeobox domain
  Pfam annotation: Domain name=START; Domain location=245-465; Score =277.0; E_value=3.8e-80; Accession=PF01852.10; Description=START domain
  Pfam module annotation: Pfam domain module=Homeobox::START; Domain location=58-114::245-465
MFDSHPHLLDMSPPHKTTCSESDLAKPCRDDEYETKSITDTMDAPSGDDQDPNPRPKKKGYRRHTQRQIEEMEAFFKQCPHPDDKQRKELSRELGLEPLQVKFWFQNKRTQMKTQHERNENAILKAENEKLRAENSRYKEALTNATCPNCGGPAALGEMSFDEQHLRIENARLREEIDRISGIAAKYVGKPVTSSYSNLSSLNNNHVPVGNYGSQSGTVGEMYGGSDLFRPLPAPADADKPMIVELAVAAMEELTRLAQAGEPLWVPSNHHSEILNEDEYLRTFPTRGLGPKPLGLRSEASRESVVVIMNHINLIDILMDVNQWSTVFCGIVSRALTLEVLSTGIAGNYNGALQVMSSEFQVASPLVPTRENYFVRYCKQQPDGIWAVVDVSLDNLRPSTISRSRRRPSGCLIQELPNGYSKVTWIEHVEVDDRAVHSIYRTLVNSGLAFGAKRWVATLERQCERLASSMANNIPAGDLCVITSAEGRKSMMKLAERMVMSYCTGVGASTAHAWTTLSATGCDDVRVMTRKSTDEPGRPPGIVLSAATSFWLPVPPKRVFHFLRDQNSRNELIQYIQLNSQWDILSNGGLVQELAHIANGRDPGNCVSLLRVNSANSSQSNMLILQESCTDSTGSYVVYAPVDIVAMNVVLSGGDPDYVALLPSGFAILPDGPPALNGGPIHDVGSGGSLLTVAFQILVDSAPTAKLSLGSVATVNSLIKCTVERIKVAVIRDNTT

SEQ ID NO: 172622 - protein, 224 aa, Glycine max
  Coding DNA Sequence Number=SeqID_80937
MANFPPCWELMVEAARVTGSAVPGRDFKAVADGVRVVGLAPGFKAAPWLPGAVSVGADNEPGPRVGAADPLRAGGGDERRGHGGGGDRRAGQVVNGDGPSFTLGGVVGVERREVSLVLVPEAELASENRLLDVAFYLENLRAALRESQPLWKVQGRDSAKVRSRGIETLPNSLAEVKTQEGVVGLLVDGDLHQGLLRGFQDLGFGEIKGARRSEVWSSLISEGH

SEQ ID NO: 172623 - protein, 125 aa, Glycine max
  Coding DNA Sequence Number=SeqID_80938
MKLAKYRLKAQVEKDEGPSGEGQSPRVEKDEGPKTFGILIKFGEIFSLGSLLNQSQTYQGNPCGVCPDLSSFTGSGVYPDLSSFTGSGVYPDLSSFTGSGVYPDLSSFTGSGVYPDLSSFTGSGV

SEQ ID NO: 172624 - protein, 1085 aa, Glycine max
  Coding DNA Sequence Number=SeqID_80939
  Gene Ontology: Mol. function=transferase activity, transferring phosphorus-containing groups; Cellular component=Tor2-Mei2-Ste11 complex; Biological process=cell cycle arrest in response to nitrogen starvation
  Homolog annotation: Hit_ID=Q9FR53; Match level="QueryCoverage=98%, HitCoverage=41%, E-value=0.0, Identity=68%"; Hit description=PTOR
  Pfam annotation: Domain name=HEAT; Domain location=187-223; Score =20.4; E_value=0.0069; Accession=PF02985.13; Description=HEAT repeat
  Pfam annotation: Domain name=HEAT; Domain location=452-488; Score =0.2; E_value=25; Accession=PF02985.13; Description=HEAT repeat
  Pfam annotation: Domain name=HEAT; Domain location=524-560; Score =7.7; E_value=1.9; Accession=PF02985.13; Description=HEAT repeat
  Pfam annotation: Domain name=HEAT; Domain location=656-688; Score =8.8; E_value=1.3; Accession=PF02985.13; Description=HEAT repeat
  Pfam annotation: Domain name=HEAT; Domain location=778-815; Score =16.2; E_value=0.1; Accession=PF02985.13; Description=HEAT repeat
  Pfam annotation: Domain name=HEAT; Domain location=823-859; Score =6.0; E_value=3.4; Accession=PF02985.13; Description=HEAT repeat
  Pfam module annotation: Pfam domain module=HEAT::HEAT::HEAT::HEAT::HEA T::HEAT; Domain location=187-223::452-488::524-560::656-688::778 -815::823-859
MATASQSHRYIGPPSVGPGPGDALNRILADLCTRGNPKEGASLALKKHLEEEARDISGEAFSRFMDQLYDRISGLLDSSDVAENLGALRAIDELIDVALGENASKVSRFSSYMRIVFDTKRDPEILVLASRVLGHLARAGGAMTADEVERQVKIALDWLRGNRVEYRRFAAVLILKEMAENASTVFNVHVPEFVDAIWVALRDPALPVRERAVEALRACLRVIEKRETRWRVQWYYRMFEATQDGLGKNAPVHSIHGSLLAVGELLRMAEYTGNTVGDRWVGVAGYRLIGSRVVIYRYRYIIPQPCSEQKHCILHLLASTEWFIQEDDLIPLLPNGPSILLIGGLLSIHVSGCGWAGILATPQDRDSGFIALGEMAGALDGELIHYLPTITTHLREAIAPRRIKPSLEALACVGSIAKAMGSAMEPHVRGLLDIMFSTGLSTVLVEALEQISTSIPSLLPTIQGRLLDSISMVLSKSHYHLGRPAQSVGRGIIINVPQQVSELNGSALVQLALQTLARFNFKGHELLEFARESVVVYLDDEDGATRKDAALCCCRLIASSFSGMACSHFGSSRLTRSGGKRRILVEESAVQLEKAVTLNDAVNRFKMQLVGRVTYTDALVEKLLISAVADADVTVRHSIFTSLHGDRGFDEYLAQADNLSAVFAALNDEDFDVREYAISVAGRLSEKNPAYVLPALRRHLIQLLTYLEQSADSKCKEESAKLIGCLIRNCERLILPYTAPIHKALVARLVDVNANTGTISGVLVTVGDLARVGGFAMRQYIPELMPLIVEALLDGAAVSKREVAVATLGQVVQSTGYVITPYNEYPQLLGLLLKLLNGELVWSTRREVLKVLGIMGALDPHLHKRNQKTLPGPHGDVTRSASDSSQQIQSMDEFPMDLWPSFASSDDYYSTVAINSLMRILRDPSLASYHLKVVGSLMFIFKVLPDLFHTVRTCEDSLKDFITWKLGTLVSIVRQHIRKYLQDLLSLISEFWSAFTLPAPARPGLGYPVLHLVEQLCLALNDEFRTYLPVILPGCIQVLSDAERCNDYTYVLDILHTLEVFGGPKDVMHLIIVKKVEMGSEWAKM

SEQ ID NO: 172625 - protein, 89 aa, Glycine max
  Coding DNA Sequence Number=SeqID_80940
MGVPYVTYPQKADKSLMSPVSNEHVIKELNPVAVTLPSISSVDLPNFPPSSHEKPTSTRNNCSSPLFTCQCCQPSKLRDFFLITNNLSI

SEQ ID NO: 172626 - protein, 652 aa, Glycine max
  Coding DNA Sequence Number=SeqID_80941
  Gene Ontology: Mol. function=transferase activity, transferring phosphorus-containing groups; Cellular component=phosphoinositide 3 -kinase complex; Biological process=protein catabolic process
  Homolog annotation: Hit_ID=Q9FR53; Match level="QueryCoverage=99%, HitCoverage=26%, E-value=0.0, Identity=79%"; Hit description=PTOR
  Pfam annotation: Domain name=FATC; Domain location=620-650; Score =25.4; E_value=0.00021; Accession=PF02260.11; Description=FATC domain
  Pfam annotation: Domain name=PI3_PI4_kinase; Domain location=265-512; Score=292.7; E_value=7.2e-85; Accession=PF00454.18; Description =Phosphatidylinositol 3- and 4-kinase
  Pfam annotation: Domain name=Rapamycin_bind; Domain location=95-198; Score=207.3; E_value=3.6e-59; Accession=PF08771.2; Description =Rapamycin binding domain
  Pfam module annotation: Pfam domain module=FATC::PI3_PI4 _kinase::Rapamycin_bind; Domain location=620-650::265-512::95-198
MALKKGFSLVNINTWLVVLPQIIARIHSNNHAVRELIQSLLVRIGQNHPQALMYPLLVACKSISNLRKAAAQEVVDKVRQHSGVLVDQAQLVSKELIRVAILWHEMWHEALEEASRLYFGEHNIEGMLNVLEPLHEMLEEGAMKNNVTIKERIFIEAYRQELLEAYECCMNYKRTGKDAELTQAWDIYYHVFRKIDKQLQSLTTLDLESVSPELLECRNLELAVPGSYRADAPVVTIASFARQLVVITSKQRPRKLTIHGSDGDDYAFLLKGHEDLRQDERVMQLFGLVNTLLENSPKTAEKDLSIERYAVIPLSPNSGLIEWVPNCDTLHHLIREYRDARKITLNQEHKCMLSFAPDYDHLPLIAKVEVFEHALNNTEGNDLARGKAAYNIPPPYLRIAKSLWAMGYEEVGYLLGLGDRHPSNLMLHRFSGKILHIDFGDCFEASMNREKFPEKVPFRLTRMLVKAMEVSGIEGNFRSTCENVMQVLRTNKDSVMAMMEAFVHDPLINWRLFNFNEVPQMSMLTSNHVPPVVNTEESAPNRELPHPQRGARERELLQAVNQLGDANEVLNERAVVVMARMSNKLTGRDFSTCSSVSNNSPQHAVDHSSLISGDTREVDHALSVKLQVQKLIIQASSHENLCQNYVGYGLLT

SEQ ID NO: 172627 - protein, 626 aa, Glycine max
  Coding DNA Sequence Number=SeqID_80942
  Gene Ontology: Mol. function=calcium ion binding; Cellular component =late endosome membrane; Biological process=protein transport
  Homolog annotation: Hit_ID=P93484; Match level="QueryCoverage=99%, HitCoverage=99%, E-value=0.0, Identity=87%"; Hit description =Vacuolar-sorting receptor 1 precursor
  Pfam annotation: Domain name=EGF_CA; Domain location=515-556; Score =7.4; E_value=0.03; Accession=PF07645.6; Description=Calcium binding EGF domain
  Pfam annotation: Domain name=PA; Domain location=54-166; Score=100.7; E_value=4.6e-27; Accession=PF02225.13; Description=PA domain
  Pfam module annotation: Pfam domain module=EGF_CA::PA; Domain location=515-556::54-166
MKVWRWVVSLMLVGLLPVSTMGRFVVEKNSLRVTSPEKIRGTHDSAIGNFGIPQYGGSMAGNVIYPKDNKKGCKEFDEFGISFKSTPGALPTIVLLDRGSCFFALKVWNAQKAGASAVLVADDVEEPLITMDTPEEDGSSAKYVENITIPSALVGKSFGLKLKDAFSGGDMVNLNLDWRESVPHPDDRVEYELWTNSNDECGVKCDMLMEFVKDFKGAAQILDKGGYTQFTPHYITWYCPHAFTLSKQCKSQCINHGRYCAPDPEQDFTTGYDGKDVVIENLRQLCVFKVANETEKPWVWWDYVTDFQIRCPMKEKKYNKECANAVIKSLGLNTEKIEKCMGDPDADTDNPVLKEEQDAQIGKGSRGDVTILPTLVVNNRQYRGKLEKGAVLKAICSGFEETTEPAVCLSSDVETNECLTNNGGCWQDKAANITACKDTFRGRVCECPLVDGVQFKGDGYTTCEASGLGRCKINNGGCWHDAQNGHAFSACLDNGGVKCQCPTGFRGDGVKNCQDIDECKEKKACQCPDCSCKNTWGSYDCSCSGDLLYMRDHDTCISKTGSQGRSTWAAFWLILLGVVMIAGGAFLVYKYRIRQYMDSEIRAIMAQYMPLDSQAEVPNHVNDQRA

SEQ ID NO: 172628 - protein, 508 aa, Glycine max
  Coding DNA Sequence Number=SeqID_80943
  Gene Ontology: Mol. function=nucleic acid binding; Cellular component= nucleus; Biological process=double-strand break repair via homologous recombination
  Homolog annotation: Hit_ID=A5BI61; Match level="QueryCoverage=95%, HitCoverage=53%, E-value=0.0, Identity=70%"; Hit description =Putative uncharacterized protein
  Pfam annotation: Domain name=DEAD; Domain location=169-349; Score= -19.3; E_value=0.0012; Accession=PF00270.20; Description=DEADDEAH box helicase
  Pfam annotation: Domain name=ResIII; Domain location=168-343; Score= -30.7; E_value=0.018; Accession=PF04851.6; Description=Type III restriction enzyme, res subunit
  Pfam annotation: Domain name=SNF2_N; Domain location=171-435; Score =203.1; E_value=6.8e-58; Accession=PF00176.14; Description=SNF2 family N-terminal domain
  Pfam module annotation: Pfam domain module=DEAD::ResIII::SNF2_N; Domain location=169-349::168-343::171-435
MEEEEDEVGWCSSDSGDGDGDDDIEERKSQNVDALLRGNLVVKRQSLLPRLLSVSQGAAVCRKPFKPPCSKSHASASAYNQDLTRKLSARKRFVPWGSSSPIPIPIPRSALDDSKFNVAVAVADVAEELKPSLPPGIDPLVLWHPQDSEDANANFTTITVDPLLVRYLRPHQREGVQFMFDCVSGLSTTPNIHGCILADDMGLGKTLQSITLLYTLLSQGFDGKPMVRKAIIVTPTSLVSNWEAEIKKWVGERVPLVALCESTREDVISGIDNFTSPKSNLQVLIVSYETFRMHSSKFSSTDSCDLLICDEAHRLKNDQTITNRALAALPCKRRILLSGTPLQNDLEEFFAMVNFTNPGILGDIAHFRRYYEAPIICGREPAATAEEKKLGAEQSAELSVNVNRVKRAITEELKQSKILAYITALKKLCNHPKLIYDTIRSGSPGTSGFEDCIRFFPPEMLSGRSGSWTGGHGAWVELSGKMHVLARLLAHLRQRTNDRIVLVSNYTQ

SEQ ID NO: 172629 - protein, 1098 aa, Glycine max
  Coding DNA Sequence Number=SeqID_80944
  Gene Ontology: Mol. function=nucleotidyltransferase activity; Cellular component=intracellular; Biological process=DNA repair
  Homolog annotation: Hit_ID=A7QW56; Match level="QueryCoverage=93%, HitCoverage=93%, E-value=0.0, Identity=53%"; Hit description =Chromosome chr3 scaffold_199, whole genome shotgun sequence
  Pfam annotation: Domain name=BRCT; Domain location=84-162; Score =42.3; E_value=1.7e-09; Accession=PF00533.17; Description=BRCA1 C Terminus (BRCT) domain
  Pfam annotation: Domain name=IMS; Domain location=383-741; Score =267.2; E_value=3.5e-77; Accession=PF00817.11; Description =impBmucBsamB family
  Pfam module annotation: Pfam domain module=BRCT::IMS; Domain location= 84-162::383-741
  Subcellular localization annotation: CTP_CleavageSite=85; ConfidenceScore=5.60e-01
MSLDSSRSGNSKRSFSNSISSNDYIKKKKKKKTTPNQKTLGAAWGSKSNSRKPAFSDFASYMTEKNRKLHNQFEAQASTSSLTLSASLFSGVSIFVDGFTIPSNQELRSYMLKYGGRFENYFSRHRVTHIICSNLPDSKVKNLRAFSAGLPVVKPTWILDSVAANRLLSWVPYQLDQLANNQPKLSAFFTLKSSKMSEDAYTNDLCQVVSDIEDSSMRVGRSDSEDRHSSKVGDMSELSGQISTESDDTIPENTNAIMMEELTSVREHAGGSNAATKDERNVKGELEPAHQAPSTSFSTPCSDELNVKEYPNSSGTKPSKQCHSTLADPNFVENYFKSSRLHFIGTWRNRYRKRFPTLSTGFNNESANNSASDISHNSVIIHVDMDCFFVSVVIRNHPELLGQPVAVCHSNNSNGTAEISSANYPARSHGIRAGMFVRDAKALCPHLVIFPYNFEAYEEVADQFYSILHQRCKKVQAVSCDEAFLDATDSEVEDPELLASSIREEIYKTTGCTASAGIAGNMLMARIATRTAKPNGQYHITTEKVEDHLCQLPINALPGIGYVLQEKLKKQNVHTCGQLRMISKASLQKDYGMKTGEMLWIYSRGIDNRLVGGFQVNMNTITSHCTFENDRLCYALQQHDESKSVGADVNWGVRFKDIKDGCGVQGRTFTLKIKKRRKNADEPAKFMGCGDCENLSHSVTIPVATDNVEILQRIVKQLLGCFYIDVKEIRGIGLHVSRLESAEASKQGHDKQNRDSTCSRACRDLPGSSVEMDNKIPNNQASTNPISTPPPLCNLDVEVIRNLPPEVFSELNEIYGGKLIDYIANSKSTSENSSPSGNSFLEQAIKKEEELSYSKPVPQNNPLSKNKAKQNEAGTGEGEAVPYSVCGPYFKVTHHSSFEKDDLLPSSFSQVDGSVFQQLPEDLKAVIVEQLPAHRRAEICSNVVVAPPLENHSLSVGIEISENFPGSSYHDNLWAGNPPNWVGKFKVSSCLMLKKLAEMYYKSGLTSTLSLVLHQIISEFYELNLAQQFSDETVNIMCELLRQYIKVKIERDIEEIYICFRLLKRYSYSLLSLSPSAIYQSNKMGQKQAGHRQYFNRM

SEQ ID NO: 172630 - protein, 103 aa, Glycine max
  Coding DNA Sequence Number=SeqID_80945
MWYWRNKQEYESDSVQPFKPYIHILQHCTDYGNVGRVDLSTRQGDLVKELFVKWKAPFDGWVVINTTDGSVKNQEGGALHGLKMAYEKGFQAVELQMDSEAVV

SEQ ID NO: 172631 - protein, 555 aa, Glycine max
  Coding DNA Sequence Number=SeqID_80946
  Gene Ontology: Mol. function=protein kinase activity; Cellular component=nucleus; Biological process=protein amino acid phosphorylation
  Homolog annotation: Hit_ID=A7QEK5; Match level="QueryCoverage=99%, HitCoverage=93%, E-value=0.0, Identity=46%"; Hit description =Chromosome chr17 scaffold_85, whole genome shotgun sequence
  Pfam annotation: Domain name=PPR; Domain location=170-203; Score =10.2; E_value=0.48; Accession=PF01535.11; Description=PPR repeat
  Pfam annotation: Domain name=PPR; Domain location=270-304; Score =31.0; E_value=4.2e-06; Accession=PF01535.11; Description=PPR repeat
  Pfam annotation: Domain name=PPR; Domain location=374-408; Score =47.5; E_value=4.6e-11; Accession=PF01535.11; Description=PPR repeat
  Pfam annotation: Domain name=PPR; Domain location=409-443; Score =12.1; E_value=0.28; Accession=PF01535.11; Description=PPR repeat
  Pfam annotation: Domain name=PPR; Domain location=445-479; Score=6.2; E_value=1.4; Accession=PF01535.11; Description=PPR repeat
  Pfam annotation: Domain name=PPR; Domain location=66-100; Score=33.9; E_value=5.7e-07; Accession=PF01535.11; Description=PPR repeat
  Pfam module annotation: Pfam domain module=PPR::PPR::PPR::PPR::PPR::PP R; Domain location=170-203::270-304::374-408::409-443::445-479::66-100
MYSNLLRGYAQDSNLLCGRAIHAKLIIGSIPLTLFVQNHLLNMYVKIGDLHSGLKVFEEMPQRNVVSWSAVMAGCVQNGCASEALWLFSRMQQEGVTKPNEFTFVSALQACSLTETENVTLAYQIYSLVVRSGHMSNIFLLNAFLTALVRNGRLAEAFQVFQTSPGKDIVSWNTMIGGYLQFSCGQIPEFWCCMNREGMKPDNFTFATSLTGLAALSHLQMGTQVHAHLVKSGYGDDLCVGNSLADMYIKNHRLDEAFRAFDEMTNKDVCSWSQMAAGCLHCGEPRKALAVIAQMKKMGVKPNKFTLATALNACASLASLEEGKQFHGLRIKLEGDIDIDVCVDNALLDMYAKCGCMDSAWGLFRSMNCCRSVISWTTMIMACAQNGQSREALQIFDEMRETSVVPNHITYVCVLYACSQGGFVDEGWKYFSSMTKDCGIFPGEDHYACMVNILGRAGLIKEAKELILRMPFQPGALVWQTLLSACQLHGDVETGKLAAERAIRRDQKDPSTYLLLSNMFAEFSNWDGVVILRELMETRDVQKLPGSSWIEIEKI

SEQ ID NO: 172632 - protein, 253 aa, Glycine max
  Coding DNA Sequence Number=SeqID_80947
  Gene Ontology: Mol. function=nucleic acid binding; Cellular component= spindle; Biological process=response to DNA damage stimulus
  Homolog annotation: Hit_ID=A7P9I1; Match level="QueryCoverage=83%, HitCoverage=28%, E-value=1e-89, Identity=76%"; Hit description =Chromosome chr3 scaffold_8, whole genome shotgun sequence
  Pfam annotation: Domain name=Helicase_C; Domain location=9-88; Score =81.9; E_value=2.1e-21; Accession=PF00271.22; Description=Helicase conserved C-terminal domain
MTLDLFAQLCRERRYPHLRLDGSTSISKRQKLVNCFNDPSKDEFVFLLSSKAGGCGLNLIGGNRLVLFDPDWNPANDKQAAARVWRDGQKKRVYIYRFLSAGTIEEKVYQRQMSKEGLQKVIQQEQTDSLVAQGNLLSTENLRDLFTFHENIKSEIHENMQCSRCQTFDGPRSTEAQSTITDSESDEETSDIGGFAEIAGCLQNLKRSEKQAPGPVAYKGDKSPNNKVRMDTTRRGLDKSRVNTTTKGLLDKF

SEQ ID NO: 172633 - protein, 267 aa, Glycine max
  Coding DNA Sequence Number=SeqID_80948
  Gene Ontology: Mol. function=histone deacetylase activity; Cellular component=nucleus; Biological process=histone deacetylation
  Homolog annotation: Hit_ID=A7P8U9; Match level="QueryCoverage=53%, HitCoverage=39%, E-value=9e-70, Identity=73%"; Hit description =Chromosome chr3 scaffold_8, whole genome shotgun sequence
  Pfam annotation: Domain name=Hist_deacetyl; Domain location=2-242; Score=7.5; E_value=1.3e-10; Accession=PF00850.10; Description =Histone deacetylase family
MESGGNSLPSGSDGVKRKVSYFYDPEVLKPMAAKDRDLCKFHADDYVAFLRGITPETQQDQLRQLKRFNVGEDCPVFDGLYSFCQTYAGGSVGGALKLNHGVCDIAINWAGGLHHAKKCEASGFCYVNDIVLAILELLKIHEGWVITRGWINVLAKLPMSEPPDLGAQTMADVSLELEMGMKIGISPQFQNHNKHQTRQEEELKLFRDYTDWSGLIIMLQPMGPWIGAFGHWGEEATWEDVQVIHEQFPNFNLEDKVQQTRGDIVMT

SEQ ID NO: 172634 - protein, 466 aa, Glycine max
  Coding DNA Sequence Number=SeqID_80949
  Gene Ontology: Mol. function=metalloendopeptidase activity; Cellular component=mitochondrial matrix; Biological process=protein maturation via proteolysis
  Homolog annotation: Hit_ID=A7P9H4; Match level="QueryCoverage=100%, HitCoverage=39%, E-value=1e-134, Identity=57%"; Hit description =Chromosome chr3 scaffold_8, whole genome shotgun sequence
  Pfam annotation: Domain name=M16C_assoc; Domain location=1-130; Score= -82.6; E_value=4.9e-05; Accession=PF08367.2; Description=Peptidase M16C associated
  Pfam annotation: Domain name=Peptidase_M16_C; Domain location=205 -373; Score=16.0; E_value=0.00039; Accession=PF05193.12; Description =Peptidase M16 inactive domain
  Pfam module annotation: Pfam domain module=M16C_assoc::Peptidase_M16 _C; Domain location=1-130::205-373
MGTKDLTFVQLNQLIGRKTGGISVYPFTSSVRGKEDPCSHMVIRGKAMAGHIEDLYDLVNSVLQDVQFTDQQRFKQFVSQSRARMENRLRGSGHGIAAARMDAKLNAAGWMSEKMGGLRFPLCAKASCNFHTKGASSSIKDFKFQLEAHSLPPDVVGFGTPSVPPDLFSLNYNSWCLLLYFSIIRSSYLEFLRTLEERVDQDWADISSSLEEIRKSIFSKQGCLINVTADRKNLAKTEKVLSKFVDLLPTSSPIATTTWNVRLPLTNEAIVIPTQVNYIGKAANIYDTGYRLNGSAYVISKYISNTWLWDRVRVSGGAYGGFCDFDTHSGVFSFLSYRDPNLLKTLDVYDGTGDFLRELQIDDDTLTKAIIGTIGDVDAYQLPDAKVCCGTYWVSQRKKGKGDVKRYYLLGTSLPECVVLRQFEIFCKVTPPYCPCILLFTYVASPEDVDTANKDRPDFFQVKKAL

SEQ ID NO: 172635 - protein, 466 aa, Glycine max
  Coding DNA Sequence Number=SeqID_80950
  Gene Ontology: Mol. function=binding; Cellular component=nucleus; Biological process=mRNA modification
  Homolog annotation: Hit_ID=A7Q1I8; Match level="QueryCoverage=91%, HitCoverage=80%, E-value=1e-117, Identity=41%"; Hit description =Chromosome chr7 scaffold_44, whole genome shotgun sequence
  Pfam annotation: Domain name=PPR; Domain location=179-213; Score =41.2; E_value=3.6e-09; Accession=PF01535.11; Description=PPR repeat
  Pfam annotation: Domain name=PPR; Domain location=241-275; Score =27.4; E_value=5.2e-05; Accession=PF01535.11; Description=PPR repeat
  Pfam annotation: Domain name=PPR; Domain location=362-396; Score =33.2; E_value=9.4e-07; Accession=PF01535.11; Description=PPR repeat
  Pfam annotation: Domain name=PPR; Domain location=432-466; Score=2.1; E_value=4.3; Accession=PF01535.11; Description=PPR repeat
  Pfam annotation: Domain name=PPR; Domain location=87-121; Score=33.9; E_value=5.6e-07; Accession=PF01535.11; Description=PPR repeat
  Pfam module annotation: Pfam domain module=PPR::PPR::PPR::PPR::PPR; Domain location=179-213::241-275::362-396::432-466::87-121
MLRHHSSIFSRILKSSFRNGWHDESLLLHYLSNGWHDDARNLLQNSSGGDLHSHVVRWTSLLSNFSRHGFVAEARTLFDIMPYRNLVSYNAMLSAYLRSGMLDEASRFFDTMPKRNVVSWTVMLGGFSDAGRIEDRGSKMRRRCLMKCLREMSFHGTRWWWRLEEAMMVFEETPYKNVVSWNAMIAGYVERGRMDEARELFEKMEFRNVVTWTSMISGYCREGNLEGAYCLFRAMPEKNVVSWTAMIGGFAWNGFYEEALLLFLEMLRVSDAKPNDETFVSLVYACGGCEEVLLGCTLDLVLWTLHTMCLKAGQLERAQELFDMVPVRNKVASTCMIAGYLSAGQVLKAWNLFNDMPDRDSITWTEMIYGYVQNELIAEAFCLFAEMMAHGVSPMSSTYAVLFGAMGSVAYLDQGRQLHGMQLKTVYVYDLILENSLIAMYAKCGEIDDAYRIFSNMTTSLPHTFA

SEQ ID NO: 172636 - protein, 732 aa, Glycine max
  Coding DNA Sequence Number=SeqID_80951
  Gene Ontology: Mol. function=nuclease activity; Cellular component=ER to Golgi transport vesicle membrane; Biological process=nucleotide -excision repair
  Homolog annotation: Hit_ID=A7QPK8; Match level="QueryCoverage=98%, HitCoverage=99%, E-value=1e-166, Identity=45%"; Hit description =Chromosome chr18 scaffold_137, whole genome shotgun sequence
  Pfam annotation: Domain name=UVR; Domain location=229-264; Score =10.2; E_value=0.036; Accession=PF02151.10; Description=UvrBuvrC motif
MDLEGKKGEDMDSLFEGMVLFNPAEEKDNGSDDSLTISSCSQSQPLDENLFSDLTLVVDPLQNLEVAEAERDLQSRQGHAPARRRKRSGLRIGYGRDAFSSNDPPHTPSPLPQPISDSDSVGDADAVRVRDTDTDTDTETLPSITTATATATDDPVTVTLTQPSNESENQNRKHQQSSTESSSAEFRQLKSSIHDKLNHATQLVKSASSARKDSIRNRRKTVENANLASLKHMELEKQLEEACEAEDFERAEKVSDDLSAAEKEKQAFANSLREADAFVDALDLKLQHALDSQLAIEEQCAILLDHYATNALNNADFSMKKASSVYSKEMDQWLSSSEALEVKKMELEIESQFMNEARLELNNTIEHSIQNDKREKEILCKRKDVLMGELEQLLALVKQKEMEIADNDSNLEAVENKINKVVSGFKEMQSSIDVKYDKLQSVLAQVKLETETLVLKKEEIDNFLIREEEMGARLREFVRISTEEAEGYRKIVKLRRSLMSSILKSREDKLTLSKKEEKLSGDVKLFQQEVSAARASLQELSSRKSSIQQDIASFKQRIVFIDKRVPELEAEKKVATTARNFKEAARIATEAKSLCVEKESIQINMDMATLNLEKLEEEINDTLNKLQETEGMILLKEKELAMVRYQKLLLAAATARAEKAAAVEMGDVEEANLLLAEAEAADCDAEKLKSTYKFEAEDFTDLQRHLISMDLVSHLDQKQLEELAVSLRLFTG

SEQ ID NO: 172637 - protein, 112 aa, Glycine max
  Coding DNA Sequence Number=SeqID_80952
  Homolog annotation: Hit_ID=A5C0P0; Match level="QueryCoverage=91%, HitCoverage=9%, E-value=7e-09, Identity=32%"; Hit description =Putative uncharacterized protein
MGFEEMRFWEDCWLMEQEPLRAKYPRLYNISCQQQKLIQDMGCHSANVWEWKLEWRRHLFDNEVQAAASFLDDISRGHIDRWTSDCWVWKPEPNGQFSTRSAYRMLLEGPAA

SEQ ID NO: 172638 - protein, 66 aa, Glycine max
  Coding DNA Sequence Number=SeqID_80953
MSRRLLSRITMLVEITIATIGGYFGNWKKGMLRDEGVFDIYIGWLVSGGDWVGEDRERIRNLINGG

SEQ ID NO: 172639 - protein, 321 aa, Glycine max
  Coding DNA Sequence Number=SeqID_80954
  Homolog annotation: Hit_ID=A5BZ04; Match level="QueryCoverage=54%, HitCoverage=27%, E-value=9e-14, Identity=26%"; Hit description =Putative uncharacterized protein
  Pfam annotation: Domain name=FAR1; Domain location=78-139; Score=9.4; E_value=7.4e-06; Accession=PF03101.6; Description=FAR1 family
MGENDESGGEDGEHTDPLSSMDGVGEEGDLFGGGGSGNEEHGKIIINALIDIVDIVMKNLEADVVKRLDFGDLEAAYEFYYWYARINGEDRGLTSETRKREPKKETRCDCKAKFRVHVDLHCQWSITEFTDLHSHELLEDSLCSMLPAHRRMTVADILLIENFRKVGIRPPPILGAFANSSGGYDKIGCNDELLEELLADYDVPKFEELWMHMLNQFELQENKWMKELYEKKKMEIEADFDSDYGVVTLQSGLHSLERSASKVFTKTIFHMFRCMLIRAPTVMRLAEVAHRHDDDYNHIVDLLAAELKKLRVKHGNQSVAE

SEQ ID NO: 172640 - protein, 530 aa, Glycine max
  Coding DNA Sequence Number=SeqID_80955
  Homolog annotation: Hit_ID=A7PCF2; Match level="QueryCoverage=85%, HitCoverage=31%, E-value=0.0, Identity=75%"; Hit description =Chromosome chr2 scaffold_11, whole genome shotgun sequence
MLMVLMNIFAFLVLLIFFQIVQISYINEGVLQDGLVHINVRGARAEETQSHVHRMYFMGPNTFREPWHLPYSPPHAIIEIVYEDAFNRFIDEINSVAAYDWWEGSVHSILSVVAYPCAWSWKHWRRRVKISRLQEYVKSEYDHCCLRSCRSRALYKGMKVGATPDLMVAYIDFFLGGDEKRLDIVSIIQKRFPMCIIFGGDGSYMAPYNLHNDTLLTNLLGQHVPATVWNRLVAGLNAQLRTVRHGSIRTALGPVVDWINSHANPQLEFHGVKIELGWFQATASGYYQLGIVVAVGDYTLLDLHQSDTWVGTDELMRKNVAHGRKNVKQLQHSWPYISNSLSLKRITGGINGGLINDATLKSLDFRRDFLFPLSLLLCNTRPVGRQDTVQLLITLMLLADLSVTLLMLLQFYWIALAAFLSVLLILPLSLLSPFPAGLNALFSKEPRRASLSRVYSLWNATSLSNIGVAFICCLLHYALSHFHHPDETSTRDRMAGEMRLDNQKHQREVQRKQAGGILSWLIEIHVEELY

SEQ ID NO: 172641 - protein, 158 aa, Glycine max
  Coding DNA Sequence Number=SeqID_80956
MLWLRRTLHRHGTTSNDSFVDVVVTPFVEELAVGEAIGGNFERTQNWRLRQRIRLYKKGRGTPSSIQVCGFLMNESRGVGDEHRTRIAKMCICFIHGVAEVVGVEGHGYVDGGRGRGATVLAGGVLPKERELRGKMTDINNLTVLNNFNSRDLLGIKW

SEQ ID NO: 172642 - protein, 136 aa, Glycine max
  Coding DNA Sequence Number=SeqID_80957
MGIFKKLLGDQQIYWCPKQLRSLTHEINYFEKLSFKGDPLDYVISIPFLRMNALNKKAFPVVVHTQWKVFSITLRFLGGFSCNLGSMGILHSKLWAILHGVQLAREGGIFKLKIHSDKEEAILLTVDGCEEEHGCF

SEQ ID NO: 172643 - protein, 298 aa, Glycine max
  Coding DNA Sequence Number=SeqID_80958
  Gene Ontology: Mol. function=protein kinase CK2 regulator activity; Cellular component=protein kinase CK2 complex; Biological process =Wnt receptor signaling pathway
  Homolog annotation: Hit_ID=A9PJM8; Match level="QueryCoverage=89%, HitCoverage=91%, E-value=5e-83, Identity=56%"; Hit description =Putative uncharacterized protein
  Pfam annotation: Domain name=CK_II_beta; Domain location=125-278; Score=313.7; E_value=3.3e-91; Accession=PF01214.9; Description =Casein kinase II regulatory subunit
MVKTKNYWQGGVCLAFADEVMLAVWKVKEERGGVGSKSEVTSVDRKRINDVLDKQLERSSPSTSRAAAINGKDRSSSSLLAAAKDSRSASVTAPISKNSNASDEESETDSEESDVSGSDGDDTSWISWFCNLRGNEFFCEVDDDYIQDDFNLCGLSSQVPYYDYALDLILDVESSHGDMFTEEQNELIESAAEMLYGLIHARYILTSKGMAAMLDKYKNYDFGRCPRVYCSGQPCIPVGQSDIPRSSTVKIYCPSLFWNYISSSVLDDLWTTKATETITELCPESFWLQTSQALKLKF

SEQ ID NO: 172644 - protein, 584 aa, Glycine max
  Coding DNA Sequence Number=SeqID_80959
  Gene Ontology: Mol. function=endonuclease activity; Cellular component=nucleus; Biological process=response to DNA damage stimulus
  Homolog annotation: Hit_ID=A5BQG0; Match level="QueryCoverage=58%, HitCoverage=60%, E-value=3e-59, Identity=84%"; Hit description =Putative uncharacterized protein
MVQFHERIITELLEDTNGGLVVLSSGLSLSKLIPSLLILHFSSQGHAPSPLTVLHFPQIQNRLPPQNPKPPILPNSRRNHRRPPGAPPPRALHLRQSLLHHAADPNCRPPNQQVTYLQDRWHNHPQRTLALRDFHRSLHRSDFPVAQPRRVCPRVIRQAARDGVGIRKGEADDEVPARAEAVPVAAISGVRVAGAGEGPAGGGGYKGADEQTNKVDVEDSTVENGLFKSFDEIVRRQLDPIWHTLGKKTKQLVSDLKTLRKLLDYLVRYDAVTYLKYLDTLRVSESFRSVWLFAGASYQIFDYAKKRVFHLVKADGVKFNESSKSVKNKKRKTTGDDKDIEEGGTSGAYIYTSLLAILGNRDDLLSQYNLIGSPHFTFMSSNIIFSHRSSQIPWTIARNSASALDLATTLCFWLFQVTRFSPRKSASDIGDDVTPNSIISKLSLLALHFPRLRIIWSRSLHATAEIFASLKANQDEPDETKAIRVGVPSEEGIVENDVRAENYNTSAVEFLRRLPGSLAELALRPVEKLAELMGGHKAARTLRDFLDAKYPTLLYYQFIQVFCYFDSTSLDYDGNPLGTATRTQ

SEQ ID NO: 172645 - protein, 166 aa, Glycine max
  Coding DNA Sequence Number=SeqID_80960
  Homolog annotation: Hit_ID=A7R0E4; Match level="QueryCoverage=47%, HitCoverage=38%, E-value=2e-09, Identity=48%"; Hit description =Chromosome undetermined scaffold_306, whole genome shotgun sequence
MQQLLIWAVLAAFGGNNIGVAFKWHKTSSRLCNYKFHHDRSVEENLCLGLKLVWQRLSCERYTYNFTPWGTVIDYRLCFQTEFELSQSSLNKIPFLKSQALQNLKEERDAAARQTRQLQQELDMLKRRRNRRSDPGFSFTFAIFVGLLGALLGFLMKLLFSSPSTE

SEQ ID NO: 172646 - protein, 389 aa, Glycine max
  Coding DNA Sequence Number=SeqID_80961
  Homolog annotation: Hit_ID=A7R2N3; Match level="QueryCoverage=73%, HitCoverage=95%, E-value=2e-29, Identity=32%"; Hit description =Chromosome undetermined scaffold_437, whole genome shotgun sequence
MDSIPCLQGLNSQSQVPSSWSSLSCPSEPPDIGNWFSSYEYRSPGPDSNFSVEDSAFSEEETQRDGEEEEEENVRVQGEGVAGENVVQCIRTCVKEDNHSEDQCLNTPPDIRNWFSSYVYESPESDTSSLFRDEVSEENECGKERFDFEVVKEDESRFENVHSKGRVDHNSSSNKNTKGDDSAEMKTNSTTVDTSHLEKILQPCLQDKTLQQHNLGPTKYKEALGLNHKSPGCDPEGHLMSLDTDRSVMKPPKLLQKNDTGESKTKGEIQHDKKLDLSARVAKNFSARSSTCTSNKENDGFVTTRRNSYTGGNDESSCKKAEKIILAGAVPLACEKQGVTKRKALTEATNVKQYNVMGITGKWQCPQKRKPDVGPAMKQLRLDRWVRRV

SEQ ID NO: 172647 - protein, 181 aa, Glycine max
  Coding DNA Sequence Number=SeqID_80962
  Gene Ontology: Mol. function=transcription factor activity; Cellular component=nucleus; Biological process=regulation of transcription, DNA-dependent
  Homolog annotation: Hit_ID=A7PBV3; Match level="QueryCoverage=60%, HitCoverage=54%, E-value=6e-26, Identity=51%"; Hit description =Chromosome chr16 scaffold_10, whole genome shotgun sequence
  Pfam annotation: Domain name=AP2; Domain location=1-42; Score=37.0; E_ value=6.8e-08; Accession=PF00847.11; Description=AP2 domain
GKFAAEIRDPNKRGSRVWLGTFDTAIEAAKAYDRAAFRLRGSKAILNFPLEAGADDRKRQREEQEEEPAVEVVKRVKVEESDVSRIKETPLTPSSWLGFWGGDSNGIFTVPPLSPLSPHPALGFPQLMVVWNNIRNVKIARNACLKLKVVMAGSVIGKGEVQRSPKIATIMETESQKMRPK

SEQ ID NO: 172648 - protein, 459 aa, Glycine max
  Coding DNA Sequence Number=SeqID_80963
  Gene Ontology: Mol. function=peptidase activity; Cellular component =cytoplasm; Biological process=protein targeting
  Homolog annotation: Hit_ID=A5C9T2; Match level="QueryCoverage=86%, HitCoverage=92%, E-value=8e-97, Identity=47%"; Hit description =Putative uncharacterized protein
  Pfam annotation: Domain name=DUF862; Domain location=24-167; Score =241.9; E_value=1.4e-69; Accession=PF05903.5; Description=Eukaryotic protein of unknown function (DUF862)
MRWFPLSTTSNSERERNRENTTRASVYLNVYDLTPINNYLYMLGLGIFHSGIQVHDIEYGFGAHEYPSSGVFEVEPRSCPGFIFRRSVLLGSTDMSNSEFRYFIERLSAKYHGDTYHLIAKNCNHFTDEVCQHLTGSPIPGWVNRMARVVWFKLLGSFCNCLLPESLQVAAVRHLPERVAFDDDDGSGSDGLSASIESEEDEPNHHFLTSPNGDVAFLKEKPSQVMGAFIFLFLLCVFCFQSKVTYATRCGDAGPEIHYPYQIKGQQQQHKSLPGFELLCKDNLTTIHFPSYGDLVVKSISYDTKNIHLLDPKNCAHHVFLNLNLSLTPFHYFYVLKNYTYLNCSTTLPHPLVEVPCLSASSYHVYTVDPAVPVPGSCDGVKTVAIPFAYSPYLSDKSLGLRLTWHLREPLDNEAAVNRTRVIGSSICVFVMAMLLLISMKVRGATRNLHQKEGQLLQS

SEQ ID NO: 172649 - protein, 755 aa, Glycine max
  Coding DNA Sequence Number=SeqID_80964
  Gene Ontology: Mol. function=oxidoreductase activity, acting on the CH-CH group of donors; Cellular component=peroxisome; Biological process=fatty acid metabolic process
  Homolog annotation: Hit_ID=Q945U4; Match level="QueryCoverage=88%, HitCoverage=100%, E-value=0.0, Identity=94%"; Hit description=Acyl -CoA oxidase
  Pfam annotation: Domain name=ACOX; Domain location=567-749; Score =271.0; E_value=2.5e-78; Accession=PF01756.10; Description=Acyl-CoA oxidase
  Pfam annotation: Domain name=Acyl-CoA_dh_1; Domain location=365-530; Score=-27.3; E_value=0.048; Accession=PF00441.15; Description=Acyl -CoA dehydrogenase, C-terminal dom
  Pfam annotation: Domain name=Acyl-CoA_dh_M; Domain location=225-285; Score=68.4; E_value=2.5e-17; Accession=PF02770.10; Description=Acyl -CoA dehydrogenase, middle domain
  Pfam module annotation: Pfam domain module=ACOX::Acyl-CoA_dh_1::Acyl -CoA_dh_M; Domain location=567-749::365-530::225-285
MNVKGKVVRNESRVEDERRKRKEERNMKYEIFSSDSNVITFSSFGTLKTQLNHIKHPLFYSNCCYCNTTQSSFITETKATSCDIRKTLARMEDSIDHLAFERNKAQFDVDEMKIVWAGSRQDFELSDRISRLVASDPAFRKDDRTTLGRKELFKNTLRKAAYAWKRINELRLNEQEAYKLRSFVDQPAFTDLHWGMFVPAIQGQGTDEQQQKWLPLAYRMQIIGCYAQTELGHGSNVQGLETTATFDPKTDEFVIHNPTLTSSKWWPGGLGKISTHAVVYARLIIGGEDHGVHGFIVQLRSLDDHLPLSGITIGDIGMKFGNAAYNTMDNGVLRFDHVRIPRNQMLMRVSQVTREGKYVHSNVPRQLVYGTMVNVRQKIVADASVALSRAVCIATRYSAVRRQFGSHNGGLETQVIDYKTQQARLFPLLASAYAFRFVGEWLKWLYMDVTKRLQANDFSTLPEAHACTAGLKSLTTTATADGIEECRKLCGGHGYLCSSGLPELFAVYVPACTYEGDNIVLLLQVARYLMKTVSQLGSGNKPVGTTAYMARVEQLMQYHSDVKKAEDWLKPNVVLEAFEARAARMSVACAQNLSKFTNPEEGFQELAADLVDAAVAHCQLIVVSKFIEKLQQDIPGKGVKKQLEVLCSIYALFLLHKHLGDFLSTGCINPKQGSLASEQLRNLYSQVRPNAIALVDAFNYTDHYLGSILGRYDGNVYPKLYEEAWKDPLNDSVVPDGFKEYIQPMLKQQLRNARL

SEQ ID NO: 172650 - protein, 388 aa, Glycine max
  Coding DNA Sequence Number=SeqID_80965
  Homolog annotation: Hit_ID=A7R2D2; Match level="QueryCoverage=99%, HitCoverage=99%, E-value=1e-84, Identity=49%"; Hit description =Chromosome undetermined scaffold_419, whole genome shotgun sequence
  Pfam annotation: Domain name=DUF828; Domain location=37-244; Score =331.1; E_value=1.9e-96; Accession=PF05703.2; Description=Plant protein of unknown function (DUF828)
  Pfam annotation: Domain name=PH_2; Domain location=266-373; Score =172.2; E_value=1.3e-48; Accession=PF08458.1; Description=Plant pleckstrin homology-like region
  Pfam module annotation: Pfam domain module=DUF828::PH_2; Domain location=37-244::266-373
MEGGFFTPWKNEPWQELASEDVKESEQLISLPPLAEPPTPREPMEFLSRSWSLSASEISKALSEKQKQTFLDNKAPDTLPEPISAPQLAGGKMIVSGNCRRMGAIGKWLHQKQYGITNVSVKKKDRARVENARVHSALSIAGLASAVAAVAATEDPRGGSRSKLDVALASATQLLASYCVEIAEIVGADRQRVASTVRSAVDIQTPGDLMTLTAAAATGDAALTARMPKEAKKNASISPYDKVIAETQWLRAFDGQMLERYPPCLGDLLQLTEKGALRWRHVHVYIKKCQVKVKIKSKHVGGAFSKKNKCVVYGVCDKDNAWPYRKEREASEELYFGLKTAQGLLEFKCQNKLHKQKWVDGIEFLLRRVNSVEATEHSLEFLSISTST

SEQ ID NO: 172651 - protein, 561 aa, Glycine max
  Coding DNA Sequence Number=SeqID_80966
  Gene Ontology: Mol. function=nucleotide binding; Cellular component =Golgi apparatus; Biological process=regulation of transcription, DNA- dependent
  Homolog annotation: Hit_ID=A5CBH9; Match level="QueryCoverage=91%, HitCoverage=88%, E-value=0.0, Identity=70%"; Hit description =Putative uncharacterized protein
  Pfam annotation: Domain name=DUF246; Domain location=129-471; Score =770.7; E_value=9.5e-229; Accession=PF03138.5; Description=Plant protein family
  Subcellular localization annotation: CTP_CleavageSite=52; ConfidenceScore=5.33e-01
MGVEKLSLLSTTNLAVLAQANNKCSSRKHVCWRSSTTPFHLQRKPISWSVLCGFMLFGLGLISLLTGHMVSDLEWYSHRRSLYSTMDGSYRAPIDVWKSQYSKYYYGCSVRGRAYAPAVPEWMSNGYLLIGTSGGLNQQRTGITDAVVVARILNATLVVPELDHHSYWKDDSDFIHIFDVDWFISYLAKDVTIVKRVPDKFMRSMEKPPYTMRVPRKSEPDYYLDQVLPILLRRQVVQLTKFDYRLANNLDNELQKLRCRVNFHALRFTKPIQELGQIIVMRMQKMARRFIAVHLRFEPDMLAFSGCYFGGGEKERRELGEIRKRWTTLPDLSPDGERKRGKCPLTPHEVGLMLQALGFSKDTYLYVASGEVYGGEETMQPLRDLFPNIYTKEMLAEEELKPFLPFSSRLAAIDYIVCDESDVFVTNNNGNMAKILAGRRRYMGHKRTIRPNAKKLSTILAGRHQMDWDTFAKKVKSCQRGFMGEPDEMRPGRGEFHEFPSSCVCKRPYVDEELSKELIPPRMELEEAGHEVNLNHEVIGRGGIKSYLALLMPTERQLKIE

SEQ ID NO: 172652 - protein, 603 aa, Glycine max
  Coding DNA Sequence Number=SeqID_80967
  Gene Ontology: Mol. function=heat shock protein binding; Cellular component=integral to membrane; Biological process=chaperone cofactor-dependent protein folding
  Homolog annotation: Hit_ID=A7QY81; Match level="QueryCoverage=99%, HitCoverage=99%, E-value=0.0, Identity=57%"; Hit description =Chromosome chr2 scaffold_241, whole genome shotgun sequence
  Pfam annotation: Domain name=DnaJ; Domain location=12-77; Score =111.1; E_value=3.3e-30; Accession=PF00226.22; Description=DnaJ domain
MDEPNEAQDNRELYALLNLSPEASDEEIRRAYRQWAQAYHPDKYQAPHMKDIATENFQRICEAYEILSDPNKRQIYDIYGMEGLTSGLELGPKLNGAEEIKAELERLKRMKEREKMAAHFQPSGTIVANMSLPRYLDGNGMLRGFSSLFSRLIVYFITFMSIRMAMTSEIQSQLSKRNAVTIGGNLAVNGEEGGGAATAVFRHHLSEVSSVEVVASAGLRALIGVQTTRNLSSHSAATMGIALSLKDGSLNLSNLWTRQLSETASGHIELALGPHSSVTVGWQKKDQRRSASGEVKVLLRHQFIILIVFLLNLLAALWEELGESNCKGKKIRTKLELLQLGYLKQGHSSLEVEVGGGRKLSKFSSVRWLYIIGIQGISWKFELYRGGQKLIIPIYYVSGSFMFSIVKMLGRSMYIEILLTRHLNPVFATGAFVVPASLYFVLKKLFIKPYYLRRNKQKALEEKEKTSAQVKEARATAEKAQNLQQNVANRKRNKQLETGGLVIMRALYGNQRILNNLKSSSETSFELTSEVIDVTIPLNFLVNDSGQLKLHEGVKKSGIMGFCDPCPGSPKDLYVEYVYAGNQYRVWAGDYEELQIPQGSHRI

SEQ ID NO: 172653 - protein, 260 aa, Glycine max
  Coding DNA Sequence Number=SeqID_80968
  Gene Ontology: Mol. function=protein binding; Cellular component =cytoplasm; Biological process=steroid metabolic process
  Homolog annotation: Hit_ID=A7QVF7; Match level="QueryCoverage=84%, HitCoverage=58%, E-value=1e-101, Identity=79%"; Hit description =Chromosome chr2 scaffold_187, whole genome shotgun sequence
  Pfam annotation: Domain name=Oxysterol_BP; Domain location=5-259; Score=-112.9; E_value=0.0024; Accession=PF01237.9; Description =Oxysterol-binding protein
MEFDLSMYFSLASLNMCNSSACQYIRYSLTLCVKQVSHHPTLIACHCEGRGWKFWADSNIHSKFWGRSIQLDPVGVLTLEFSDGEIFQWSKVTTTIYNLILGKIYCDHHGSMDIRGNRTYSCRLKFKEQTILDRNPRQVHGFVEDVTGKRVATLFGKWDDNMYYMSGNINVKPKDFTSANASLLWKRTMPSPNLTRYNLTPFAITLNELTPGLKEKLPPTDSRLRPDQRHLENGEYEKANLEKQRLEKRQRMICIRIGNF

SEQ ID NO: 172654 - protein, 567 aa, Glycine max
  Coding DNA Sequence Number=SeqID_80969
  Gene Ontology: Mol. function=transporter activity; Cellular component= membrane; Biological process=oligopeptide transport
  Homolog annotation: Hit_ID=A7PC99; Match level="QueryCoverage=90%, HitCoverage=85%, E-value=0.0, Identity=77%"; Hit description =Chromosome chr2 scaffold_11, whole genome shotgun sequence
  Pfam annotation: Domain name=MFS_1; Domain location=8-469; Score= -9.2; E_value=0.038; Accession=PF07690.7; Description=Major Facilitator Superfamily
  Pfam annotation: Domain name=PTR2; Domain location=58-461; Score =300.3; E_value=3.6e-87; Accession=PF00854.12; Description=POT family
  Pfam module annotation: Pfam domain module=MFS_1::PTR2; Domain location=8-469::58-461
VPAEVTRSTTLRALHDMVETVVGQNNADAANNVSKWTGTVYIFSLVGAFLSDSYWGRYKTCAVFQGLMSLSLSSYLFLLKPKGCGNESVNCGKHSKLEMGMFYLSIYLVALGNGGYQPNIATFGADQFDEEHSKEGHNKVAFFSYFYLAFNIGQLFSNTILVYFEDEGMWALGFWLSAGSAFAALVLFLVCTPRYRHFKPSGNPLSRFSQVLVAASRKSKVQMSSNGEDLFNMDAKEASNNANRKILHTHGFKFLDRAAFISSRDLGDQKGLGYNPWRLCPVSQVEEVKCILRLLPIWLCTIIYSVVFTQMASLFVEQGAAMKTKVSNFRIPPASMSSFDILSVAVFIFFYRRVLDPFVGKLKKTDSKGLTELQRMGVGLVIAVLAMVSAGLVECYRLKYAKQGCIHCNDSSTLSIFWQIPQYAFIGASEVFMYVGQLEFFNAQTPDGLKSFGSALCMTSISLGNYVSSLLVSVVMKISTEDHMPGWIPGNLNKGHLDRFYFLLAALTSIDLIAYIACAKWYKSIQLEANTGEIDEPESPELTQELLSLMLGILVNKQSNQGPLMWG

SEQ ID NO: 172655 - protein, 85 aa, Glycine max
  Coding DNA Sequence Number=SeqID_80970
MKNGKGSNKRKRRTTMRGEDITVCTIFIERESSSSIWKESGCSLTRPQRTTLHTTESTKLAKHILFSYPLTKPGVVEKSFHSIRR

SEQ ID NO: 172656 - protein, 811 aa, Glycine max
  Coding DNA Sequence Number=SeqID_80971
  Gene Ontology: Mol. function=hydrolase activity, hydrolyzing O -glycosyl compounds; Cellular component=vacuole; Biological process =carbohydrate metabolic process
  Homolog annotation: Hit_ID=Q43857; Match level="QueryCoverage=79%, HitCoverage=97%, E-value=0.0, Identity=74%"; Hit description=Acid beta-fructofuranosidase precursor
  Pfam annotation: Domain name=Glyco_hydro_32C; Domain location=502 -616; Score=170.0; E_value=6.4e-48; Accession=PF08244.3; Description =Glycosyl hydrolases family 32 C termi
  Pfam annotation: Domain name=Glyco_hydro_32N; Domain location=146 -461; Score=660.6; E_value=1.2e-195; Accession=PF00251.11; Description=Glycosyl hydrolases family 32 N termi
  Pfam annotation: Domain name=Pentapeptide; Domain location=722-761; Score=31.9; E_value=2.4e-06; Accession=PF00805.13; Description =Pentapeptide repeats (8 copies)
  Pfam annotation: Domain name=Pentapeptide; Domain location=767-806; Score=33.4; E_value=8.1e-07; Accession=PF00805.13; Description =Pentapeptide repeats (8 copies)
  Pfam module annotation: Pfam domain module=Glyco_hydro_32C::Glyco _hydro_32N::Pentapeptide::Pentapeptide; Domain location=502-616::146 -461::722-761::767-806
MGSPNTRTSSSSDSELPCSNYIPVPDGPHSPAEPARREVIVIFCGLLVLVSLVAFNGYSWAHSNGHDGDHHHASSSLPTTLLTVTPNELELSPDTVPWSTWQTTLSRGVSAGVSEKSSWLFNSNNGNGESYPWNNSMLSWQRTAYHFQPEKNWMNGPMYYKGWYHFFYQYNPNGAVWGDIVWGHAVSRDMIHWFHLPLAMVADQWYDKNGVWTGSATILPDGQVIMLYTGSTNESMQVQNLAYPADPSDPLLVDWIKYPANPVLFPPPGIDAKDFRDPTTAWITSEGKWRISIGSKLNKTGIALVYDTNDFKTFERVEGVLHVVPGTGMWECVDFFPVSSKGENGLDTSINGENVKHVVKVSLDDDRHDYYALGTYDEKNVKFTPDDFNNDVGIGLRYDYGIFYASKTFYDQSKGRRVLWGWIGESDSEYADVAKGWASVQGIPRTVALDKKTGSNLIQWPVAEVESLRLRSDEFQNLKVKPGSVVPLEIGTAAQLDIVAEFEIDKKALEKTGQSNKEYKCSTSGGSTERGTIGPFGLLVLADDDLSEYTPTYFYVVKGSHGQLKTSFCSDQSRSSLATDVSKKIFGSFVPVLKDEKLSVRILVDHSIVESFAQGGRTCVTSRVYPTKAIYGAARLFLFNNATEATVTASVKSFPVVCQTNSNRDHRQGNVVSATLAAAIIAFSSDMSALADLNKFEAEMRGEFGIGSAAQKAVHVNENFRANFTAADMRESDFSGSTFNGAYLEKAVAYKANFPGVDLSDTLTDRMVLNEANLSNAILLRTVLTRSDLGGAIIEGADFSDAVLDLPQKHV

SEQ ID NO: 172657 - protein, 223 aa, Glycine max
  Coding DNA Sequence Number=SeqID_80972
  Gene Ontology: Mol. function=calcium ion binding; Cellular component =spindle pole; Biological process=amine metabolic process
  Homolog annotation: Hit_ID=Q84U32; Match level="QueryCoverage=65%, HitCoverage=100%, E-value=3e-71, Identity=88%"; Hit description =Putative serine/threonine kinase
  Pfam annotation: Domain name=efhand; Domain location=159-187; Score =25.3; E_value=0.00023; Accession=PF00036.23; Description=EF hand
  Pfam annotation: Domain name=efhand; Domain location=195-223; Score =20.4; E_value=0.0066; Accession=PF00036.23; Description=EF hand
  Pfam annotation: Domain name=efhand; Domain location=88-116; Score =30.4; E_value=6.6e-06; Accession=PF00036.23; Description=EF hand
  Pfam module annotation: Pfam domain module=efhand::efhand::efhand; Domain location=159-187::195-223::88-116
LFWQKIGMVSSGKYPTNEQVVVEINGVAMSFVRSGGCNPRIDDSYSPTFSAQAEIIDDEAVPILDGLTLYGPKKGKMGKDLSEEQVSSMKEAFSLFDTDGDGRIAPSELGILMRSLGGNPTQAQLKAIVAEENLTAPFDFPRFLDLMAKHIKPEPFDRQLRDAFKVLDKDSTGFVAVSELRHILTNIGEKLEPSEFDEWIREVDVGSDGKIRYEDFIARMVAK

SEQ ID NO: 172658 - protein, 76 aa, Glycine max
  Coding DNA Sequence Number=SeqID_80973
  Subcellular localization annotation: CTP_CleavageSite=32; ConfidenceScore=5.11e-01
MPLVLGNIGSGSTSQVRKWNMNSTRKTMIFVSQAQYKPIKSLVIHLKVVRKLQTLNHTLVSRGKHQPCEESKASQI

SEQ ID NO: 172659 - protein, 71 aa, Glycine max
  Coding DNA Sequence Number=SeqID_80974
  Subcellular localization annotation: CTP_CleavageSite=35; ConfidenceScore=5.29e-01
SRSAPQLALSAFRSRAGRAMHAGPVLLLDRALGVCTSVGSGAGRLAGLSARNGFRRAQRLQLVARLAPDAR

SEQ ID NO: 172660 - protein, 253 aa, Glycine max
  Coding DNA Sequence Number=SeqID_80975
  Homolog annotation: Hit_ID=A5C851; Match level="QueryCoverage=79%, HitCoverage=22%, E-value=3e-33, Identity=42%"; Hit description =Putative uncharacterized protein
  Subcellular localization annotation: CTP_CleavageSite=25; ConfidenceScore=5.33e-01
MSQRRSSPVVVARKNKPPHPSPSPRRRTKSKSRPIKILKRCSSAPLLSRRDNDDGDVDLDGDDHYSRTSGGGSFFRPKTFSDAFLSSPSPFSSPRIHTKQGYKYDKEAKVVVNVTVEGSPGPVQTMVKLGSSVEDTIKRVVDKYTEEGRSPQIDANMASSFQLHHSYFSLHSLDKSEVIADVGSRSFYLRKNNDASSTLTSSFHWGSAPELATHTSTPSIANPPLLIPSFIARRICKIVRRAHRLWKILVCSQ

SEQ ID NO: 172661 - protein, 182 aa, Glycine max
  Coding DNA Sequence Number=SeqID_80976
  Gene Ontology: Cellular component=membrane; Biological process =intracellular signaling cascade
  Homolog annotation: Hit_ID=A7QYS5; Match level="QueryCoverage=67%, HitCoverage=89%, E-value=2e-50, Identity=76%"; Hit description =Chromosome undetermined scaffold_254, whole genome shotgun sequence
  Pfam annotation: Domain name=Cornichon; Domain location=3-122; Score =114.2; E_value=3.8e-31; Accession=PF03311.5; Description=Cornichon protein
MADLFAWLISFFLLIALLVLVMYQLMCLADLEFDYINPYDSSARINMVVLPEYITQAVLCCFYLLTGHWIMALFCLPYLSLNLRLYRQGRHLVDVTEIFNLLSWEKKQRLVKLFYLVFTLFLSDDLHIIGLVTAVLACIMECCKLPDVCGREQLITCHIAILINVYFRGGEIQGRDCLLKED

SEQ ID NO: 172662 - protein, 186 aa, Glycine max
  Coding DNA Sequence Number=SeqID_80977
  Gene Ontology: Mol. function=oxidoreductase activity; Cellular component=extracellular region; Biological process=hydrogen peroxide catabolic process
  Homolog annotation: Hit_ID=A7PCE4; Match level="QueryCoverage=100%, HitCoverage=56%, E-value=2e-68, Identity=70%"; Hit description =Chromosome chr2 scaffold_11, whole genome shotgun sequence
  Pfam annotation: Domain name=peroxidase; Domain location=42-186; Score=158.6; E_value=1.7e-44; Accession=PF00141.14; Description =Peroxidase
MERMRLLFIFISILFNATTLSGVELLVHNYYKEKCPLAEDIVRHNVEVAVLKNPRLAASLLRLHFHDCFVMGCDASVLLDNVEGMTSEKLAGPNLNSLRGFEVIDKIKYLLEEECPITVSCADILAMAARDAVELRGGPRWEVLLGRKDALESSFSGANILIPAPNSSLEVLIDNFKQQGLDIEDL

SEQ ID NO: 172663 - protein, 460 aa, Glycine max
  Coding DNA Sequence Number=SeqID_80978
  Gene Ontology: Mol. function=bile acid:sodium symporter activity; Cellular component=membrane; Biological process=sodium ion transport
  Homolog annotation: Hit_ID=A7QK92; Match level="QueryCoverage=65%, HitCoverage=92%, E-value=1e-121, Identity=72%"; Hit description =Chromosome chr2 scaffold_112, whole genome shotgun sequence
  Pfam annotation: Domain name=SBF; Domain location=123-308; Score =167.8; E_value=2.9e-47; Accession=PF01758.7; Description=Sodium Bile acid symporter family
  Subcellular localization annotation: CTP_CleavageSite=57; ConfidenceScore=5.32e-01
MISSGLKLKHFRNVDSLFHFPKSKPPILLPCCPTISSPCSIRFNSHFPYRSTKVPLKCAPLPSSDSLPPDLSDAPTQTEQNSMSILEILKQSNSYLPHVLIASILLALIYPPSLTWFTSRYYAPALGFLMFAVGVNSNENDFLEAFKRPAEIVTGYFGQFAVKPLLGYLFCMIAVTVLSLPTTVGAGIVLVACVSGAQLSSYATFLTDPQMAPLSIVMTSLSTASAVFVTPLLLLLLIGKKLPIDVRGMVYSITQIVVVPIAAGLLLNRFYPRICNVIRPFLPPLSVLVASICAGAPLAFNVETMKSPLGVAILLLVVAFHLSSFIAGYILSGFVFRDSLDVKALQRTISFETGMQSSLLALALANKFFEDPKVAIPPAISKRKERHKTQLLKGMDIGIHITTNWSILYSSEHRFCLLGGTDGSRSDNAEVCYLQLSGFGDRQLSKEEILVERVAGNIKC

SEQ ID NO: 172664 - protein, 719 aa, Glycine max
  Coding DNA Sequence Number=SeqID_80979
  Gene Ontology: Mol. function=protein binding; Cellular component =cytoplasm; Biological process=hydrogen transport
  Homolog annotation: Hit_ID=A7QKD3; Match level="QueryCoverage=87%, HitCoverage=87%, E-value=1e-180, Identity=56%"; Hit description =Chromosome chr2 scaffold_112, whole genome shotgun sequence
  Pfam annotation: Domain name=DUF544; Domain location=12-139; Score =220.9; E_value=3e-63; Accession=PF04424.4; Description=Protein of unknown function (DUF544)
MKLNKELKGTHCNVLLLRNNLNLSPDIAEVSQEKLLSLVAERLIDSNSNVNNKDAGYVENQQQNIADAIDLLPRLATGIDVNIKFRRIGDFEFTRECAIFDLLDIPLYHGWIVDPQDYDTANAIGSKSYNSLMGELVSLETLNMEVHHKNNPEEDCVDFVAATTATLGVPSPSLSKARSFDDSSHSISDNILRKGDLEEEAELLRVLKMSEDESDPVVGHMHGGEISVSMDRKMCNDEVINMDCGDKLGNSSGAGNSNFHEHGPEPSLSDDCAASGKDHSEQISSTSTLGEAANSSLKTDTISDLHQSTYTGPEESFDLNDVIEKNSLDALVQNESEVIPSPEKHSVSLFECRADFSGGDGKVHDQSTPTTIDHEVVGESHGPDATGLSFSSPGHTNSDSSSVRYHQTDVSGALTSSVQGSEPIYEGEECVLDTRTGNFEDREPVYEGEVVLAEQADRSTLVAPDLRAKDELTPEQGELIKSFLRNNASQLTFYGLFCLQDGLKERELCVFFRNNHFSTMFKFEGELYLLATDQGYINQPDLVWEKLNEVNGDTLFMTGNFKEFKVENHESSTWDENNALTSTADYLASIDSATHAGLDINSDLQLAIALQQQEFEQQPPRQNNSQPQSSISGSSRLVTGPQVARNTGRHSSSSTSASPSTLSRELKLSRLRFTIAISPNLALGADASGVVEACVSQSHRHQVMFEFPTRFDGSFLEGC

SEQ ID NO: 172665 - protein, 176 aa, Glycine max
  Coding DNA Sequence Number=SeqID_80980
  Gene Ontology: Mol. function=phospholipase D activity; Cellular component=membrane; Biological process=phosphatidylcholine metabolic process
  Homolog annotation: Hit_ID=Q9AWB7; Match level="QueryCoverage=70%, HitCoverage=15%, E-value=3e-40, Identity=65%"; Hit description =Phospholipase PLDb1
  Pfam annotation: Domain name=C2; Domain location=29-127; Score=34.2; E_value=4.6e-07; Accession=PF00168.21; Description=C2 domain
MHVATTTNCSFTKLRLRTYQKETDTCDFLVLTLHMAHFWEEAHTMDMLNHLLGGKIKAHVSKAGTGDSYVTVSVAGAVIARTFVIRNSENPVWTQNFNVPVAHLASEVHFVVKHNYDVGSEIIGAVGIPVEQLCSGTRVEGFFPILNDTGKPCKDRSVLSLSIQYTPVEKVFIAME

SEQ ID NO: 172666 - protein, 278 aa, Glycine max
  Coding DNA Sequence Number=SeqID_80981
  Gene Ontology: Mol. function=sequence-specific DNA binding; Cellular component=integral to membrane; Biological process=electron transport
  Homolog annotation: Hit_ID=A7QKC6; Match level="QueryCoverage=90%, HitCoverage=77%, E-value=1e-121, Identity=82%"; Hit description =Chromosome chr2 scaffold_112, whole genome shotgun sequence
MANRRDPRGHTLDAVHKTYKVEEDAAVVDSKILQYCSIDKKEKKSVGEMEQEFLQALQAFYYEGKAIMSNEEFDNLKEELMWEGSTVVMLSSDEQKFLEASMAYVSGKPILSDKEFDELKLRLKMEGSEIVAEGPRCSLRSRKVYSDLSVDYLKMFLLNVPATVVALGLFFFLDDVTGFEISYLIKIPEPFSFILTWFAAIPFILWLAQSITRAIVQDFLILKGPCPNCGTENTSFFGTILSVSSGDSTNKVKCENCETKMVYDSKTRLITLPEGSNA

SEQ ID NO: 172667 - protein, 284 aa, Glycine max
  Coding DNA Sequence Number=SeqID_80982
  Gene Ontology: Mol. function=enzyme activator activity; Cellular component=anaphase-promoting complex; Biological process=ubiquitin -dependent protein catabolic process
  Homolog annotation: Hit_ID=Q4TU48; Match level="QueryCoverage=71%, HitCoverage=43%, E-value=1e-56, Identity=59%"; Hit description=Cell cycle switch protein CCS52A
  Subcellular localization annotation: CTP_CleavageSite=68; ConfidenceScore=5.34e-01
MDESFTPAPPPPPMSLSRHDHVQRMINSKRYKSPSKTIYSDRFIPSRSGSNFDLFNLPSPSSSEDSCSCSPYSTALRRALFGPDTPDKFESPNIFRYKTETRKSMYSLSPTPFTSQDDLLPGYDNNHKPPKRPRKIPPSSFKVLDAPALQDDFYLNLVDWSSNNILAVALENSVYLWNASSSKVTKLCDLGIDDSVCSVGWAPLGTYLSVGSNSGKVQSGWEAMGNSHEGGQLVDKHLVGQLSFVRELYWCTNAFMGSISLHLSVSNMYHTLCLCWALNFHDTY

SEQ ID NO: 172668 - protein, 249 aa, Glycine max
  Coding DNA Sequence Number=SeqID_80983
  Gene Ontology: Mol. function=phospholipase D activity; Cellular component=membrane; Biological process=phosphatidylcholine metabolic process
  Homolog annotation: Hit_ID=A7QKD5; Match level="QueryCoverage=80%, HitCoverage=25%, E-value=2e-67, Identity=61%"; Hit description =Chromosome chr2 scaffold_112, whole genome shotgun sequence
  Pfam annotation: Domain name=PLDc; Domain location=96-123; Score =36.0; E_value=1.4e-07; Accession=PF00614.13; Description =Phospholipase D. Active site motif
MNQKIEGDQRFNRKGKNNNFGRSATMATRTHFNTMQMMYDTIYKALQKAGLDNEYEPQDYLNFFCLGNREIPDNENVVNPTEENMPRALTKKNRRFMIYVHSKGMIVDDEYVLLGSANINQQSMEGTRDRDRAMRAYQPNHTWAKKQSKPRGQARFINLQVLSCDKILEGIVHGYRRSLSEFNWRQYAAEEVTEMKSHLLKYPLEVDSKGKVKPLFGCEAFPDVGGNISGTFTLSGLRKYRHLIIYVSS

SEQ ID NO: 172669 - protein, 1178 aa, Glycine max
  Coding DNA Sequence Number=SeqID_80984
  Gene Ontology: Mol. function=DNA-directed RNA polymerase activity; Cellular component=DNA-directed RNA polymerase II, core complex; Biological process=transcription
  Homolog annotation: Hit_ID=Q1L5X6; Match level="QueryCoverage=88%, HitCoverage=91%, E-value=0.0, Identity=53%"; Hit description=DNA -directed RNA polymerase
  Pfam annotation: Domain name=RNA_pol_Rpb1_2; Domain location=126-285; Score=113.6; E_value=6e-31; Accession=PF00623.11; Description=RNA polymerase Rpb1, domain 2
  Pfam annotation: Domain name=RNA_pol_Rpb1_3; Domain location=288-439; Score=98.3; E_value=2.4e-26; Accession=PF04983.9; Description=RNA polymerase Rpb1, domain 3
  Pfam annotation: Domain name=RNA_pol_Rpb1_4; Domain location=493-571; Score=8.6; E_value=0.0014; Accession=PF05000.8; Description=RNA polymerase Rpb1, domain 4
  Pfam annotation: Domain name=RNA_pol_Rpb1_5; Domain location=616 -1048; Score=-97.6; E_value=7.4e-05; Accession=PF04998.8; Description= RNA polymerase Rpb1, domain 5
  Pfam module annotation: Pfam domain module=RNA_pol_Rpb1_2::RNA_pol _Rpb1_3::RNA_pol_Rpb1_4::RNA_pol_Rpb1_5; Domain location=126-285::288- 439::493-571::616-1048
MAERLAYCHRQLMKGGLQWQQHRPQWHENISVLEINAAGQVTGSNLGLPNASDECATCGTKDKKFCEANELSSRVLDCLRISKARFSALNPDKTPNSIFADIQQRKIGENAFNSSGLRWIKDVVLGKRNDSSFRTVVVGDPDLELSEIGIPCHIAESLQVSEYVNRQNREKLLYCCELHLLEKGKINVCRKGSIVHLYKKEDLQIGDKFYRPLADGDKVLINRPPSIHQHSMISLTVRVLPISSVVCINPLCCSPLRGDFDGDCLHGYIPQSVTARIELNELVALDRQLINGQSGRNLLSLSQDSLTAAYLLMEDGVLLNVYQMQQLQMLSISNKRLIPPAVVKAPSSNSSLWNGKQLFSMLLPYDFDYSFPSDGVVVSDGELVSSSEASGWLRDSDYNVFQSLVEHYQGKTLNFLYAAQKVLCEWLSMTGFSVSLSDLYLSSDSYARENMIEEIFYGLQDAERACNFKQLLLDYYCDFLSGSLQESENAITVNADRLNYERQISASLSQASVDAFRQVFRNIQSLADKYACKGNSFLAMFKAGSKGNLLKLVQHSMCLGMQNSLVRLSYRLPRHLSCADWNSQKWVDSIQMSSGTLESVQSYIPYAVVESSFLTGLNPLECFVHSVTNRDSSFSDHADLPGTLTRRLMFFMRDLYDAYDGTVRNLYGNQLIQFSYDIEEDSSCNKGFQQYALGGESVGAISACAISEAAYSALGQPVSLLETSPLLNLKNVLECGSRKRNGDQTVSLFLSEKLGKQRHGFEYAALEVKNYLERLLFSNIVSKVMIIFTPHDSRSQEKYSPWVCHFHLDKEIVTRRKLKVHSIIDSLYQRYYSQRKDSKVCFTNLKISSRKCSADSMVKEGEDTSIDKEEGDDCIMVTIVENSKNPIQLDSVRDLVIPFLLGTAIQGFLDVKKVDILWNNQSKVTNSRNGFSGELYLRVTLSSEGSRGRFWGVLLKLCHKIMHIIDWTRSHTDNINHFSSAYGIDAGWQYFFNSLACATSDTGKSILPKHLCLVANSLSCSGEFVGLNAKGMALQRKHASVSSPFVQACFANPGSCFIKAAKSGATDNLQGSLDGLAWGNCLSMGTSGMFDVIYSEKGHQVAKSVDVYELLEASFDKPNNKIGTHLHKYSSDKCGSEFRHKNGYALKEGKQWKTILRNFVTVNDIQKLTFASRCILNK

SEQ ID NO: 172670 - protein, 322 aa, Glycine max
  Coding DNA Sequence Number=SeqID_80985
  Gene Ontology: Biological process=intracellular transport
  Homolog annotation: Hit_ID=Q60DL9; Match level="QueryCoverage=99%, HitCoverage=77%, E-value=4e-48, Identity=36%"; Hit description =RanBP1 domain containing protein
  Pfam annotation: Domain name=Ran_BP1; Domain location=186-321; Score=- 39.2; E_value=0.00077; Accession=PF00638.9; Description=RanBP1 domain
MEGSLFDVHRAEPSQQPIVAAPPLDMKRAESSQQHVRALNTQFASWVQTQLKNHPDELWEDGVRDYLDHASSIMVIPYMVADPISSSTITSVAVHAAEKFSDVVNWLKANATKAENSAADASAAFSGKKLLPEVIINENKSSGEKTGSTPVSTATNFTSSWSPGLFSNSQGIFGIENELEQPSSPSVKKSEEKGVVVVHEVKCKLYVKSSDPGDKDAWKDKGMGQLSIKCKEGVSKATKESKPTIVVRNEVGKVLLNALLYPGIKTNLQKNSLVAIFHTSGNADGSGGDNDSVVARTFLIRMKTEDDRNKLASTIKEYAPMS

SEQ ID NO: 172671 - protein, 146 aa, Glycine max
  Coding DNA Sequence Number=SeqID_80986
  Homolog annotation: Hit_ID=A7QML3; Match level="QueryCoverage=97%, HitCoverage=92%, E-value=2e-39, Identity=60%"; Hit description =Chromosome chr19 scaffold_126, whole genome shotgun sequence
MAWKWIVRRTRESKPFFLAFATICGVVPGVIGYGVMQLTNTRNEKLEASPGAAVKLCLGDLLVMGSNPETASLHMQGLFALIMYQMMGQVNKERLAEYLGELQRKEDTNDRYVAALRGETLTRKPYVRIQPIPEHIDTKANKEQKN

SEQ ID NO: 172672 - protein, 342 aa, Glycine max
  Coding DNA Sequence Number=SeqID_80987
  Gene Ontology: Mol. function=oxidoreductase activity; Cellular component=cytoplasmic vesicle membrane; Biological process=electron transport
  Homolog annotation: Hit_ID=A7QKI6; Match level="QueryCoverage=98%, HitCoverage=71%, E-value=1e-173, Identity=87%"; Hit description =Chromosome chr2 scaffold_112, whole genome shotgun sequence
  Pfam annotation: Domain name=p450; Domain location=1-342; Score= -37.8; E_value=2.7e-11; Accession=PF00067.13; Description=Cytochrome P450
MKRYGPIFKTNLVGRPVVVSTDPDLNHFIFQQEGQVFQSWYPDTFTEIFGRQNVGSLHGFMYKYLKNMVLNLFGPESLKKMLPELEQTTCRTLEQWSCENSVELKEATARMIFDLTAKKLISYDSTKSSENLRENFVAFIQGLISFPLDIPGTAYHKCLQGRKRAMKMLKNMLQERRRMQRKEQTDFFDYVVEELKKEGTILTEAIALDLMFVLLFASFETTSLALTYAIKLLSDNPVVLKRLQEEHEAILKQREDPNSGVTWKEYKSMTFTFQFINETVRLANIVPGIFRKALREINFKGYTIPAGWAVMVCPPAVHLNPAKYHDPLAFNPWRWEVRLRHV

SEQ ID NO: 172673 - protein, 255 aa, Glycine max
  Coding DNA Sequence Number=SeqID_80988
  Gene Ontology: Mol. function=metal ion binding; Cellular component =integral to membrane; Biological process=ubiquitin cycle
  Homolog annotation: Hit_ID=Q9LN71; Match level="QueryCoverage=53%, HitCoverage=34%, E-value=5e-22, Identity=44%"; Hit description=E3 ubiquitin-protein ligase At1g12760
  Subcellular localization annotation: CTP_CleavageSite=64; ConfidenceScore=5.38e-01
MATTRSSSEDIVDSTPLLANSGGSSDELTSGRGFSRRQRLRQAARFLRRASGRRMMREPSMLVREAAAEQLEERQSDWAYSKPVVVLDIVWNFAFVVVAGAVLVLSASEAPGMPLRLWIVGYAMQCVLHMVCVCVEYRRRRRQQRAAASSVQDRVGSSSGNLSVSSREGSASGSAQYVSLGQLDDEGTRLSYDVATVAFSYRKLVEFQELQGLGRSVWRFLLRAHSRDVTECISDFSLGFLRPRLPIGIGFGIQP

SEQ ID NO: 172674 - protein, 173 aa, Glycine max
  Coding DNA Sequence Number=SeqID_80989
  Gene Ontology: Mol. function=galacturonate binding; Cellular component=plasma membrane; Biological process=cell-cell signaling
  Homolog annotation: Hit_ID=Q8LC13; Match level="QueryCoverage=79%, HitCoverage=81%, E-value=5e-23, Identity=38%"; Hit description =Remorin
  Pfam annotation: Domain name=Remorin_C; Domain location=66-168; Score= 96.3; E_value=9.3e-26; Accession=PF03763.4; Description=Remorin, C -terminal region
MGEEVSSKTEPELHCVDSVPEEHNSSVQEKELEKPEPPNDKVTPPSPAAAQEVADHASKKDTEESLDKDAMLARVVTEKRAYKRLSAVGFWEDSKKASVEAQLKKIEENLEKKKAEYVEKMKNKVAKIHLLAEEKRAVVEAQKREEFIDLEETASKFRSRGDTPRRFFACFSG

SEQ ID NO: 172675 - protein, 473 aa, Glycine max
  Coding DNA Sequence Number=SeqID_80990
  Gene Ontology: Mol. function=L-isoleucine transmembrane transporter activity; Cellular component=integral to membrane; Biological process=amino acid transport
  Homolog annotation: Hit_ID=A7QJI3; Match level="QueryCoverage=83%, HitCoverage=75%, E-value=1e-143, Identity=61%"; Hit description =Chromosome chr8 scaffold_106, whole genome shotgun sequence
  Pfam annotation: Domain name=Aa_trans; Domain location=144-469; Score= 40.9; E_value=4.7e-09; Accession=PF01490.9; Description=Transmembrane amino acid transporter protein
  Pfam annotation: Domain name=Spore_permease; Domain location=145-468; Score=-177.7; E_value=0.1; Accession=PF03845.4; Description=Spore germination protein
  Pfam annotation: Domain name=Trp_Tyr_perm; Domain location=144-455; Score=-252.0; E_value=0.0045; Accession=PF03222.4; Description =Tryptophantyrosine permease family
  Pfam module annotation: Pfam domain module=Aa_trans::Spore _permease::Trp_Tyr_perm; Domain location=144-469::145-468::144-455
MASNTNTNNSNKKEKDLEFFFEEDINELGAQQMDAETAKLESESSSSDDEGNDTTRRHSFTSQQWPQSYKETTDSYTLAATPNFESILRVPSIIYSSFESRSKNNLDIDGKTPFLSGHEGITQSTSWKEGLVQKHLSGELPIGRECSFLQTVFNATNVMAGVGILSTPYTLKEAGWMSMVLMVLFAVICCYTATLMRYCFESREGITSYPDIGEAAFGKYGRIIVSIILYTELYSCCVEFITLEGDNLTGLFPGTSLDLGSFRLDSVHLFGILAALIIIPTVWLKDLRIISILSAGGVFATLLIVVCVFCVGTINGVGFHHTGQLVNWSGIPLAIGIHGFCFAGHSVFPNIYQSMADKRQFTKALIICFVLSITIYGGVAIMGFLMFGGETLSQITLNMPRDAFASKVALWTTVINPFTKYPFYHKLVFYECHQNEHDLIKFRNNFSLLFLNYTQICFVDEPIGEKSRRVATR

SEQ ID NO: 172676 - protein, 351 aa, Glycine max
  Coding DNA Sequence Number=SeqID_80991
  Gene Ontology: Mol. function=hydrolase activity, acting on acid anhydrides, catalyzing transmembrane movement of substances; Cellular component=integral to membrane; Biological process=copper ion transport
  Homolog annotation: Hit_ID=Q9SH30; Match level="QueryCoverage=92%, HitCoverage=32%, E-value=1e-103, Identity=47%"; Hit description =Putative copper-transporting ATPase 3
  Pfam annotation: Domain name=HMA; Domain location=120-184; Score =36.5; E_value=9.4e-08; Accession=PF00403.17; Description=Heavy-metal- associated domain
  Pfam annotation: Domain name=HMA; Domain location=42-106; Score=55.1; E_value=2.5e-13; Accession=PF00403.17; Description=Heavy-metal -associated domain
  Pfam module annotation: Pfam domain module=HMA::HMA; Domain location =120-184::42-106
MGKKFEGWECSLQCSGNLSPQAHYPMRRLEEEGRDSEGKKVVLSVMGMSCAACAGSIEKAIKRLPGIREAVVDVLNHKAQVLYYPQMLHEQRIREAIEDAGFEAKVMEEDSKDTSTQICRIHVRGMTCTSCSSTIESALQSLHGVHKARVALTTEEAEVCYDPKIVTHNHFMSAIEETGFEAVLISTGEHITKIELQIDGIKNEQSLNVIERSLHELPGVETIDIYPDINKISITYKPYMTGPRTFIEVIESTGSGCFKAIIFPNDGGREAQRQEEINRFFKLFIWSLAFTIPVFLTSMVLMYIPGVKRVLDIKVVNMLNIGLLLRCEFATPVQFIIGRRFYVGAYKALRK

SEQ ID NO: 172677 - protein, 1475 aa, Glycine max
  Coding DNA Sequence Number=SeqID_80992
  Gene Ontology: Mol. function=metal ion binding; Cellular component =intracellular; Biological process=regulation of transcription, DNA -dependent
  Homolog annotation: Hit_ID=A2YH92; Match level="QueryCoverage=95%, HitCoverage=78%, E-value=0.0, Identity=38%"; Hit description =Putative uncharacterized protein
  Pfam annotation: Domain name=ARID; Domain location=92-201; Score =16.8; E_value=3.5e-06; Accession=PF00403.17; Description=ARIDBRIGHT DNA binding domain
  Pfam annotation: Domain name=JmjC; Domain location=414-550; Score =183.6; E_value=5.2e-52; Accession=PF02373.13; Description=JmjC domain
  Pfam annotation: Domain name=JmjN; Domain location=29-73; Score=91.3; E_value=3e-24; Accession=PF02375.8; Description=jmjN domain
  Pfam annotation: Domain name=PHD; Domain location=243-291; Score =52.9; E_value=1.1e-12; Accession=PF00628.20; Description=PHD-finger
  Pfam annotation: Domain name=PLU-1; Domain location=931-1250; Score= -39.1; E_value=1.2e-06; Accession=PF08429.2; Description=PLU-1-like protein
  Pfam annotation: Domain name=zf-C5HC2; Domain location=685-732; Score= 14.0; E_value=0.0023; Accession=PF02928.7; Description=C5HC2 zinc finger
  Pfam module annotation: Pfam domain module=ARID::JmjC::JmjN::PHD::PLU- 1::zf-C5HC2; Domain location=92-201::414-550::29-73::243-291::931 -1250::685-732
MGKGKPRSVEKGVVGPSLSVTSSTIPLGPVYYPTEDEFKDPLEYIFKIRPEAEPFGICKIVPPKSWKPPFALDLDSFTFPTKTQAIHKLQSRPAACDSKTFDLDYSRFLRDHSGKKSRKRVVFEGEELDLCKLFNAVKRFGGYDKVVDGKKWGDVARFVRPSGKISDCAKHVLCQLYREHLYDYENFYNRMNQGMAQRCKKGVHDDHKIDHGVQPVVSKKNHKSVDGSKHKDSKVQKEEHDQICEQCKSGLHGELMLLCDRCDKGWHTYCLSPPLEHIPPGNWYCFNCLNSDRDSFGFVPGKHYTLEAFRRIADRSRRRWFGSGPVSRVQIEKKFWEIVEGLVGEVEVMYGNDLDTSVYGSGFPRVTDQKPKSIDDKLWEEYTTNPWNLNNLPKLKGSMLRAVHHNITGVMVPWLYIGMLFSSFCWHFEDHCFYSMNYLHWGEAKCWYSVPGSQASAFEKVMKNSLPDLFDAQPDLLFQLVTMLNPSVLQENGVPVYSILQVSFSLLIFVFDVLLLIDICQEPGNFVITFPRSYHGGFNLGLNCAEAVNFAPADWLPHGAFGADLYQQYHKTAVLSHEELLCVVAQYGDVDGRVSSYLKKELWRISDKEKSWREKLWKNGIIKSSRMGPRKCPQYVGTEEVGFFSTYGSSMHYMPAISLSLCCFAINNSSSTIASMSKPKKNVNVSENQPVPGKEDMGCLFMSYHWEHLCECKTVKLRLLYRHSLAELYDLAFSMDKYTSEDKAECSSVKRKPSCLSALTKKVKGGSITFAQLATEWLLQSSAILQNVFLHDAFVTALRKAEQFLWAGSEMDSVRDMVKNLIEAQKWAEGIRDCITKIELWLCHRDSNVKKVHLEFIDELLKFTPAPCNEPLYHKLKDYAEEARLLIQDIDTALSMSSNMSELELLYSKACGLPIYMKESKKLEGKISSTKAWLDNVRKCISARQPAALHIDALYKLKAEVFVDLQVQLPEIDMLLNLLSQVESCSAQCHDMLEGHMNLKNVGLLLKEWGSFAVDVPELKLLRQYHSDAVSWVSHFNDILGRVQMQENQHNAVDGLKSIFEEGLSLKIQVDELPLVEVELKKANCREKAVKAHDLKMPLEFIQQLLKESTVLHIEGEKQFVNLTGVLAVAIPWEERAREMLSHEAPISDFEDMIRASENIFVILPSLNDIKDALSEANSWLRNSKPYLVSSMCASNSVRKVEDLEMLVSQSKHLKVSLEERGTLELVLKNCRIWEYEACSVLDDARCLLDNSLPEINSGLTCKVEDLIERIQSAIASGVSLGFDFNEISKLQASCSTLQWCKRALSFCNCSPSLEDVLEVAEGLSHSSVSGALLKVLIDGFEWLKKALEGISGPHNCRRCKLTDIQDILTDYQTINMTFTAVKCQLEDAIGKHKLWQEQVQHFFGLSPRERSLSSILQLKYPGVSKLIRSSVAMIMIEKVKAFTIVVKPLPRPEVVKCLNALTHSAGLYLYSLRE

SEQ ID NO: 172678 - protein, 533 aa, Glycine max
  Coding DNA Sequence Number=SeqID_80993
  Gene Ontology: Mol. function=DNA binding; Cellular component=nucleus; Biological process=transcription
  Homolog annotation: Hit_ID=A7QIW8; Match level="QueryCoverage=99%, HitCoverage=88%, E-value=1e-163, Identity=54%"; Hit description =Chromosome chr2 scaffold_105, whole genome shotgun sequence
  Pfam annotation: Domain name=BAH; Domain location=87-206; Score=84.0; E_value=4.8e-22; Accession=PF01426.9; Description=BAH domain
  Pfam annotation: Domain name=TFIIS_M; Domain location=359-470; Score=- 9.7; E_value=0.0035; Accession=PF07500.5; Description=Transcription factor S-II (TFIIS), cen
  Pfam module annotation: Pfam domain module=BAH::TFIIS_M; Domain location=87-206::359-470
MVNRRRLTRVATSDDEDEAPRPQRTRKRMRLIEEDNDDDENEEEKQQEVPELPQPAEDAKPLGEPVRVSGKGRGRKRHYDSFEFDGIQYILEDPVLLVPEEKGQKPYVAIIKDITQSISGNVKVTGQWFYRPEEAEKKGGGNWQSCDTRELFYSFHRDDVPAEAVMHKCVVHFVPRHKQLPKRKDHPGFIVQKVYDTVERKLWRLSDKDYEDIKQQEIDVLVEKTLQRIGELLDLEPEEAPDDDEDQLKNRKSLRRKSVSPLDVSKEEEETLKSEQHPKSETPAGCITNPSEYYRILVEFNALTGDSHRDKWLERLLQRIHYMCDSNDSKERDKGLGNVNSDEINGGSKHRSSESANVCQDKVQKSSKSFIWPDAGVSAMVALEKASHDALSSDSMKYNQKLRQLAFNFQKNAVLARRLLSGELEPSKILNMTPNELKESSLLTKGIGVEGLVAEEKTKEEPDKIQHLQMTDARCSKCMDCKVALREIIQAGNNERYQLECVSCGHSWYASRDEVSMLTIDASDSKGNIGTAL

SEQ ID NO: 172679 - protein, 167 aa, Glycine max
  Coding DNA Sequence Number=SeqID_80994
  Gene Ontology: Mol. function=aspartic-type endopeptidase activity; Cellular component=integral to membrane; Biological process =cytochrome complex assembly
  Homolog annotation: Hit_ID=A7QIX9; Match level="QueryCoverage=52%, HitCoverage=16%, E-value=1e-37, Identity=79%"; Hit description =Chromosome chr2 scaffold_105, whole genome shotgun sequence
  Pfam annotation: Domain name=Peptidase_A22B; Domain location=6-148; Score=-72.4; E_value=1.1e-06; Accession=PF04258.4; Description =Signal peptide peptidase
MGWLQHHRFWRHPFTRNAGGILTQVLFPPSFLPLIPCMTYVNPKLDLNDKVQILWIGMLLQPVYQEFCFHNYNQRRYDWLANKSLRSGYFLWAMFAYGFGLLVTYVALNLMDGHGQPALLYIVPFTLGTLMTLGRKRGDLRVLWTSGEPERPCPHIRLLHSGELNCE

SEQ ID NO: 172680 - protein, 93 aa, Glycine max
  Coding DNA Sequence Number=SeqID_80995
MKLAKYRLKAQVEKDEGPSGEGQSPQVEKDEEFLSGFLVEPIIRLIKVILVASTQTYLPSLEVASNLTYLPSSEVASILTYLPSPEVASSKPS

SEQ ID NO: 172681 - protein, 176 aa, Glycine max
  Coding DNA Sequence Number=SeqID_80996
  Homolog annotation: Hit_ID=A9PCV7; Match level="QueryCoverage=100%, HitCoverage=82%, E-value=2e-81, Identity=67%"; Hit description =Putative uncharacterized protein
  Pfam annotation: Domain name=PLAC8; Domain location=20-140; Score =19.2; E_value=0.00034; Accession=PF04749.8; Description=PLAC8 family
MASQQHIEKMQLRQNFRNLWHSDLLSTIQADTPYCCFSLWCAPCVSYLLRKRALYDDMSRYTCCAGYMPCSGRCGESKCPELCLGAEAFMFVLQQLACIFSIIALIVGNSEIRQASQLLSCLADFVYCTVCACMQTQHKIEMDKRDGKFGPQSVMGVPPVQQMSRFDQAVPPFVGY

SEQ ID NO: 172682 - protein, 135 aa, Glycine max
  Coding DNA Sequence Number=SeqID_80997
MSWRHQTAMSEEISNRDFGGGDAWWLVAKRNATFLHIVEKESRILSPSSQLSLIIILFPNGQEVILMSSPVFLASEVTSPHQSFSTSNLTLLAILKHALNAYAEIRLSDGPLQQASVYYWLMDLICVYMLLSTLK

SEQ ID NO: 172683 - protein, 450 aa, Glycine max
  Coding DNA Sequence Number=SeqID_80998
MKERKTGINTVRKRVGWWLGEPSILRIFARRDKVKEIIIAPRWNKSGMRYGFVKFIEVEDSKRLERQVDNIFIGSLKLYVNLPRFQRSRGFEEQREVQGQRNHYEEGASQRNKSTQGYEYRYPYSYAQIVSKKGPGGVRWIKIQGKERDDGRSSQDLKVHDINLVQNIHELFITKGFQSVKLRHMGDNFMLLTPLDGLEMKEIVKGPEDWLKEVVEEIKAQDVCHSCCGVTRFMENGNGSYIRSLDLEFTSSVSKCSSDAGRWLDADKVVRDVVPVSAMRESNLQHVGGVVDTVSHQTGCEGTKGDQHSGKGNDDHDIYRVMENGVVHLNLVDTQHQQVEDTVHHENPKGIDDMSKVLLPNIEPCMVNESVEKGTPLKARDGASMVVKYCENYGTRGGVRLCDREIELFNLRNNCARQVIEATFEANVVGVTNMEKDVDMQGKSNLAAWR

SEQ ID NO: 172684 - protein, 125 aa, Glycine max
  Coding DNA Sequence Number=SeqID_80999
  Gene Ontology: Biological process=transposition, DNA-mediated
  Homolog annotation: Hit_ID=Q1J7G7; Match level="QueryCoverage=35%, HitCoverage=64%, E-value=1e-11, Identity=73%"; Hit description =Transposase
GTSYVPINVSFSPKVGPGLPGINRDTRIYLFCEVIFRHQWLLFLSAVPPVQLLTGWCVTAKAPPDISAGKARPIRHSGCATVGKGDRCGPLRYYASWGGGGPGGRPGFGRGSGGYGAPTSSNIPS

SEQ ID NO: 172685 - protein, 149 aa, Glycine max
  Coding DNA Sequence Number=SeqID_81000
  Gene Ontology: Mol. function=zinc ion binding
  Homolog annotation: Hit_ID=O04238; Match level="QueryCoverage=94%, HitCoverage=17%, E-value=3e-48, Identity=67%"; Hit description =Transcription factor
MNNSLPALTSDTSPSVVNLFRINKVADRLSWIAQPGNRGEPYEFYNLCLSLSRGIDYALANGETPPKAHELPLLVKQICQLKNDECSQAAMMVLMISIKNACEIGWFQTKESEELVTIADEIRKVYSSLGTINVGPRSCSTAISTIMQK

SEQ ID NO: 172686 - protein, 674 aa, Glycine max
  Coding DNA Sequence Number=SeqID_81001
  Gene Ontology: Mol. function=zinc ion binding
  Homolog annotation: Hit_ID=O04238; Match level="QueryCoverage=97%, HitCoverage=74%, E-value=1e-156, Identity=50%"; Hit description =Transcription factor
  Pfam annotation: Domain name=zf-MIZ; Domain location=113-155; Score =23.3; E_value=1.1e-06; Accession=PF02891.11; Description=MIZ zinc finger
  Subcellular localization annotation: CTP_CleavageSite=51; ConfidenceScore=5.03e-01
MFLLVAQTDNIETSACLINPQQVNFLLNGKGVLNRTNVQMDPGPQVPTNVTGMLKFGTNLLQAVGQFNGRYVVLVAYMSFTPFLEDPVLQDYLQPAVTSVDSDSDIIEGASQISLNCPISFTRIKTPVKGHSCKHFQVTIPALASLNVQQIVTATYAVLSLVLKNVGENITEVIVLANGSWKAVLEKDHDVDKMQKKARNCEKEQTQPQESTCPPGTVDLTKDDDGLDTVGSCDIVERKPTPASIHSQFVTPNSTSLGMNSTGVNQNVATQIDDFWPGVCFVRSRSDTPTVGNSELPVLPDTVSPTFSQESAGHDNNPVVNSAMHNQFLGPNNLQMQMNHMNSVNEYGRSSSAPRHIHRTPVAVQALPVQSQALGPQQNSITNLNSSLLPSNSSATPHISLSNPTSVDTLNAILSDTERQQHFSRTPMNLPQVSGVNSPAFQHHTATQNRGPLINTSAPTQPQNQYRANAFSEFRNLHLQQALNLRPPPPRSSNAQWPRIQQGVPQSGNFQAAARGASVAAGQGSSHARNVPTSGATTHSHQARGMVANQPARPSVLVQNQSTVAGTPFHGLTTEQRGNTAQSVSRPEELFSSQSEQNWAPTGRMRGSLDLSQLNDESIAQRIITPTQGQNSRPPGPQPIRRTGISSLQPATTQQDVLIANNRNANAHNRSSSR

SEQ ID NO: 172687 - protein, 666 aa, Glycine max
  Coding DNA Sequence Number=SeqID_81002
  Homolog annotation: Hit_ID=A7QNE4; Match level="QueryCoverage=99%, HitCoverage=99%, E-value=1e-173, Identity=52%"; Hit description =Chromosome chr2 scaffold_132, whole genome shotgun sequence
MKSEEGEAEKVEKLGEKLRRGVLVGKSRGPCTPTHTHNYHSSSVLSVSARKLAAALWEFNHSFPLFQMHHHRSANNASAAAAGGAGADPRLRRHHHYILHKDRAPDISNFLADASPSSPDQPASASSLRRHVAASLMQHHRAIERNNHALQPLSPASYGSSMEMTPYNPGATPTSSLEFKGRIGDPHYSLKTSTELLKVLNRIWSLEEQHASNISLIKALKSELDHARVRIKELLRDRQADRHEIDDLMKQIAEDKLVRKSKEQDRLHAAVQSVRDELEDERKLRKRSESIHRKLARDLSEVKSSLTSAVKELNQERTRRKLLEDLCDEFARGINEYEREVHTVKHKSDKDWVQGADQDRLILHISESWLDERMQMQLEAGQNGFTDKSIVDKLSLEIETFLKAKQNSRGSENVAVRNRRNSLESVPLNDRVSAPQEVGDDDDSVGSDSNCFELNKPSNKGSKVYEEEPVDKIFKETSKTNQRKKKSIPREGLKHRSPSSLQVKFEEQMAWAMSSDSNKKSQSIDADQGKITDTRPVEGTVSERSEHFEIYENDDSERKNNPAELHNSSKNHIIDNLIRGQLLASEGGNMHAENNYGEASCSNAGWRNQASPVKQWMAKLASQDLDISEASKVPSGSKESNTLKAKLLEARSKGQRSCLKALKGSF

SEQ ID NO: 172688 - protein, 298 aa, Glycine max
  Coding DNA Sequence Number=SeqID_81003
  Gene Ontology: Mol. function=transcription factor activity; Cellular component=cytoplasm; Biological process=regulation of transcription, DNA-dependent
  Homolog annotation: Hit_ID=A7QNB6; Match level="QueryCoverage=98%, HitCoverage=99%, E-value=5e-58, Identity=47%"; Hit description =Chromosome chr2 scaffold_132, whole genome shotgun sequence
  Pfam annotation: Domain name=AP2; Domain location=105-156; Score =84.8; E_value=2.9e-22; Accession=PF00847.11; Description=AP2 domain
MTAPPSKYTHHSKLLIPSEEDPPKHPYPRLVRITVTDTEATDSSSDEEQHTSTRHRHRKFVNEISIESSCASENDGAASRKRIRRRSTATPKGRASDTRLVSNGKKFRGVRQRPWGKWAAEIRDPSRRVRLWLGTYDTAEEAALVYDNAAIRLRGPHALTNFITPPATCHNTDPPPVANGYGYASGEETNDNNNNLFSPTSVLHSCSLSEEAESVRGKDDEYSSVSMSRVKAESPFPVPSEIEFDFRGISPVPESVLFYDDDWSSEFLTACEDFGFNRNRDFFQDIDDLFVSDPLLAL

SEQ ID NO: 172689 - protein, 1174 aa, Glycine max
  Coding DNA Sequence Number=SeqID_81004
  Gene Ontology: Mol. function=protein kinase activity; Cellular component=cytoplasm; Biological process=protein amino acid phosphorylation
  Homolog annotation: Hit_ID=A7QNB2; Match level="QueryCoverage=96%, HitCoverage=96%, E-value=0.0, Identity=52%"; Hit description =Chromosome chr2 scaffold_132, whole genome shotgun sequence
  Pfam annotation: Domain name=WD40; Domain location=1021-1058; Score =35.2; E_value=2.4e-07; Accession=PF00400.23; Description=WD domain, G-beta repeat
  Pfam annotation: Domain name=WD40; Domain location=1070-1108; Score =4.4; E_value=9.1; Accession=PF00400.23; Description=WD domain, G -beta repeat
  Pfam annotation: Domain name=WD40; Domain location=843-881; Score =11.4; E_value=1.3; Accession=PF00400.23; Description=WD domain, G -beta repeat
  Pfam annotation: Domain name=WD40; Domain location=892-931; Score =18.7; E_value=0.022; Accession=PF00400.23; Description=WD domain, G -beta repeat
  Pfam annotation: Domain name=WD40; Domain location=935-974; Score =35.2; E_value=2.3e-07; Accession=PF00400.23; Description=WD domain, G-beta repeat
  Pfam annotation: Domain name=WD40; Domain location=978-1016; Score =16.9; E_value=0.076; Accession=PF00400.23; Description=WD domain, G -beta repeat
  Pfam module annotation: Pfam domain module=WD40::WD40::WD40::WD40::WD4 0::WD40; Domain location=1021-1058::1070-1108::843-881::892-931::935 -974::978-1016
MDEDFVDEATQLEVAEESQRQNKDSPHPECRKILKSLEAFIPVKQDYSQIPPREYDGILHGKNVVEGIDHADTSQHPHVSLFMDDADVMVEELTVKSYNGSSLDIGTSNNREQIYNRQNHWQNLYQLASNSGIGNSLSDIGTRNSVPATSSAREDIGSSSFPEMLARKSLSDGQSNVMEHLASAENKEGAGDVRQGTRKKIISQSGFAEFFIKNTLRGKGIVYKGPSSDGFCVQSREQNWMKIGIDADQNRMKTGIGADQNRLKTVIDADQNQLKTGIDADQNRLKTGIDADQNQMKASIGTDQNQMKNHSGTDQKQMKTGIVTHLNSNQSVGYGSKTAKFPSYCGAMPRSGRSDCVGVTLREWLKHGHHKASKVESLNIFRKIVDLVDICHSQGVALHNLCPSYIKLSPSNQIMYLGLPVQKQMVDSVVNSEVVHLDNSFIRKRLSEQVTFPSLDMGSKKKKFNENVRVTGGDLCLETASDRKLHSHTVGSQDYYNEYEEGTQFSKYNIGRMSSIPRVSNAGQMPLTSCEKFENKWYTSPEGGYTTSSNIYCLGVLLFELLGHFDSERTHIAAMSDLRHRILPPIFLSENPKEAGFCLWLLHPEPSSRPSTRVKGNKWANLLISLVTGNTFGKFIPGGRGTCIEKVQGWEILQSELINGLQELFSEELSSSIDQEDAESELLLHFLVLLKEQKQNNAFKLVEEIKCLESDIEEVERRHDSRKSLVSSGLQNDYSCQKEIMPLKKESLSLEMLPSISPISNSNKVRLMRSICHLEGAYFSTRSKLQLSETDASTHPDKDILRNRENQNVAQKSEEQPKKDTLGVFFDGLCKYARYCKFEVRGVLRNVDFNNPANVICSLSFDRDADYFASAGISRKIKIFEFSALCNDSVDIHYPAVEMSNRSKLSCVCWNNYIKNYLASTDYDGIVKLWDASTGQEFSQFTEHEKRAWSVDFSAVCPTKFASGSDDCTVKLWSISERNCLGTIRNAANVCCVQFSAHSSHLLAFGSADYSTYCYDLRNLRSPWCVLAGHRKAVSYVKFLDSETLVSASTDNTLKIWDLNKTSPVGASINACSLTLSGHTNEKNFVGLSVADGYIACGSETNEVYTYYRSLPMPVTSHKFGSIDPISGKDTDDDNDGLKKRFHVTATFLHLRVPGVLRLSLKHSGQSHQPAGSI

SEQ ID NO: 172690 - protein, 277 aa, Glycine max
  Coding DNA Sequence Number=SeqID_81005
  Gene Ontology: Mol. function=phosphotransferase activity, alcohol group as acceptor; Biological process=protein modification process
  Homolog annotation: Hit_ID=A7QF39; Match level="QueryCoverage=46%, HitCoverage=19%, E-value=8e-26, Identity=51%"; Hit description =Chromosome chr16 scaffold_86, whole genome shotgun sequence
MASAGNILFRKEADGHTLLIPIDHGYCLLEKVSSPRSFPCNLISPALPCASACASDTRSIVDVKENLASTRQHYSPDTVDYIKSLDAEKDIELLKYYKWDVPIECAQTLCISTMLLKKEVERGLTPFDIGSIMGLWEGLRVNTEVGLVWQSMNLNVDPDFLLNNAVHWLKKNLLNTDGSPLGNLGPSGFGGVIRNGQWFFSFFWFCEVFAIYNGLKLAYDRGIHNLVCESDSKIVLHLIKENKNPFQPYNAFIHKIQQYIVEPWHLSFKRETIARFG

SEQ ID NO: 172691 - protein, 549 aa, Glycine max
  Coding DNA Sequence Number=SeqID_81006
  Gene Ontology: Mol. function=catalytic activity; Cellular component =endoplasmic reticulum membrane; Biological process=metabolic process
  Homolog annotation: Hit_ID=A7QUA6; Match level="QueryCoverage=97%, HitCoverage=97%, E-value=0.0, Identity=79%"; Hit description =Chromosome chr2 scaffold_176, whole genome shotgun sequence
  Pfam annotation: Domain name=AMP-binding; Domain location=80-437; Score=184.7; E_value=2.3e-52; Accession=PF00501.19; Description=AMP -binding enzyme
MAQKRFIIEVEKAKEASEGRPSRGPVYRSLFAKDGFPAPIQGLNSCWDVFRLSVEKYPSNPMLGRREIVDGKPGKYKWLTYKEVYDQVMKVGNSIRSCGYGEGVKCGIYGANSAEWIMSMQGQNQSFDLPIKKRSDICTIMYTSGTTGDPKGVLISNESIITLLAGVKRLLESVNEQLTEKDVYISYLPLAHIFDRVIEETFIWHGASIGFWRGDVKLLIEDVGELKPTIFCAVPRVLDRVKLNNMKKGLRHGEASPLLDKIVFDKVKQGLGGRVRLILSGAAPLSAHVEGYLRVVTCAHVLQGYGLTETCAGTFVSLPNEIEMLGTVGPPVPNVDVCLESVPEMGYDALASTPRGEICVKGKTLFAGYYKREDLTKEVLIDEWFHTGDIGEWQPNGSMKIIDRKKNIFKLSQGEYVAVENLENIYGQVSSIESIWVYGNSFEAFLVAVVNPSKQALEHWAQENGISMDFNSLCEDARAKSYIIEELSKIAKEKKLKGFEFIKAVHLDSIPFDMERDLITPTYKKKRPQLLKYYQVQVVKFSGLHFTSY

SEQ ID NO: 172692 - protein, 462 aa, Glycine max
  Coding DNA Sequence Number=SeqID_81007
  Gene Ontology: Mol. function=nucleoside-triphosphatase activity; Cellular component=chloroplast; Biological process=chlorophyll biosynthetic process
  Homolog annotation: Hit_ID=O22437; Match level="QueryCoverage=83%, HitCoverage=52%, E-value=1e-154, Identity=72%"; Hit description =Magnesium-chelatase subunit chlD, chloroplast precursor
  Pfam annotation: Domain name=AAA_2; Domain location=99-293; Score= -51.7; E_value=0.096; Accession=PF07724.5; Description=ATPase family associated with various c
  Pfam annotation: Domain name=AAA_3; Domain location=152-276; Score= -18.9; E_value=0.039; Accession=PF07726.2; Description=ATPase family associated with various
  Pfam annotation: Domain name=Mg_chelatase; Domain location=79-289; Score=-95.0; E_value=1.2e-06; Accession=PF01078.12; Description =Magnesium chelatase, subunit ChlI
  Pfam module annotation: Pfam domain module=AAA_2::AAA_3::Mg _chelatase; Domain location=99-293::152-276::79-289
  Subcellular localization annotation: CTP_CleavageSite=54; ConfidenceScore=5.53e-01
MGFALAFTASSTCCSNLQSQSLLFAAAALRSKPCLSLCNTYRPKRIRKRSPIVGAQSENGALVTSEKPGTNYGRQYFPLAAVVGQDAIKTALLLGAIDPGIGGIAISGKRGTAKTVMARGLHAILPPIEVVVGSIANADPTCPEEWEDGLTECLEYDSAGNIKTRIIKSPFVQIPLGITEDRLIGSVDVEESVKTGTTVFQPGLLAEAHRGVLYVDEINLLDEGISNLLLNVLSEGVNTVEREGISFKHPCRPLLIATYNPEEGAVREHLLDRIAINLSADLPMSFENRVAAVGIATEFQENSSQVFEMVEEETDNAKTQIILAREYLKDVTLNRDQLKYLVIEALRGGCQGHRAELFAARVAKCLAALEGREKVELVILPRSIITESPPDQQNQPPPPPPPPQNQESGEEQNEEEEQEAQPKLKMVSPPILDLILGCPQLSKKSTWCGFPSAILDPRLLVQ

SEQ ID NO: 172693 - protein, 1110 aa, Glycine max
  Coding DNA Sequence Number=SeqID_81008
  Gene Ontology: Mol. function=binding; Cellular component=nucleus; Biological process=metabolic process
  Homolog annotation: Hit_ID=A7Q4W0; Match level="QueryCoverage=67%, HitCoverage=84%, E-value=0.0, Identity=62%"; Hit description=Non -specific lipid-transfer protein
  Pfam annotation: Domain name=PPR; Domain location=205-239; Score =42.8; E_value=1.2e-09; Accession=PF01535.11; Description=PPR repeat
  Pfam annotation: Domain name=PPR; Domain location=316-350; Score =39.5; E_value=1.2e-08; Accession=PF01535.11; Description=PPR repeat
  Pfam annotation: Domain name=PPR; Domain location=382-416; Score =30.2; E_value=7.4e-06; Accession=PF01535.11; Description=PPR repeat
  Pfam annotation: Domain name=PPR; Domain location=483-517; Score =36.4; E_value=1e-07; Accession=PF01535.11; Description=PPR repeat
  Pfam annotation: Domain name=PPR; Domain location=584-618; Score =43.3; E_value=8.3e-10; Accession=PF01535.11; Description=PPR repeat
  Pfam annotation: Domain name=PPR; Domain location=619-653; Score =14.9; E_value=0.13; Accession=PF01535.11; Description=PPR repeat
  Pfam annotation: Domain name=PPR; Domain location=655-689; Score =12.7; E_value=0.24; Accession=PF01535.11; Description=PPR repeat
  Pfam annotation: Domain name=PPR; Domain location=721-755; Score =11.5; E_value=0.34; Accession=PF01535.11; Description=PPR repeat
  Pfam annotation: Domain name=PPR; Domain location=73-106; Score=22.5; E_value=0.0016; Accession=PF01535.11; Description=PPR repeat
  Pfam module annotation: Pfam domain module=PPR::PPR::PPR::PPR::PPR::PP R::PPR::PPR::PPR; Domain location=205-239::316-350::382-416::483 -517::584-618::619-653::655-689::721-755::73-106
MEKSKSLNLANLVQHCITNKAHLSGKVVHARLFRLALFSDTFLSNHFIELYSKCDHIASACHVFDNIPHKNIFSWNAILAAYCKARNLQYACRLFLQMPQRNTVSLNTLISTMVRCGYERQALDTYDSVMLDGVIPSHITFATVFSACGSLLDADCGRRTHGVVIKVGLESNIYVVNALLCMYAKCGLNADALRVFRDIPEPNEVTFTTMMGGLAQTNQIKEAAELFRLMLRKGIRVDSVSLSSMLGVCAKGERDVGPCHGISTNAQGKQMHTLSVKLGFERDLHLCNSLLDMYAKIGDMDSAEKVFVNLNRHSVVSWNIMIAGYGNRCNSEKAAEYLQRMQSDGYEPDDVTYINMLTACVKSGDVRTGRQIFDCMPCPSLTSWNAILSGYNQNADHREAVELFRKMQFQCQHPDRTTLAVILSSCAELGFLEAGKEVHAASQKFGFYDDVYVASSLINVYSKCGKMELSKHVFSKLPELDVVCWNSMLAGFSINSLGQDALSFFKKMRQLGFFPSEFSFATVVSSCAKLSSLFQGQQFHAQIVKDGFLDDIFVGSSLIEMYCKCGDVNGARCFFDVMPGRNTVTWNEMIHGYAQNGDGHNALCLYNDMISSGEKPDDITYVAVLTACSHSALVDEGLEIFNAMLQKYGVVPKVAHYTCIIDCLSRAGRFNEVEVILDAMPCKDDAVVWEVVLSSCRIHANLSLAKRAAEELYRLDPQNSASYVLLANMYSSLGKWDDAHVVRDLMSHNQVRKDPGLIIMLNHFCRDLDNFCKRTLVMDAEHQLFATCFFFFREVAVLLPRVASSFPVSGSLSSILLRASVVSFFIETRRYAWGAAGLVHMYDHRNDASISTSRQVAIAECNADPNYDEMSPRACRWIATKKTVKKISTATYRQPGSSQDFRCLLDAIWGALTGQLHWGPVAIRYRPERVMRQFGYVQSILAHPVDSWVSFDDVDDRWTHYSDHLAPAGDICVVSGQCVPDYIDRFFIISHPFMTAPQTSDPPRDAFATQPRHIPQVPESHVPQESVAASTHADFDADKPRHAVISVTIWLDEVCHAIAETLEHHLSLNEVTPGTSTYEVIQKCLRIVRGVTEDRNVYVRSQHTWCTDQP

SEQ ID NO: 172694 - protein, 810 aa, Glycine max
  Coding DNA Sequence Number=SeqID_81009
  Gene Ontology: Mol. function=heat shock protein binding; Cellular component=cytosol; Biological process=protein folding
  Homolog annotation: Hit_ID=A7PQW4; Match level="QueryCoverage=73%, HitCoverage=48%, E-value=0.0, Identity=60%"; Hit description =Chromosome chr6 scaffold_25, whole genome shotgun sequence
  Pfam annotation: Domain name=DnaJ; Domain location=693-775; Score =97.1; E_value=5.5e-26; Accession=PF00226.22; Description=DnaJ domain
  Pfam annotation: Domain name=TPR_1; Domain location=232-265; Score =2.5; E_value=2.6; Accession=PF00515.19; Description=Tetratricopeptide repeat
  Pfam annotation: Domain name=TPR_1; Domain location=276-309; Score =24.0; E_value=0.00056; Accession=PF00515.19; Description =Tetratricopeptide repeat
  Pfam annotation: Domain name=TPR_1; Domain location=438-471; Score =3.6; E_value=2; Accession=PF00515.19; Description=Tetratricopeptide repeat
  Pfam annotation: Domain name=TPR_1; Domain location=551-584; Score =12.1; E_value=0.19; Accession=PF00515.19; Description=Tetratricopepti de repeat
  Pfam annotation: Domain name=TPR_1; Domain location=589-622; Score =27.3; E_value=5.8e-05; Accession=PF00515.19; Description =Tetratricopeptide repeat
  Pfam annotation: Domain name=TPR_1; Domain location=623-656; Score =12.5; E_value=0.17; Accession=PF00515.19; Description=Tetratricopepti de repeat
  Pfam annotation: Domain name=TPR_2; Domain location=232-265; Score =12.6; E_value=0.81; Accession=PF07719.8; Description=Tetratricopeptid e repeat
  Pfam annotation: Domain name=TPR_2; Domain location=276-309; Score =19.4; E_value=0.013; Accession=PF07719.8; Description=Tetratricopepti de repeat
  Pfam annotation: Domain name=TPR_2; Domain location=438-471; Score =5.4; E_value=6.5; Accession=PF07719.8; Description=Tetratricopeptide repeat
  Pfam annotation: Domain name=TPR_2; Domain location=551-584; Score =11.3; E_value=1.2; Accession=PF07719.8; Description=Tetratricopeptide repeat
  Pfam annotation: Domain name=TPR_2; Domain location=589-622; Score =16.6; E_value=0.092; Accession=PF07719.8; Description=Tetratricopepti de repeat
  Pfam annotation: Domain name=TPR_2; Domain location=623-656; Score =14.1; E_value=0.52; Accession=PF07719.8; Description=Tetratricopeptid e repeat
  Pfam module annotation: Pfam domain module=DnaJ::TPR_1::TPR_1::TPR _1::TPR_1::TPR_1::TPR_1::TPR_2::TPR_2::TPR_2::TPR_2::TPR_2::TPR_2; Domain location=693-775::232-265::276-309::438-471::551-584::589 -622::623-656::232-265:...
  Pfam module annotation: Domain location=:276-309::438-471::551 -584::589-622::623-656
MASEDMANLKIEDSKDQRDGGFVFTSKQDNNNSSGSSFLQLGDAHAHAIDKFKFGARKEQSGNNKSRPKLKLSTPPQGYHDFIWKPKNESFGFFSVDATSIDQCSNKNECEVVDIENKEEASDCGGSFKSANDEVDITNDGSRHMSGFTFSASQVQSSSSSLKRHPNKINWVKVGHAHQNDTYNSTPNPLSFSGTSSLFTSGQANTRGSEVQGIKDEFASISATTLAAEEACEKWRLKGNQAYKNGNLSVAEDCYTQGVSCASKVEASQRCRRALMLCYSNRAATRMSLGRMRDAVEDCRLAAEIDPNFLRVRLRAAKPPILCQRGLALMGKLKGINKKIINYILPTGCLSLESYHCFLAMGEAEDASKYSKRCLQSGTDFCVDKKIVVEASDLLQKTQKVSELINHSDELLQRRTAADAERALELINEALVISSYSEKLLEMKAEALFMLCRYEEVIQLCDQTVGSAEKNSYPLDADCEVRDLDSSQLSKGLYFRLWRCSMMLKSYFHLGKLEEGLSLLEEQEEKVSAINMSGSKVLESLMPLAVTVRELLHHKTAGNEAFQAGKHEEAVEHYTAALSCNVESLLFASVCFGNRAAAYKALGQITDAIADCNLAIALDGRYLKALSRRATSYEMIRDYDQAASDIRRVVSLLINRNQHGISDRSISYANDLKHNQIWLSEIEEEAKKGIPLDMYLILGVEHSVSSSEIKKAYHKAALRHHPDKAGQSLARSDNGDDQIWKDIVEEISKDADRLFKIIGEAYAVLSDTAKRSQYDSEEEMRNSQKKRHGNSINRNNVIDQTDNRRHWKEV

SEQ ID NO: 172695 - protein, 983 aa, Glycine max
  Coding DNA Sequence Number=SeqID_81010
  Gene Ontology: Mol. function=DNA binding; Cellular component=nucleus
  Homolog annotation: Hit_ID=A7P8X0; Match level="QueryCoverage=22%, HitCoverage=87%, E-value=4e-28, Identity=35%"; Hit description =Chromosome chr3 scaffold_8, whole genome shotgun sequence
  Pfam annotation: Domain name=Myb_DNA-binding; Domain location=830 -876; Score=47.5; E_value=4.6e-11; Accession=PF00249.22; Description =Myb-like DNA-binding domain
MDPFDDILPVAPTARSKCLDPNDTGTRPGAKFIPKAKSKQLPRKEIPVSEHATSSKDGILGNECQNAVASAEESKGFIHHTQVEIPNSGDSTNSKQASVKGDTAALVDDSTITASEVDANQNSINFLKPACEVTEGDPVDFEGVNNGTTQPVHHANAVENELNNVAAPSPTCSTIDRMKEQPKNGEDSFLDSNKCLELIDNSILVGMDLGFKSSSDDKIAIIQSNFDLKSNFCKKQEGVSAEFELDPFSNILPNPVARNVHKFKPKIKPRPRAGNVPAIASDSSNVRMEKSVELPTSCTNNFQSFLSCGDGSGGVNQSTSLPLPTSEILRTTELPKKFDDSSSSIPFSEDNKSLAAAIPSQLDSPNVMLSEDAVHNGTTDWSSSFRKSPGEAADIFSGLESLHDFITQAATGTALHSFNGKSGEENFVTPASSSINSFGECDITQAQRCPEYHTPQDSLTFNEAAVLNEDNTHSSNRRSETEEIVDLNPACAGDDVIDYQFMKSGKDPTGIPVHEELTNAADSPTLADFLHADVTREKEDSNKRKNDGSTSCSLRKKRRFIAGEEDKGAKTSRQLRKQAAHKPANSSFNEDVEDNNDLDPPYNSNGDELQENDDDYEVNYPSRKKRVSKSSQKKSMAKSGKTSQKPKKAYEDLEKTEEPLKKFSHSTRRKKRCVDKALLEIPEDELDRLRIPIKDIILLEEHRERLASWRLIDVIVVFLPPVHDDGRRFWMLTKFGYRESWVRLRRGIRGIVKGKVGKTEKSSGGDSLHEAGAYNEGAYNEGAYDDGAYNDGEFLGSEDGRDPYDDQANEGIASTSVLLNYQSFREKTPRGKWSKQETELFYEAVREMGTDFSMIQEIFFPNKSRHQIKLKYKNEERQQPLQLTDAVNNRAKDHPHSKLFIERLQLASAKAEDPCRDASDFVMAEEVVDLTAGTNEEVAEVATTKEDADVKEQEDSVAVPSPEQSDDSEDDFQRWSQYKSGYQ

SEQ ID NO: 172696 - protein, 552 aa, Glycine max
  Coding DNA Sequence Number=SeqID_81011
  Gene Ontology: Mol. function=binding; Cellular component =intracellular; Biological process=RNA processing
  Homolog annotation: Hit_ID=A7Q1K9; Match level="QueryCoverage=84%, HitCoverage=87%, E-value=0.0, Identity=62%"; Hit description =Chromosome chr7 scaffold_44, whole genome shotgun sequence
  Pfam annotation: Domain name=DUF946; Domain location=57-551; Score =903.2; E_value=1.2e-268; Accession=PF06101.2; Description=Plant protein of unknown function (DUF946)
MGTSSFFLFLCIIIVIDDDDGSCAIKYEYEAAIVETLLLLLVSYSATIASPPKASLQIKKTFTLPAIAADAAAIAVVMRLPNIGKPVAFYKPVGIPDGFHILGHYCQSSDKPLRGFVLVVREVETASSETSNRDKLTALKNPLDYMLVWCSNAGSKELPIGSAYFWVPQPPEGYSALGFLVANMPDKPNLDEMICVRADLTDKCEPYRLMLDAASVIPEFPFQVWSLRPRDRGMLGKGVSVGTFFCTSCWNNGDELSVVCLKNLNPEVYLPSSVDWFFNNGALLYRKGVSTGEAIDAAGSNLPGGGRNDGEFWIDLPSDDKRDFVKHGDLKSAKLYVHVKPALGGTFTDIAMWVFCPFNGPSTLKIGITSRAFSKVGEHVGDWEHFTLRICNFSGELWSIYFSQHSGGKWVDAYELEYIDGNKAVVYSSKNGHASYPHPGTYLQGSSKLGIGIRNDATRSNLYVDSSVQYELVAAEYLGDVVREPQWLQFMREWGPKIVYDSKTELDKIINALPGGLRNSFGSLIKKLPVELYGEEGPTGPKEKNNWIGDER

SEQ ID NO: 172697 - protein, 94 aa, Glycine max
  Coding DNA Sequence Number=SeqID_81012
  Gene Ontology: Mol. function=electron carrier activity; Cellular component=mitochondrial respiratory chain; Biological process =electron transport
  Homolog annotation: Hit_ID=A9P8Y7; Match level="QueryCoverage=81%, HitCoverage=68%, E-value=1e-36, Identity=93%"; Hit description =Putative uncharacterized protein
  Pfam annotation: Domain name=Cytochrom_C; Domain location=4-92; Score= 60.0; E_value=8.1e-15; Accession=PF00034.12; Description=Cytochrome c
MDSVVQKEQIANVNRREEGPNLNGLFGRQSGTTPGYSYSSANKNMAVTWEEKTLYDYLLNPKKYIPGTKMVFPGLKKPQERADLIAYLKESTAQ

SEQ ID NO: 172698 - protein, 447 aa, Glycine max
  Coding DNA Sequence Number=SeqID_81013
  Gene Ontology: Mol. function=hydrolase activity; Biological process =proteolysis
  Homolog annotation: Hit_ID=A7PPW3; Match level="QueryCoverage=90%, HitCoverage=54%, E-value=1e-35, Identity=61%"; Hit description =Chromosome chr18 scaffold_24, whole genome shotgun sequence
MGGSIAVHVAARRSLSTLAGLLVVDVVEGTAMTSLIHMQKILSSRMQHFSSIEKAVHGCPWCRSHVPGGKNQAHQKCSFVEVENASVQIEWSVRGGSLRNIDSARVSIPATLKYDDSKKWLVPLLAFQNIAIFTELSWKRLNNIGKAGLSDKFLSCPVPKLLLLAGTRMPSWIKSVKLIGHVHRPLEAQGERVEEGHWRNEEVVKRDLMVNNTSKDLETVLCDQTEPKPPSLTGRAQLKACVADFRSEKEKRWRSLAQRCAKKWWKSTVSENSVDSESKWERLLLRVSIRLSEQAHDTREVEPPCELAAAPPPTKSSSSPGADRLTVVASAADFKWLLLLRRMTNQREGSVQESGHTIGQMQGKFQMAVVRHTGHAIQEDVPDEFATLIVNFISRNQIGPHEIEVKRQYFRLLSNVMSREKDGIGHRFALIASQVSASINVILGCKV

SEQ ID NO: 172699 - protein, 626 aa, Glycine max
  Coding DNA Sequence Number=SeqID_81014
  Gene Ontology: Mol. function=peptidyl-prolyl cis-trans isomerase activity; Cellular component=chloroplast thylakoid membrane; Biological process=protein folding
  Homolog annotation: Hit_ID=Q9STK2; Match level="QueryCoverage=79%, HitCoverage=96%, E-value=3e-76, Identity=37%"; Hit description =Peptidyl-prolyl cis-trans isomerase
  Pfam annotation: Domain name=FKBP_C; Domain location=530-622; Score =151.0; E_value=3.4e-42; Accession=PF00254.19; Description=FKBP-type peptidyl-prolyl cis-trans is
  Pfam annotation: Domain name=NTF2; Domain location=40-157; Score= -1.7; E_value=0.087; Accession=PF02136.11; Description=Nuclear transport factor 2 (NTF2) domain
  Pfam module annotation: Pfam domain module=FKBP_C::NTF2; Domain location=530-622::40-157
MEQPERRSKWRVVDGVGEKQSVTTLAATTTSFDDNDVVDSNSAVVRNFYGGINAHDVDSVEYLMAENCVYEDLVFPRPFVGRKEILEFFKKFTNSTSKGLQFVIDDLSTEDSSSVGNGRENLFPLAKGIEVKPGKPCPYHADNVRGKLHVTQATLGIGSSSEKSILQCSSGHKSPVFLCSLLPDKVESCPLNLEFDADDLVAFSVVGSRSIHLSGYFADDDGDDLRDDYEYDSWGEDIEGTESEESSEYDSEDGYADDFIVDSDTDMYPSSPIPNSGVVIEEIMDDDKPKNGDDPTKKLKKKKHVAQLKEKDNKSSELPIVAKGDTDLVVESEDEDGFPISIAEKGVSVSKTEAEMKGEQARKKTEKANKKEKDVGHSASVKRKVDSADEDEPQDGKKKKKRNKLKDHIKGGSDHASDNSNEKKVTEPDEKHAEDVKTSTKLSDVSHAKDEDGGKLSNNEVLVEKKIKKKNKKKTKESEGEAAANQITTTAEKQNLSTEKKGKKQTETKPSQVRTFPNGLIIEEVFMGKPDGKKAAPGKKVSVKYIGKLQKDGKIFDSNVGRAPFKFRLGVGQVIKGWEVGINGMRIGDKRRITIPPSMGYADKRVGSIPPSSWLVFDVELVDVGR

SEQ ID NO: 172700 - protein, 137 aa, Glycine max
  Coding DNA Sequence Number=SeqID_81015
MGKEVYDGTFRKTRYGFFRKFRKLSGRSDLPEIKARTRGLSRAIGRLVGRDRPDDQNAADVPERRRPTASVRRLRVHQMTAEGRDMAENVADMTDDVPEQAAEAPEMRADAPVADSGEGSDGDDAADAFLGGPRDPS

SEQ ID NO: 172701 - protein, 834 aa, Glycine max
  Coding DNA Sequence Number=SeqID_81016
  Gene Ontology: Mol. function=metalloendopeptidase activity; Cellular component=integral to membrane; Biological process=proteolysis
  Homolog annotation: Hit_ID=Q40983; Match level="QueryCoverage=98%, HitCoverage=65%, E-value=0.0, Identity=89%"; Hit description =Metalloendopeptidase
  Pfam annotation: Domain name=Peptidase_M16; Domain location=4-147; Score=46.2; E_value=1.2e-10; Accession=PF00675.11; Description =Insulinase (Peptidase family M16)
  Pfam annotation: Domain name=Peptidase_M16_C; Domain location=149 -386; Score=73.5; E_value=7.2e-19; Accession=PF05193.12; Description =Peptidase M16 inactive domain
  Pfam module annotation: Pfam domain module=Peptidase_M16::Peptidase _M16_C; Domain location=4-147::149-386
MGCVHVFEAHLEVHAGSIDEEEDEQGIAHMIEHVAFLGSKKREKLLGTGARSNAYTDFHHTVFHIHAPTSTKDSDGDLLPFVLDALNEIAFHPKFLASRIEKERRAILSELQMMNTIEYRVDCQLLQHLHSENKLSKRFPIGLEEQIKKWDADKIRKFHERWYFPANATLYIVGDIDNISKTVYHIEAVFGQTGADNEKGSVATPSAFGAMASFLVPKLSVGSSGNSIERSANAMDQSKVFNKERQAVRPPVKHNWSLPGSGADLMPPQIFQHELLQNFSINMFCKIPVNKVQTYRDLRQVLMKRIFLSALHFRINTRYKSSNPPFTSVELDHSDSGREGCTVTTLTITAEPKNWQNAIRVAVQEVRRLKEFGVTQGELTRYLDALLKDSEHLAAMIDNVSSVDNLDFIMESDALGHKVMDQRQGHESLLAVAGTVTLEEVNSVGAKVLEFIADFAKPTAPLPAAIVACVPKKVHNEGAGETEFKISSTEITDAIKAGLDEPIQPEPELEVPKELIQSTKLEELKKLRKPAFIPVNPETDATKLHDEETGITRRRLANGIPVNYKISKTETQSGVMRLIVGGGRAAESPESRGSVIVGVRTLSEGGRVGNFSREQVELFCVNHLINCSLESTEEFISMEFRFTLRDNGMRAAFQLLHMVLEHSVWVDDAFDRARQLYLSYYRSIPKSLERSTAHKLMVAMLDGDERFIEPTPKSLENLTLQSVKDAVMNQFFGDNMEVCIVGDFTEEDIESCILDYLGTAQATRNHEREQKFNPPLFRPSPSDLQFQEVFLKDTDERACAYIAGPAPNRWGFTVDGVDLLESINNASIINGELC

SEQ ID NO: 172702 - protein, 178 aa, Glycine max
  Coding DNA Sequence Number=SeqID_81017
  Gene Ontology: Mol. function=transferase activity; Biological process= metabolic process
  Homolog annotation: Hit_ID=A7P939; Match level="QueryCoverage=54%, HitCoverage=38%, E-value=5e-25, Identity=58%"; Hit description =Chromosome chr3 scaffold_8, whole genome shotgun sequence
MAHINSVQEVNEVVALHDPDHMTLEFLSYADGKEAVAKAANLIFVEHLKRHKLGGELDLILLEPQLNEALQIVGSKGPEPDLLLVYGPVRSHLGFPAWRLRYTEIILNLKWLVNIFGSDLPSPYLLYIPPVIFSFSSSKSVTHGIIELLEIWFLNESHLQLHESAPKLWYVEKEFGGS

SEQ ID NO: 172703 - protein, 127 aa, Glycine max
  Coding DNA Sequence Number=SeqID_81018
MDLVKGYMMLGFYNSDDGQGNPPAIWPVLWSVGRAVHVKGNYRDALFFRSTLVFEELGDLKDPSQWVMTVTSRNLEFDVSEDSRKVLTLKAKLECLEARDLAGIRHLQAYRWLFCAFCGQMRDKGPL

SEQ ID NO: 172704 - protein, 137 aa, Glycine max
  Coding DNA Sequence Number=SeqID_81019
MVNKYKITVLTKHVWLSLSFLVWIPLILPMFVENLVVLLVMPLFLVPSTEALNCALLQLMWYLLVIRIKVQHKFQILDVAEFDILEDAHECVIMSINDIPEKTPIQANHPFHLPIPITNVTFDEEEERQLDDDKVNN

SEQ ID NO: 172705 - protein, 73 aa, Glycine max
  Coding DNA Sequence Number=SeqID_81020
MDNTTTPPTPMVLIQWQGISPKEASWEPWEIVYDKFHLEDKVPCPLIQGSSLPVHSSAPINNTQEETGYVVLP

SEQ ID NO: 172706 - protein, 162 aa, Glycine max
  Coding DNA Sequence Number=SeqID_81021
MCGEKDVQKKAQTIQKQNIAPHVLSRGGYEYLENKLMDEKRKGKLEEAAQSESTDTMIDPLSPIRRHVKWKMARMKKTDQITSKAAKEITEKIDSLEEQASQAILWTDSKDLSHVFLRDSQRPVAADATNQGLAGRVDHRKSDSTANVILQPEAVPISGGIL

SEQ ID NO: 172707 - protein, 70 aa, Glycine max
  Coding DNA Sequence Number=SeqID_81022
MESMDELHKEGRKEKLGGGVDWGRGMEGFVGVREKGRLRMGLGGVRRKRKEKEKEVRRRRKGIVGAKKGC

SEQ ID NO: 172708 - protein, 43 aa, Glycine max
  Coding DNA Sequence Number=SeqID_81023
MVEVVKGEDAKPTVKMKAYHKAFQQGPYELLATTLRSLFPGLF

SEQ ID NO: 172709 - protein, 55 aa, Glycine max
  Coding DNA Sequence Number=SeqID_81024
MEKEESPLIQDQVQDSPPSVLRCHEAYKWAHTYPMGQKSTLRLMRTLGPSSAVLA

SEQ ID NO: 172710 - protein, 95 aa, Glycine max
  Coding DNA Sequence Number=SeqID_81025
MASWLRWINRHPQQRFQLLEDQWHLHRHAHQIYILGLVQLMVTFWGCNLSMFQNMFGMGNQTENYTSDEQSRRIKVKNKYQRKLFLGFSNLGFIG

SEQ ID NO: 172711 - protein, 61 aa, Glycine max
  Coding DNA Sequence Number=SeqID_81026
  Subcellular localization annotation: CTP_CleavageSite=43; ConfidenceScore=5.05e-01
MTISDPFSDGSSEKNKSHDDSTSGGFNPFSFSLTFGNSIGAIRGKKLEKSQGTDRDAAIAG

SEQ ID NO: 172712 - protein, 87 aa, Glycine max
  Coding DNA Sequence Number=SeqID_81027
MKKEEEMLSQLMTRKAYGSLRCNTSISISETHGSIFTANGMGNGGSSKEPPNSGGGGKRRVSFKDLMIGNKAPVALRQKVDLIQQNW

SEQ ID NO: 172713 - protein, 67 aa, Glycine max
  Coding DNA Sequence Number=SeqID_81028
MARGIVVFPRQLWVSAGKLRHNIPIQNGENAWNWVANMVLKFHDDPTVNDSEIVIFLRQVRCPAGKR

SEQ ID NO: 172714 - protein, 128 aa, Glycine max
  Coding DNA Sequence Number=SeqID_81029
MMGEKEEFPKGEFSSFDGLGPAYSCLVWVPIFALSTPLPRLAPMLVFALSASWLIFSSYQQPIVEVPQVAEDDHVDQVVNKEQQVNVENPVEQQVPQQDNEPTLRRPTRVKMSTIPSDYQVYLQRIGL

SEQ ID NO: 172715 - protein, 60 aa, Glycine max
  Coding DNA Sequence Number=SeqID_81030
MMEEDYRPVIHPRRRLNPSVTTYPLAGRRGEKKRQRVTLGQFQLTQASWFLHHDAIWWPK

SEQ ID NO: 172716 - protein, 43 aa, Glycine max
  Coding DNA Sequence Number=SeqID_81031
MDEEQWMYDSIMSEEVDINVENEEDVGMKIEHVDCSNAFNTSQ

SEQ ID NO: 172717 - protein, 246 aa, Glycine max
  Coding DNA Sequence Number=SeqID_81032
  Homolog annotation: Hit_ID=A7QPK8; Match level="QueryCoverage=89%, HitCoverage=36%, E-value=4e-47, Identity=46%"; Hit description =Chromosome chr18 scaffold_137, whole genome shotgun sequence
MASSFEALEVKKMELEIESQFMNEASLELNNTIEHSIQNGKKEKEILCKRKDVLMDELEQLLAKKMQSSIDVKYDKLQFVLAQKKKWEQDFGNLLGFLQQAEGYREIVKLRRSLMSSTLTSREDKLTLAKNNEKLSGDVKLFQQEVSATRASLQELSSRKSSIQQGIVSFKRRIIFIDKRVLELEAEKKVVTAARNFKEIPRIATEAKSLCVEKESIQIDRDTTTLNLELLREKLGLVNHRYKEEC

SEQ ID NO: 172718 - protein, 78 aa, Glycine max
  Coding DNA Sequence Number=SeqID_81033
  Homolog annotation: Hit_ID=A7P2Y1; Match level="QueryCoverage=97%, HitCoverage=40%, E-value=2e-09, Identity=40%"; Hit description =Chromosome chr1 scaffold_5, whole genome shotgun sequence
MDLLKDEDASKAMVVLTFLLVKNSMDDAIRDLPFPHNKNLAINYGSDGEDDLFVPALNQPLSSNRYYVIKGRGKHKGL

SEQ ID NO: 172719 - protein, 283 aa, Glycine max
  Coding DNA Sequence Number=SeqID_81034
  Gene Ontology: Mol. function=catalytic activity; Biological process =trehalose biosynthetic process
  Homolog annotation: Hit_ID=A9PCZ6; Match level="QueryCoverage=26%, HitCoverage=19%, E-value=6e-27, Identity=78%"; Hit description =Putative uncharacterized protein
  Pfam annotation: Domain name=PPR; Domain location=224-258; Score =28.0; E_value=3.5e-05; Accession=PF01535.11; Description=PPR repeat
  Pfam annotation: Domain name=Trehalose_PPase; Domain location=28-192; Score=-54.4; E_value=0.0024; Accession=PF02358.7; Description =Trehalose-phosphatase
  Pfam module annotation: Pfam domain module=PPR::Trehalose_PPase; Domain location=224-258::28-192
MKQLHHPSALDMFDKIIDASKGKQFVMFLDYDGTLSPIVDDPDRAFMCDSMRKTMRKLARCFPTAIVTGRCKGKMHDLFWNLEATGMIGIVDYTNYDDMKYAIRKLDDSEFRNAFSRAFIRVILEVLVVIQGGAILEASAVVHISHEAAAIAATEVIAIVTGAEGSLWLPCWSPKPKHSRHSISLSRLSQDGRIRDANKVLNEMTETLKFKNKLLEAGLKRDPFTYKALIHGFYKTNELERANELMFSMVDAGFTPSYCTFSWIGDSYNKKDNMDAVLALPDE

SEQ ID NO: 172720 - protein, 521 aa, Glycine max
  Coding DNA Sequence Number=SeqID_81035
  Homolog annotation: Hit_ID=A7QKJ9; Match level="QueryCoverage=12%, HitCoverage=32%, E-value=4e-15, Identity=68%"; Hit description =Chromosome chr2 scaffold_112, whole genome shotgun sequence
  Pfam annotation: Domain name=Peptidase_C48; Domain location=219-408; Score=-32.9; E_value=0.059; Accession=PF02902.10; Description=Ulp1 protease family, C-terminal catalytic domain
MMKKELKKSLKVELSHIASHQSAPIKAPEIQALLGRVSTKGSCAGPEGSGLLKELLSGGDDLMGLFVVVGENTVFAGLGKVFENSSTIHNVHYENDVVKVQVVRTYMPHAEVPIPTSEVHYLEQTVGTFVAWPTHLVREVTNEVVVGPDKPPSKSVGQLNRLTSVATDDPLGELVKKSYVVYTKPMELAWDEAKFGLPNASNGFFITHADVTEIILGDKCLNISVLQLWMMFMNDWSTSIGFFPVYGFLEPQSIRCTKDTRKECQKYIETWVKESHREIYLGPYFNQAHWQLLVLCPRENIIVWFCSVRRKPDVHIKFAVNNAMKKICSNLQGKDNAPPPPPQWIEAKSHVQQGAYECGYYVMHWMWCIVSAGLKNELHNYFSDGTTLDTDTMTTIRKKWAAYFLEVGKWMSAFDMFLLGSFSPPQPSHTLVQEIIGKAPQDALGNQAEHALASLASMMLESPSFIVQFTHGLNLSLSSKEYTHGVVIRFRSVEAFEIFINSKEYKNISALGLLYAIQILV

SEQ ID NO: 172721 - protein, 237 aa, Glycine max
  Coding DNA Sequence Number=SeqID_81036
  Homolog annotation: Hit_ID=Q9FLX0; Match level="QueryCoverage=50%, HitCoverage=10%, E-value=1e-20, Identity=44%"; Hit description =Arabidopsis thaliana genomic DNA, chromosome 5, P1 clone:MXC20
MESGKLSRGQLHGQTSEDKLSKGDSDDEMLSSVLKKKINSKVSIEQLLEPINVDSSSRDDSDDEMLSSALKRTRRPSLKSKQVELENIQIHERIMGDDSFNGGIIEVSEGKMLKKMKKQPLLFVELLFWKTRRECHYINAEYLLSELGHLKKESANWNNTQGDEEIGSSPAKVWTQDIKNKLDVIKGFAPTSGSNSDKDDHNGEQLMEDESQIALRRRKKLVLDGDLERQIKDLHEK

SEQ ID NO: 172722 - protein, 146 aa, Glycine max
  Coding DNA Sequence Number=SeqID_81037
MTSRKRKSIGSRPTQQYDTRRFSSLYAWNRYTDNVLGRNILPERKVELYHTELDDFKTELERCNFHKRLTNLPDGSIDLALVKEFYANLYSSEGPSPKQSRVRGHLVKIDTDSLNTFLETPMVLAEGETLPTYSRYCRLPIDTGIL

SEQ ID NO: 172723 - protein, 77 aa, Glycine max
  Coding DNA Sequence Number=SeqID_81038
MLQCEGFSSKLIYDCEITNGDNVRNWVANMILKFHNDPTVKGFEIVVFLRLVWWTAGKRKGFERRRGKTKMRPKGGS

SEQ ID NO: 172724 - protein, 540 aa, Glycine max
  Coding DNA Sequence Number=SeqID_81039
  Gene Ontology: Mol. function=phosphoprotein phosphatase activity
  Homolog annotation: Hit_ID=A7UQU7; Match level="QueryCoverage=59%, HitCoverage=64%, E-value=5e-20, Identity=34%"; Hit description=IMP dehydrogenase/GMP reductase, putative
  Pfam annotation: Domain name=DUF1723; Domain location=168-217; Score =68.3; E_value=2.5e-17; Accession=PF08330.1; Description=Protein of unknown function (DUF1723)
MVRTRGLGRALGAGRGRGISEDTHEADVPLRRRPTASARRQRVRLREDMTERPEDVPQLHEDVPYVSNATPEITGAADAVQTEGVAIDGSLGSPTANEGFPGGPRDPSILTDFVEHVAHSIWSGRERPDLKLVSHGRKVNKIGRPAPEIEGLIVGTGLSPLIRCFVITTDPGLISAFVERWHRETSTFHLPVGELTITLDDVASLLHLPITGALHTFEPLVTSDAIRLLTELLEVSHEEATFETRQAGGPHAFKDLAQAGGFAWGAAALVHMYDHLNDASQASTRQLGGYITLLQCWIYEHFSTMHTSVVDDAYDEGSPRACRWLTGKAHITGIKGAPYQRRLDALSVTNVCWMPYGEHWRVRAFDLISSYTGQLRWGQIVTVPPPPVCDSLTGDDIDDRWLNFPDHLVPSGELCVVPGQVVADYMEWFFWISHPFVTRTEETAAPRHPPPPHHKEFVEPPIPEVSVATDLPTHSVVHCEGCQGMAQNLGAIAEDLERVINLRMVTKGTDLHDIMTRCLRRARGDTADGSLRPRQRSRID

SEQ ID NO: 172725 - protein, 54 aa, Glycine max
  Coding DNA Sequence Number=SeqID_81040
MGGSTQKIIGVHLKDDDSTLDTCHTPFSKNMPNVNREKEVDDVLMMPKKSASHV

SEQ ID NO: 172726 - protein, 77 aa, Glycine max
  Coding DNA Sequence Number=SeqID_81041
MESHGRILSPLSTAEELRKNLLPWDSTEELLPQDSTEEEMTNKAKGKGKEVTGKGSASKRKGAFDDDKTGGGRKRNK

SEQ ID NO: 172727 - protein, 77 aa, Glycine max
  Coding DNA Sequence Number=SeqID_81042
MARDIGTYITKMSWGSHKVEETLERKEHDYGSLTFSTSEEGVCIVEDDERNECVVKEECRAGNPKRERVEEECCAHH

SEQ ID NO: 172728 - protein, 98 aa, Glycine max
  Coding DNA Sequence Number=SeqID_81043
  Subcellular localization annotation: CTP_CleavageSite=52; ConfidenceScore=5.00e-01
MQRMISTTHNNNNLGSHKIGRAELTSKLQTWVEFQEASSSKRTLLLLRVSIRSLAKMQVKRGSWESRRDCSSAMRFIMRLVRRQRLSWIWKQQGYLES

SEQ ID NO: 172729 - protein, 74 aa, Glycine max
  Coding DNA Sequence Number=SeqID_81044
MMITTFTFVSMIVVAATTIIMMTMAVMEVVDNGGVITTEVVAIDDVGGSNNDYDSGCNNDHDGEVTIMLVMMMS

SEQ ID NO: 172730 - protein, 95 aa, Glycine max
  Coding DNA Sequence Number=SeqID_81045
MAMPHMVGCPNIPTTTSPCSYRNRRGRIIVIEMGSPAGEATEGYDLLRRLEVPPPVRRKTLNLYEEEDSLLEAPRRVSCEEEPLMDMTSQSTKGC

SEQ ID NO: 172731 - protein, 70 aa, Glycine max
  Coding DNA Sequence Number=SeqID_81046
MSDKLDKSATSEKEASRPNHTSWTRGTSQKNASLSQKGPREKFEDAKVVVSLSLDRVLSKTQPLSETSTA

SEQ ID NO: 172732 - protein, 93 aa, Glycine max
  Coding DNA Sequence Number=SeqID_81047
MEEKNSAKAKHQEQAPTASTNSKHAEHSRNSRMEKRKGWRHAMKPYPAHRNGESHRLGVASENGDSHSYVAYVATTRGDTPLSPALPPLAMAG

SEQ ID NO: 172733 - protein, 459 aa, Glycine max
  Coding DNA Sequence Number=SeqID_81048
  Gene Ontology: Mol. function=transcription regulator activity; Cellular component=nucleus; Biological process=regulation of transcription
  Homolog annotation: Hit_ID=A7Q759; Match level="QueryCoverage=90%, HitCoverage=96%, E-value=1e-110, Identity=59%"; Hit description =Chromosome chr5 scaffold_58, whole genome shotgun sequence
  Pfam annotation: Domain name=HLH; Domain location=211-262; Score =56.6; E_value=8.5e-14; Accession=PF00010.17; Description=Helix-loop -helix DNA-binding domain
MPPIFNTLDYSLDQHHLYAPNQHQQHLMKFQGSGDENNNGSMVDYMPQTTPPHGFYGATSAATTSYDKLSFADVMQFADFGPKLALNQAKNCEESAIDPVYFLKFPVLNNKMEEDQQNMMMNNDDPDGDEAENHHHDERFNNLVSVEDKEGMMVREDEETTRVSDDNNSVQIRFLGHEEPQQKNNCAVQENKNGKRKRPRTVKTSEEVESQRMTHIAVERNRRKQMNEHLRVLRSLMPGSYVQRGDQASIIGGAIEFVRELEQLLQCLESQKRRRLLGEAQARQVGDPSLATQQQPPFFPPLPIPNEQMKLVEMETGLHEETAESKSCLADVEVKLLGFDAMIKILSRRRPGQLIKTIAALEDLQLIILHTNITTIEQTVLYSFNVKVASDSRFTAEDIASSVQQIFNFIHANTSMCCSRTRITCDFYSCLYEIKILILHRRLHPKSFGFTIVIVVRGD

SEQ ID NO: 172734 - protein, 79 aa, Glycine max
  Coding DNA Sequence Number=SeqID_81049
MHEKFGDIGDVGDEEALVEGGVGDEGREEELQLGLACALYIGAAASLAMVTKVKRKRSSKWDEEDFKFNIFVPPKDFWH

SEQ ID NO: 172735 - protein, 213 aa, Glycine max
  Coding DNA Sequence Number=SeqID_81050
MVRGTKVRYDVVTINKFLKTDFQDLEAQSCTYFELKDKDDFDPDKLAKVLCIPGKSYVKAKESNKAYKFKKDALRTITQISMSFAFSNVAPTLHTSNLNRQRASLIYCILANIPINIGKVISDKIHSLASSKNFGEEDSADKPLVFPALIIALCAYQKAKIPVSMEIMVVPDEGNQFHHNEEWVEVSNAREKGVEGGNDAGTRKEGSGYVDVF

SEQ ID NO: 172736 - protein, 242 aa, Glycine max
  Coding DNA Sequence Number=SeqID_81051
MTRGNPGDLEPFDPEIDRTFHRLVRHSVHPYYFEHSVHSVASDSEHSDFEHLAANFHTENMAQPPPRPLPAGMTLRGCSWRNSSLHLGPLSSEKIFQASGKWRELGLSNMEKSMIDAASGGALGDMTLVEARNLVEKMASNSQQFSARNDAIVLRGVHDVATDSSSSAENKKLEGKLDALVNLVTQLSINQKSASAPVTVARVWGLCSSVDHHTDLCPSLQQSGVNEQPEAYAANIYNRPPQ

SEQ ID NO: 172737 - protein, 129 aa, Glycine max
  Coding DNA Sequence Number=SeqID_81052
MVRGKGKGAFGCRGQAIGCSFASVITTCSTFVNIIISSNGFTFASCWMIVTQAISEILGNKLVIGCWGFDGGDKAYGYGKGWVCCSFSVMCGDADNGCGWKMMLMDKQRWDRVGVDGYCGGGCGGEGGH

SEQ ID NO: 172738 - protein, 175 aa, Glycine max
  Coding DNA Sequence Number=SeqID_81053
NDPDTSDSEIYGLYVEENSPRLVVIRKLYEGPTTVYNIPLHHDQVKVGVEEVRDADAPIPVPTEEVQLEGQTLNTFVACPTHLVKHLSEHVMWDATMFGGFNDNFPLYIKYEDLSKIAHNGQCLSIFVIQLWILHMTETSMRAGNADVYEFLEPQSIQRSGQSQFESESYIKNWM

SEQ ID NO: 172739 - protein, 231 aa, Glycine max
  Coding DNA Sequence Number=SeqID_81054
NTDLEETNALVFSLNNEKSAPDPHGFNGWLLPSLNSNLAILIPKEEGADRVEKFIPLACPCEFSLQGRYNIAEEARKCRYPGSENAIRSGTRAPPSDSPGTQTARSQTAPVRQVSARSRGDCCSFPPREAHVVDDVDIIVAVEGLQDHLVRGEVRELQLRTRLQAQFLCDANSLTNVLGQPKYILYSAKKKLREGGDDFDWNTDDELEIENYNSSSSCLTLPNGDAGEVSF

SEQ ID NO: 172740 - protein, 317 aa, Glycine max
  Coding DNA Sequence Number=SeqID_81055
  Subcellular localization annotation: CTP_CleavageSite=24; ConfidenceScore=5.21e-01
MARNPRQDFSVSKPSSSFLPSTIVAQQSFNLWCSFLLQIAKGGHFRGREVRGYKWDFENPGEVWFSKSAFCADFCCEIVQQDFAQVQKNTRLLLVVERAVQNEFWMFASRSQRVFCLCSVLLGCDSLCCVNVVLLGCCGSLRGLMGTRGWWVYARIVDVENLLCTIARPPPSTTCDGVKLPAFIVDHRVVPGDMSRGSGDLGDVRRAPGSQQIKGKQDHKARRLVVAGQLLENEVRKLREPLVIDYQPIVMAAQLIRDRVEMECLEGAWETLEGNTRCRFRGTIRFTATSLVHPDEPARTLQRTVAWTAPWISFVYF

SEQ ID NO: 172741 - protein, 172 aa, Glycine max
  Coding DNA Sequence Number=SeqID_81056
MVALVLKLHKLPKEHFWKNSDEDNWEVMMDDDDVIRDNISQLIDENTTMSCLFKEEKVLEVRKYHDSINKYKMGTRNTEALCFRWVMKVSVEMRIEDSRRRMSYTKALSECQLAKRTACILQDCLFKLKSRIWREDETERYLSLMRKPSCGALDEILSDCEVSRGGGDTSTT

SEQ ID NO: 172742 - protein, 90 aa, Glycine max
  Coding DNA Sequence Number=SeqID_81057
  Subcellular localization annotation: CTP_CleavageSite=50; ConfidenceScore=5.36e-01
MFAHSIKGCRPLGRTCGVLIPSPCVNTTPEPFNLKVRRSRLFRFFRRFPRINVGGDSARIPFVEHASRESRVALPPKGRLRQHPCWPSND

SEQ ID NO: 172743 - protein, 120 aa, Glycine max
  Coding DNA Sequence Number=SeqID_81058
MRKRIEEQPLMVKEECKKVNVSSKRLAKKESHFAIKTNIKETSLLRQPPHLLLCKRTLFSTVIPLELIAIPQVKELLDEGLVRKSLHPCALVVPKIGVPTDPKRIKVIPEWPTPPSIREI

SEQ ID NO: 172744 - protein, 118 aa, Glycine max
  Coding DNA Sequence Number=SeqID_81059
  Gene Ontology: Mol. function=nucleic acid binding; Biological process= DNA integration
  Homolog annotation: Hit_ID=Q53J63; Match level="QueryCoverage=54%, HitCoverage=14%, E-value=7e-09, Identity=42%"; Hit description =Retrotransposon protein, putative, Ty3-gypsy sub-class
MELFLLRDGLREEETTSIARFLSGLNMEVRDKVELHSYRDLDELIQLCIRVEQQLKRKSSSKSCGLHFYPRKDQPKEFWGLHLQNPRKLRETTSSPSSSGSEDEVRGEESIEEVYPHE

SEQ ID NO: 172745 - protein, 120 aa, Glycine max
  Coding DNA Sequence Number=SeqID_81060
MEEIYGEDDEEQEIKNFLINGVLCFLMINDRRMEKEERLLETSLQGEDESRTCLPPLEAMDKTLKEEGDVAPCGACRPWIFFINGVLFFFNINVSGMENKERRLETPLQGEDESRTSLPP

SEQ ID NO: 172746 - protein, 48 aa, Glycine max
  Coding DNA Sequence Number=SeqID_81061
MDKSLKVGEDEWREKERRRKELWFNPLIQDQVQDSLLSVLRGHKACKA

SEQ ID NO: 172747 - protein, 187 aa, Glycine max
  Coding DNA Sequence Number=SeqID_81062
  Homolog annotation: Hit_ID=A5BXY0; Match level="QueryCoverage=67%, HitCoverage=9%, E-value=1e-12, Identity=34%"; Hit description =Putative uncharacterized protein
MTRGNPSDLQPFDPEIDRTFHRLVRHSVHLDYPEHFVPFEHPEHSVIGESDHFVVGYFEHPDFEYSDFEHSENITQPPPRERTLREMAAPDFTYESLCIQYPDEDVPYVLKTGLIHLLPKFHALAGEDPHKHLKEFHVVCSTMKPPDVQEKDHIFPKAFPHSLEGVTKDWLYYLAPRSITSWDDLKR

SEQ ID NO: 172748 - protein, 185 aa, Glycine max
  Coding DNA Sequence Number=SeqID_81063
MASQQLINGINKESEKNKGRNVGPKDHTKGDQIVKNMSGSSRVESTLAKGGDIQIGGKSNFKNNNSTTIKYKKKASEELVMLVASKETRDISKGGAEDIKGEGQKGHFRDFLVPGSPRLASGSPGPPNNFMVKSRGEGLGKRREKKKEEEKKKLNRRRTTTTIDFYIVLRLYFIHSSSVLRSSSS

SEQ ID NO: 172749 - protein, 263 aa, Glycine max
  Coding DNA Sequence Number=SeqID_81064
MSTTKFEILSRQPKVTPLLNRRFMKGRSDMRVQPNASFDFERLLKAYIKGIIFPLFLHLLYVFLLPSASFSSLVVFVLFGQPFPFDILPFYSLVISINLGTSSAYLFYVSFWEGEAKSPLPIPFQGVVDIDSKTIVVQVSRRNMITSLSRGLKPRRPRQSCKRPKMPKWFFIWILLLYPLTLVDHDMLREDGPKASKDAIAHFQARTWGIVEFWSDEYEKAFHESQKAQEDLTKAEMELVEPNNTTETLMQSTEESHKSLEDT

SEQ ID NO: 172750 - protein, 1658 aa, Glycine max
  Coding DNA Sequence Number=SeqID_81065
  Gene Ontology: Mol. function=translation initiation factor activity; Cellular component=eukaryotic translation initiation factor 4F complex; Biological process=regulation of translation
  Homolog annotation: Hit_ID=A5CBT6; Match level="QueryCoverage=99%, HitCoverage=99%, E-value=0.0, Identity=46%"; Hit description =Putative uncharacterized protein
  Pfam annotation: Domain name=MIF4G; Domain location=1197-1419; Score =217.0; E_value=4.4e-62; Accession=PF02854.10; Description=MIF4G domain
  Subcellular localization annotation: CTP_CleavageSite=91; ConfidenceScore=5.55e-01
MSFNQSKSDKSDAVYRKSGRSGSFNQQRGPFGGAYGKGGGGGAGPSPSLSSSRSFNKKSNNNAQGGQSRVNPTPVNSTESNSTYAARTVPNGSYVQPQIHGGSDAPITNATAKSSELLAAQRSSRAVPKAPTSQPPSMSPDPAAPTTPAKADASKAFPFQFGSISPGFMNGMAIPARTSSAPPNIDEQRRDQARHDSLRPVPSMPTPPVPKQHLVKKDTGVADQSNAGEIHTGIRAKKDTQMSPLPPASQMQKPSVISLSGMSMPMPYHHQSQASVHFGGPNPQIQSSAPLQMPLPMPLPIGSGAQVQQQVFVPSLQPHPIHPQGIMHQGQSMGFTPQIGPQLTHQLGNMAIGISPQYPPQQGGKFAARKTTPVKITHPETHEELRLDKRTDAYSDGGSSGSRHHSGMPSQSQPAQQFAASHPINYYPSSSYSTNSLFYPTTSSLPLTSSQITPNSQPSRFNYAVNHGPQNASFINSSSHSSLPVNKAGTSIPGNAESPNPEIFQDVHNTILSAPSGVTSVSIKPTGGSGVVVDSSFSNSSTQKSGSSSSSLTSSDAFETTEITSQQSKVSSDSSVLSSLPSLSAASTMKPTSASLLLPASAVSEDSISVLPNNEGGKKESLSRSNSLKDNQKKIQKKGQSQHQVAVQSPSVVNVPFQAVDGDIPDEVSETVGTKTNHSAAITSEDLSAAASDTLSATIESLTCAVEMKTNDSTQVSACASAEGPVTQVMDNLNNHKIAELDELSHQDKPLQPNILEMGGKTENLSLQGSKQSVSDGGTELKQPKKGTVKLSTEFVTLKTKESTSCSAECDTTADNNGMSVSTKLDSKDVCLNRNDSVVSNEAVSSNSGTSDQQSADLLEATSKQCKDDSAENAGSVSVSLPASGTKDRPISESSKVKPTSKGKKKRKEILQKADAAGSTSDLYNAYKGPEEKKETIISSEKTESGSTSGNLERLPTDTAQPDAVANEQSKQSKAELDDWEDAADMSTPKLEVSDETEQVSDGSAITAKKYSRDFLLKFAEQCTDLPEGFEITADIDEALMSVNVSSHVIERDSHSTGRIIDRSGGMSRRGSGVIEEDKWSKVSNAFHSGMRLDGVGGNAGFRPGQGGNFGVLRNPRTQTPLQYAGGILSGPMQSMVNQGGMQRNSPDGERWQRATSFQQRGLIPSPSTPQTPLQMMHKAEKKYEVGKVTDEEQAKQRQLKGILNKLTPQNFEKLFDQVRAVNIDNVVTLNGVISQIFEKALMEPTFCEMYANFCFHLAAALPDLSQDNEKITFKRLLLNKCQEEFERGEREQEEANKVDEGEVKLSNGEREEKRTKARRRMLGNIRLIGELYKKKMLTERIMHECIKKLLGQYQDPDEEDIEALCKLMSTIGEMIDHPKAKEHMDAYFEMMRSLSNNMNLSSRVRFMLKDVIDLRKNKWQQRRKVEGPKKIEEVHRDASQERLAQASRLGRGPGNNPPRRIPMDFGPRGSSMLSPNAQMGGLRGLPTQVRGYGSQDARMEDRQTYEARTLSVPLPQRPLGDESITLGPQGGLARGMSIRGPPAVSSSTGLNGYNNLSERTSYSSREDPASRYTPDRFAGSTAYDQSSVQDRNMNYGNRDLRNANRILDKPVVTSPARAQGTAASQNISAERLQDMSMAAIREYYRVGLVEWKRMERK

SEQ ID NO: 172751 - protein, 170 aa, Glycine max
  Coding DNA Sequence Number=SeqID_81066
MVASGGSNLARLGKLGGKLLPYFAINSGRSEEGKGSAFLTLHIHLKLLRKIVYVKKIQAEALPNVSVGDFAKIFSRSSSFIVCSSLFFDLQPTNVRGANTFLKRKYNSRIWNILHDRFPSVFPTFSTNKRWWRLCAFSSFGRRTREHRLTRPQKGRLRQLATPLGTVFVS

SEQ ID NO: 172752 - protein, 51 aa, Glycine max
  Coding DNA Sequence Number=SeqID_81067
MTKTTIDTSEPYTGAMRGTMHEPQANLGADQNFSPRTIAKPAGGAIPTTHA

SEQ ID NO: 172753 - protein, 502 aa, Glycine max
  Coding DNA Sequence Number=SeqID_81068
  Gene Ontology: Mol. function=RNA-directed DNA polymerase activity; Biological process=RNA-dependent DNA replication
  Homolog annotation: Hit_ID=Q9LDL8; Match level="QueryCoverage=30%, HitCoverage=24%, E-value=2e-14, Identity=27%"; Hit description =Putative uncharacterized protein AT4g08830
MGSLKALSPDAKVEKVNKTFITLIPKKDEDIGLPDNIVQLIGGCVSMALMRVLWNVSLSTHFDCSGPRSLTSSGQKINLDKSRMFFSKNIGRNLKQQISSEVGTQWTDDLGKYLGLLAFARRVTLAKSVLQALVTYIMQTTLFPKKRYVNQAFMLRANWQFCQMEAPIWASILRNKYRCGADSFPTVDSKRAVNFWRDCWIPRSFPLIDSYAEAIPESKMEKKVSDYVGINGNCDGNFALRAAYEEIIHKACNWVRAYQEAAAIYKSISAFNLVPGEIALNCDGAVTDGGNKSACGGAIYLGLKLAGQEAFARSEWIHARTEEVVDEVDSKGPRSKRGYHRGGVGDVDEDEVGVLAPIEMAARDGELRVFLVASEVSGDSTASCLMASLKILSPFAIHFAAKTGGDYASPLSSKLFCTSSSNESQSYNGLLNDAEITNIVPRTRSLSVTIYPCCLERDTAKVFGITAREPWWRKVADMERISKQPWKVTMATVALMGVKEGW

SEQ ID NO: 172754 - protein, 68 aa, Glycine max
  Coding DNA Sequence Number=SeqID_81069
MKYRSSYRRSVEGSAACYGEVVSATGVGDAGVASRDFSEVAAASWVTATLLFLIKGSGVEDSDDSSSG

SEQ ID NO: 172755 - protein, 65 aa, Glycine max
  Coding DNA Sequence Number=SeqID_81070
MSVKNLVGHLGGDQSRSHCFGRMLQPCGIGTGLKEHSNWVTPKAYTPKSPSGPLPPDSGPTHKTF

SEQ ID NO: 172756 - protein, 86 aa, Glycine max
  Coding DNA Sequence Number=SeqID_81071
  Homolog annotation: Hit_ID=A5BS07; Match level="QueryCoverage=80%, HitCoverage=8%, E-value=3e-08, Identity=46%"; Hit description =Putative uncharacterized protein
MEAISYASIVGSIMYAQIYTQLHISFVARMLGRYQSNPGKGTLESCKEGAQIDSLKGCLRLTVKSKELRRSLKAHLNDEEYFPLST

SEQ ID NO: 172757 - protein, 200 aa, Glycine max
  Coding DNA Sequence Number=SeqID_81072
MVADKVCPHLPVWDAAKKQGFELYYKAQMPYRHMKIVWMDSKKSSTPTYDGSDVVVPHNNVQLLRPLPSIPYRGNYNLKKMTEAQMIAHVTPIHEAQKKRRAEATAAKIDEQEAVTTVQVEASAKVMDDTIIGETSNAVMDDEVEPLISDPASKQSTTSNDATFRDKGDHDVVIVYFTSSVPTLSIMHNPSLSLVIRFKI

SEQ ID NO: 172758 - protein, 307 aa, Glycine max
  Coding DNA Sequence Number=SeqID_81073
  Gene Ontology: Mol. function=catalytic activity; Cellular component =cytoplasm; Biological process=metabolic process
  Homolog annotation: Hit_ID=A2Q5Z5; Match level="QueryCoverage=38%, HitCoverage=5%, E-value=1e-45, Identity=73%"; Hit description =Putative uncharacterized protein
MVISKVGRINIVGNSNISRFDQPCWKTRRGGWMALCGILLCITGSEAMFAGLGHFSQLSIKVWLVDSKGLIVSSRKNSLQHFKKPWAHEQEPINSLLEAIKVEKGLSKDDKAQKLPLRHWLEPGVCWLLLPPVQLIVGISHVSWVSLPFFIGSSIGLVDWSWTSSYLGIFRWWRYLLFYVGFNIILVYICQLPIEFPETFKWTFYHFGLFKLSTKLEWSEVFSGLSLLLFYIMVSLLATPLTAEVAKRLGFVNHIVEEAQLLKKSREVADAIVKNNQDLVLRYKAVINDVLKLDLGRTLSLEKVRVV

SEQ ID NO: 172759 - protein, 46 aa, Glycine max
  Coding DNA Sequence Number=SeqID_81074
MAAEWRRRKSDWRHHFKEKLWFSPLIQDQVQDFPLSVLRCHEECKA

SEQ ID NO: 172760 - protein, 111 aa, Glycine max
  Coding DNA Sequence Number=SeqID_81075
MVMPILGSRDFVSDRDMFCMYKVVMGEKEKPSQPKPKLLNKRKDPPPPHFNPKSPDHKPNKLKNQPPSDPKPSDPRNSQKIKVLDSKFELEFEPTPKGPTIKIKHPQSTPS

SEQ ID NO: 172761 - protein, 129 aa, Glycine max
  Coding DNA Sequence Number=SeqID_81076
  Homolog annotation: Hit_ID=Q69F85; Match level="QueryCoverage=44%, HitCoverage=3%, E-value=1e-07, Identity=50%"; Hit description=Gag -pol polyprotein
MEETYMFRNKVRQAGQKRDRRERITKTDSRKSDKRHKPDKCQPFPKRSKYERHTPLTANCTTILEEAFNMEVPIKLPPMKPPWTRDFKCINPINQDDPMVVSIIIANFMLSKDLINQGSSTDILYWKTF

SEQ ID NO: 172762 - protein, 520 aa, Glycine max
  Coding DNA Sequence Number=SeqID_81077
MSSFLSDSAISMSGNDSGGSIQQPLMDREAYEILCPFFNIWPSVPVFMFFFLTKLTNKIGWVLAANVGVDGLPLMFNRDGDPRFPFYWQFDPTRPFLKQDELVGGTVPPSMVPPTIGEGGQPSGEVGPVVGIVEVTPNAPSSVLAKRNQDDDVGVSGHKKVDAWFGSPFKFTRCAFNSAQGGVLGGGECPKVANTTIAFAEAVRSNHQLSSKVGSVLAKLLRQGIATEMEKLAKVVAELEAGLKELESKMGESELWVSKEREASKELEGELIDIRQAGFFANDIDLGLFDPFKDVKDDVLLDEEDIAVEEEAVKEEASEEAQDVGANEADLGDLGSKALVVLCEVKSVICTRLKVLPNSLVVVRFVELGLLNVVFMVLKETYFGFYEPVKLTKDVSVLDFGETRQGQTLDLMSLVCVVYVSCSCIHVTHGAVCPGDVVLCSCICVTTEVSCTGDMMSCSCIRVTHGVTRTRGLTKGEPWVLQALWRNDQRRVHHGFWQDSPRENLGFDEPVELGPWMYLS

SEQ ID NO: 172763 - protein, 97 aa, Glycine max
  Coding DNA Sequence Number=SeqID_81078
MELTSSRLQYVPTPRVTQAARTTLVQAGRLNKLDKLATLSCRGHHPQHQMTLAHARGLNRLVNLLLIKATTLDIRQSPSPQDNLLRYWTTFFTRKAA

SEQ ID NO: 172764 - protein, 229 aa, Glycine max
  Coding DNA Sequence Number=SeqID_81079
  Gene Ontology: Mol. function=aspartic-type endopeptidase activity; Cellular component=extracellular region; Biological process =proteolysis
  Homolog annotation: Hit_ID=Q9LI73; Match level="QueryCoverage=99%, HitCoverage=49%, E-value=4e-68, Identity=60%"; Hit description =Chloroplast nucleoid DNA binding protein-like; nucellin-like protein
  Subcellular localization annotation: CTP_CleavageSite=51; ConfidenceScore=5.30e-01
MGLGRGPISFTSQLSNTNTKHTFSYCLLDYTLSPPPTSYLTIGPTPNDAVSQNSFTYTPLLTNPFSPSFYYISIQSVSVDGVRLPISESVFRIDAHGNGGTVVDSGTTLSFLAEPAYGKILAAFRLRVRLPAVESAATLGFDLCVNVSGVARPRLPRLRFRLAGKAVLSPPAGNYFIEPAEGVKCLAVQPVRPGSGFSVIGNLMQQGYLFEFDLDRSRIGFTRHGCAVR

SEQ ID NO: 172765 - protein, 101 aa, Glycine max
  Coding DNA Sequence Number=SeqID_81080
MNEKLWDGTQKPSNISVNLALQHLLHQALSWEFYCCQNTMLSGRSFTSGSRGNSIAYSGELCPLHRRDPFASFSLYATAHRVGNTSGQAKLSLTRCGLSLN

SEQ ID NO: 172766 - protein, 517 aa, Glycine max
  Coding DNA Sequence Number=SeqID_81081
  Homolog annotation: Hit_ID=A7QVM9; Match level="QueryCoverage=83%, HitCoverage=99%, E-value=2e-91, Identity=46%"; Hit description =Chromosome chr14 scaffold_190, whole genome shotgun sequence
  Pfam annotation: Domain name=DUF593; Domain location=195-287; Score =145.6; E_value=1.3e-40; Accession=PF04576.6; Description=Protein of unknown function, DUF593
MGTVMQKISAIFSSLAGLIKSLCLLLYTQLPYDLTTDEVGTKSKQRITTDCGEIIELVDKLTTSEAGLESTPFSSDIGQQNPNLLDLGDAYKLAVSNSRGRPGMLVEHWLGKDSTRISEDLKILLSQFSATRGTDLSVNDISPRLSINSDEVKTSDVSNSAGIQILQKMISLERNEYGLSLDGSLVSEIEGESAVDRLKRQVDHDRKLNALYKELEEERNASAVAANQALAMITGLQEEKATLHMEALQYLRMMDEESEYETEALQKANCLLVEKEKEIEELEAKLELYRKKFPDESVLESMVDTNSEMKDESILGKSVSENTNISDKSEVLPTSLEKQNVQSVKNSPLEFQDERLYISQRLKKLEKQVYFFLNIHQSRDNWLNSENDEKESLENCEKLDNNILMQETVCSPKLNSDDMGDDSSSKEPPVCKQNGELGYNGHSSPALCRNNDLSSTGSLVSDFIGRLQVLEADLSFLKHSINLSSNGEEGLKLLQEIADQLQQLRQIGIRELDQPFA

SEQ ID NO: 172767 - protein, 142 aa, Glycine max
  Coding DNA Sequence Number=SeqID_81082
MSFSGEGSICSGDSRMLLLEVRLIRESFNDDPAHLHCGSNFASDQSSDIRVGGAIVGGVVVPLSAGVVAPTGGIATGIRPHPYFGVRSTLMEDEAESTRPNWRKRNRMKTVQVEDSISSPSLMFGNSIGAVGGITEGISGNR

SEQ ID NO: 172768 - protein, 148 aa, Glycine max
  Coding DNA Sequence Number=SeqID_81083
  Homolog annotation: Hit_ID=A7PT07; Match level="QueryCoverage=70%, HitCoverage=6%, E-value=5e-09, Identity=36%"; Hit description =Chromosome chr8 scaffold_29, whole genome shotgun sequence
KESRIPADLKYFSSFALSWIFSWQYRYGKTENSKQYPPLQRHAFVKWWSQFDTSKAAPDQVKNWFQSNPEFLKPADPETSLFLNQKSQLAAFLASSKSKESLAQNLKEVLQLLQQEVEEEPSKKEAESSETNDDQEDDPFYQNEEYCF

SEQ ID NO: 172769 - protein, 101 aa, Glycine max
  Coding DNA Sequence Number=SeqID_81084
MNPRNVGPLCSMFNQEDLLLKTVTKSRSLEKLFADAMIASGQVYTLIATKFITEEETKSNTHFVQQFDRQRFQFQVEERVNTRKVSNDEIHCQAESKNMRL

SEQ ID NO: 172770 - protein, 133 aa, Glycine max
  Coding DNA Sequence Number=SeqID_81085
CDNSLPVCYLCLDPVMISNFVFVGADGPFLSLHHVSGGGATNTASGSVGLRVFVIVDDDEGDGDRGGLGFQGIRDWSVVVAVLVVGNTEVTENEGMGLVFGREKGMEWIITFVLFEPPLEAGGDHGLYKEEDG

SEQ ID NO: 172771 - protein, 114 aa, Glycine max
  Coding DNA Sequence Number=SeqID_81086
MATVVALAVDPSLVPEKKHQFEIEIGTPPPPPPPQNPRFENPRSGAASQISSSNPPSGKTLIRVDFFDGRNLDWAKSEDKAYGGRNQPPWQRSRETEGARSSKGPRVRVRRDLN

SEQ ID NO: 172772 - protein, 40 aa, Glycine max
  Coding DNA Sequence Number=SeqID_81087
MEKETHTKTTSQGDESQNVSSPYYLHPGESLGIVDAIAFD

SEQ ID NO: 172773 - protein, 165 aa, Glycine max
  Coding DNA Sequence Number=SeqID_81088
  Homolog annotation: Hit_ID=A5BP48; Match level="QueryCoverage=63%, HitCoverage=40%, E-value=4e-10, Identity=67%"; Hit description =Putative uncharacterized protein
MASRVIEHKLRTVGKISQSPTSFVLLFFLIHGCLWLSGILGSIAYNWSRPNMKTGVKIIHASSPPDNIFLQFLWFLFGSGCLWLSGMSGSIAYNWSRPNMKTGVKIIHASSCYGKVPITRKVEGTSTWFFKENKGGYIPCGSLACKGFYKVERNIKNRRLLGDWM

SEQ ID NO: 172774 - protein, 103 aa, Glycine max
  Coding DNA Sequence Number=SeqID_81089
MSPPPLEPHNHSQTHLELLGRLPLQASFSAGGIVGACALSATLARLARISEFQLSAYLFAQRMDSSGALSGISPRSSNMHNSSFFQILPRAQPKECCAQRMAL

SEQ ID NO: 172775 - protein, 176 aa, Glycine max
  Coding DNA Sequence Number=SeqID_81090
  Subcellular localization annotation: CTP_CleavageSite=78; ConfidenceScore=5.44e-01
MHFEYPGQYIIPSSSEPACGQKRLSSVKGNCLMSGVVALTLTSLSCLSSPRPGQVLFGLLLSSCPRWTCFWFCRRGLTCQEDTHHGASDSESSSSERLRVSCRVGGGASCLYGRVQPSVASPTGESVPITMILPLLLQGDQGTMVAGMLGCPPVCGIAIVLGRHRLRHPLPHTYMY

SEQ ID NO: 172776 - protein, 249 aa, Glycine max
  Coding DNA Sequence Number=SeqID_81091
MVLFHLQEGEIMLRKWMMERDTLGYSGKRVGSLGIGVRCIHMWRSLPIVIHININVKDHQDLGGFAAKEQRTHPYNQQLSGIDDVEDVDALTSLVCLPVLGLEEPRHDLEFKLTSVGYDRQGNAFSYHVEPVSIIEVTEDRGDHSDKTFEEIKENKELLRQLEPLSEEQCDDPPRTSLRYLPCHSILHKPHDRHMRSIVMCPQGHQETERVVVAPGAPHATHDQHSLQAPLAQQDPKALSLELLHVTFD

SEQ ID NO: 172777 - protein, 81 aa, Glycine max
  Coding DNA Sequence Number=SeqID_81092
  Homolog annotation: Hit_ID=Q69F85; Match level="QueryCoverage=85%, HitCoverage=3%, E-value=3e-07, Identity=50%"; Hit description=Gag -pol polyprotein
MEGTKTLNELGAIVSIEHLKMKFSTLMGEIMTVKADQKHAQQCYAESLKVALYPPTREPAKLYPTADGTTQIMSVDEGSPV

SEQ ID NO: 172778 - protein, 298 aa, Glycine max
  Coding DNA Sequence Number=SeqID_81093
MILVEVREPLIKRLFFQEQQNEEKREPKACQTKGRKTQGTPLESLSKTQDGRVIDQSKGSQNPRTNNSLVGSPKAHKTQGPPLVSLVSPKAHQTQDPPLVSLASPKACQAQGQSLVSLNSPKARKTQGPPLARKTQGAPFVSLASPKARQTQGLPLVSLYSPKARKTQGLPLVSLAKIQDERIADRFSKGSSNSRSALGESLFSKGLSNPRNIKIPRSALGTKTQGSPLVHTLTKHKAPLWSAHSLRTTTTTVKGLGSTRKTTIRLVGKSFNQVEVILTPYNHQGKSSAKDKETPLDE

SEQ ID NO: 172779 - protein, 362 aa, Glycine max
  Coding DNA Sequence Number=SeqID_81094
  Homolog annotation: Hit_ID=A5AZG1; Match level="QueryCoverage=29%, HitCoverage=33%, E-value=6e-07, Identity=31%"; Hit description =Putative uncharacterized protein
  Pfam annotation: Domain name=zf-CCHC; Domain location=132-149; Score =22.6; E_value=0.00058; Accession=PF00098.14; Description=Zinc knuckle
MKREKHVSYSSHNSCKSLSEELRDYYEVRHRSHLRPYSHRRENERKSQEANINLSYFHGKDNVEAYLDWEIRVEQKLKRNTTLKSYGSHSYPKKDQGLGILGVAPSKTKDNKGKTIEKQPPKASMQEKISSIKCFKCLGRGHITSQCPTKKTMIMRSQDIYSSQDEATTSPSSSESEEAKWEESSEEIYPQKEGQPLMVKEECKEVSVSSKRLAKKERHFEIKTNIKEISPLRQSQHFLLCKKTLVSIATSLGLKFIPQVKELLDEGLVRKSLNPCALLVPKIGIIRHQIPKIGGMMNVLSGATLFCKITRAPNIFMICVHRDSLGSDQGVLMNPKRIKIIPEWPTPPSVKEKSQSFKNLGI

SEQ ID NO: 172780 - protein, 98 aa, Glycine max
  Coding DNA Sequence Number=SeqID_81095
MRCLRMSSDLLSPDDEGETKVVSVFFHQAINTNGRGVHNHSRKESKQRKKKRKKKRKNQRNKKDDKESKEESAPPEIVQGITFAMHGHFKHDFWHLLS

SEQ ID NO: 172781 - protein, 71 aa, Glycine max
  Coding DNA Sequence Number=SeqID_81096
MARRLQKDWARNAREGPRVLMSLRWCLQSPFLLRHSTAIDLQEANDSIDEDDPRPTCSTWSYIMWYQSIII

SEQ ID NO: 172782 - protein, 44 aa, Glycine max
  Coding DNA Sequence Number=SeqID_81097
MLEKPKDDGLRILKMTGSGVVFTHREGFFMHYAAESVKHLKVVN

SEQ ID NO: 172783 - protein, 60 aa, Glycine max
  Coding DNA Sequence Number=SeqID_81098
MYRQQKSLYHPIYFSLSTTEWNAGERNRREGMTWREGKEGVWVERKAKEKRRGEAPSTRE

SEQ ID NO: 172784 - protein, 144 aa, Glycine max
  Coding DNA Sequence Number=SeqID_81099
  Gene Ontology: Mol. function=transferase activity; Biological process= protein amino acid phosphorylation
  Homolog annotation: Hit_ID=Q4ADY5; Match level="QueryCoverage=54%, HitCoverage=21%, E-value=2e-27, Identity=74%"; Hit description =Spermine synthase
MEDGVGRGLECPKTMDGKASNRNGLEKDIPSCCLKARAPIHESEVKCHSTVVSGWFSASQTCPEKFRKSVYFNNLMWPGVLPDGQEIEIKRLSSRSGQGLVEFKNEAELVAKLQHTNLEVALEEMKKELKARPKSGKWLQVEKR

SEQ ID NO: 172785 - protein, 69 aa, Glycine max
  Coding DNA Sequence Number=SeqID_81100
MEESEASQGVMGPDCNARWDVAIDAPQPCLHPVDPFVVVIVVVTIAHHVVVVAVVGCAHYTHNQSPDIE

SEQ ID NO: 172786 - protein, 185 aa, Glycine max
  Coding DNA Sequence Number=SeqID_81101
MVEVLIKYFQALFPRSNLIGVQKVAGGVGRRLTEEMLEVLNGSFTEDEVIEEGGVWRIGNEHNFDASKQDGFLSPACQPMIVHGLEEEFMMHTLVSYIKVQTFWFSSPLGLCIDVERFTDFQEWLASCIRSAKEEEKEEASRGSIDVFETPVIWKAPRAGMYKANFDASVRKGVGVGMRLILRDD

SEQ ID NO: 172787 - protein, 67 aa, Glycine max
  Coding DNA Sequence Number=SeqID_81102
MKKQQWKISGRQRRRGEKRCHPLGNKPWKKELRHQECALDKKLGEDASMEEKKEREKERGGSTKLKE

SEQ ID NO: 172788 - protein, 225 aa, Glycine max
  Coding DNA Sequence Number=SeqID_81103
MIDQWNNRHAFRVDAYPRQEGLLSFNSDYMVWYRRKTKMFVDPQNANTTALAEVAETLQYMVSPQGRNTWTVDDLVPYVEKITILSEEQERITEPVSHGPASERQFLAQHYHILQSSVETQGIASRRKAVEAEEYSQKMAEHDHGMYYTPQTFAQYPTQMYQYPFQGHHTDTSASQHSFGGVAETQSHFSWPKEILIAKHEDGIDHVAHSHGITDTKMNDLHVSV

SEQ ID NO: 172789 - protein, 221 aa, Glycine max
  Coding DNA Sequence Number=SeqID_81104
  Gene Ontology: Mol. function=phosphoenolpyruvate carboxylase activity; Cellular component=cytoplasm; Biological process=carbon utilization by fixation of carbon dioxide
  Homolog annotation: Hit_ID=Q6Q2Z9; Match level="QueryCoverage=100%, HitCoverage=21%, E-value=1e-93, Identity=77%"; Hit description =Phosphoenolpyruvate carboxylase
MTDTTDDIAEEISFQGFEDDCKLLGNLLNDTLQREAGSTFVDKLEKIRVLSQSACNMRQAGMEDMAEMLEKQLASELSKMTLEEALPLARAFSHHLTLMGIAETHHRVRKGGNMVLTAKSCDDIFNHLLQDGVSPDELYNTVCKQEVEIVLTAHPTQINRRTLQYKHLKIAHLLDYNDRPDLSPEDRDMLIEDLGGRLSSNVKWTDELTRSKPTPVDEARA

SEQ ID NO: 172790 - protein, 55 aa, Glycine max
  Coding DNA Sequence Number=SeqID_81105
MKSESAKEMDSGELIGMGEKPGGTLGAREEWEEECWDDGGVGLVDGGDRLGLRLK

SEQ ID NO: 172791 - protein, 63 aa, Glycine max
  Coding DNA Sequence Number=SeqID_81106
MVDSPRTNKMTKQQRPTKCDPSYWEYVDALHSVKNSSSTLKCSTSSFEQTKPKRKMPMLVQNA

SEQ ID NO: 172792 - protein, 221 aa, Glycine max
  Coding DNA Sequence Number=SeqID_81107
MQCGTFSVKNLVGRPRVHDKTNHTLPTTAHFPLLYSTNDHKVKKTYIALGISPPPNWEQVTIRVSHEGPNLASGKSMLYLMLDSCYWVVLLFYPWRLPSRCCQSTDKGSFKEVVLCRSDDVGWGIVLGRAQWCWMTRVVQGEGSIKEDVGRRALGRQVSGDEKEAPQHRRPTTSTHRQWAVTVVAEDVENMDNVANVSHEEPYDSVIENVGGDSQDFPSGP

SEQ ID NO: 172793 - protein, 45 aa, Glycine max
  Coding DNA Sequence Number=SeqID_81108
MPSTRLLVMKGVLINEYQGTPNVWVFRHVEYLNTDEEWFRELALL

SEQ ID NO: 172794 - protein, 49 aa, Glycine max
  Coding DNA Sequence Number=SeqID_81109
MGVAAVKVKFPASSFAVVGGQWRQTRCLSAERMFCGGLDPWLMKTDLWR

SEQ ID NO: 172795 - protein, 83 aa, Glycine max
  Coding DNA Sequence Number=SeqID_81110
MFLVFNSAFKGLDDTPQPKSKAGAWWIVVKCNRQKGSTECGYYAMHWMSTIILGTFRNNWETYFNDVRPLEAKRLKSLRIHWT

SEQ ID NO: 172796 - protein, 48 aa, Glycine max
  Coding DNA Sequence Number=SeqID_81111
MPCTTTTFKTDDFCERIREIQVVGDNLGWGCLVRSYMQMTSKQQKREV

SEQ ID NO: 172797 - protein, 131 aa, Glycine max
  Coding DNA Sequence Number=SeqID_81112
MDVAEESRGITQVKLSQPTLLRASEARLTGVSSKGGKCAESPPTFICGKRQKNRRKLVMKNIPDSGVVFTFEEGRQKRGFCSYVPSIEEEIRPTYFFLKGKSSDSFYLEGGLFKALDLKMTHFYLVKKLRY

SEQ ID NO: 172798 - protein, 137 aa, Glycine max
  Coding DNA Sequence Number=SeqID_81113
  Homolog annotation: Hit_ID=A5BCD4; Match level="QueryCoverage=78%, HitCoverage=29%, E-value=6e-21, Identity=48%"; Hit description =Putative uncharacterized protein
MVTRLQDEKLNKVILKLADAKVVLWSIQEVCSNKEDKKNTENLSSVGRKRGRVKLKKLPLSICTSKDRAQPMEGVRARSAPLTEMNTGGNHHPVGNIPLFPMEPSTERVIPIEATTTCKCQEFKAPACIKQNKAVQS

SEQ ID NO: 172799 - protein, 72 aa, Glycine max
  Coding DNA Sequence Number=SeqID_81114
MDLGWTRMQFPVRQKCCGSKTVVTIVYGKPKKLLAESRTMSLSLRRFVALPKIVQADYQPRRPQDKIAQITV

SEQ ID NO: 172800 - protein, 88 aa, Glycine max
  Coding DNA Sequence Number=SeqID_81115
  Homolog annotation: Hit_ID=A5C3T2; Match level="QueryCoverage=100%, HitCoverage=12%, E-value=2e-18, Identity=47%"; Hit description =Putative uncharacterized protein
MDIDYAIRKDEPTAITDESSPADVALYERWERSNWLSVMFIKNKISAEIRGSVDQDEKEEERLVMEMGESALLKTAYGKNKITKSQAN

SEQ ID NO: 172801 - protein, 530 aa, Glycine max
  Coding DNA Sequence Number=SeqID_81116
  Gene Ontology: Mol. function=ATP-dependent helicase activity; Cellular component=intracellular; Biological process=transport
  Homolog annotation: Hit_ID=A7QXE2; Match level="QueryCoverage=93%, HitCoverage=43%, E-value=0.0, Identity=88%"; Hit description =Chromosome undetermined scaffold_221, whole genome shotgun sequence
  Pfam annotation: Domain name=DUF1605; Domain location=221-332; Score =102.0; E_value=1.8e-27; Accession=PF07717.7; Description=Domain of unknown function (DUF1605)
  Pfam annotation: Domain name=HA2; Domain location=93-184; Score =108.2; E_value=2.5e-29; Accession=PF04408.14; Description=Helicase associated domain (HA2)
  Pfam annotation: Domain name=dsrm; Domain location=431-493; Score =44.1; E_value=4.8e-10; Accession=PF00035.16; Description=Double -stranded RNA binding motif
  Pfam module annotation: Pfam domain module=DUF1605::HA2::dsrm; Domain location=221-332::93-184::431-493
MAVMAEKWRKIWKLQEYTTNWVRRGRAGRVQPGECYHLYPKCVYDAFSEYQLPELLRTPLNSLCLQIKSLQVESIGGFLSAALQAPEPRAVQNAIDFLKMIGALDEQENLTNLGKFLSMLPVDPKLGKMLIMGAIFRCFDPVLTIVAGLSVRDPFLLPQDKRDLAGTAKSRFSAKDYSDHMALVRAYEGWKDAEREGSAYEYCWRNFLSAQTLQAIHSLRKQFSFILKEAGLVDAEANVINKLSHNQSLVRAVICSGLFPGIASVVHRETSMSFKTMDDGQVLLYANSVNARYQTIPYPWLVFGEKVKVNAVFIRDSTGVSDSILILFGGALSNGIQAGHLKMLDGYVDFFMDPNLADSFLKLKEELNKLIQKKLEDPSIDIHKEGKYLMLAVQELVSGDQCEGRFVFGRESRKPKASNDENKFTKDGTNPKSLLQTLLMRAGHSPPKYKTKHLKTNEFRALVEFKGMQFVGKPKRNKQLAERDAAIEALAWLTHTSDNNQHEDDKSPPDVTDNMLKLLGKRRKSKRGHG

SEQ ID NO: 172802 - protein, 305 aa, Glycine max
  Coding DNA Sequence Number=SeqID_81117
  Gene Ontology: Mol. function=ATP-dependent helicase activity; Cellular component=intracellular
  Homolog annotation: Hit_ID=A7QXE2; Match level="QueryCoverage=71%, HitCoverage=19%, E-value=3e-77, Identity=66%"; Hit description =Chromosome undetermined scaffold_221, whole genome shotgun sequence
  Subcellular localization annotation: CTP_CleavageSite=54; ConfidenceScore=5.36e-01
MRNSKLCAASLLIARAKSLQLHHRHVRHCFPPFSSSSATSISLFRFHHPWLSSLCNAKSLITTRLFSSYYSLEQFSDDEYDCDFENQQASSTVANVDEWKWKLSMLLRSEKDQEIVSRDRKDRRDYEQIANLAKRMGLYSELFGKVVVASKVPLPNYRPDLDDKRPQREVVIPLSLQRRVEGLLQEYLDRLQLNSAKTTDSLDDVNSTNQVKDINMDENADSFVDESVMEKVLQKRSLRMRNMQRAWQSLSVENTLEDFHSIISSYIQVGIKGGTILLCLIITDATAAVSPLFASASHRLQLWRN

SEQ ID NO: 172803 - protein, 67 aa, Glycine max
  Coding DNA Sequence Number=SeqID_81118
  Homolog annotation: Hit_ID=A8SIB0; Match level="QueryCoverage=100%, HitCoverage=86%, E-value=8e-08, Identity=37%"; Hit description =Putative uncharacterized protein
MASIHHAPYALGDTCATMTEQRIAIPRGLVHTARHTMGVAHARIRYLNHKEGDLKGRASDWSEVVTR

SEQ ID NO: 172804 - protein, 393 aa, Glycine max
  Coding DNA Sequence Number=SeqID_81119
MVTMNVGQHEHTLHDYLTLSLRITAIKAWTGQHDQKDAIQWPIIRRSCGPSEEVLETHRHSKEFTNAHDYIKLTTFPFSLTGEAKDWLSDLPKKLGTFPSLRRNHCLKLLSDSRSYEGVAHTPWLFIIEGNLMPKLTDATIGIIEVIASNANSGIGSKRIPRRPTRVHRVVVNSSSSSLAQKMDVLTKQMETPMKAKVQMMTPTPLPPVSDEFGETRHRPPKFVLEGAKRSKARPRKEEKRHTMQDMMMEHMTKSDERSEKPHAEYKKKEKATSAEKDKEVLTEEGPIKDKKAFTDSIEDVLVKVNKFIFLDDFVVFDIEVDEDVPIILGHPFLNTYDIVIEVKQALFPSVRMEDPLERVLVIDDLNWDLSSVEEEILMFLEAQSAAKPMRNQ

SEQ ID NO: 172805 - protein, 89 aa, Glycine max
  Coding DNA Sequence Number=SeqID_81120
MANGHLRLKEPIVSHFSLAKRDLAKAKVTHRGEALSICKLALAKMDLTKRELWNDNNKKNKYKLKKKRFGNAAEGLAQRARLAKQGQSA

SEQ ID NO: 172806 - protein, 141 aa, Glycine max
  Coding DNA Sequence Number=SeqID_81121
MEIGKEGEKLFAVQEMKGNKKNSSNFSSSSGFQISIWFQKIYYASSGTRKTHPTAATASRFVCGSKKYVTLQRGLGKCTQWQVPIHDGVPSIADPWFQYLHEKKLMAGDEVVFYFRFDDHAGELLIRKDIEWDKEDIHLDD

SEQ ID NO: 172807 - protein, 923 aa, Glycine max
  Coding DNA Sequence Number=SeqID_81122
  Gene Ontology: Mol. function=protein binding; Cellular component =histone methyltransferase complex; Biological process=histone H3-K4 methylation
  Homolog annotation: Hit_ID=Q1S5M0; Match level="QueryCoverage=59%, HitCoverage=99%, E-value=0.0, Identity=77%"; Hit description =Putative uncharacterized protein
  Pfam annotation: Domain name=F-box; Domain location=2-49; Score=36.3; E_value=1.1e-07; Accession=PF00646.24; Description=F-box domain
  Pfam annotation: Domain name=WD40; Domain location=387-424; Score =24.0; E_value=0.00057; Accession=PF00400.23; Description=WD domain, G-beta repeat
  Pfam annotation: Domain name=WD40; Domain location=431-468; Score =22.5; E_value=0.0016; Accession=PF00400.23; Description=WD domain, G- beta repeat
  Pfam annotation: Domain name=WD40; Domain location=581-618; Score =13.5; E_value=0.69; Accession=PF00400.23; Description=WD domain, G -beta repeat
  Pfam annotation: Domain name=WD40; Domain location=700-738; Score =23.2; E_value=0.00094; Accession=PF00400.23; Description=WD domain, G-beta repeat
  Pfam module annotation: Pfam domain module=F-box::WD40::WD40::WD40::WD 40; Domain location=2-49::387-424::431-468::581-618::700-738
MSGAPVLPRELIVEILSWLPVKALMRFRYVSETWNSLIFDPTFVKLHLERSPKNTHVLLEFQAIYDRDVGQQVGVAPCSIRRLVENPSFTIDDCLTLFKHTNSIFGSCNGLVCMTKCFDVREFEEECQYRLWNPATGIMSEYSPPLCIQFKDNNNTYYPWKCGFGFDDSSDTYKVVALLCDIKSQTKEIKVHCLGDTCWRKTSNFPAFPVLGEGHFACGTVNWLALRVSSFHYLWENVTIDHIDQLVIFSYDLMYETYTYLSMPEGLLEVPRMEPYFGVLKGCLCLSLDHMKTHCVVWLMREFGVENSWTKLLNVNYEQLLNHDRPLCMSQDEDVVLLTSYAVLALLAVASVFPCLLYFSLSLSHFTFELLATMNAPIIDPLQGDFPEVIEEYLEHGCMKCIAFNRRGTLLAAGCNNGSCVIWDFETRGIAKELRDNECSSPITSVCWSKCGHRILVSAADKSLLLWDVMSGKRITRIVLQQTPLQARLHPGSSKPSLCLACPLSCPPMIVDLNTGNTTSLKVSILEISNNGPTPTSRNKCADGITSFSPTAACFSKYGNLVYVGNSKGEILVINYVDGEVRAMVPIPGGSVVKNIVFSRNGQYLLTNSNDRIIRIYENLLPLKEEVRTLDELNGNLNDLNDVEKLKAVGSKCLTLFREFQDSITKVHWKAPCFSGDGEWVVGGSANKGEHKIYVWDRVGHLVKILEGPKEALIDLAWHPVRPIVVSVSLNGIVYIWAKDYTENWSAFAPDFKELEENEEYVEREDEFDLIPETEKVKGSDVNEDDEIDIVTVEKDPAFSDSDMSEEELCFLPATPSCDAPEQPDKFVNSSSKLVDSNNSGSPLSEEAGPNENTMNHNSSPVEDDAGGTRIKRKWKPSEKVLELQAEKMKKPTKSGKSSKSKSKYLVDEDDGIGFYGDDLSDG

SEQ ID NO: 172808 - protein, 114 aa, Glycine max
  Coding DNA Sequence Number=SeqID_81123
MIPIDVAKLRTQLRDSKFLDKQGNSMRRMNSDEHNSMWHNVEASAAKEKTMVHNVEVEPVREVEEVIIKVPYSEGVCGDAESLVIVVVMEVRRGGTQAGKVRQSKTKEAKGGGR

SEQ ID NO: 172809 - protein, 141 aa, Glycine max
  Coding DNA Sequence Number=SeqID_81124
  Gene Ontology: Mol. function=protein serine/threonine kinase activity; Cellular component=integral to membrane; Biological process=protein amino acid phosphorylation
  Homolog annotation: Hit_ID=A7PNC8; Match level="QueryCoverage=39%, HitCoverage=8%, E-value=4e-23, Identity=90%"; Hit description =Chromosome chr1 scaffold_22, whole genome shotgun sequence
KPTLDWPTRKKIALGAGRGLLYLHEQCDPKIIHRDVKAKNILLDDYCEAVVGDFGALDFGKAASEEIQVLQEQMKEAHASEMDSIKQLSFETETARREEKEMRSKTQELKQEAEKSKAVAKELEKKLELYLQQAEGAKASE

SEQ ID NO: 172810 - protein, 185 aa, Glycine max
  Coding DNA Sequence Number=SeqID_81125
MDMNVGYLISHQISLIAQHDTSRHGFPALITTLCKARGVQSNSRSLESMSPAINLAYIKKKCWNLNDPTVTFRGLRKARGKKSEAPSTSAPEAEGPSSSTLPPSSSTEIPMIPPTPSQMPFLAPVSTGDQSSSYGGGGASTAQEPVTKEPPAAAVEEEATPEQIPKPSLAPAHAPDDATPVVEPE

SEQ ID NO: 172811 - protein, 167 aa, Glycine max
  Coding DNA Sequence Number=SeqID_81126
  Homolog annotation: Hit_ID=Q9AVH2; Match level="QueryCoverage=28%, HitCoverage=16%, E-value=5e-20, Identity=97%"; Hit description =Putative senescence-associated protein
MTEGSGEGFCLANLPGDAFSLWGNFFEAKKQMMADAKFAGLLGEGRIKATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNCANQRFLSY

SEQ ID NO: 172812 - protein, 183 aa, Glycine max
  Coding DNA Sequence Number=SeqID_81127
  Homolog annotation: Hit_ID=A5BZH4; Match level="QueryCoverage=60%, HitCoverage=17%, E-value=3e-08, Identity=31%"; Hit description =Putative uncharacterized protein
  Pfam annotation: Domain name=zf-CCHC; Domain location=140-157; Score =21.5; E_value=0.00084; Accession=PF00098.14; Description=Zinc knuckle
MAFHWNFYLFYKPPTRKNHNLATNMSHHSSSVNGEGRNRSHLRPHHHRREKERKPQEANINLPYFHGKDNVEAYLDWEIRVEQQHKRKSTSKSYGSLYYPKKDQGQGILGVTPSKPKNDKGETIEKQPLKASMQEKTSSMKCFKCLGRGHITSQCPTKKTMIMRGQDIYSSQDEATTSPSSSE

SEQ ID NO: 172813 - protein, 138 aa, Glycine max
  Coding DNA Sequence Number=SeqID_81128
  Gene Ontology: Mol. function=structural molecule activity; Cellular component=flagellin-based flagellum; Biological process=ciliary or flagellar motility
  Homolog annotation: Hit_ID=A4W986; Match level="QueryCoverage=100%, HitCoverage=100%, E-value=6e-67, Identity=91%"; Hit description =Flagellar basal-body rod protein FlgB
  Pfam annotation: Domain name=Flg_bb_rod; Domain location=9-39; Score =51.8; E_value=2.4e-12; Accession=PF00460.11; Description=Flagella basal body rod protein
MLDKLDAALRFQQEALNLRAQRQEILAANIANADTPGYQARDIDFSSELKKVMERGRAEGTGVALAMTSSRHIPAQAMTAPATDLLYRIPDQPSLDGNTVDMDRERTQFADNSLKYQTGLTLLGGQIKGMMNVLQGGN

SEQ ID NO: 172814 - protein, 88 aa, Glycine max
  Coding DNA Sequence Number=SeqID_81129
MERDEKRLEYRFCCSSEENTGEEDNEGGIGAVDALILIGEIKRKMKKKKIAIYGSRFDEEMSEIGRFGGLGMEVRRKEEGAAQEILKT

SEQ ID NO: 172815 - protein, 123 aa, Glycine max
  Coding DNA Sequence Number=SeqID_81130
MLTSKISFMVMGGFHQQTLLPREENTETFSSHTSYPELRRSEFLIGGYVGARASLLSTTPFFVTMTQKLVARGDVLRLSAPLHSMTPSVIDEQRPMWPSAPFSEMSASSGGDFFKSHKLSRTT

SEQ ID NO: 172816 - protein, 330 aa, Glycine max
  Coding DNA Sequence Number=SeqID_81131
KRASLAKLPTLSGIFEELVPLSTAFKELSAYPCGRCQLSGPCLAKRPMSSRKRKSIGARPTAQYDTRRFHSFEAWTRYSDNELGRHILAERKVEIYHTELDEFKAELERRNFHKRLTNLADSSIDLALVKEFYANLYSPEGPSPKQVRIRGRVIRIDADSLNTFLETPVVLAEGESLPAYFRYCRMPTDIREIEAALCIPNRGSVLNAEGHPGKILRKDLTTLAQVWSVLSYSSLAPTSHTSDLIVDRARLIFGLVSQWDMNVGAFIHGQITGVASDSPIFERLSPIINLAYIRKNCWNHADLTVTIRGARRARARPAEAPSTSAAPPPA

SEQ ID NO: 172817 - protein, 198 aa, Glycine max
  Coding DNA Sequence Number=SeqID_81132
MSYPVIITLTFLCPSVSWCMPPTRHPLDPDKSNRDLGFPALITGLCQSFGVPITPSKVIQSPITQAFIEKYCTPRQAQGDAPQAVDALPPPHQADPAGSLGMERYLQHLVRQQAANHRGQVQIHECLYQLSLSQQGQGFAPLACPTPYQFKVEVAWPEDWPEDQTEEAPAGAPDDAEDARMDEEMTDLLGFLGGSGAM

SEQ ID NO: 172818 - protein, 176 aa, Glycine max
  Coding DNA Sequence Number=SeqID_81133
  Subcellular localization annotation: CTP_CleavageSite=39; ConfidenceScore=5.56e-01
MDQATADLSRYPSVRATSPKLLSLHRGLFKFSTRTTKSACAHPEGGPPSSGSNPDSPGRQRPLWRHFQRDKELSPEANSIIHPDPNDVRRPLAVPHCQPNGCDISREDLPIPNSSENIPVKGLPEKKDGCGKKEVSLEEEGTPAKVSLLELLMSSEPHRAFLVKVLNEAHVAQDIS

SEQ ID NO: 172819 - protein, 69 aa, Glycine max
  Coding DNA Sequence Number=SeqID_81134
TFRGEKSFFWGCSDTHPHGWRGVAFARKLRWAGPSWVTVRSQDKLTAEINQAPPLPGAKQAENVAAGQP

SEQ ID NO: 172820 - protein, 77 aa, Glycine max
  Coding DNA Sequence Number=SeqID_81135
MHGSVKNGTQRVCSVPLFKGPMWEGAKRTFLVIFPKVVISLLMVSRGIILFKEHTAAVGTTSNNMLSKRKTLDEGSL

SEQ ID NO: 172821 - protein, 72 aa, Glycine max
  Coding DNA Sequence Number=SeqID_81136
MTVKGLREKWRMENWRTALRNNFAGLQTRRVSEKSGEWRIGGQRYAITSRGSRLEGGGHMNSARQLHSWVSE

SEQ ID NO: 172822 - protein, 91 aa, Glycine max
  Coding DNA Sequence Number=SeqID_81137
MVGYTPSSFADMFFAGKRIEVGLKRGKFGHLALMKTGASEEGENEGETRVVTVIPVQSSFPPTQQCHYPANNNPSPYAPPSYPQRPSLNQP

SEQ ID NO: 172823 - protein, 215 aa, Glycine max
  Coding DNA Sequence Number=SeqID_81138
MPEHNTCQATIERLEEAVNRLTHNHSALNTKMDSIHSSLNAKIDSLLERFMAITTNPNPSTPLPTPPSPSLPRPHMKLDVPRNMAQLMNTLPSSSGWQTALWDSPARVYSVALFRGFCQNYAAKFRHFDLCPFLRWPNSPDFRRIKSSIIVVAPDWALSPHSLLFRSSQVLRRPRVFSSSTSQSRRWSFVEIRGCATTAMISGALAIAANRVCIS

SEQ ID NO: 172824 - protein, 149 aa, Glycine max
  Coding DNA Sequence Number=SeqID_81139
MGVVKKFYANLYSTEDQSPKQVRGHPWKLLRKDLTTLAQTWSVLSYNNLTPTSHTSDLNMDRARLVYGLVTGMDMNIGALISGQISTIAQSKSYRLRFLALITALCRARGVTSDSLTYESLSPTINLAYIKKNCWNVDDLTVNFRGARK

SEQ ID NO: 172825 - protein, 55 aa, Glycine max
  Coding DNA Sequence Number=SeqID_81140
MEGGIGLILDLTPKEEKRIEGLTRDPPVEYWNDFKSALRKRHIPSYYERELVDKL

SEQ ID NO: 172826 - protein, 306 aa, Glycine max
  Coding DNA Sequence Number=SeqID_81141
  Gene Ontology: Mol. function=protein serine/threonine kinase activity; Biological process=protein amino acid phosphorylation
  Homolog annotation: Hit_ID=A7P6R6; Match level="QueryCoverage=62%, HitCoverage=27%, E-value=1e-46, Identity=48%"; Hit description =Chromosome chr9 scaffold_7, whole genome shotgun sequence
MGLQLIFLLIELHLDFCTQQVHEYAGPSVFKSQPPFSSPNIKDIHAPATAPSPATLPVPSPSPRISPLGSSLKKKKTPPPAYTLILPPPPPNKDCLSMTCLEPLTYTAPGSPCGCVSELAKEIATSVLLNHTQVRIVGADAANQQLEKITVLLDLVPKGVKFDDTSAILIYKKFWYREILIDASVFGAYEVLYVHSPGLPPSPPSTPSDASGIDDGPNPGHDNNGTIMKPLGVDVPKKKKEGNNGRLIVIFVLSSSAILLKPDTSRGGGMDPGGYVKVKCIACGHRNERFVLLTAMLLDLFPVLYG

SEQ ID NO: 172827 - protein, 120 aa, Glycine max
  Coding DNA Sequence Number=SeqID_81142
MLKLVLKSLRKHSLIDDEKVWPKDAFIVKGILQDSGTLKRVAWGLDIGTRVPLTNEPFVQIKHSFAIEADVATSFSYKKDLDGQWVRKQDHQANVPYERSPSPPPRDPSSALLNDVLNEF

SEQ ID NO: 172828 - protein, 273 aa, Glycine max
  Coding DNA Sequence Number=SeqID_81143
  Gene Ontology: Mol. function=DNA binding; Cellular component=nucleus; Biological process=regulation of transcription
  Homolog annotation: Hit_ID=A7QHQ5; Match level="QueryCoverage=90%, HitCoverage=97%, E-value=2e-82, Identity=64%"; Hit description =Chromosome chr8 scaffold_99, whole genome shotgun sequence
MEGTHHLRHLHQQQQQKQRVLPQSMSSVNVDVTDRFPQWSIQETKEFLVIRAELDQTFMETKRNKQLWEVISNRMKEKGYHRSAEQCKCKWKNLVTRYKGFETMEQEATRQQFPFYNEFNAIFTARMQRMLWAEAGGGSKKNKAMTMQLSSDEEDGKEESTEAGSDRKKKKAKIVSGGGGSLNNLKEILEDFMRQQMQIEAQWMVAFEARENERRLKEMEWRQAMEVLENERIMMEERWREREEQRRIREEARAEKRDALITALLNKLERQGM

SEQ ID NO: 172829 - protein, 64 aa, Glycine max
  Coding DNA Sequence Number=SeqID_81144
  Homolog annotation: Hit_ID=A2I5F0; Match level="QueryCoverage=98%, HitCoverage=33%, E-value=6e-14, Identity=57%"; Hit description =Polynucleotidyl transferase
MEAWNRLRDIFQDNNHFRAVTLEYDFTHTTMEAFSSVSSYCQHLKSLSNQLKNISFPIDNSRLN

SEQ ID NO: 172830 - protein, 214 aa, Glycine max
  Coding DNA Sequence Number=SeqID_81145
  Gene Ontology: Mol. function=binding
  Homolog annotation: Hit_ID=A7NYI9; Match level="QueryCoverage=83%, HitCoverage=42%, E-value=3e-27, Identity=40%"; Hit description =Chromosome chr6 scaffold_3, whole genome shotgun sequence
  Subcellular localization annotation: CTP_CleavageSite=56; ConfidenceScore=5.03e-01
MVVLLKPEARQRTGCNDPQHVLPHSPFSSQTLTSAISSLHRPKCEPYFFFIILLRRGSLRRACNTSLKPFSDEELAKKIEDLTLKFQLSIENTNANDLDSEDFQEISLSSVNFAEEFELPEEIILANIERKANNVELPFSLRIMKNKLYRKEEFKEAGEFVYCFAKKAFSSMVFIFRELHSFTMPMREVLFYDVSEDPLTVKVDHLKVLLGAAG

SEQ ID NO: 172831 - protein, 163 aa, Glycine max
  Coding DNA Sequence Number=SeqID_81146
  Subcellular localization annotation: CTP_CleavageSite=86; ConfidenceScore=5.71e-01
MGVATCTQQYCWGTQQTVNGQFCPSTKAVSGRALFRKNFRKTSLRKTSGRTFFRKKKVGFRKNSGIRSERTCSRIFPEEGSFERPPSSSGRSFLEKMNSKKLFPKELLTTGGSSSGMRMLNFLKYFFRKLLCLIPEEVVPEVSSGTTSSGIGHSNFRKKLFQN

SEQ ID NO: 172832 - protein, 91 aa, Glycine max
  Coding DNA Sequence Number=SeqID_81147
AWSQELRAIPRRNCGAGGSRWLGGEGEKKRMRNEVSTSKGMSNPRGGQVGIQKALAARPVRDYDDSQLELLRFGKLESSSNHAGFSPKAQT

SEQ ID NO: 172833 - protein, 140 aa, Glycine max
  Coding DNA Sequence Number=SeqID_81148
MQGWRCDLNASPQALDRLLGCFLAFKVKVQPRFRNSIVLKYSDESDLVNAVLDMLPDSEPCCKIENSILESTDPTELESQFVFVTTDHDRSMLDSSEPIELESIPLTPTKRVSSDEFDDEPKNFQISPAEVSSNKLAKHS

SEQ ID NO: 172834 - protein, 82 aa, Glycine max
  Coding DNA Sequence Number=SeqID_81149
MASCDPCNLARWDKAFDVVGGGSAEVNAHGVANSNKANTTLFLYKIEKEKNGVVEGAVEGAVWGGWEGDDDGLVWERVEERR

SEQ ID NO: 172835 - protein, 124 aa, Glycine max
  Coding DNA Sequence Number=SeqID_81150
VDSRGSPILLPRSSNLAQASEEDLILIWAFLTGRQIDWAHLVRYRMHKALRVNAPLPYPQLVTLFLHHFQIPLDDEPFVQVKRSFAIGAGAITSFGYRKDRNGQWLKKDALPPQDERTPSPAPQ

SEQ ID NO: 172836 - protein, 158 aa, Glycine max
  Coding DNA Sequence Number=SeqID_81151
MAWASKYIGGGRKKIWYCDECFVLKTANSMKIEPGLKDEVGPSNVQPQRSVPPSSLFGSFNQPLATRQATTPELMNEDHRKCYEMTIMLQITRTSEEILNIVHAKEQTYGEVSRSFAIRWMDMLERWTALRDFVDRRSSSDVNPLWSKSILDDHIQNQ

SEQ ID NO: 172837 - protein, 88 aa, Glycine max
  Coding DNA Sequence Number=SeqID_81152
MMLFAKTAIVVLGDLADTLGNNTGPLIQQKAETILTQTDYVHKEFMSLQEEADLTQEEIMSKWFTEDVFAEAAEEGDLRRIRVKMKWI

SEQ ID NO: 172838 - protein, 19 aa, Glycine max
  Coding DNA Sequence Number=SeqID_81153
ILRLARDLGDFLLVGIHSQ

SEQ ID NO: 172839 - protein, 151 aa, Glycine max
  Coding DNA Sequence Number=SeqID_81154
MGDFISRLSFPENTETFSSLRSYPELRRSEFLIGGYVGARASLLSTTPPFVAMTQELANVVICALSGDVSIFRWRLFKSHKLSRTTGGGPDDTRRYLTVIRTLLSSRGGGPDDKQRPSGGPDEQAETKYGHSAPLYHPKACGPDDYAEIPY

SEQ ID NO: 172840 - protein, 27 aa, Glycine max
  Coding DNA Sequence Number=SeqID_81155
MAGTSQLRAYSFLGRCTREPRVALPLK

SEQ ID NO: 172841 - protein, 60 aa, Glycine max
  Coding DNA Sequence Number=SeqID_81156
MADQSSETECYSPRLMPCQDIPIAGTKTGALKWDKWAFFIKYYSPTPKKMDKNKHKRKIP

SEQ ID NO: 172842 - protein, 86 aa, Glycine max
  Coding DNA Sequence Number=SeqID_81157
MSLHVLYLYAFSGFPLGISRLLYLSLQSFKEMNGQDHLELPSGVGTKHEKQKPIKERMQVGMESRPTDRCPFSALNKQRTSLQDSP

SEQ ID NO: 172843 - protein, 52 aa, Glycine max
  Coding DNA Sequence Number=SeqID_81158
MATRLGELMLTPEVTGSPRRAGYFTLKSFGGAGEPKASLGELGNWCRTTQSS

SEQ ID NO: 172844 - protein, 87 aa, Glycine max
  Coding DNA Sequence Number=SeqID_81159
MAAGCFTLGRSRETSAIWLLSNFGLALKAMHCSVEWPGSPMVCAGALGLYHFGKRGCWILQGDITAIWLAKRDGKRSSYIIGIRVNS

SEQ ID NO: 172845 - protein, 79 aa, Glycine max
  Coding DNA Sequence Number=SeqID_81160
  Subcellular localization annotation: CTP_CleavageSite=47; ConfidenceScore=5.53e-01
MSCTSSLSAPLHLTKRTTSVHLLSEKSGLSQKSLTCAKRSISALSTRAQTRPPIFIPLCLYLDQVDACFVRVIQQWKLV

SEQ ID NO: 172846 - protein, 143 aa, Glycine max
  Coding DNA Sequence Number=SeqID_81161
MASRERARAEDIPSSSNPPPPTATIELDGLQAQPIVPMLPIVSMEQFLDKVAWPEAQLPLGRSPEVVPPSPIPTRVEPEPAESQPPVVDPSASPEVEIPPPPPAPPAPPLILIPDDSDNEVVAPPDSPAYYLEDGSDFSDWMD

SEQ ID NO: 172847 - protein, 135 aa, Glycine max
  Coding DNA Sequence Number=SeqID_81162
MTEVLSELRGLRTYVGERFDSLDGRLVGMDIRLTQLEEDELNCHYQKGGDCRSKDFAFDVLMMPYDRDDLMSYGNALLKLNSREQSENTRYNIKKMSSILGREFQIEIAKGLAKKFKLKSFFSRDYSLVIDYQRM

SEQ ID NO: 172848 - protein, 124 aa, Glycine max
  Coding DNA Sequence Number=SeqID_81163
MVKSNTLQEVFPIPYLGPSPSLQESESTIGSTIDIPDNPPLEKTQRSPIVYRHHPRILDVELEGNERPSESCLTPVDNPTMDLLEENLDSPIALRKGTGSSSPRQETCWLSMGICYKSWGQWTY

SEQ ID NO: 172849 - protein, 48 aa, Glycine max
  Coding DNA Sequence Number=SeqID_81164
MGRMEIYSCHHQKGGEFRSKLHDESRLIQRVLMITKIMTKSSKVKNTS

SEQ ID NO: 172850 - protein, 173 aa, Glycine max
  Coding DNA Sequence Number=SeqID_81165
MAPKKHSAKRSRRDVAVEGTSAAPEFDSHRFRSAEHQQRFEAIKGWSFHIERRVQPRDDEYTDFQEEIARRHWTSLVTPMAKFDPDIVLEFYANAWPTEEGVRDMRSWVRGQWIPFDADALSQFLGDPLVVEEGHECEFSQRRNRADGFDEEAIAQLLCTPGQDFARTAARRR

SEQ ID NO: 172851 - protein, 410 aa, Glycine max
  Coding DNA Sequence Number=SeqID_81166
  Subcellular localization annotation: CTP_CleavageSite=62; ConfidenceScore=5.12e-01
MLPRTARVIGDIKAVPTAIQPGFNPGMSSNVFNVVSIQIATDVARRNPQAATAGEKHVAVILANAAAGSKHFRRAVAHLRAAGLVRHFQQQLVHQFFQAGERFLRLPVTPGEVADCPVRLGQRRGAQKHQRRQRRLRIRRQLAGIQNLDHAARGNLQQLMRPVQRQHMQHVAVSIQRARRLTRQIELPRQHLLVHRILRRQAQILGAEFYLLLIGVPGVIDALRQRVDAAEKMVQPRLQAVARQALPGAEAHLRQQDRTEIARAILAAAANLLQLAGDLFNAGVQRARTFAAQDQHFVDQRRHQLLLKDGVVGLARRHRAQQAVEAVIFPYRVGMLLQQLLVNAQQPRGAVAALHQRAKPDKTQRIAAQQRAGHRAAKQMRTLFHPVEEAVGTGRRDTAAARVAHLNPRR

SEQ ID NO: 172852 - protein, 159 aa, Glycine max
  Coding DNA Sequence Number=SeqID_81167
MEKNVAAAAAVSSAAKADPTLLATTHHPPPNTIGRGRSTLGHNNNTHLGYNRVAYPYGLPPNYTPPVMQDDAGHPDEVHEDHQEYAQGDVEFYPLIPVEGPTPNTLPQPNLTAQPIFFSTEGPLPVTEERRKLDLLEERLRVVEGFGDYPFTDMTDLCL

SEQ ID NO: 172853 - protein, 86 aa, Glycine max
  Coding DNA Sequence Number=SeqID_81168
MEVNSFQKHAGISVDHEQLGVSYYDLRNKGDQITSRDLKVTRGGGGAPVAHYYDASPCVCLGVQYFSMKVQLVGSLMTLLGVTGTP

SEQ ID NO: 172854 - protein, 72 aa, Glycine max
  Coding DNA Sequence Number=SeqID_81169
MASKKLSSMRSRKDAAAAGTSATPEFDSHRFRSTKHQQRFKAIKGWSFHRERCVQLRDDEYTDFQEEIARRR

SEQ ID NO: 172855 - protein, 306 aa, Glycine max
  Coding DNA Sequence Number=SeqID_81170
  Gene Ontology: Mol. function=metal ion binding; Cellular component =intracellular; Biological process=regulation of transcription, DNA -dependent
  Homolog annotation: Hit_ID=A7P291; Match level="QueryCoverage=87%, HitCoverage=83%, E-value=5e-81, Identity=51%"; Hit description =Chromosome chr19 scaffold_4, whole genome shotgun sequence
  Pfam annotation: Domain name=C1_1; Domain location=107-157; Score= -2.2; E_value=0.05; Accession=PF00130.13; Description=Phorbol estersdiacylglycerol binding
  Pfam annotation: Domain name=C1_3; Domain location=116-147; Score =7.9; E_value=0.062; Accession=PF07649.3; Description=C1-like domain
  Pfam annotation: Domain name=PHD; Domain location=117-168; Score =59.1; E_value=1.6e-14; Accession=PF00628.20; Description=PHD-finger
  Pfam module annotation: Pfam domain module=C1_1::C1_3::PHD; Domain location=107-157::116-147::117-168
MDSSTTFLNDLPPLKRLRLLQQQQQQKEEHQYYDSSSPLPAKKRKESRTLSPPSPTTTKTVYNYSLPAKKRVWALQPQSPPSNDVVPAFDLNVEYTPSPNNHGDLEEDHSEDEDGVLCCVCQSTDGDPADPIVFCDGCDLMVHASCYGTPLSKSIPDGDWFCERCCFRFEKNDVGNINCNACVLCPSTEGAMKRTTAEEEGGATWAHVVCALFVPEVFFLDPEGREGIDFSKVPKKRWEERCYLCGSCEGCALVCSEPKCGLGFHVTCALKEELWIEYREGKKGGTIVAGFCKKHTQVWEKGIESS

SEQ ID NO: 172856 - protein, 119 aa, Glycine max
  Coding DNA Sequence Number=SeqID_81171
MAKTLRFGPKGLRMTRHDVCRYICLANGSRIREMPQIISVATYPSVGGRRVTRGMRVPRKEYARSRHQRLFEENVGKTGKDAIYELLSERFGSCIYARGRVFPFAPTYSSICDEEIRPT

SEQ ID NO: 172857 - protein, 382 aa, Glycine max
  Coding DNA Sequence Number=SeqID_81172
  Gene Ontology: Mol. function=alpha,alpha-trehalose-phosphate synthase (UDP-forming) activity; Cellular component=cytosol; Biological process=trehalose biosynthetic process
  Homolog annotation: Hit_ID=A7P284; Match level="QueryCoverage=63%, HitCoverage=26%, E-value=1e-131, Identity=90%"; Hit description =Chromosome chr19 scaffold_4, whole genome shotgun sequence
  Pfam annotation: Domain name=Glyco_transf_20; Domain location=142 -381; Score=97.8; E_value=3.4e-26; Accession=PF00982.12; Description =Glycosyltransferase family 20
MRYASTSSPHNMFEELLHGDPFHVEAYHNLLMLTSKTNKPTEELLKRIEEVGKDCGLIFDIKEVGRGADKGYNGNSSNIPTSRLERLLRDRELRKSGRASENNGEAMEEEVVRLREEESAAEAATKGAGGGEERQETKPFRQRLLVVANRLPVSAVRKGEDAWSLEMSAGGLVSALLGVKEFEAKWIGWAGVNVPDEIGQKALTKALAEKRCIPVFLDEEIVHQYYNGYCNNILWPLFHYLGLPQEDRLATTRSFQSQFEAYEKANQMFADVVNRHYEEGDVVWCHDYHLMFLPKCLKTHNKKMKVGWFLHTPFPSSEIHRTLPSRSELLHSVLAADLVGFHTYDYARHFVSACTRILGLEGTPYGVEYQGKLTRVAAVRAT

SEQ ID NO: 172858 - protein, 149 aa, Glycine max
  Coding DNA Sequence Number=SeqID_81173
MDFKPHRTYALEVGGLCTTLVVHRLSQDFKPRCARTLKARGLCTALVAHRPSMTSPICPLSIGQLKPRCDLVTRTFWHPLRGYGKTFPIALVLHCFFDKMSGIMNNHSTLGIPVVPLMLETLMAEMRRKGKDFRRIANEALRARDFLCH

SEQ ID NO: 172859 - protein, 86 aa, Glycine max
  Coding DNA Sequence Number=SeqID_81174
  Gene Ontology: Mol. function=aspartic-type endopeptidase activity; Biological process=DNA integration
  Homolog annotation: Hit_ID=Q2QXM6; Match level="QueryCoverage=80%, HitCoverage=6%, E-value=1e-08, Identity=42%"; Hit description =Retrotransposon protein, putative, unclassified
MAAVSGSIPANLPVLTGKNYENWKIQIRVVMRFQGVWEFVEEGYIPVGERATEEQKAADREKEKKDCKALFILQWDPLESTCRHAS

SEQ ID NO: 172860 - protein, 147 aa, Glycine max
  Coding DNA Sequence Number=SeqID_81175
MAQALRAIEHLRRVIGSDSCSPDCYEKVKNINNNLDKSKAEIESAQQKDKECREEEDKHKIYTGKRKNQKNSQAVSPLNLLARERKKNQKNSQAVSPLNLLARKRRKNQKNSQAVSPLNLLARGRRKNQKNSQVVSPLNSSGKREKE

SEQ ID NO: 172861 - protein, 86 aa, Glycine max
  Coding DNA Sequence Number=SeqID_81176
MRLHCHQASRRPSMTTDRPLLLMAHRPGSMCGACRPWIFFINGVLCFLKMNGSGMEKEEKDDRRRHFKEKMSQEEAHHHRKPWIRA

SEQ ID NO: 172862 - protein, 68 aa, Glycine max
  Coding DNA Sequence Number=SeqID_81177
MHLHDQGTYREDPTEDLAFHTRKPSLEQREEQDERLQKYKCALMDRLADISEFRLSACLSHLADELKR

SEQ ID NO: 172863 - protein, 129 aa, Glycine max
  Coding DNA Sequence Number=SeqID_81178
GCHPARPGELDCFHQKAPPSVGRSWKAQVELYGLPNDGCQVPQSGQARVASQQTDGPQTKLGYDTGEPHGTTSQVVGGDTLWSSTPFVDRAKRIRQYQDDVGRSRRLGAMAKGSSVGGDIDRPNDVPLE

SEQ ID NO: 172864 - protein, 135 aa, Glycine max
  Coding DNA Sequence Number=SeqID_81179
  Homolog annotation: Hit_ID=A5CAG1; Match level="QueryCoverage=54%, HitCoverage=5%, E-value=2e-12, Identity=50%"; Hit description =Putative uncharacterized protein
  Pfam annotation: Domain name=Chromo; Domain location=51-99; Score =22.6; E_value=0.00086; Accession=PF00385.15; Description='chromo' (CHRromatin Organisation MOdi
MDKSLKVGEDEWRERERRSTKFCVSNEKAIAPTVKPQPLPPMQIDELERRVEPLAVKAARNHPAGTTEVLIQWKDLPDFEATWESIDVMKQQLSAFHLEDKVALLGGNIVRLLVKQVYEGRTHGKYKRKSEQQPK

SEQ ID NO: 172865 - protein, 128 aa, Glycine max
  Coding DNA Sequence Number=SeqID_81180
  Homolog annotation: Hit_ID=O52175; Match level="QueryCoverage=64%, HitCoverage=94%, E-value=1e-32, Identity=85%"; Hit description =Salmonella berta plasmid pBERT, complete plasmid sequence
MAYERGGDFLEDARKILNREVRGPRQSRFSIGSAPLTSITKSDAQISGGETRQDYKDTRRFPLAAPSCALLFLPFGLPVSFRCYGRVCLIPRLTLSSGPTAAPYPETIVLSPTRKDMQKHHWAAATGN

SEQ ID NO: 172866 - protein, 544 aa, Glycine max
  Coding DNA Sequence Number=SeqID_81181
  Gene Ontology: Mol. function=kinase activity; Cellular component =mitochondrion; Biological process=carbohydrate metabolic process
  Homolog annotation: Hit_ID=A8GL00; Match level="QueryCoverage=86%, HitCoverage=86%, E-value=0.0, Identity=77%"; Hit description=FGGY -family pentulose kinase
  Pfam annotation: Domain name=FGGY_C; Domain location=253-497; Score= -38.4; E_value=0.00015; Accession=PF02782.7; Description=FGGY family of carbohydrate kinases, C-terminal domain
  Pfam annotation: Domain name=FGGY_N; Domain location=1-241; Score =34.1; E_value=3.3e-12; Accession=PF00370.12; Description=FGGY family of carbohydrate kinases,
  Pfam module annotation: Pfam domain module=FGGY_C::FGGY_N; Domain location=253-497::1-241
MTGRMLGQASREITLYRPKADFVEQSSDEIWQSVCNAIKDVVSQADINPIQVKGIGFDATCSLVVLDKEGKPLTVSPTGRSEQNIIVWMDHRAITQAERINATGHRVLEFVGGIISPEMQTPKLLWLKQHMPTTWSNVGHLFDLPDFLTWRATQDTTRSLCSTVCKWTYIGHEDRWDPSYFRQIGLEDLLENNAAKIGSEVKTMGEPLGHGLTQRAAAEMGLMAGTAVSVSIIDAHAGSLGILGASGASGESADFDNRIALIGGTSTAHMAMSRSARYIGGIWGPYYSAILPDYWLNEGGQSTTGALIDHVIQSHPCYQDLLKQGKDSGKTIYEVLNGILRKMAGEPENIAFLTKDIHMLPYFHGNRSPRANPTLTGTLTGLKLSRTPEDMALHYLATIQALALGTRHIIETMNQSGYCIDTIMASGGGTKNPIFVQEHSNATGARCCCRKRVKPCCSAAPMMGTVAAGAVRLFARSDGRHEPHRTLFATIRISTRAFSGMNSDTPMADHAGMGTYRFVFPRCRHTGKIQGAIGFDNGREVPVM

SEQ ID NO: 172867 - protein, 36 aa, Glycine max
  Coding DNA Sequence Number=SeqID_81182
MRRYMEKNEETKMEEKLACEATMEAGSLSFNEILQW

SEQ ID NO: 172868 - protein, 101 aa, Glycine max
  Coding DNA Sequence Number=SeqID_81183
MRLTCQALKHLINEWQGKMIFSGFLVQPLIINADSPAVLHSCGDKLIPLILDRCEACLLRNHLDWTHPLAVRNGVDDSSLQELGCGCLTGLAPSSKSILCM

SEQ ID NO: 172869 - protein, 188 aa, Glycine max
  Coding DNA Sequence Number=SeqID_81184
MGLSQMPLLKKRFYQVKIKGLEVTSLQELRELMGQLQWQAFRKAYGKIWNLAMIEAFAKAIASLTQHYDQPLRWRKPYLFSGFYPSMSRIARVVRISAQELDRVKQNRNGVAGIPRKCLEERARALASQNEWPPFIDILALLIFEVVLFPNVDDLVDLAAIDAFLAFHHNKESPVVAILANIYDTFDR

SEQ ID NO: 172870 - protein, 82 aa, Glycine max
  Coding DNA Sequence Number=SeqID_81185
MTKNERRMVKNDEEFPQNLLRKRYGSTSTRFFFTKTCFLPKIAEMHSQGVYGNFTEALRKPRKPRKPFFKNVEEHAAQLLPP

SEQ ID NO: 172871 - protein, 107 aa, Glycine max
  Coding DNA Sequence Number=SeqID_81186
MACLPNYTPPNVAYIPNEDVNNSTPILIKCQQPQSDHAHVSRPMEETHEIPHHDLANFEPCLGYAAEGQAVGGIPMPNTLEGPQFRPQPQPLHFAVGRAPPAMAEKG

SEQ ID NO: 172872 - protein, 137 aa, Glycine max
  Coding DNA Sequence Number=SeqID_81187
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=62%, HitCoverage=72%, E-value=3e-24, Identity=69%"; Hit description=LacZ protein
MLIVSMPSIFFRLSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 172873 - protein, 49 aa, Glycine max
  Coding DNA Sequence Number=SeqID_81188
MTIDTLEPYIGAMRDTMHEPQANLGPDPKFLPDRKKQSRACYQGIGPEI

SEQ ID NO: 172874 - protein, 190 aa, Glycine max
  Coding DNA Sequence Number=SeqID_81189
  Gene Ontology: Biological process=transposition, DNA-mediated
  Homolog annotation: Hit_ID=Q1J7G7; Match level="QueryCoverage=17%, HitCoverage=48%, E-value=1e-11, Identity=97%"; Hit description =Transposase
YIEQLTEMPQNVLYDAIGIYQRCWNLLRADQRLIFAKKLAQGFPVLQWLLFLSAVPPVQLLTGWCVTAKAPPDISAGKCSGHAARRVPFAIQAAQLLGRAIGAGLFAITPAGERGMCCKAIKLGIRFKCKWVDNNTDPCDEKWSVVLHGKTIGVNVEDDNSYIDTYVSPLSTQMSPNIVGEEEVDDVHAN

SEQ ID NO: 172875 - protein, 46 aa, Glycine max
  Coding DNA Sequence Number=SeqID_81190
MGVSLAIIGASLGIFLRKLLKELLKEVFSKKLLKEVFSRKLLKEAT

SEQ ID NO: 172876 - protein, 100 aa, Glycine max
  Coding DNA Sequence Number=SeqID_81191
  Subcellular localization annotation: CTP_CleavageSite=48; ConfidenceScore=5.39e-01
MVQLSAHHCAKSNNFTVSCTLSSGLSVDGLLSAPSCAKPQIHSSLEVRLAQVVALSLNHSLLSACCRKIFGVVESAKRHCYAKPQMLTGSYNFKFGLVRG

SEQ ID NO: 172877 - protein, 117 aa, Glycine max
  Coding DNA Sequence Number=SeqID_81192
MAPPDSIPIAEQFNEMVAWPGTQPSLHKEDEGPTAQVPQHIKDESSEATIPEPFDIGEEEEETQPAADPSTPLLQMLEDPTTVVLAMDTSPHTTPVLQLTDEEDGQTQDTQDQSQEF

SEQ ID NO: 172878 - protein, 93 aa, Glycine max
  Coding DNA Sequence Number=SeqID_81193
MRSFNGDFPPWRCSGRQRRRGEERHHLLENKPWKKELHHQECALDKKLEEDKKELHHQECFEVCLKRLSLIKVTTSVTQASIYRLGSFLGKLS

SEQ ID NO: 172879 - protein, 174 aa, Glycine max
  Coding DNA Sequence Number=SeqID_81194
  Gene Ontology: Biological process=transposition, DNA-mediated
  Homolog annotation: Hit_ID=Q1J7G7; Match level="QueryCoverage=18%, HitCoverage=47%, E-value=2e-11, Identity=96%"; Hit description =Transposase
MCRNCRKSSWYSLQSDENVSVAHGKRCNKGEHYPISPAHRLSLPYEIPDEHSSGGQESERSGYRYIEQLTEMPQNVLYDAIGIYQRCWNLLRADQRLIFAKSWPRASRYQQGHQDLFILRSDLPSQVLQWLLFLSAVPPVQLLTGWCVTAKAPPDISAGKCSGHAARNHHTRRA

SEQ ID NO: 172880 - protein, 173 aa, Glycine max
  Coding DNA Sequence Number=SeqID_81195
MLIENTPFDLEDPPSPIERHVKWKMACTKRYGQMTSEAAQEISDRIGSFVPHGRDDILNTAIGRSEHPSRVHVAGSGMTISQYYSRASRGSSNSSTTITQQQLADIIKNLKEQETHVSPKKLPEPVQRATNVFEDDPLRQLIKSLSYPNFVRGPLLDDMRPFFGPCEVLGTHH

SEQ ID NO: 172881 - protein, 68 aa, Glycine max
  Coding DNA Sequence Number=SeqID_81196
ESQPAESGLYFFPCPTPDQFRVEVAWPEAQAGEAPAGAPAEAPDEAEEAREDEEMTDLLDFLGGSGAA

SEQ ID NO: 172882 - protein, 115 aa, Glycine max
  Coding DNA Sequence Number=SeqID_81197
  Homolog annotation: Hit_ID=Q84VH5; Match level="QueryCoverage=41%, HitCoverage=7%, E-value=2e-19, Identity=93%"; Hit description =Envelope-like protein
EITAKQVQHWPKKGKLSTGKLSVKYAILHRIDTANWVPTNHTSTVATGKAAASGAVSKDALIAELKDTCKTVALMMDEAAEEEEEAAEEEEEAAEEEEDAADDTESDDDDSDATP

SEQ ID NO: 172883 - protein, 137 aa, Glycine max
  Coding DNA Sequence Number=SeqID_81198
MMMIKDDDKGDDKKLKDQSKNNSRESKANQRTTQVNQRAIKKTQEESLETRIKIQGSRSQESRSRFKTQDSRMKRRLNQDNFSFQGLIPSGWRLLSPLLLYLPLHLDGGKSPLKDLIEAQRSSCHRSFSSKLPSLPN

SEQ ID NO: 172884 - protein, 151 aa, Glycine max
  Coding DNA Sequence Number=SeqID_81199
MYMRSFLIGAAVVASFGYCKERDGSWVKKGTQPNDDEGQLPVEGDSSLLQSILDRFDGLQTYVGERFDALEQQVDMRFDAMDSRITKDCHHQKGGDCGSNVFQGYFDDAKESRVKQNPKIQESSFKNHDSRIIKIKIQDSRFKNQEKTQSR

SEQ ID NO: 172885 - protein, 96 aa, Glycine max
  Coding DNA Sequence Number=SeqID_81200
  Homolog annotation: Hit_ID=A7QJC7; Match level="QueryCoverage=58%, HitCoverage=3%, E-value=4e-18, Identity=79%"; Hit description =Chromosome chr8 scaffold_106, whole genome shotgun sequence
MRTKILEESNAVVDDGVDVENVNDEAFREAMPLGTKMLSWLLHALAISVCTTLVSVEPKLTVETRSHVMKAMLGFFTIPNDPIDVVNPLIDNLITL

SEQ ID NO: 172886 - protein, 248 aa, Glycine max
  Coding DNA Sequence Number=SeqID_81201
  Pfam annotation: Domain name=zf-CCHC; Domain location=39-56; Score =12.6; E_value=0.019; Accession=PF00098.14; Description=Zinc knuckle
KDQAQGILGAAPLKPKEDKGKTIEKSTPKTISQARTSNIKCFKSLGIGHIASQCPIKKTMIMKAQDIYSSQKETTSLSSSGSEDEVRGEESSEEVYPHEEGDLLMVRRLLGGHILLGRPWQFDWKIIYNGLTNEITLTHLGTKFVLHSQTPSHVAKDQVQIKLKWDEEKNRKRKEEQHLMVKEECKEISVSSKTLSKKESHFSIKTNIKETSLLRQPPHLFLCKRTLVRNVIPLEFYVIPQVKELLDE

SEQ ID NO: 172887 - protein, 93 aa, Glycine max
  Coding DNA Sequence Number=SeqID_81202
  Homolog annotation: Hit_ID=A2I5F1; Match level="QueryCoverage=77%, HitCoverage=5%, E-value=4e-07, Identity=45%"; Hit description =Transposon-like protein
MYKIVEVRQSKRYNKAYDLFIFAQQEEQVYYTTYPEGHQGWSAVMKTKTRSRITDNIIDADLLKEVDLVEPDEDECILSENDIESDFDDTNTS

SEQ ID NO: 172888 - protein, 396 aa, Glycine max
  Coding DNA Sequence Number=SeqID_81203
MASKKRKAPGTPSQEELERRKWDEELTSFDEGNIDVAIVKEFYANLYDPKDKSPKQVRVIGHLVKFDVDTLNTFLKTPVIIEEGEELPAYSRFAILRLDPQELAAKLCIPGRGFELNADGQPLKILRKNMTTLAQTWSVISYSNLVPTSHTSDITLDRAKLIYGIIMKMDMNLGYLISHQIFIIAQHDSSRLGFSVLIIALCKARGVTSDSRSLESLSPAINLAYIKKNCWSLDDPIVTFRGLRKARGKRSEAPPTSAAPDASTPSSSTLPDPSAPATSSPHLPQLPASAPTPLPSLPSPSRGGEASTAQEYVLVEEPVPEAEDELVPLEPSFHETDSIAQEEAVAQELPAPISEDTLPSAPALEQEQPSSQDPPAALVLDLNEHAEDQQQDDQEF

SEQ ID NO: 172889 - protein, 154 aa, Glycine max
  Coding DNA Sequence Number=SeqID_81204
MRRVSKVTHLEGPTGFEIKVSEKCIWNINWQMANPKSKEHLLQQNGRAKQYVRAGDSERELNRNNRARPEMTGRCWKTSEITRDGAREKQNHRTETTVQRSDEKRREMNKNRVFDVEEKKCLGHVKVIALIMDAILAMKSTASAATGWCNTTTG

SEQ ID NO: 172890 - protein, 80 aa, Glycine max
  Coding DNA Sequence Number=SeqID_81205
MPSLIAYNDPQYAMKVNTEFHGKCLAPIIRQFVKFQDMPENQKNIDAQSLGCFWRKQPSSPGRAKFAWASWAATSSPFFL

SEQ ID NO: 172891 - protein, 106 aa, Glycine max
  Coding DNA Sequence Number=SeqID_81206
MKLTNVALERLDVVLKAESGHRLEQVVVVDRLALLALALVRGLVDDEADELRHALLHRLLCVLRDLRIRRQSLLHDVAHKAVRVVVKVRHRQTDNQRSNEKDETNH

SEQ ID NO: 172892 - protein, 66 aa, Glycine max
  Coding DNA Sequence Number=SeqID_81207
MAEVIVGANLNCSSFHFKDELLPSDDDLTMGYRVEAMMKGYRDDDMVEVTCKLSNGSEDDKSDEVW

SEQ ID NO: 172893 - protein, 162 aa, Glycine max
  Coding DNA Sequence Number=SeqID_81208
  Homolog annotation: Hit_ID=A5B2V4; Match level="QueryCoverage=49%, HitCoverage=10%, E-value=3e-12, Identity=38%"; Hit description =Putative uncharacterized protein
MTSSVELWFLGQGYHDHLEKGVGDVPNDKKSEWEKLDFQLCAAQEIFANDIQSLFDATMKVTALKQTSHDMIAHIGKARAAVEELKRFLVVDSLEEFLLETKFRQWTLITRLLRVPHVLKDENLADVVETSTMIAPRGRGGGRNNRGGRSGRGGCPQCTYCK

SEQ ID NO: 172894 - protein, 99 aa, Glycine max
  Coding DNA Sequence Number=SeqID_81209
MVEHCMESTSKDEKESSSDAMRNPWGSHDRVFGTSFWPRSYVGCCVCSWGALCTDLPGSLALAFGRDHTSYGVEHLWALRLITYGRGAVTCTTGWSRQT

SEQ ID NO: 172895 - protein, 54 aa, Glycine max
  Coding DNA Sequence Number=SeqID_81210
AIKGSALADYWPNNPSKIIGRCTLSSRMKTSWPYSKRSEHTRIWTNGLFASMGH

SEQ ID NO: 172896 - protein, 173 aa, Glycine max
  Coding DNA Sequence Number=SeqID_81211
MAPKKLSAKRSRRDAAAEGTSAALEFDSHRFRSAEHQQRFEAIKGWSFHRERRVQLRDDEYIDFQEEIARRHWTSLVTPMAKFDPDIVLEFYANAWPTEEGVRDMRSWVRGQWISFDTDALSQFLGDPLVLEEGQECEFSQRRNRANGFDEETIAQLLCTPGQDFARTAARRR

SEQ ID NO: 172897 - protein, 462 aa, Glycine max
  Coding DNA Sequence Number=SeqID_81212
MEVTGLELQAVIRQQQMVEAQPETGFGGAGGFRPQIRIGHPIVAGEVARIVVHLAHGRGTEGLGIGAEQHQPVGRRVAQGSAGRPFVGLDVFVALAVAFVIVVARACQHGDRNVAQRNFILQPAGGEVYLGLREAGGGAARLLFLFIDLGAARAVFQLAAVGGLLAEFVGRAGVVCIDFDFRGVQLGGGVQQILADRLELIAQCRIALDGRAVGHRVAARAARRLRIFRLLSAVVVVAQIAAQRLIVVDLPGAFGQHVADGFVVRRIEAVALAQIADVAGAERQQTVEVIGLAVGAGAHAQAVIAAAGGAVDAEPAIVARQQQIGGINGLVGDNAAQRAAAVQQRGGPAHDFNALDQRRIEEGAADVAGIGPLADAVDQRQHAVFAVAAHRHVLAVAAPGAVDGDARHAAQHIGGRGGGLAFRRVAFNDRDHHRRFKAAALVAGGDHGHGLVGGFGFFGRRR

SEQ ID NO: 172898 - protein, 406 aa, Glycine max
  Coding DNA Sequence Number=SeqID_81213
  Gene Ontology: Mol. function=nucleoside-triphosphatase activity; Cellular component=chloroplast; Biological process=cell division
  Homolog annotation: Hit_ID=Q2PMM5; Match level="QueryCoverage=99%, HitCoverage=19%, E-value=0.0, Identity=81%"; Hit description=Protein ycf2
  Pfam annotation: Domain name=AAA; Domain location=77-297; Score=6.8; E_value=4.6e-06; Accession=PF00004.20; Description=ATPase family associated with various cellular activities (AAA)
MIEQPGAIYLRYLVDIHKKYLMIYEFNTSCLAERRIFLANYQTITYSQTLRGANSFHFPSHGKPFSLRLALPPPSRGILVIGSIGTGRSYLVKYLATNSYVPFITVFLNKFLDNKPKGFLIDDSDDIDDSYDSDDIDRDLDMELELLTMMNTLTMDMMPEIDRFYITFQFELAKAMSPCIIWIPNIHDLDVNESNYLSLGLLVNYLSRDCERCSTRNILVIASTHIPQKVDPALIAPNKLNTCIKIRRLLISQQRKHFFTLSYTRGFHLEKKMSHTNGFGSTTMGSNVRSVQDHGILFYQIGRAVSQNVLLSNCSIDPISIYMKKKSCDGGDSYLYKWYFELGTSMKKLTILLYLLSCSAGSVAQDLWSLPGPDEKNGITSYGLVENNSDLVHGLLEVEGALVDPH

SEQ ID NO: 172899 - protein, 89 aa, Glycine max
  Coding DNA Sequence Number=SeqID_81214
MLWKLGRIDGDPVLRETRIRATWEYVSSVEGGQQGMVGLYMICGCGELFCTIARPPPSTTCDGVVPRDMSRGSGDLGDIRWGAIAQNQA

SEQ ID NO: 172900 - protein, 81 aa, Glycine max
  Coding DNA Sequence Number=SeqID_81215
MEKNFGASMEAQWRRRRREKGNKPSGGSTHSRKYFPESKTAEGKATISSFHQFPDESLSEALERFRGLLRRTPTHGFFEPI

SEQ ID NO: 172901 - protein, 33 aa, Glycine max
  Coding DNA Sequence Number=SeqID_81216
MNKEEVMSPVESPTVATYPSAGGRREAHQCVFQ

SEQ ID NO: 172902 - protein, 180 aa, Glycine max
  Coding DNA Sequence Number=SeqID_81217
  Gene Ontology: Mol. function=chitin binding; Cellular component =extracellular region; Biological process=chitin metabolic process
  Homolog annotation: Hit_ID=UPI00006A17C9; Match level="QueryCoverage =96%, HitCoverage=100%, E-value=6e-17, Identity=30%"; Hit description= UPI00006A17C9 related cluster
  Subcellular localization annotation: CTP_CleavageSite=38; ConfidenceScore=5.29e-01
VRACSPLMARTCGPLIARSCGLLKARMSSPLKVRACSPLMARTCSPLKVRACNPLIVKTCSPLKVRACRPLMARTCSPIKARMSSPLKKVTACSPMMARTCSPLKVGVCSHLMARKSSPPKVRACSPLITRTCSPQKVNACSPMMARTCSPLMVGACSYLMARKSSPLKVMACSPLMART

SEQ ID NO: 172903 - protein, 180 aa, Glycine max
  Coding DNA Sequence Number=SeqID_81218
  Gene Ontology: Mol. function=chloramphenicol O-acetyltransferase activity; Biological process=response to antibiotic
  Homolog annotation: Hit_ID=P62577; Match level="QueryCoverage=100%, HitCoverage=86%, E-value=5e-74, Identity=72%"; Hit description =Chloramphenicol acetyltransferase
  Pfam annotation: Domain name=CAT; Domain location=6-180; Score=238.5; E_value=1.5e-68; Accession=PF00302.9; Description=Chloramphenicol acetyltransferase
MEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQLKRFHRSGVNTTTISGSFYTYIRKMWRVTVKTWPISLKANPWVSFTSLDLNVANMDNFFAPVFTMGKYYTQRDKVLMPLATQ

SEQ ID NO: 172904 - protein, 56 aa, Glycine max
  Coding DNA Sequence Number=SeqID_81219
MENWRTALGNDIRGALRLEALGYDIHRAPKKWRMENWRTALGNDIRRAPDSKVEDT

SEQ ID NO: 172905 - protein, 270 aa, Glycine max
  Coding DNA Sequence Number=SeqID_81220
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTFEAHVMLDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 172906 - protein, 178 aa, Glycine max
  Coding DNA Sequence Number=SeqID_81221
MGGYTPSSFADLVFADERIEVGLKIGKFNHPAWTNEKTGANEEADIIPSHYTPPSHPQRSSLNQPQNPPTTQPMLNTTFSTNQNTNEGRNFAAKKPIEFTLILVSYDDLLPYPLNNSMVAITLTKVPQPPFLRGYHSNATCAYHGGVPGHSIGHCMTSKRKVQSLIDAGWLEFEENRL

SEQ ID NO: 172907 - protein, 152 aa, Glycine max
  Coding DNA Sequence Number=SeqID_81222
MSITWKDIEGGVVVNKNFGRYVVQTFYGYVQGFVVPLALDGYFFIGECEDIPVFLKSSSSLANLPAGTSSSGTRPTLSLSSTPAFAFPFGSLDHTGGSGAVKIRPLQVIPLVPEMLVTLAKDRSPLTCTTDASFLSSGLCVAYLHGTALSLL

SEQ ID NO: 172908 - protein, 63 aa, Glycine max
  Coding DNA Sequence Number=SeqID_81223
MTMTQDHEKLDSDLIATSVVDMIREDSSIKVSLIQERINNEFAYKVSYKKAWMAKQKVIAIEY

SEQ ID NO: 172909 - protein, 131 aa, Glycine max
  Coding DNA Sequence Number=SeqID_81224
  Subcellular localization annotation: CTP_CleavageSite=58; ConfidenceScore=5.45e-01
MPTRHSVGPKKSNRVLGFPALITSLRQFYEVPVASSRVIRPLLTGLSSRSTAPPRRCRARHHSSGQQTHCHHLQCSPQLIHKKAGALPTTHGRPTCDQVQSQRQRQGQLRDDEFLHFLGGGGAIQSGSPNL

SEQ ID NO: 172910 - protein, 40 aa, Glycine max
  Coding DNA Sequence Number=SeqID_81225
MARTRGLGRAIGRVIGRDRQDDHDDVPERRRPTASARRQR

SEQ ID NO: 172911 - protein, 112 aa, Glycine max
  Coding DNA Sequence Number=SeqID_81226
MYNSIITYIGLHCSAHWQMVIILPKENVVIWFCSLHTRPDNYLKGIINSALKDLTILHKVNPRLVLGGLLLNVIDKKEAPSYFNDVRPLEPERLKALRIQWAKYYLKVRNET

SEQ ID NO: 172912 - protein, 87 aa, Glycine max
  Coding DNA Sequence Number=SeqID_81227
MGVQIATRPTWALQKVVASGGSNPARLGELGGNHLPYFAINRGGSEEEKAEALLKRFRNVFREEFRKGFDRSSTFFIRSSSFFDLQR

SEQ ID NO: 172913 - protein, 51 aa, Glycine max
  Coding DNA Sequence Number=SeqID_81228
SSDNGRDISGDGGGGGGIGGGSNDDVVVVAVLVVTTTVKSGCVQLTLDCTK

SEQ ID NO: 172914 - protein, 74 aa, Glycine max
  Coding DNA Sequence Number=SeqID_81229
MVVQQQVTTARDGHRWSWVVEEDFIGWFGGVLRGRCENRLCKLVLLSGNSLLALSANSSRVGIALSELLALSEM

SEQ ID NO: 172915 - protein, 74 aa, Glycine max
  Coding DNA Sequence Number=SeqID_81230
MSQAQALRIQLGSSSSLVPIIFSTCGLVDTVQEGYTGFHMGAFNVEISDYLNVTILLVIVSAGYHLSLARCFGT

SEQ ID NO: 172916 - protein, 95 aa, Glycine max
  Coding DNA Sequence Number=SeqID_81231
MWYHISMKNLVRRLGVHDRTCLTMGRSGLKEHSNRMTPKAYTPKSSSEPLPPDSGPTQKKHLNTQTLPMNYAMHTTTQLFSKSQLYIYFNSSRLK

SEQ ID NO: 172917 - protein, 81 aa, Glycine max
  Coding DNA Sequence Number=SeqID_81232
MEQENEVKIKLRVENGGRLPKLDGRRAQEHLVKHGRRRKIWYPLSPKSSAKSWTALEVLSTSSAMPYMASCTFPELYKRIK

SEQ ID NO: 172918 - protein, 86 aa, Glycine max
  Coding DNA Sequence Number=SeqID_81233
  Subcellular localization annotation: CTP_CleavageSite=76; ConfidenceScore=5.52e-01
MPETSMLQNGLKPRTTVLKPSKQQTKKGQTSMPKPRSHQDATRKSKGKISEFSFVSKFQRAGWESELKRLPARGLSVAGARDLNSN

SEQ ID NO: 172919 - protein, 151 aa, Glycine max
  Coding DNA Sequence Number=SeqID_81234
  Homolog annotation: Hit_ID=A5C8K3; Match level="QueryCoverage=53%, HitCoverage=13%, E-value=3e-09, Identity=41%"; Hit description =Putative uncharacterized protein
MELHHFLKFVDPSNASKTTENLYKILRDVVLRVGLENVVHVVTDNAANYVVVACVEKLKLTEPLVLVLRLVDSEDKLTMGFLYHAMHKAREEMGENAIATGGKAQPAIASGGKAGERGVSPLGAGETAMLHVNLAGLQLFRLAGLVLLSID

SEQ ID NO: 172920 - protein, 309 aa, Glycine max
  Coding DNA Sequence Number=SeqID_81235
  Gene Ontology: Biological process=response to biotic stimulus
  Homolog annotation: Hit_ID=A7PC91; Match level="QueryCoverage=61%, HitCoverage=40%, E-value=6e-71, Identity=71%"; Hit description =Chromosome chr2 scaffold_11, whole genome shotgun sequence
  Pfam annotation: Domain name=Bet_v_I; Domain location=44-188; Score= -46.8; E_value=0.015; Accession=PF00407.10; Description=Pathogenesis -related protein Bet v I family
  Pfam annotation: Domain name=Polyketide_cyc; Domain location=53-187; Score=17.2; E_value=0.0095; Accession=PF03364.11; Description =Streptomyces cyclasedehydrase
  Pfam module annotation: Pfam domain module=Bet_v_I::Polyketide_cyc; Domain location=44-188::53-187
SSAEEQDPTRRHLDPPPGLTAEEFEDLKPSVLEHHTYSVTPTRQSSSLLAQRIHAPPHAVWSVVRCFDNPQAYKHFIKSCHVKEGFQLAVGSTRDVHVISGLPAATSTERLDLLDDDRHVIGFTIVGGDHRLRNYRSVTSVHGFECDGKIWTVVLESYVVDVPEGNTEEDTRLFADTVVKLNLQKLASVSEGMCGDGDGDGDGGRFLGGKRHCHWRQGSTRHCHWRQSRREGCIAPGSGDIGHVGVRIAILTGDTQSVGLAHRNGEIGLHGVPPALLAGLAVSEIGFKASCRCSQVAHAFLVHDETKHK

SEQ ID NO: 172921 - protein, 94 aa, Glycine max
  Coding DNA Sequence Number=SeqID_81236
  Subcellular localization annotation: CTP_CleavageSite=40; ConfidenceScore=5.15e-01
MSTSDVAPYRACRPWIFFINGVLCFLKINGRGMKKPSNPRSSLMQAPLELVGLGSSSSMDSFASWKMNGSGMEKEEGEETPLQGEDESRRSSPP

SEQ ID NO: 172922 - protein, 142 aa, Glycine max
  Coding DNA Sequence Number=SeqID_81237
MKNLWLNDCCLAKPRLSEPCSLSQSVSSTRVALSEHYSLSASWNRYTDNILGRNILPERNVQIYHTEFDEFKVELERLVYGLFISEGQGRQGQDQLMLLLLLDAILPRKQPVTRAMSKRLEEDWAKAVEEGPRVLMNLRVDF

SEQ ID NO: 172923 - protein, 256 aa, Glycine max
  Coding DNA Sequence Number=SeqID_81238
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=45%, HitCoverage=96%, E-value=4e-24, Identity=56%"; Hit description =Putative uncharacterized protein
MTPVNRKAGTGERTRERQGETPGIFIVLSGFATTDLSVRFRDACQGGGAYGKTALPRPSHFPVKYLPGIFQEISAPFPFFSCHMKHFTDTLISANIETAMTMITPSSKLTLTKGNKSWYRAPPRGRRRGVQGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 172924 - protein, 33 aa, Glycine max
  Coding DNA Sequence Number=SeqID_81239
MYLRDQGTYREDPTKDLALHSPKTSFTTKRKTR

SEQ ID NO: 172925 - protein, 100 aa, Glycine max
  Coding DNA Sequence Number=SeqID_81240
MQPCCKIENSILESTDPTELESQSVSATVNHDRSMLDSTEPTELESQSVSITGDHDPLLRISLTPTKHVSSDELDDEPKNFQISPAQVSSNKLAKHSQAE

SEQ ID NO: 172926 - protein, 242 aa, Glycine max
  Coding DNA Sequence Number=SeqID_81241
  Subcellular localization annotation: CTP_CleavageSite=37; ConfidenceScore=5.43e-01
MSSSLEGCTPLTSDGYTSSLSEGSTSAPLENSRRANCASTTRGGGRSPASTRRLSHSYYANQGKISPTPLQGDECRSCVPPQCRSPPVEVSVGLCRHDIGIVPSTRSPLDPKKSNRALGFLALIIRPPINQAFIEKYCTPKQAQGEAPQQLGDDQQRATGALSPPLESTSTHLQRLERYLRLVANQQATKSKAKEEAPLKRVPVWPHKPTQALANTDFRAWNISSISRPSRDGHSSDRDMGS

SEQ ID NO: 172927 - protein, 273 aa, Glycine max
  Coding DNA Sequence Number=SeqID_81242
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSIAIRVILIRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 172928 - protein, 92 aa, Glycine max
  Coding DNA Sequence Number=SeqID_81243
  Homolog annotation: Hit_ID=A7PXL8; Match level="QueryCoverage=45%, HitCoverage=1%, E-value=3e-10, Identity=71%"; Hit description =Chromosome chr12 scaffold_36, whole genome shotgun sequence
MAYLLKEEFPVERATTRTKCGDAQTRRWSIKKSESGYNRMEQFLASRLREIMKANSCDFFMPKGFGGEEGRMGVEEECGVEGGGGTGKKMKR

SEQ ID NO: 172929 - protein, 91 aa, Glycine max
  Coding DNA Sequence Number=SeqID_81244
MGLNQAPSFNKRFYHVKIKSLEVASLQELGQRMEQLQRQAFLKTYGKIWDLAVIELVPTIEEFERILGCPLGGRKSYLFSGLYPFMARVAK

SEQ ID NO: 172930 - protein, 63 aa, Glycine max
  Coding DNA Sequence Number=SeqID_81245
  Homolog annotation: Hit_ID=Q04357; Match level="QueryCoverage=53%, HitCoverage=8%, E-value=7e-09, Identity=88%"; Hit description=Potato DNA for copia-like transposable element
MILEIANHPRIHQASLAGEFEIKDLGSLKYFLGMEVARSKKGIVVSQQKVYSGPTQRNWDDGL

SEQ ID NO: 172931 - protein, 55 aa, Glycine max
  Coding DNA Sequence Number=SeqID_81246
LASHLKEVSLAIRELLKEVFSKKLLKEVFSRNLLKEASQGSFLKKSSQGSYLVYK

SEQ ID NO: 172932 - protein, 193 aa, Glycine max
  Coding DNA Sequence Number=SeqID_81247
MLAQTWSVLSFSNLVPTSHTLDITLDRARLGFLALIIALCKAKGVISDSFTLESLGSHKAKGKRSEAPPSSEIPPSLAAAPIPSTPSASTFVLPAPLYAGPSNFSFTPQMLHSMLQSLHRGQSIIMQSLEGLGLPSIMSMDEFDLQIPKPSPAPVPEETQPATPVTEPEQPIQDSSAVPTLDLNEDQPQDEQD

SEQ ID NO: 172933 - protein, 147 aa, Glycine max
  Coding DNA Sequence Number=SeqID_81248
  Homolog annotation: Hit_ID=UPI00006A2D9E; Match level="QueryCoverage =78%, HitCoverage=79%, E-value=2e-08, Identity=17%"; Hit description =UPI00006A2D9E related cluster
MVAINPARVPQPPFFQGYDSNATCAYHGGVPEHSIEHCMISKRLHVHTFRGLHVLAIRGLHALTFRGLHVLALRTTRMHALAFRGLQILAFRGLYALAFRGLHVLTFRGLHALAFKGCHALAFKGLHVLAFKGLHALAFKGLHVLAF

SEQ ID NO: 172934 - protein, 81 aa, Glycine max
  Coding DNA Sequence Number=SeqID_81249
MMLPLSNILPSDHNADLPLWKYQLGSCPQDTQWTRKSPTGPWSFQLWLQASISPIGCPVPPARDRARKTPSGPEEVQQGLE

SEQ ID NO: 172935 - protein, 181 aa, Glycine max
  Coding DNA Sequence Number=SeqID_81250
ENRLRSKDAFYNRRPLPHHCLGHSLVDEEAKPAEPFGERRRKMHIHPYILENHGVYPKRFLEDGQFFGVRKTTHDNLDQRLVAEVDRESDLTAYSGYVAMELWADDDDIPTGARIEILFSDRKGIAALLYDHPNISDAFIEWVFCASPVDALTEWKRKAGEGIHENQWCKHAGCKRRNNLN

SEQ ID NO: 172936 - protein, 144 aa, Glycine max
  Coding DNA Sequence Number=SeqID_81251
MACDVAPSYSRGKRATQSLNVRTVIGRHQPLCYCIEAGKRWHFNETFRQRWTTANLSFVQSPKRRETGRAPQGLPVRDPQDRVSLPAEPVEKEKSRGIALYQTLMQSPQRAVFALAIPMSVAATIPRGVDNRHMPKKFFCFLRA

SEQ ID NO: 172937 - protein, 100 aa, Glycine max
  Coding DNA Sequence Number=SeqID_81252
MGRKKLEMGFKDQKIDLDLFVEDKPAAEQNVCLQVMEVGQQVPERKPRAKRIFVHVLSRESQALSDQPLHLRLIWSTKLAKAELSQFQFDLNSAKRRPNR

SEQ ID NO: 172938 - protein, 97 aa, Glycine max
  Coding DNA Sequence Number=SeqID_81253
MVKKPGGPFGPTLKSYLEPHELIVVHASSTIESGASRIDCLALFIYPPPSNLIRSPMNWLPSAVHTSSTIESGAPRIDCLALFVYPPPSNLIQSPMN

SEQ ID NO: 172939 - protein, 82 aa, Glycine max
  Coding DNA Sequence Number=SeqID_81254
  Pfam annotation: Domain name=zf-CCHC; Domain location=46-63; Score =25.1; E_value=0.00024; Accession=PF00098.14; Description=Zinc knuckle
MCVLEEERLIMEEGERVNLTVHGKKKGHQPKNKGKIPAQPVIKKESKCFFCKKKGHMKKDCLKFKSWMDKKGYGKPKDACGK

SEQ ID NO: 172940 - protein, 552 aa, Glycine max
  Coding DNA Sequence Number=SeqID_81255
  Gene Ontology: Mol. function=transferase activity, transferring nitrogenous groups; Cellular component=cytoplasm; Biological process= pyridoxine biosynthetic process
  Homolog annotation: Hit_ID=A8GI22; Match level="QueryCoverage=35%, HitCoverage=79%, E-value=2e-95, Identity=92%"; Hit description =Pyridoxal phosphate biosynthetic protein PdxJ
  Pfam annotation: Domain name=ACPS; Domain location=222-289; Score =82.0; E_value=2e-21; Accession=PF01648.11; Description=4' -phosphopantetheinyl transferase superfamily
  Pfam annotation: Domain name=PdxJ; Domain location=4-234; Score =345.6; E_value=8.7e-101; Accession=PF03740.4; Description=Pyridoxal phosphate biosynthesis protein PdxJ
  Pfam module annotation: Pfam domain module=ACPS::PdxJ; Domain location=222-289::4-234
MADLLLGVNIDHIATLRNARGTQYPDPVQAAFIAEQAGADGITVHLREDRRHITDRDVRLLRQTIQTRMNLEMAVTDEMLDIAIELKPHFCCLVPEKREEVTTEGGLDVAGQLDKMSVAVERLAQAGILVSLFIDPDHRQIDAAVAVGAPYIEIHTGAYAEAQGELAVQAELRRIAVAAAYAAEKGLKVNAGHGGDERAAGRGCRHESADAGSAPVMAVLGLGTDIVEMARIEAVVERSGDRLARRVLSDAEWALYQQHQQPIRFLAKRFAVKEAAAKAFGTGIRNGLAFNQFEVFNDALGKPNIRLHGRAAELAGEMGVTAIHVSLADERRYACATHHELVPQLFVGLAMLRIGDDGVVDRANLLAGRRIIMADALGAAIGIDLINLIAHRNRLVRAFRLAHVAVDAFLGNQQCHCQLSFHRWVVSQLIEINPSLPVKHPALIGIRHTHRRHHLRMGNPYSRLLSKQPDKIERAQGIINDLVLLVAIAQHQQRHLVILPGIAAVTQRTYAADILMGKTVIGEIEQFKRRAGLVQTLINLLDKTISLAIGRE

SEQ ID NO: 172941 - protein, 769 aa, Glycine max
  Coding DNA Sequence Number=SeqID_81256
  Gene Ontology: Mol. function=4 iron, 4 sulfur cluster binding; Cellular component=formate dehydrogenase complex; Biological process= electron transport
  Homolog annotation: Hit_ID=A8GF48; Match level="QueryCoverage=100%, HitCoverage=100%, E-value=0.0, Identity=75%"; Hit description =Oxidoreductase alpha (Molybdopterin) subunit
  Pfam annotation: Domain name=Molybdopterin; Domain location=109-562; Score=-1.2; E_value=4.7e-09; Accession=PF00384.13; Description =Molybdopterin oxidoreductase
  Pfam annotation: Domain name=Molydop_binding; Domain location=646 -754; Score=52.9; E_value=1.1e-12; Accession=PF01568.12; Description =Molydopterin dinucleotide binding domain
  Pfam module annotation: Pfam domain module=Molybdopterin::Molydop _binding; Domain location=109-562::646-754
MKFKRKIQPYRAAAGGWGSLEATTRFVLDSKAALKNMRNLMRMNKARGFDCPGCAWGDDNKSTFSFCENGAKAVTWEATRRVVEPEFFAQHSVSTLYQQSDYFLEYQGRLTHPMRYNSATDHYEPISWDDAFALIAQHLQAMDHPDQLELYTSGRASNEASWLYQLFGRVLGTNNFPDCSNMCHEASGTGLKRSIGVGKGTIRLDDFDHADAIFVFGQNPGTNHPRMLHSLRHAADHGARIVTFNTLRERGLERFADPQKPLEVVTSMAGNISSAYYQPNLGGDMAAVRGMVKALLEEQRKRLAAGEKGIFDQAFIDANTQGVEQYLAAVDDTRWEQIVQQSGLSEAQIREAAAIYQSAERVIITWAMGITQHKHSVDTVREIVNLQLLFGQLGKQGAGLCPVRGHSNVQGNRTMGIDEKPSKAFLDALGAHFAFEPPREHGHNTVEALNAMLRDEVKVLIALGGNLAAAAPDSPVTEEALQHCGLTVHISTKLNRSHLVPGHEGLILPTLGRTERDRQASGNQFITVEDSFSMVHASEGVGIPLAETQRSETAIVAGIAHATLGSDHIDWLGMAADYNVIRDHIAATIPGFADFNRQCDIPGGFYLGNAAAELRFNTPSRQAEFSAAALPTSLFPQLGNDVEVPFTLQTLRSHDQYNTTIYGLDDRYRGVYGQREVVFIHPDDMASLGFSEGQLVDIETLWNDGLTRRVSGFKLVPYNIPRGNLAAYYPETNPLVPLSSYGDGSGTPTSKSVPVKLALTAAAPTQRIA

SEQ ID NO: 172942 - protein, 87 aa, Glycine max
  Coding DNA Sequence Number=SeqID_81257
  Subcellular localization annotation: CTP_CleavageSite=48; ConfidenceScore=5.32e-01
MGQRGADRIGQQGMAQAEQKTVINMSGFGNQGSSSGRMRASLAFIKPVVMAGRTAVFHGHSFRKKRTECTTGKSEKRIATQGLAYRR

SEQ ID NO: 172943 - protein, 507 aa, Glycine max
  Coding DNA Sequence Number=SeqID_81258
  Gene Ontology: Mol. function=endonuclease activity; Cellular component=chromosome; Biological process=DNA metabolic process
  Homolog annotation: Hit_ID=A4W769; Match level="QueryCoverage=99%, HitCoverage=48%, E-value=0.0, Identity=68%"; Hit description =Exonuclease SbcC
  Pfam annotation: Domain name=ABC_tran; Domain location=30-156; Score=- 53.5; E_value=0.018; Accession=PF00005.18; Description=ABC transporter
  Pfam annotation: Domain name=SMC_N; Domain location=2-430; Score= -112.4; E_value=0.0022; Accession=PF02463.10; Description=RecFRecNSMC N terminal domain
  Pfam module annotation: Pfam domain module=ABC_tran::SMC_N; Domain location=30-156::2-430
MKILSLRLKNLNSLKGEWKIDFTAEPFASNGLFAITGATGAGKTTLLDAICLALYHETPRLSKVSQAQNDLMTRDTAECLAEVEFEVKGTAYRAFWSQNRARNQPDGNLQAPRVELARCEDGKILADKVTDKLEQTAALTGLDYGRFTRSMLLSQGQFAAFLNAKPGDRAELLEELTGTEIYGQISAMVFEKHKSARSRLEKCEAQAAGVVLLSEEQQQQLQQSLQALTDEEKTLLVQQQSQQKDFQWLTRHDELVREQQRVTAMQQQAQQALTDAAPELAKLQLAQPAAQLRPLWEHLQEQTARLTQTRQRIIEVNTRLQSRTALRARIRNTALRNHAQLQTELTALAQWLAEHERYRLLGQEIAGWRAQFSQLTRDKTHIATLAARMAELRQKLAEMPENTLTLTADEVSAAMEQQSRTRPLRQRLTSLHARYQPLQKRLLQNAQILQKAQAEQAKLTETLTLRRQQYKEKNQHYLDLKALCETEATIKKLEHYRSQLEAGKPCP

SEQ ID NO: 172944 - protein, 152 aa, Glycine max
  Coding DNA Sequence Number=SeqID_81259
MAFEAEGKGFGTLGIQNSLKLVRRRRKKEKIQAEALPQCFRDQFHERSSPLFIRSSSFVNLQPCQRGIWKGICYASTRLACYQLAKRVEALFKPDLHKIREENGSLLRGLKSVNFRKHRAEQGIKFSSFREISEFLSDCEIPRGGGDIPTPL

SEQ ID NO: 172945 - protein, 31 aa, Glycine max
  Coding DNA Sequence Number=SeqID_81260
MEEIHGEDDEEQGIKLHVELVGLGFKIQMIG

SEQ ID NO: 172946 - protein, 52 aa, Glycine max
  Coding DNA Sequence Number=SeqID_81261
MAIYREKAILGWLKLTQASWSSPKHEAISWPKLKTLKSCKCKRLKMLKYLEM

SEQ ID NO: 172947 - protein, 196 aa, Glycine max
  Coding DNA Sequence Number=SeqID_81262
MKIVISIPLINCGFAGGEQYQENCYFYSINKSDWRQESTMYNYHEKGRAPDLESVLVDFMTYQARSKGDYYSMQHQGTQFEKDYSFADYQWESEWKPYYHKEPEGLSNLDDLLVQFKDIVDSMHKEFKRAETHIGKLVDDMTKVVVRREEEYEEIETHQERILQVNIIHHQLITKEEKDEVSIIPKYPCMATTGYV

SEQ ID NO: 172948 - protein, 238 aa, Glycine max
  Coding DNA Sequence Number=SeqID_81263
MTTLAQVWSVLSYSNLAPTSHTSELTVDRARLIFGLVSCLDMNIGALISSQMTSIAQSNTSRLGFPALIIALCRATGVVSDNLTFERLSLVVAPPGSIPSVEQFREMVVWPGTQPSLHREDEGPTAQVPQHVEDESSEATIPEPFVIGEEAKETHMRQVAAATLERSLEATLEPSAQGEDIPSPQPAADPSTPILEMPEDLTTPVLAMDTSPPATLVLHLIDEEDVQTQDTQDQSQEF

SEQ ID NO: 172949 - protein, 190 aa, Glycine max
  Coding DNA Sequence Number=SeqID_81264
MAPPLTSSPLSSATSPCCVSTNTGGQAQPQIHQPRPEPPTKRKDHPPSFEPHPSISTKKHKAQQPSDPKPLDPRTTLKRKDPNSNKKEVASFAKANKKSLSKHTRRPKLDETLKKNEAFELEDGVYVFVKALSEEKHERKLEENAKHSANKATVMEIDGEPMLKAFIVESIQAQSKQDIKKSQVEELEQV

SEQ ID NO: 172950 - protein, 118 aa, Glycine max
  Coding DNA Sequence Number=SeqID_81265
MDEHQQNWKEMDNIMIKINKELDEMFNIVHLYGEVSRSFAIRLDELEPTWHLLHSSGNMHSVTYNQDLVSPALLAGWMELREFYGLTGNRHVTLTHYGQSIFLLTIFKSSSEPKVFPK

SEQ ID NO: 172951 - protein, 170 aa, Glycine max
  Coding DNA Sequence Number=SeqID_81266
MESDNSSNTGDNIASQEEDATVATIGVHQPNKEVQLAKFDIAEATKVKTKVMSTVATRWRQFKSTLTSKFVFAKSEGQQMQDVVTKYGLDPEAWKQFEETRLTHNWEGIRKRAQSIQKHNDCPHVLSRGGYDLLQKKLLDEKRKRIQEEALLSDNPASLDDPPSPIKRHV

SEQ ID NO: 172952 - protein, 235 aa, Glycine max
  Coding DNA Sequence Number=SeqID_81267
MASNPSRAQKKAKSSKRKQGECSRSTLNRLDTWFIDESKKNNFKMIYSAVVGLDMGGVHKFEESTDGYSKMQTYKGMLLDPARNMRNCLGVGDLTIEDRMLVYLITYILTPRSCNYTQVTDDDLHIVFGLKSGIKMIWILLIEDIMLKSPRLVDYEFSYVVLALRFIDYFNIDDSNEIVDFTKAFSEITKRHLKMLGMRFVEHEWIMAREPPAIANMDQMEEEAEAEAQQEPAQQ

SEQ ID NO: 172953 - protein, 84 aa, Glycine max
  Coding DNA Sequence Number=SeqID_81268
MSVSSRQRARLPPGIESYRYQKCADDRKLSPRAIGHNCLWIAKKVQMTIICLCVPSDSIVFGWRKGVRMTIICLRVLSDVESYR

SEQ ID NO: 172954 - protein, 237 aa, Glycine max
  Coding DNA Sequence Number=SeqID_81269
MAFRGSKIEEKTNFIFCVFLENAMNSLSVPTALSELSGQSLAKPIMQKRNFLQYSLSGPHVAKHLTFERLSPTINLDDIRKNCWNVDDLTVSFRGVRRARARLADIPSTSTASTATPASTSIAPSVPAHVDSQCFKVQDASSETTIPEPFTLHHEEGEEQVRPETAATPERSLEGTSEPPTPVADLSSPQPAAEPSTPKLEILEDPTTLVLALNTSPPATPVLHLTGEEDAQGIPRI

SEQ ID NO: 172955 - protein, 89 aa, Glycine max
  Coding DNA Sequence Number=SeqID_81270
  Subcellular localization annotation: CTP_CleavageSite=15; ConfidenceScore=5.14e-01
MSPDFKHFVSKWPFRGNTGFNKNRRKSLKVYQPHTGQGLTFSPWVKVYGKLGFWLKACRTAGHDICQGLASGSGIKGMSHIISMIHMQQ

SEQ ID NO: 172956 - protein, 293 aa, Glycine max
  Coding DNA Sequence Number=SeqID_81271
  Gene Ontology: Mol. function=chitin binding; Cellular component =extracellular region; Biological process=chitin metabolic process
  Homolog annotation: Hit_ID=UPI00006A17C9; Match level="QueryCoverage =68%, HitCoverage=100%, E-value=2e-23, Identity=28%"; Hit description= UPI00006A17C9 related cluster
MASSSPSVIKDAKVLMVGTGRISYELLMTLTLSSFLDIHIVSTLLYKSFQVFFSLKGFLVFFVKLKDDPIALVEFLSKYCQWVVLTLGANGCIAKHGTKSVDAESNPLKVRTCSPIKARASNPLKARVCDPLKARACSSLKARTCSPLKERACSPLKVRACSPLKARTCSPLKARASNPLKARASSPLKARACSPLKARTCSPQKVRACSPLKVRACSPLNARTCSPLKARTCSPLKARTRSPLKPRACGPLKVRACSPMKARMCDPLKVRACNPLKARVCSRLMVRTCSSLK

SEQ ID NO: 172957 - protein, 85 aa, Glycine max
  Coding DNA Sequence Number=SeqID_81272
MQDFFTRPSGKRTRNDLTSQYNAGGYIPQQDGAGQDGAGDAAHGVFEIEVVITKKTIFLLGSINGHAVTLLVKWVVSYVFSEMPK

SEQ ID NO: 172958 - protein, 128 aa, Glycine max
  Coding DNA Sequence Number=SeqID_81273
MLQPYGINIGLKEHSNPVTPKAYTPKSPSGPLPPDSDRSGFLRERKRLQCERYFSQLKHDIKIPNGENSQKWASNIVFKFHDDPTVNKSKIVIFLRQVRWPAEKREGFGRRKKNEIVRQRRLRSQSEN

SEQ ID NO: 172959 - protein, 458 aa, Glycine max
  Coding DNA Sequence Number=SeqID_81274
  Gene Ontology: Mol. function=transcription regulator activity; Cellular component=nucleus; Biological process=regulation of transcription
  Homolog annotation: Hit_ID=Q8GZ38; Match level="QueryCoverage=99%, HitCoverage=99%, E-value=1e-84, Identity=46%"; Hit description =Putative bHLH transcription factor bHLH016
  Pfam annotation: Domain name=HLH; Domain location=271-320; Score =57.1; E_value=6.1e-14; Accession=PF00010.17; Description=Helix-loop -helix DNA-binding domain
MSQCVPSWDVEDNPPPSRVSLRSNSNSTAPDVPMLDYEVAELTWENGQLSMHGLGLPRVPVKPPTAVTNKYTWEKPRASGTLESIVNQVTSFPHRGKPTPLNGGGGGGVYGNFRVPWFDPHATATTTNTVTMDALVPCSNREQSKQGMESVPGGTCMVGCSTRVGSCCGGKGAKGHEATGRDQSVSGSATFGRDSKHVTLDTCDREFGVGFTSTSINSLENTSSAKHCTKTTTVDDHDSVSHSKPVGEDQDEGKKKRANGKSSVSTKRSRAAAIHNQSERKRRDKINQRMKTLQKLVPNSSKSDKASMLDEVIEYLKQLQAQLQMINRINMSSMMLPLTMQQQLQMSMMSPMGMGLGMGMGMGMGMGMDMNSMNRAHIPGIPPVLHPSAFMPMAASWDAAAAAGGGDRLQGTPANVMPDPLSTFFGCQSQPMTIDAYSRLAAMYQQLHQPPPASGSKN

SEQ ID NO: 172960 - protein, 241 aa, Glycine max
  Coding DNA Sequence Number=SeqID_81275
  Homolog annotation: Hit_ID=A5C365; Match level="QueryCoverage=48%, HitCoverage=14%, E-value=5e-09, Identity=30%"; Hit description =Putative uncharacterized protein
MKDKRDEEEKLEKQKKKKDSKALSSKAKGKEKEENDFSKKIVMKENHFVTKGDIKRALLLKQSFYLLLSRGISLSTAIPLELEVIPQVKELLDEGLVRKSLTPYALLVPKIGIMRHQIPMIGGMMNVLSGATLFCKIIHASNIFMINIYRDLLDQGVVTEPKRTKVIPEWPTPPSIRKIWDFHHLTNFYKRFVPNFSILVAPLIELVLRKKSPEFQEPRDLRPNPFQGGGNDAILPPKGIG

SEQ ID NO: 172961 - protein, 175 aa, Glycine max
  Coding DNA Sequence Number=SeqID_81276
SKVEDACTALGNDTNGSPDKSGEWRIGGQHYAITSRGSRLEALGNYIHGSPKKVENGELANSATQQLRGAPDSKRYTITSRGYRLEGGGLMNSARKLHSWVSEKSREWRIGEQRYATTSRGSILEALGNYIHGSPKKSGGWRIGGQRYAITSRGSRLEGGGHMNSARQLHSWVSE

SEQ ID NO: 172962 - protein, 457 aa, Glycine max
  Coding DNA Sequence Number=SeqID_81277
RHVADQRQVQVEVAAGQERHAEQHRSAAAEDGDQQAHADAADVVEAEARFHRCSALDHVLDQQRHRQHQAGDEATARRVVAAQEQEDRHGQGQREHDLRQVGRHRQLDRRAGHDLLRCHPRAPQQSMHHQRGDAEHGDLAEGIEAAEVDQDHVDYVLAVGLGQRPAQQFAGHRVRRKGHRGVSQRAKAGTGDDRDHRVTALAPARPLRPGLRRQVVHAQQHQHQGHHLDQQLGQGQVGCGQNTKVSATIRLTPRPSTASRRAYRHRRIAPGPPPAVSASANSIHRKPLSSGMPAIASEAMIASALVNGISLRRPHELAHVTGAGFVVDDAGGHEQRGQGGVVEDVEHAGHHRQLISVRQAEQQGTPIALIARAGWKWSSTPAPFRHAGASHSEDRGRSAAVRRAAPRSAAGAGCRRASRTPAVPPAPSTMRECRYAAPGSADAGSRRKCRHGKRGSW

SEQ ID NO: 172963 - protein, 76 aa, Glycine max
  Coding DNA Sequence Number=SeqID_81278
MAAEWRRKRQRRRNFKEKMSLEEAHHHRRPWIRAWRKTATNEGRGREEREILCSKRALKSEPTNPRSSPRFSTKCA

SEQ ID NO: 172964 - protein, 194 aa, Glycine max
  Coding DNA Sequence Number=SeqID_81279
LVCTNNADMTGRLLVGSLAFESRILHYLIVRILLPRSSNLAQVSEEDLIIMWAFHTDRQLDWAHLVRYRMHQALRLNAPLPYPQLVTLFFCHFQIPLDSEPYVPIKRSFLIGAAAIASFGYRKERDGSWVKKGTQPADEEGNLPDEDNSTLLRRLMDKFDGLQTFVGDKFDAMELQVDMLARFVKFRNVAKVEK

SEQ ID NO: 172965 - protein, 69 aa, Glycine max
  Coding DNA Sequence Number=SeqID_81280
MELGLRLEALNDNFSNVLLGITFRIEPLSMSTLAITCVAKLPFGGRTTRDSREVSSKKGTRAESPPTFI

SEQ ID NO: 172966 - protein, 87 aa, Glycine max
  Coding DNA Sequence Number=SeqID_81281
  Subcellular localization annotation: CTP_CleavageSite=77; ConfidenceScore=5.19e-01
MLVRMIHTRLFAATWVKSCPGMHSRCVIASLSGCARTLGHPLISGGVIWSTLKMSRRSPLKARACSPLQARMCSPLMARTYSPLKVI

SEQ ID NO: 172967 - protein, 42 aa, Glycine max
  Coding DNA Sequence Number=SeqID_81282
MGGGGKLPGTTLQANLKRVGLRPQKEKTPEKLAFHRFNRKRK

SEQ ID NO: 172968 - protein, 382 aa, Glycine max
  Coding DNA Sequence Number=SeqID_81283
QQNLPDADGRRQQPARDRQRQQQVRRLARQKLAPAAHALLCHARRHPGASRPIQPVEQPDVVRERQRRHQRPIVTLGAHKGPPALERRLPQHAVGVDVGVVMFDIVMGMVEQHVPHAPTVGIQPQRDAHQGVQPAVGPGPTEKRVMRGIVHHVHRQEHADKDKTEVASEKRPAVLLLQAQPVTQAAQRQQQRHLCQHAAVGEAVIAVGRQIMLGWLTRRSAFMAIGPIRRKKRCCCASSSTIADAAICHAVPLRTSASGHNRRQRRIVAPAGQVLQPARLGLPVAGGGEIVPEHHQQRGKHLAERVSQQHPAPTDADKQVAQDQRHHQHQRHMKQFAQHEQRPTAAPRQHAFFPAAAFYVRADRTNRKSTRCRAARARRSAA

SEQ ID NO: 172969 - protein, 109 aa, Glycine max
  Coding DNA Sequence Number=SeqID_81284
  Gene Ontology: Mol. function=nitrate reductase activity; Cellular component=nitrate reductase complex; Biological process=nitrate metabolic process
  Homolog annotation: Hit_ID=A8GFU4; Match level="QueryCoverage=100%, HitCoverage=8%, E-value=3e-56, Identity=93%"; Hit description =Nitrate reductase, alpha subunit
MLKYLLGTENGIQGKDLGQQGGVMPQEVEWREQGGEGKLDLVVTLDFRMSSTCLYSDVVLPTATWYEKDDMNTSDMHPFIHPLSAAVDPAWDSKSDWEIYKGIAKAFSE

SEQ ID NO: 172970 - protein, 115 aa, Glycine max
  Coding DNA Sequence Number=SeqID_81285
  Homolog annotation: Hit_ID=A5ZQM3; Match level="QueryCoverage=59%, HitCoverage=95%, E-value=2e-20, Identity=53%"; Hit description =Putative uncharacterized protein
  Subcellular localization annotation: CTP_CleavageSite=61; ConfidenceScore=5.20e-01
NSNVGQGTYGPRGQFSGRQFLWGVGLPKGNGGVQKVSSGQTEIGPRVQKAEGSLTARPTRRAGTKVGLSDPTVPSGRAVAQRIKGWAVRPLKRYVSWVQNVVRQFGPYPVWALEH

SEQ ID NO: 172971 - protein, 48 aa, Glycine max
  Coding DNA Sequence Number=SeqID_81286
MGAKCLEVLKQGSHPNNGWSPDEIRAFSEEIAKRAYRAKLSALSEFIL

SEQ ID NO: 172972 - protein, 99 aa, Glycine max
  Coding DNA Sequence Number=SeqID_81287
MLVKNLNRSLRVHDKIVHTLEDQSGSAPTIWDQHRLQGTFKPSVFTPKAYTPKSLSGALLPDSGPTQKTFYHVNSIYELYKTHDSLIVLKIILSRRACD

SEQ ID NO: 172973 - protein, 68 aa, Glycine max
  Coding DNA Sequence Number=SeqID_81288
MTKDFHCSEDTSCYNEASSLANDTSLESSCSLTNFRYGESCTRCGEWLLNILVFNIHIHCGKSSHSFT

SEQ ID NO: 172974 - protein, 72 aa, Glycine max
  Coding DNA Sequence Number=SeqID_81289
MLMHALLRSFNSGNWSDSKVLDIVYVCLNAVLVEFSATRGICGRCLIRIRLTYHEESGFSISGDTIGTHEHC

SEQ ID NO: 172975 - protein, 80 aa, Glycine max
  Coding DNA Sequence Number=SeqID_81290
MENWRRALRNNFAGLQTRWWRMHEQRQAMTFMGLRKKVENGELRQTMTFMGLRKKVEGDWEQRYSITFAGLQSVGGGMNR

SEQ ID NO: 172976 - protein, 26 aa, Glycine max
  Coding DNA Sequence Number=SeqID_81291
MGRSCALSFTRLFRVSVERYLEYACM

SEQ ID NO: 172977 - protein, 70 aa, Glycine max
  Coding DNA Sequence Number=SeqID_81292
  Subcellular localization annotation: CTP_CleavageSite=22; ConfidenceScore=5.19e-01
MTLQIPPHLAFCILGKFKRLIRTKMPKSSPNMHVNQEVSTRVKPRLLSKQSMGQNTSNKIDDDGSKSHQG

SEQ ID NO: 172978 - protein, 112 aa, Glycine max
  Coding DNA Sequence Number=SeqID_81293
MVYRLKVSEEDSIIMWVFLTGHQIDWAHLVRYRMHKALRSNAPLPYPHLITLFLHHFNVPLDSKPFVKVKRSFSIDTNVVSSFGYRKERDGSWVKKDALAQAAADRSPSPPP

SEQ ID NO: 172979 - protein, 124 aa, Glycine max
  Coding DNA Sequence Number=SeqID_81294
MAIFRGGFDDYIINVNLHKCVYKIMKHGIHGPLISGVATYPSAGGRRVTRGLRVPRKEYARSRHQRLFEENIGKTGKDAIYELLSERFGSCIYARGRVFPFAPTYSSFGMRNQTYVVLSDKVFG

SEQ ID NO: 172980 - protein, 84 aa, Glycine max
  Coding DNA Sequence Number=SeqID_81295
MAQTPPRERTLREMATLDFTYESLCIQYPDEGVPYVLKTGLIHLLPKFHGLAGEDPYKHLKEEWPKIGCTTLLPDPSPARMIFT

SEQ ID NO: 172981 - protein, 96 aa, Glycine max
  Coding DNA Sequence Number=SeqID_81296
MGGANSNFQILIWAFQTIFRSWIASEGSNPARLGKLGGNLLPLCPIKRQKGTVLRVPDSPDYAFQLRGASVTLPRRFRKQIREGFPPFFIRSSFFN

SEQ ID NO: 172982 - protein, 142 aa, Glycine max
  Coding DNA Sequence Number=SeqID_81297
MEAMKEQMTTMMEAMMSMRKIMEVNTATVIAASIATKVDQTHPSGLNQVQSKHSFPPYGLPPNYTPPTVAHAPDENVDNLAPIPIKNQQPQSGHAQSPSCYGGDYAFVDMAELCLVPDVVIPPKLKVPNFNKYKGTTCPKIT

SEQ ID NO: 172983 - protein, 97 aa, Glycine max
  Coding DNA Sequence Number=SeqID_81298
MERYLQHLVHQQATNHRGQVQIHECLYQLSLSQQGQGFAPFACPTPDQFRAEVAWPRDWPEDQTEEAPAGAPGDAEDARMDEEMTDLLGFLERSGAT

SEQ ID NO: 172984 - protein, 70 aa, Glycine max
  Coding DNA Sequence Number=SeqID_81299
QEPNIEEPPAPAPAAEEETTPDQTPQPSPAPAHIPEDVAPVVESEQPIQDSLAASALDLNENQPQEEQDV

SEQ ID NO: 172985 - protein, 300 aa, Glycine max
  Coding DNA Sequence Number=SeqID_81300
  Pfam annotation: Domain name=Transposase_23; Domain location=112-181; Score=6.2; E_value=0.00025; Accession=PF03017.5; Description =TNP1ENSPM transposase
MTTEPAKEITEKIDILAAAIGRPEHPGRVRVAGAGVTIKQYFGSAPRTDQLEESIIEKVTRQVMASFSQLQSQMQSQGLVVPSEPLVGPGPFGPRVSTKGSCVDPSGNDPETGDSDRCGWYIEADPARLVAVGRVYEGSTVHSTPLLPGQVKVSVDEVKDADAPVPVPTDEVSLVGQALHTFLAWPTHLVKSLSQQVAVSPPKPPPKPDPEVDDPLYLMTLTIPELFLRPYQVRWDATVFGVVNPDFPLYIKHEDLSEIAHGGQCLSISVLQLWILHLTETCMRAGNSDIYGFLEPQSIQ

SEQ ID NO: 172986 - protein, 257 aa, Glycine max
  Coding DNA Sequence Number=SeqID_81301
  Homolog annotation: Hit_ID=A5BSR3; Match level="QueryCoverage=38%, HitCoverage=28%, E-value=7e-07, Identity=37%"; Hit description =Putative uncharacterized protein
  Pfam annotation: Domain name=Transposase_23; Domain location=161-231; Score=-6.6; E_value=0.0062; Accession=PF03017.5; Description =TNP1ENSPM transposase
MARTKKTGQITSEAAKEITKKIDSLEEQASQGSFVLHGCQDLLTTVIGRPEHPGHVRAARASVLIKQYFGSTPRSSHISSSMPPEELEQLTQQIRDQLEESITKKVTWQLMLSFNQMLSQLQSQIQSQGLALPPKPEVGPSATRVNTKGSCVDLSLTNPETVDSDKCGLYIEDNLSRLVALGRVYEGSTMVHNIPLLHDQVKVGVEEVEDAKAPIPIPTNEVILVGQALNTFLACPTHLVKRVSDQVFYFHYMLFFN

SEQ ID NO: 172987 - protein, 302 aa, Glycine max
  Coding DNA Sequence Number=SeqID_81302
  Subcellular localization annotation: CTP_CleavageSite=32; ConfidenceScore=5.01e-01
MAEPSKKRKGTSSQSQRHSGSQETPIPPSIPSGSLFSSEEQCIRNPNVYGTKIVIDQSLFYDLTQLPSEGVPFEGALIDDWKFDFSVHDARRLVCTNQADMIGRLLAGSLAFESRILHYLIVRVLLPRSSNLAQVSEEDLIVMWAFHKGLQMDGAHLVRYRMHKALRLNAPLPYPHLVTLFLQHFNIPLDSEPYVPIKRSFLIGASVISSFGYIKEHDGSWVKKGARNVGEEGHEGEDSSLLTNIMDRFDGLQTFVGERFDTLELQVDMRFNEMESRITKVEEDVSYIRSSFYLPPAPPPSS

SEQ ID NO: 172988 - protein, 423 aa, Glycine max
  Coding DNA Sequence Number=SeqID_81303
  Gene Ontology: Mol. function=hydrogen ion transporting ATP synthase activity, rotational mechanism; Cellular component=proton -transporting ATP synthase complex, catalytic core F(1); Biological process=plasma membrane ...
  Gene Ontology: Biological process=ATP synthesis coupled proton transport
  Homolog annotation: Hit_ID=Q7HDI4; Match level="QueryCoverage=100%, HitCoverage=92%, E-value=0.0, Identity=89%"; Hit description=ATP synthase subunit beta
  Pfam annotation: Domain name=ATP-synt_ab; Domain location=112-297; Score=218.4; E_value=1.7e-62; Accession=PF00006.16; Description=ATP synthase alphabeta family, nucleotide-binding domain
  Pfam annotation: Domain name=ATP-synt_ab_C; Domain location=310-417; Score=179.0; E_value=1.3e-50; Accession=PF00306.18; Description=ATP synthase alphabeta chain, C terminal domain
  Pfam annotation: Domain name=ATP-synt_ab_N; Domain location=1-56; Score=44.4; E_value=4.1e-10; Accession=PF02874.14; Description=ATP synthase alphabeta family, beta-barrel domain
  Pfam module annotation: Pfam domain module=ATP-synt_ab::ATP-synt_ab _C::ATP-synt_ab_N; Domain location=112-297::310-417::1-56
MPNIYNALIVKGRDTVGQQINVTCEVQQLLGNNRIRAVAMSATEGLMRGMEVIDTGAALSVPVGGATLGRIFNVLGEPIDNLGPVDTRTTSPIHRSAPAFIQLDTKLAIFETGIKVVDLLAPYRRGGKIGLFGGAGVGKTVLIMELINNIAKAHGGVSVFGGVGERTREGNDLYMEMKESGVINEQNIAESKVALVYGQMNEPPGARSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVSLAETIRGFKLILSGELDGLPEQAFYLVGNIDEATAKATNLEMESNLKK

SEQ ID NO: 172989 - protein, 81 aa, Glycine max
  Coding DNA Sequence Number=SeqID_81304
MWERNEDHSGQEEEENEEAWDWEALSLSGRGEGEEERWREWVDKRKRLRWWWWWWWRRRRGKGVARRKRNLGATPPIFVVC

SEQ ID NO: 172990 - protein, 139 aa, Glycine max
  Coding DNA Sequence Number=SeqID_81305
  Gene Ontology: Cellular component=mitochondrion; Biological process =cellular iron ion homeostasis
  Homolog annotation: Hit_ID=A2Q4D6; Match level="QueryCoverage=36%, HitCoverage=32%, E-value=5e-17, Identity=78%"; Hit description =Frataxin-like
  Subcellular localization annotation: CTP_CleavageSite=15; ConfidenceScore=5.45e-01
MATQLLFFTFAAEVTKAMASKLLLKRRLFRFLQLSQPSFSSIHAAPILSVKASEFMFPYKENALLPPLSSSSRNFCSRSFNLDESQGPLTIDYSSLLQEGEFHRLADSTIHSLQEKLEDYGDSVEVDGFDIDYGVSMIL

SEQ ID NO: 172991 - protein, 82 aa, Glycine max
  Coding DNA Sequence Number=SeqID_81306
VFDSRDDVLQWARSITHENGFVAVIIRSDTNTSSRGRTSFVLIGCERSDEYRCRKKEFVRRDTETRKCVYPFKLQGKPVVGW

SEQ ID NO: 172992 - protein, 124 aa, Glycine max
  Coding DNA Sequence Number=SeqID_81307
MMLINVIETVESTMNCNKGLSIVFYFNNKKKRAPSIELDYPSSSTSGMFPTVLKVCPLYEEDDVYENKFEDALSDDDLDNINEEVCLDDIDALLAGKKNQEHNIIQTIEGDEEWEIFYIMRQPF

SEQ ID NO: 172993 - protein, 496 aa, Glycine max
  Coding DNA Sequence Number=SeqID_81308
  Gene Ontology: Mol. function=drug transporter activity; Cellular component=membrane; Biological process=multidrug transport
  Homolog annotation: Hit_ID=A7Q9Z0; Match level="QueryCoverage=94%, HitCoverage=97%, E-value=0.0, Identity=66%"; Hit description =Chromosome chr8 scaffold_68, whole genome shotgun sequence
  Pfam annotation: Domain name=MatE; Domain location=265-428; Score =117.9; E_value=3e-32; Accession=PF01554.9; Description=MatE
  Pfam annotation: Domain name=MatE; Domain location=45-205; Score =125.8; E_value=1.3e-34; Accession=PF01554.9; Description=MatE
  Pfam module annotation: Pfam domain module=MatE::MatE; Domain location=265-428::45-205
MEGHLKQKLLRNKERRTSSEQEEEELSLVKRVWNESQVMWIVAAPAIFTRFSTFGISVISQAFVGHIGSKELAAYALVFTVLVRFANGVLLGMASALSTLCGQAYGAKEYGMMGVYLQRSWIVLFLTAVCLLPVFIFTSPILMLLGQDESIAQVAGNIALWSIPVMFASIVSFTCQTFLQSQSKNVIIAFLAAFSIVIHVFLSWLLTMKFQFGIPGAMISAGLAYWIPNIGQLIFVTCGWCSDTWEGFSFLAFKDLWPVVKMSLSAGAMLCLELWYNTILVLLTGNMKNAEVEIDALSICLNINGWEMMISLGFMAAASVRVANELGRGSAKAAKFSIIVSVLTSLAIGFLLFLFFLFFRERLAYIFTSNKDVAFAVGDLSPLLSVSILLNSVQPVLSGVAIGAGWQSIVAYVNMGCYYAIGIPVGIVLGNVLDLQVKGIWIGMLFGTLIQTIVLIVITYKTNWDEQVTIAQKRISRWSKVDNADQENEAQRKYVS

SEQ ID NO: 172994 - protein, 48 aa, Glycine max
  Coding DNA Sequence Number=SeqID_81309
MLYAALPLHMQRGCFRIRTHDQQVTKAQLYRCTKATKQKNQQLSALDS

SEQ ID NO: 172995 - protein, 435 aa, Glycine max
  Coding DNA Sequence Number=SeqID_81310
MKLSVCKRYVNLKWIKFMSIIKNMRGKQLEDSRAKGREEAIPKPYLSKHHQIGRSPNNEGLHEQPCQKVEQNPQCDRNRKGWQSLPAHGQQNERAAKPRNNGEVARIHSHQIIHSRSTHKNTVENKVPKSKLNPSFTNLPPHPFPFLLIFPHTTHLNKWRHSLINNNLTKSHSTNQRRPFPFIVNPILPIIIVTTQIVIIITINPRHYLKLNSGSFGIRNPGDDKPNRRGVVSRIHRRPCLVDQRRELLVAARLQFDEELERAAGSEDGYQVVERERDEDRPRGPLGKLGEPRGNDDAEADRVALAEQDREAAAGKDGEDSDDGEVEEEEKGGDGVEGDGEAFQEGEEDGSAHGGEDEEGGEARVVEEEGGAVVVVEEDEEEGCERDEDDEDDGVEDRALELLRGGVGGVLSVDEVGGGGDGGGGGGRRGEGVHQ

SEQ ID NO: 172996 - protein, 163 aa, Glycine max
  Coding DNA Sequence Number=SeqID_81311
MKMIQAAALTRKPGSDKVCYEGKISSIIFSPGSFSKHSYDDRFANEGSGPRISDFSMSNGGEQIKTDVQHSGTCSSEDVWSHAINMFLETNSKRDADGIHRLQLLAACPQGMLGSHCKALGSPTTTSFCSVVLSGSYHFRCLKIFVLENIGSDDKSRNWVTAH

SEQ ID NO: 172997 - protein, 318 aa, Glycine max
  Coding DNA Sequence Number=SeqID_81312
  Gene Ontology: Mol. function=pyridoxal phosphate binding; Cellular component=chloroplast; Biological process=cysteine biosynthetic process from serine
  Homolog annotation: Hit_ID=A7Q9Z5; Match level="QueryCoverage=74%, HitCoverage=60%, E-value=4e-97, Identity=75%"; Hit description =Cysteine synthase
  Pfam annotation: Domain name=ADH_zinc_N; Domain location=57-218; Score=-17.6; E_value=0.022; Accession=PF00107.17; Description=Zinc -binding dehydrogenase
  Pfam annotation: Domain name=PALP; Domain location=27-279; Score =270.6; E_value=3.3e-78; Accession=PF00291.16; Description=Pyridoxal -phosphate dependent enzyme
  Pfam module annotation: Pfam domain module=ADH_zinc_N::PALP; Domain location=57-218::27-279
MLKGFSFVKYWFCEMLDNHVPDPEFEIYDVLTSVNVQNVRIGYSMLSDAEEIGAISPGKTILVEPTTGNTGLGIAFVAATKGYKLIVTMPASINVERRILLRAFGAEVVLTDAEKGLKGAVDKAEEIVRNTPNAYMFRQFDNMTNTKIHFETTGPEIWEDTMGNVDVLVAGIGTGGTVTGTGRYLKMMNKNIKVVGVEPADRSVVSGDSPGFMPSILDIKLLDEVIKVTNVEAVEMARRLALKEGLLVGISSGAAAAAAINLARRPEHSGKLIVLELLNVALNSLFCFLLLLWSQMHHSDKAQFLKLRSFRKLKWGLT

SEQ ID NO: 172998 - protein, 261 aa, Glycine max
  Coding DNA Sequence Number=SeqID_81313
  Homolog annotation: Hit_ID=P03851; Match level="QueryCoverage=32%, HitCoverage=100%, E-value=1e-43, Identity=98%"; Hit description =Uncharacterized 9.4 kDa protein
MTVKTSDTCSSRRRSQLVCKRMPGADKPVRARQRMRKEKIPHQAPFAIQAAQLLGRAIGAGLFAITPAGERGMCCKAIKLGNARVFPVTTFRETCRASCINESANARGEAVCVLGALPLPRSLTRCARSFGCGERYQLTQRRTIKIPGVSPWKLPRALSCSDPAAYRIPVVRSKLGCVHEPPVQPDRCALSGNYRLESNPVRHDLSPLAAATGNRISRARYVGGATEFLKWWPNYGYTRRTVFGICALLKPVTFGKRVGSS

SEQ ID NO: 172999 - protein, 281 aa, Glycine max
  Coding DNA Sequence Number=SeqID_81314
  Homolog annotation: Hit_ID=UPI00016621D1; Match level="QueryCoverage =80%, HitCoverage=38%, E-value=3e-13, Identity=30%"; Hit description =UPI00016621D1 related cluster
GLHALVFRGLHVLAFRGLHVLTLRGLHILSFRGLHVLAFRGLRALTFRGIDVLAFRGLHVLALRALHVLTFRGLHVLAFRELHVFTLRGLHVLTFRGLHVLAFRGLHVLAFRGLHALTFRRQHVLAFRGLHVLAFREMHALACLHLQRTTGPRHLRTARPRLQMTTRLRLQRTTRDYSSSPSEDFHVLAFRALHVLSFRGLHVLAFRGLHVLPFRGLHVLTFRGLNVLAFRGLHALMHPHLQRTTGPRLQRTARPHLQRTTRPRLQRTARPCLQRTARPHL

SEQ ID NO: 173000 - protein, 160 aa, Glycine max
  Coding DNA Sequence Number=SeqID_81315
VPYGYPHLSSSRDGKSDDMQGYRMVIDTFGHLETASPMTCGDGKSDDMQRYRMVIRTFGHLETASPMTCGDGKSDDMWGYRMVIHTFGHLETASPMTCGDRKSDDMQGYRMVIRTFCHPETASPMTCGGTNVVLCTFRQPKGNEPVDAQRLTSSSTPFVI

SEQ ID NO: 173001 - protein, 107 aa, Glycine max
  Coding DNA Sequence Number=SeqID_81316
MTAPLDESISCFLIRVDPWVLVPIAFRGLHALAFRGVHVLDFRGLHILALRGLHALAFRGLHRATCPRLQRKTHPRLKRATHPCLNRVARPHLQRAAHPHLQRSGIL

SEQ ID NO: 173002 - protein, 153 aa, Glycine max
  Coding DNA Sequence Number=SeqID_81317
RRRERRRHPVENKPWKEKLHHQESALDKKLREEPSMEEENERESISRIFPLDLMMKSIQFQVKKRLSHEVLKVIVELSSSIGLSVYPPLSAASVLIARQKNLAEHQCQARLNARLVLSSNPLTRAKREGGAKAHHNAYFGKRALEAARGAAFA

SEQ ID NO: 173003 - protein, 87 aa, Glycine max
  Coding DNA Sequence Number=SeqID_81318
  Homolog annotation: Hit_ID=Q0ZDG6; Match level="QueryCoverage=100%, HitCoverage=49%, E-value=2e-08, Identity=39%"; Hit description =Lipoxygenase 1
MALAKELIGFSSFVSTSYKVFLHHKHGTFCVNTILLPLDNTRVVRLRKGAKLPMAAIKTILKHLDAINDRIGTRNIVLELMSTEIDP

SEQ ID NO: 173004 - protein, 415 aa, Glycine max
  Coding DNA Sequence Number=SeqID_81319
  Gene Ontology: Mol. function=motor activity; Cellular component=cell projection
  Homolog annotation: Hit_ID=UPI00016621D1; Match level="QueryCoverage =65%, HitCoverage=40%, E-value=3e-20, Identity=33%"; Hit description =UPI00016621D1 related cluster
GGPLGTSTLTLRGLHILTFRGLHVLAFRGLHVLAFRGLHALTFRGLHALNFRGLHVLICRGLHPLIFRGLHVLTFRGWHAPTFKGLHALTFRGLHVLTFRGLHVLAFIGLHALTFKGLHVLTFRGLHVLTFGGLHVLALRGLHVLTFRGLHVLAFIGLHALTFRGLHVLTFRGLHVLTFGGLHVLALRALHLLVIRGLHALNLQRVTSTHLQRTRRLHALTFRGLHVLTFRGSRTLTFRGLYVLTFGGLHVLALRGLHVLAIRGLHALNLQRGYTPSPLEDYTSSPSEGRAPSPSEDYTSSPSENCTSSPSEDCTSSPSEDYTSSPSEDCKSSPSEDYSSSPSEDCTSSLFRGRHALTFRGLHVLAIRGLDVLAFRGLHILHFRRLHVLAFRGLRALTFSGLHICALREFKVLFP

SEQ ID NO: 173005 - protein, 42 aa, Glycine max
  Coding DNA Sequence Number=SeqID_81320
MVPACHRARRLWMTKGAEDEGHYDRDCGAADKSEALAPTYPQ

SEQ ID NO: 173006 - protein, 194 aa, Glycine max
  Coding DNA Sequence Number=SeqID_81321
  Gene Ontology: Mol. function=RNA-directed DNA polymerase activity; Biological process=regulation of transcription, DNA-dependent
  Homolog annotation: Hit_ID=A5C5B9; Match level="QueryCoverage=100%, HitCoverage=13%, E-value=8e-19, Identity=29%"; Hit description =Putative uncharacterized protein
MEPEYWDKNPFKATAKVFPPGFHYRPSTLNKTKKFYEFILIDTNSVSMKHFKDPKDPNLNTHSTIQILKVMQPRHYGSNLNQPKKFSAPFDLAEEVQHGFQQFNKLFNNKESRIPADLKYFSSFALSWIFSWQYRYGKSENNKQYPPLQRHAFVKWWSQFDTSKAAPDQVENWFQSNPEFLKPADPETSLFLNQ

SEQ ID NO: 173007 - protein, 109 aa, Glycine max
  Coding DNA Sequence Number=SeqID_81322
MGNLYPFLWVVLGMLEVVSNPRRFTVGNWLCDSDLVSPTGIERVLTEKDLLADSYSDLEAFILDEKEFLLLKVISTFPELSCLIFSIIGAGRGSDGVAFSMTHFSGRVT

SEQ ID NO: 173008 - protein, 232 aa, Glycine max
  Coding DNA Sequence Number=SeqID_81323
MVGAFSQNIVTLTGLPMILLSESDLTNPWCARNVITHSLYVVVFGSCDDLELVFGRLSRIYYASRGNFTRAAAKRRVRIMRTNMTTLTWIWMTSLFSNILPSDHNANLPLQMYQLGSRPQDAQWTRRSPTGPWGFQLWWQASESHPQRHSVDPEKSNRAMGFPTLVTGLCSPTGCPFPPARSRHHDIGIAHARHLVDPKKSNRVLKFPSSNYEPLSALRSACRPQQGHQTPY

SEQ ID NO: 173009 - protein, 43 aa, Glycine max
  Coding DNA Sequence Number=SeqID_81324
MHDAILPRKGPITRTMSKRLQEDWARAAEEGPRVLMNLRGSIL

SEQ ID NO: 173010 - protein, 75 aa, Glycine max
  Coding DNA Sequence Number=SeqID_81325
MGRVFTLNNAKASKSKNLIQVSKDRMFISANQVITSSKEDAQVYMILSNLEVETKVSMGDLPIVREFPKVFPEDI

SEQ ID NO: 173011 - protein, 87 aa, Glycine max
  Coding DNA Sequence Number=SeqID_81326
  Homolog annotation: Hit_ID=A5C7C5; Match level="QueryCoverage=77%, HitCoverage=10%, E-value=9e-09, Identity=41%"; Hit description =Putative uncharacterized protein
MVAGNTTIEKPREEWSEEQKKLVQYNLKAKNIITSALGMDEYFRVSNCKSAKDMWDTLQVTHEGKIFPNEDLINEVLRCLSREWQPK

SEQ ID NO: 173012 - protein, 230 aa, Glycine max
  Coding DNA Sequence Number=SeqID_81327
  Subcellular localization annotation: CTP_CleavageSite=29; ConfidenceScore=5.19e-01
ALISGQMTSIAQSNTSSLGFPALITALCRARGVVSNSLTFEQLSPIINLAYIRKNCWNPEYLIVSIRGVRRVRAKLAELPSTSAAPTPASMSASPSVPTQIDSQRLEAMLQRSIPSVEKFRELVAWLGTQSSLHREDEGPTTQVPQHMEDESYEATISEPFTIEEEADDTQTTQVAAATPERSLEAISEPPTPAVDPSSPRNRPFHSSSRDARGPDYTSPNYGDFSSSYS

SEQ ID NO: 173013 - protein, 135 aa, Glycine max
  Coding DNA Sequence Number=SeqID_81328
MDNEEGVQEQMKADLLALKDQMASITEAMLKLQKTLEDNATATASNAVREAEPVLQPTINLGRDRNPMVFGRRYSPQAYPYGLPPDFTPRAAPEDVSQAPTFEGQLPPYADYALKEDNEGDAHLGPLLPLKDPAP

SEQ ID NO: 173014 - protein, 492 aa, Glycine max
  Coding DNA Sequence Number=SeqID_81329
  Homolog annotation: Hit_ID=A9MN04; Match level="QueryCoverage=23%, HitCoverage=89%, E-value=7e-46, Identity=81%"; Hit description =Putative uncharacterized protein
MSTHPCFPSNIDMLVLSHFDEDHVNGVEDLLRHCHGTSPSTALLQLNPLQWLATREFDVQVDEVVLIQGGSDRPPNALGEEKPNPKPDDFQRDDDSSILGDGYFTFNQPTALGTIKLRTIKHDRPINLIMRPNSLSPTSRLATLCTGDIHLTPEVISDLRNHLGPQRWDKIGLIQVPHHGSKNSWKVGNAALLSPAQFLHCASGTKHHPHSTAAEEAFHRAVIPAVSPPTDALLYSVTPEKLLIFQACILASLIAMEHDITRLATRLICHPQSTPADNSAGKKIHYDRQIAPAISCPDISNISAPYPVWLRYSELALEQIWQACMLLTGIFVLIFSELTTAQVQGFHQTPGTVTAHRNAVLGQHFSQSARASRATALVPCPAYLAVQPDSRRINSIASFLPVPVPATVYSQSGTKSDYRVAVAQPGNYREPFSESDIKSATANLLFQLADTLLLWGNGGGRRRNTLALSSELAYPRFKRGRTNINRFTGLSI

SEQ ID NO: 173015 - protein, 48 aa, Glycine max
  Coding DNA Sequence Number=SeqID_81330
  Gene Ontology: Mol. function=oxidoreductase activity; Biological process=electron transport
  Homolog annotation: Hit_ID=A8GD62; Match level="QueryCoverage=100%, HitCoverage=12%, E-value=8e-18, Identity=87%"; Hit description =Putative reductase Spro_1949
LNDNNINELTDYQGYKAEFLRLFGFGLQGVDYDADLSGEANFDVIELV

SEQ ID NO: 173016 - protein, 96 aa, Glycine max
  Coding DNA Sequence Number=SeqID_81331
  Gene Ontology: Mol. function=oxidoreductase activity; Biological process=ethylene biosynthetic process
  Homolog annotation: Hit_ID=Q330J7; Match level="QueryCoverage=81%, HitCoverage=34%, E-value=3e-23, Identity=55%"; Hit description=1 -aminocyclopropane-1-carboxylate oxidase 2
  Pfam annotation: Domain name=2OG-FeII_Oxy; Domain location=21-91; Score=6.7; E_value=0.032; Accession=PF03171.11; Description=2OG -Fe(II) oxygenase superfamily
MVQEGDEGFWFEKAFYGSRGPTFGTKVANYPPCPNLVLVKKGLRPHTNAGGIILLFQDDKVITNGKYKSVEHHVIAQTDGTKCLLPHSLCVIAQTD

SEQ ID NO: 173017 - protein, 323 aa, Glycine max
  Coding DNA Sequence Number=SeqID_81332
  Gene Ontology: Mol. function=glycerol-3-phosphate dehydrogenase activity; Cellular component=glycerol-3-phosphate dehydrogenase complex; Biological process=glycerol-3-phosphate metabolic process
  Homolog annotation: Hit_ID=Q9SS48; Match level="QueryCoverage=95%, HitCoverage=51%, E-value=1e-147, Identity=78%"; Hit description =Putative glycerol-3-phosphate dehydrogenase
MADKSARDMISPSSGVHIILPDYYSPEGMGLIVPKTKDGRVVFMLPWLGRTVAGTTDSNTSITFLPEPHEDEIQFILDAISDYLNVKVRRTDVLSAWSGIRPLAMDPTAKNTESISRDHVVFEDHPGLVTITGGKWTTYRSMAEDAVNSAIKSGKLTPANGCITNNIRIVGGEGWDPVSFTILSQQYMRMKVTYRGKVVPGVMDTASAKHLSHAYGTLAERVAAIAQAEVAYCARHEYCESAIDFIARRSRLAFLDTDAAGRALPRVIQILAAEHKWDKSRQKEEMFKAKEFLETFKSSRNAQFYDGKHNYDVSHIRGLWLLL

SEQ ID NO: 173018 - protein, 132 aa, Glycine max
  Coding DNA Sequence Number=SeqID_81333
  Subcellular localization annotation: CTP_CleavageSite=75; ConfidenceScore=5.65e-01
MRIYPRGGAKRSFSGIFLNSGSPRLASGLPGPPNNFMGKKPTRLGKLIASALSNSSPGRATMTLSALFPINRHAREAKGRGKGPEVKELKERREKKKKEEKMKLKHCRITIVINFYIVLRSFFVRHPVLTDH

SEQ ID NO: 173019 - protein, 59 aa, Glycine max
  Coding DNA Sequence Number=SeqID_81334
  Subcellular localization annotation: CTP_CleavageSite=46; ConfidenceScore=5.05e-01
MALLVLARLAQLCIWTQVVRLAGLALAQRTFIARPSSRFFLALSKRSVALSQPIGLASG

SEQ ID NO: 173020 - protein, 395 aa, Glycine max
  Coding DNA Sequence Number=SeqID_81335
  Gene Ontology: Mol. function=RNA-directed DNA polymerase activity; Biological process=regulation of transcription, DNA-dependent
  Homolog annotation: Hit_ID=Q8H6Q8; Match level="QueryCoverage=94%, HitCoverage=55%, E-value=5e-56, Identity=36%"; Hit description=CTV.20
QHFIGDPSLWKDRSAELLSNLKCRTLEDFRWYRDTFLTRVYRKEDSQQPFWKEKFLAGLPRSLGDKVRDKIHSQSASGDIPYESLSYGQLISYVQKVALKICQDDKIQRQLAKEKAQTKKDLETSEEETKTSSSEPSDENLNLIQQDDQLSSIDDDDGQINTLTREQDLLFKAINSIPDPQEKKVFLEKLKKTLEVKPRQKDFITNNKFDVSNILKRLENSSTKPTTIQDLQTEINNLKREVKELRQQQEIHQIILSQLEEDSDPESANNSEENQPENLEDDMFMGLINKIKIQNFYINIKIIINDFVLETMALFDTGADSNCILEGLIPTKFFEKTSKKLSTANDSKLKINFKLSNAIIENQGLKINKNFLLEASTLKNRPSRLLRFKEYDRFK

SEQ ID NO: 173021 - protein, 225 aa, Glycine max
  Coding DNA Sequence Number=SeqID_81336
  Gene Ontology: Mol. function=phosphoprotein phosphatase activity; Cellular component=protein serine/threonine phosphatase complex; Biological process=protein amino acid dephosphorylation
  Homolog annotation: Hit_ID=A7P656; Match level="QueryCoverage=38%, HitCoverage=24%, E-value=2e-31, Identity=79%"; Hit description =Chromosome chr4 scaffold_6, whole genome shotgun sequence
  Pfam annotation: Domain name=PP2C; Domain location=2-164; Score= -66.2; E_value=0.044; Accession=PF00481.12; Description=Protein phosphatase 2C
MCMYCKQGPHSNFAGQTSGSTACVTIIRNNYTFVANAGYSRCVICGKGQAYDLSIDHKPDLEIEKERIVKVGGFIHARRVNGSLSLARAIGPFAKRRHSLVDSIVVSEIRRSLEEEVEFQVDLSEEEPCWRCVIGSGMHGARNPEGIAPSRHDYVVVSLLGSNPARLGELGGKHLPYFAINRGGSEKEKALPKRFRNVFREEFREGFRPFFDVLHSFFIVLRSST

SEQ ID NO: 173022 - protein, 59 aa, Glycine max
  Coding DNA Sequence Number=SeqID_81337
MDTALPLSQKSTGVVNGLPRYYDAILPALDRRLQEDWTRDVREGPRILMSLRVDFGLMD

SEQ ID NO: 173023 - protein, 96 aa, Glycine max
  Coding DNA Sequence Number=SeqID_81338
MLSTHQAQEVLGVRECIGKNPSPTSAKDKAKLEYISEGQPSPLELTFRIELDLNLHSKDSKMSFPNTVAEKLDDSNYLHWRQHVEPVIKAHKLQIV

SEQ ID NO: 173024 - protein, 328 aa, Glycine max
  Coding DNA Sequence Number=SeqID_81339
MLPLSDFQIRVLNFLRIFPSQLHPNAWGFILAFERLCVQHYFFLSVNVFHYFFVPLYIKHPSGYSCLSLKGHRDTTILKAYEESYTSFKEMYFWVRHFKDCWDDLFVVDKNEAFIGKSKDKPLLVATPYAATENDKKTLNKSELSDKGNSFTMETHFKSNHDMPPLPLKRQRVINFDDDVELIGSILVYVKKFVAPFMWMSSGVSNSCYSRVQKLLELKQSLGNVNPLNLIKEKDFALKKTQGQVEEKLVDVETARDQWLLMSNFLFGLMETTNVDTPDDTMTNGFINTLKANIDDRDTKASKLMQISKNLEGWYVGLACIGTSLAAC

SEQ ID NO: 173025 - protein, 113 aa, Glycine max
  Coding DNA Sequence Number=SeqID_81340
  Homolog annotation: Hit_ID=A7Q3D0; Match level="QueryCoverage=91%, HitCoverage=31%, E-value=2e-35, Identity=71%"; Hit description =Chromosome chr13 scaffold_48, whole genome shotgun sequence
  Pfam annotation: Domain name=C2; Domain location=6-94; Score=21.4; E _value=0.0015; Accession=PF00168.21; Description=C2 domain
MGIIWVEVCLISAHGLQLSTSLWKRQWFAVGWIDHNNKYCTKVVNSGNANPVWRTKFVIPVDDSVSNIQDLALNVEVYSIDPVFFTEKLLGSATVFLREFLVKRYQRYSKVQI

SEQ ID NO: 173026 - protein, 184 aa, Glycine max
  Coding DNA Sequence Number=SeqID_81341
  Subcellular localization annotation: CTP_CleavageSite=40; ConfidenceScore=5.03e-01
MAGEEKGKGVICDVGKKVVGIASDPNVSGEWIVRRVSSTSGSLSSSFSNESNTQKPFFPLPLCYIFDTYHPPVLALARGARRGHRWHCGLSRCCSWLGACGGCTTACRTAISRRLGSRSRMRRSSGSFELCPRLLRIQVSFFRGPRFSFEEKQGIGPTQARTGSAGLSFMAGLFPFLIRHIILI

SEQ ID NO: 173027 - protein, 320 aa, Glycine max
  Coding DNA Sequence Number=SeqID_81342
  Homolog annotation: Hit_ID=A2Q4L4; Match level="QueryCoverage=40%, HitCoverage=13%, E-value=2e-12, Identity=33%"; Hit description=RNA -directed DNA polymerase
MAKELGVTCGSVQGKFVEKIKEMEERDKKEQSDWEIGENVKNEHIDMICIQEPKKELVGKRILRGILCIWSEKTFKLERKVIGNGFIMLVGQWLKEAQQGVWESNIREFNEWIEELEVEEVPWVERKFTWFRPNGAAKSNQNNFGEASMENVKAIKTILRTFELGGGQVGDLTTKIPHQGQLWARVLESKYGGWRSLNEALRDNNESIWWRDLKMASQHLQQGDAFQNRTLWRVGCGDRIKFWEDNWIGGEGTLLAKYPRLYLISCQQNQVIQQMGVHKDTGWVWDFIWRRPLFDSEIAMAVRFLKDVEGKPIQPHRRDD

SEQ ID NO: 173028 - protein, 94 aa, Glycine max
  Coding DNA Sequence Number=SeqID_81343
MAAEEEQVIFSNDTFDGNKVMDDAAFLLWTWLRSLEKDFATHFNQWSSNLTAGKSTFELQPRHGFPPYGLNFTAMEEEMGCVLLMGSAERTKRI

SEQ ID NO: 173029 - protein, 531 aa, Glycine max
  Coding DNA Sequence Number=SeqID_81344
  Pfam annotation: Domain name=Transposase_23; Domain location=379-449; Score=-12.4; E_value=0.027; Accession=PF03017.5; Description =TNP1ENSPM transposase
MCFQRKKCCLRVTIRPRRYCPMGMEYQKIHACLNDCILYRHEFQEMPKYPSCGVSPPNSPPPPTSAASQSPSTLKRTRKATRLRSLASRLIRAERPLVHVDPATRKADCPHRKLRTYLGIVAREKWRQFKYDLTLKGALAADKESVDDTVCKKYDISKEKWAQFRQTRRDPSREDVRKKAQSIQKQNTAHHVLSRGGYEYLENKLIKEKKKKKVEEAAQSGSTNTVIDPPSPIREHVKRKMARTKKTGQMTSETTKEIADKIDSLEEQASQGSFVAHGQHPGRVRATGAGVTIKKYFGPAPRTSCTSSSMTPEDLEQLTQKIKDQLEDQSQKNQMQSQFQSQMQSQGLALPPEPEVGPLATRVSTKDICVDPSGNDPDMGDSEKCGCYVEENPPHLVALGRLYEGSITVHNIPLLHDQVNVGVEEVKDADAPIPVPTEEVKLVGQTLKTFLAWLTHLVKRLSEQKSKRDVYLATYLNGALKELDNTPQRKSKAARWIVVKYFNDVRPLEPERLKALHIQWAKYYLKVKNKT

SEQ ID NO: 173030 - protein, 119 aa, Glycine max
  Coding DNA Sequence Number=SeqID_81345
FVIIKKGEIVETSFMMMNQSILMMPNAQVIDSRLQDQASRIQSKIQDSREEIKKQQVKTSYRIKQERVHLLSIGSSGAYIHLVVQREQGRVHPLWIFACKGFYKVIGNLKNRWLLGDWM

SEQ ID NO: 173031 - protein, 79 aa, Glycine max
  Coding DNA Sequence Number=SeqID_81346
MYKDKWTQPWPMGSKIYPEVHENPRTFFSNSSSILLEPLAHGSSCWTNGLSYLKNGDNPSLVFRNPYNLRDPQSLNQSL

SEQ ID NO: 173032 - protein, 413 aa, Glycine max
  Coding DNA Sequence Number=SeqID_81347
  Homolog annotation: Hit_ID=A8GEZ9; Match level="QueryCoverage=29%, HitCoverage=88%, E-value=1e-51, Identity=81%"; Hit description =Putative uncharacterized protein
VVARRRLERPRVNTGHERNEGMNSNHLASIARSEKICFDYMDFLSASCRKHWRFVDAIYGVMPIFGMVLKSRVTTSQTRKEQLKELALQVVSTQVSDETNIVRLIDLAQQQGLTVFDIQLPYELEAQQLAAIQKECAEGIAIALRIVKRLARQEQFRGADEAVTVQRLAIDNHDGHFRSFPDILQRLAAGIFVVNQRTVVIQAQRALGADIGHAAWAAGRLHRQLFGQHLFHLIIQFIHWQITPQVVVALLMHGGGMVRRGRADAGFRQPVLAQRLQRFNSEPQQVPFGDLLHLFAQRGVVHQLLDGEPGLMHVGFYAAKRLLPQAQMGDVVERDDQRGQGGFEKMQCVKPFGIFRVLPGPLGDERLSGLQRLLAVNKGNACSIFSAMKCLPFSAGLNPPPDASRQGALASCR

SEQ ID NO: 173033 - protein, 366 aa, Glycine max
  Coding DNA Sequence Number=SeqID_81348
MSTHQALMESIGSMPSNNAAAVDKLRKALLPGDGKHPLMMDGLDGMLPSMKRQATDSEMLARHQVIHMASSAGKSGTTSTLSGGGGNTASISHYLEPISPPQHNNNDTANAASSSASSSTSASGTTTTTVTATHWPPVQPPSSTASSGNWTSMPTAFSLFDNPGLRVNNPANTTSSSSSNVNTSTSNSVAGGGSSSGGGALNDFFQNRIAEAMRVTAADEASSSSSKRAETPKTLDLQGKHSELSNSSSSTVANRNLTYPDSPSSPPEMVIDENRAPSVSPDIKANEQHHPLRLFGFGGDGGKKPEPAGGDSSRSSTPGMAGVIKKHAINDNDTKSMTFNSDALKSSDTNSTMTPRRAPTFHHHRT

SEQ ID NO: 173034 - protein, 302 aa, Glycine max
  Coding DNA Sequence Number=SeqID_81349
  Gene Ontology: Mol. function=calcium ion binding; Cellular component =cell projection
  Homolog annotation: Hit_ID=UPI00006A2D9E; Match level="QueryCoverage =67%, HitCoverage=85%, E-value=6e-17, Identity=16%"; Hit description =UPI00006A2D9E related cluster
  Subcellular localization annotation: CTP_CleavageSite=54; ConfidenceScore=5.65e-01
RATRPRLQRATHPRLQRTTRPRLQRATRPRLKRTTRPRLYRATRHRLKRTTCPRLQRVARPRLQRTTHPRLRGLHTLAFRGLHILPIRGLHALALRGLNVLAFRGLHVLAFRRLHVLAFRGLHALAFRGLHALDCRGLHALSFRGLRVLAFRGLHALAIRGLHILAFRGLHAVAFRGLHALAFRGLQVLAVRGLNALAFTGLHALAFTGLRALSFKGLHVLAFRGLHALSFRGLHALAFRGLQVLAFRGLHTFTFTGLHALAFRGLHALAFRGLHVLTSKGYTPSPSEGCTPSPSEDYTSSP

SEQ ID NO: 173035 - protein, 136 aa, Glycine max
  Coding DNA Sequence Number=SeqID_81350
MQVGGCSIYGGAHESSCCIPQDDSAKEVNYMGNQNRQGFHSSGFSGYQQGGNFNQNQGQGWRSHPGNQFNKDQGGPSNKPPNQGPNLYERTTKLEETLAQFMQVSMSNHKSTESAIKKRKYLIREDIIECIFQLFL

SEQ ID NO: 173036 - protein, 123 aa, Glycine max
  Coding DNA Sequence Number=SeqID_81351
  Homolog annotation: Hit_ID=A5C9C8; Match level="QueryCoverage=43%, HitCoverage=6%, E-value=1e-12, Identity=66%"; Hit description =Putative uncharacterized protein
  Pfam annotation: Domain name=RVT_2; Domain location=1-120; Score= -168.0; E_value=0.0011; Accession=PF07727.5; Description=Reverse transcriptase (RNA-dependent DNA pol
MKEELKMIEKNDMWKLVDRPQHKQPIGEEIYVEQHEGFQIKGEEQEVYKLKKMMTKVMNKKLKRIKEHPSQENLEQVKEFKNQEEFKTQDESLQTRIKIQYLRDSRSQESRSRFKNEEKTQSR

SEQ ID NO: 173037 - protein, 112 aa, Glycine max
  Coding DNA Sequence Number=SeqID_81352
MGFVGRGDMEVEVDVWRLKSLRGGGVGDGDDMIVGNDGFGGDVMNGADAVVGEGWSTILMVRGWSTIGIGWKEGELKIVAPGCPKRLCHNSVDNAAKVDGGKVVLGGLVAMG

SEQ ID NO: 173038 - protein, 104 aa, Glycine max
  Coding DNA Sequence Number=SeqID_81353
MLWVKHPRHYIRALRAFRVLQRDIIWKFRPRQCDRGSILGFHSLPKPRAKLEDSASVEGFLSVWVSTENNGSLWWLMVAAGDGESSWDVRNDFGRKKGEEMAFF

SEQ ID NO: 173039 - protein, 48 aa, Glycine max
  Coding DNA Sequence Number=SeqID_81354
MANTKKTGQMTFEAAKEIVDKIDSLEEQASQGSFVAHGRQDVLTAGIG

SEQ ID NO: 173040 - protein, 61 aa, Glycine max
  Coding DNA Sequence Number=SeqID_81355
MVTHWVPAPRRGTGSRNRCLPEHALDNPRGPRPAVEEAPLQGWGEGHDPRRDAILPCKGIR

SEQ ID NO: 173041 - protein, 609 aa, Glycine max
  Coding DNA Sequence Number=SeqID_81356
  Gene Ontology: Mol. function=transferase activity; Cellular component= 1-2nm peptidoglycan-based cell wall; Biological process=transport
  Homolog annotation: Hit_ID=A6T9A5; Match level="QueryCoverage=61%, HitCoverage=89%, E-value=0.0, Identity=85%"; Hit description =Ascorbate-specific PTS system enzyme IIC
  Pfam annotation: Domain name=PTS_IIB; Domain location=3-87; Score =73.1; E_value=9.1e-19; Accession=PF02302.8; Description=PTS system, LactoseCellobiose specific IIB subunit
  Pfam annotation: Domain name=Ribul_P_3_epim; Domain location=479-603; Score=17.1; E_value=4.7e-12; Accession=PF00834.10; Description =Ribulose-phosphate 3 epimerase family
  Pfam annotation: Domain name=SgaT_UlaA; Domain location=48-448; Score= 362.5; E_value=7.1e-106; Accession=PF04215.3; Description=Putative sugar-specific permease, SgaTUlaA
  Pfam module annotation: Pfam domain module=PTS_IIB::Ribul_P_3 _epim::SgaT_UlaA; Domain location=3-87::479-603::48-448
MKKVLIVCGNGLGSSFIVEMNVKKIIKELGKEAEVGHTDLTSAKSEQADIIISAKDIADQLSSHSAQKPVSDVISGTLKTIMGFVILIAGANLIAATLTIFSQLFEHSFNIQGVVPNTDAMAALAQKNYGTETAMIMVFGMLVNIVLARITPLKYIFLTGHHTLYMSAMLAVILSVGGVHGFWLVLIGSLILGTMMVVCPAILQPFTRKITNSDDLALGHFGSTGYLLSALVGKAVGKGSPSIEELKVPKTLNFLRDSSVAISLTMMILFVALVLVAGKEFTESQVSGGQNFIVFAIIQSITFAAGVYIILAGVRMVIAEIVPAFKGIADKLVPNAKPALDCPTVFPFAPNAVIIGFLCSFAAGLISMFLCPLFGLSVIVPGLVPHFFCGATAGVYGNITGGRRGAIIGSFVQGLLISFLPAILLPLMGDLGFASTTFGDATSVSSALCSAILFRSSIDVTDSACGRCLRNEEISMNARFSPSLMCMDLTRFREQIEAMNASASFYHVDIMDGSYVKNITLSPFFIENLRKITDVPIDVHLMVNHPEDIIPMCIDAGADIISFHPETANNKIFRLLTQIKEAWPSLRRGAESGDAGRKAFVSMRICWIK

SEQ ID NO: 173042 - protein, 69 aa, Glycine max
  Coding DNA Sequence Number=SeqID_81357
MGNFMWHIRAKARSRLDCDGEFHVSPPRSGVIDILIGSVRHIGWRIVERQTIWREGVLVLNLHIMGAAH

SEQ ID NO: 173043 - protein, 79 aa, Glycine max
  Coding DNA Sequence Number=SeqID_81358
MVPKTCSLPTSAPNRTSSIKWYVNYLCKKENHPNPDQASSSDSSCWTKLNQDRIKTNILQLNYRTPIVMNHLVATVSTL

SEQ ID NO: 173044 - protein, 139 aa, Glycine max
  Coding DNA Sequence Number=SeqID_81359
  Subcellular localization annotation: CTP_CleavageSite=31; ConfidenceScore=5.72e-01
MKYKVSWLLHPASPPPPPPTSDASALSSSVKRTRKASRLRFLSTRPPGAERPVVHVDPAFGKADGPHRKKLRTYLGIVAPDKVDITYENWNKIPTVQKDLIWEDIQTVDERWRQFKSDLMRKWALAADQDGVDDTVCEK

SEQ ID NO: 173045 - protein, 20 aa, Glycine max
  Coding DNA Sequence Number=SeqID_81360
ELHKGMLDPYCLTVDYPSIL

SEQ ID NO: 173046 - protein, 188 aa, Glycine max
  Coding DNA Sequence Number=SeqID_81361
MDVDAVIVAGGKACTAIDNCGNKDPAIGNCGTQPKPPVRTAGQEREAVPLIATAGQERERLYRCSSWRDMPTWQSRHCHLRNTLTFQACSNEKLGGSGGTATLACPARRNSGTASLSPVPPLLLAVQPLSLLSRRWYWRFRLSAAVANGGILVPAVVNGGTSFPAGNNGGIHVITDPVCDKFEKKPSL

SEQ ID NO: 173047 - protein, 104 aa, Glycine max
  Coding DNA Sequence Number=SeqID_81362
MARMKKSGQMMSKAANETTNRINSLEEQASQLSFVAHGRQDLLTTAIGLGAVDTKNQGPGLALPLEPEVGSSATHNPPRLVALGSVYEGSIIILKVPLGNDQVK

SEQ ID NO: 173048 - protein, 272 aa, Glycine max
  Coding DNA Sequence Number=SeqID_81363
MALPSSSFHPWVVEAKLYGESKVIQRINCVCVLMITMMITKDDDKGDDKKLKDQSKNNSSDQDRIKNNSRVQDRIKKNSRLKRKVKRYILCGTSRGYIYLGLTENKRGIFTRLKKISRTAGRLGTGCRHGPLDPTWVSLDHLYTSSDIDSLWGETYKPKQKTQHTTNSVKVFLKRSLVIQEENGQWHQEALHKVVSMEAEAEPTVFQSWWCVGQVAAYQERKASKELEEELLVYKKKDVKDGALLGKEYITIEEEAVDEEQGAAEQGDDAYV

SEQ ID NO: 173049 - protein, 50 aa, Glycine max
  Coding DNA Sequence Number=SeqID_81364
MNKSLEVGEEEWREKKREITKFVPQKSPLIQDQVQDSPLSVLRCHETCKA

SEQ ID NO: 173050 - protein, 110 aa, Glycine max
  Coding DNA Sequence Number=SeqID_81365
MFGMICYHIGMHLSIVPSAHKKKKASEKVGVCTQEEFEARLSQARSDAASSVGESQLTPLDPVEEQRLRSRCWVVTVGSKRKGRLYGAGDLVHTYKCGNDIFMQHTQGSS

SEQ ID NO: 173051 - protein, 87 aa, Glycine max
  Coding DNA Sequence Number=SeqID_81366
  Gene Ontology: Mol. function=transferase activity; Biological process= amino acid biosynthetic process
  Homolog annotation: Hit_ID=A7QB90; Match level="QueryCoverage=40%, HitCoverage=14%, E-value=1e-09, Identity=91%"; Hit description =Chromosome chr4 scaffold_73, whole genome shotgun sequence
MAASPEPINFKKSKIPSMSHLRLSMNESSREALAGDHSQNIDPKITMAIAREVAAVTRLGIEVTTMDSFMLVGVTSSVDPPELEVAD

SEQ ID NO: 173052 - protein, 147 aa, Glycine max
  Coding DNA Sequence Number=SeqID_81367
MAPRKLPAKRSRKDKAAEGTSAAPEYDSHRFRSAEHQQRFKAIKGWSFHQETRVQLRDDEYTDFQEEVVRRRWTSLVTPMAKFDPDIVLEFYANAWPTHEGVRDMQSWVRGQWIPLDADALSQFLGYPLVLEEGQECEYGQRRNRVD

SEQ ID NO: 173053 - protein, 32 aa, Glycine max
  Coding DNA Sequence Number=SeqID_81368
MNQSTTEFHLMLAKVIAIGVFSNMVLSNWQTS

SEQ ID NO: 173054 - protein, 128 aa, Glycine max
  Coding DNA Sequence Number=SeqID_81369
MHKGLWTRQHLNNTELSPSKQKKKGNHDLKWSSPFDHQPKSCASVTCLPCTKLNRKGKGQEHSKPKFPHKKTRHSQEKVLLIHDHAYFISILPFPGSDGSFLVKLLWTMEMQLKAKEKKRGEAPSTRE

SEQ ID NO: 173055 - protein, 142 aa, Glycine max
  Coding DNA Sequence Number=SeqID_81370
MTILMPNTSTTFLRDERLGNSYAMHEKCNYERKMQGSCMSEHENKRAPRNLFRLCSSLRALLVSRFKALVVATFTSLSSVFSFRIFRAADLNLSLTVWACSSSALRAYTSSSSSGASTSSLLTVLKLGSQSKPCAWAFNHLR

SEQ ID NO: 173056 - protein, 129 aa, Glycine max
  Coding DNA Sequence Number=SeqID_81371
MQKCPRYGVSRYKVKDDDKCSSDENSKKGPLVTFKHSTQFVASFASNLQLASLVVVATYPSAGRRRVTRGCIFQEKNTRGVATNVYLRKTSEKPEKTCTTNFKCEVRELYLRTGKVLAPHTFVARDGSL

SEQ ID NO: 173057 - protein, 64 aa, Glycine max
  Coding DNA Sequence Number=SeqID_81372
MEAMMSMRKMMEVNMDTVVAASIATEVNPTHPPGLNQVNRPVSDMYLGSDPRSSPNEQWSTKRS

SEQ ID NO: 173058 - protein, 273 aa, Glycine max
  Coding DNA Sequence Number=SeqID_81373
  Gene Ontology: Mol. function=DNA-directed RNA polymerase activity; Cellular component=chloroplast; Biological process=transcription, DNA-dependent
  Homolog annotation: Hit_ID=Q8HVY3; Match level="QueryCoverage=100%, HitCoverage=20%, E-value=1e-148, Identity=94%"; Hit description=DNA -directed RNA polymerase subunit beta''
MDSVGIRSANPYLATPGATVHGHYGEILSEGDILVTFIYEKSRSGDITQGLPKVEQRVDTWNGRITKILGIPWGFLIGAELTIAQSRISLVNKIQKVYRSQGVHIHNRHIEIIVRQITSKVLVSEDGMSNVFLPGELIGLLRAERAGRSLEEAICYRVLLLGITKTSLNTQSFISEASFQETARVLSKAALRGRIDWLKGLKENVVLGGMIPVGTGFKRIMNRSKQRQYNKMTSETKKKNLFEGEMRDILFHHREFFFFVSKNLCDTSQQSSI

SEQ ID NO: 173059 - protein, 45 aa, Glycine max
  Coding DNA Sequence Number=SeqID_81374
MDTLELLEVEVGSGSYWKLKVENESWKLEVGSGSYWKLKLEVEVV

SEQ ID NO: 173060 - protein, 132 aa, Glycine max
  Coding DNA Sequence Number=SeqID_81375
  Pfam annotation: Domain name=zf-CCHC; Domain location=73-90; Score =30.1; E_value=8.1e-06; Accession=PF00098.14; Description=Zinc knuckle
MLEVTHEGTANKKKKRKERELHSTEDCKESSSDDEDAGNLSLMVKKFGKFLKRSKYKKLSKSSKKIESNNNTFTCFKCGKQGHIKSECPIYLRKQLAKKKGKKDRKQKQAYIAWEDNASTSSDFCSEEDFAN

SEQ ID NO: 173061 - protein, 82 aa, Glycine max
  Coding DNA Sequence Number=SeqID_81376
MSQSNIFFTLLVIYGTLTKHGERAIFDLTDLEINSGAQGHTMLNGMSWNSPMISTCHVGVVSSGKRRLRNLCWAYGYHCIIE

SEQ ID NO: 173062 - protein, 121 aa, Glycine max
  Coding DNA Sequence Number=SeqID_81377
  Homolog annotation: Hit_ID=A5BKB8; Match level="QueryCoverage=54%, HitCoverage=20%, E-value=5e-12, Identity=58%"; Hit description =Putative uncharacterized protein
MVDEPRSRPITCEPVSSGPIDDPLRARTLPTRPQRPQWRTGAQVPWKGAPERVRAPSCPDPVAPRGAVGEFGLFGMQPNRAGSGWGPAMCPGRMWNGESRSADRLGTLTDADCDGGPSPGC

SEQ ID NO: 173063 - protein, 149 aa, Glycine max
  Coding DNA Sequence Number=SeqID_81378
MGRDVAVGSDLEWQSQRKNHFKNGFSFADGYLPRRKFICIRYLLSLDEILLSLSSGGKDEDSLHRLSQHALLRLSEARLTSALSKGGKMRGVTTNVYLWKMSEKTEGNRSKRKFQVRELYLRLRKVDKSGALAPTYPPSKRKSDLRSSF

SEQ ID NO: 173064 - protein, 92 aa, Glycine max
  Coding DNA Sequence Number=SeqID_81379
MHMTQMQFMSTGAREIVSFVEAKLHDESTMIQSSKDQRATQVNQEQVKSSRIKKNSRLKKKVYNQDSRFKISRIKIKIQDSRFKNEEKTQSR

SEQ ID NO: 173065 - protein, 134 aa, Glycine max
  Coding DNA Sequence Number=SeqID_81380
MPYEFQFLKPKAQVESKKRKAPSTPSQVRFDQSRFTSQEAWERYTDIVVPRKLLTERNVVVYYTKFDEFKEELEIRHWDEELTDFADGSIDIAIVKEFYVNLYDPEDKSPKQVRVRGHLVKFDEDTLNTFLKTQ

SEQ ID NO: 173066 - protein, 94 aa, Glycine max
  Coding DNA Sequence Number=SeqID_81381
  Homolog annotation: Hit_ID=A5AQZ7; Match level="QueryCoverage=38%, HitCoverage=4%, E-value=8e-08, Identity=69%"; Hit description =Putative uncharacterized protein
MIMKGQDIYSIQEETTSSPSFSGSEDEARDEESTEEVYPYEESDILMIRRLLGGQSWTYKDEVIYDIVPMEVGHILLGMPWQFDRKIIFNGLTN

SEQ ID NO: 173067 - protein, 145 aa, Glycine max
  Coding DNA Sequence Number=SeqID_81382
  Homolog annotation: Hit_ID=A5C5V8; Match level="QueryCoverage=33%, HitCoverage=6%, E-value=7e-11, Identity=62%"; Hit description =Putative uncharacterized protein
MGLSTSPPFACNGLSEDDDFVVEVHKQLLLERGLIHSKKRSRLEHQKLQDLVYVKYNQALLDRFECHDDIDPIALNDIDNSNEWLLGELEGEEAGNDLVFDDDDDLNWLDVAEATGTGEPLQNTRSQTQINKAAAAPAPTNEKGK

SEQ ID NO: 173068 - protein, 109 aa, Glycine max
  Coding DNA Sequence Number=SeqID_81383
MGETHEVPQDHTLDDSEPCLGYATEGQAFGGVPLPNTLGGPQYRPQPQPLHFAVGRVPPAMVEREKLDHIEERLRVLEGGKNYAFADMAELCLVPDVVIPPKFKVSNID

SEQ ID NO: 173069 - protein, 67 aa, Glycine max
  Coding DNA Sequence Number=SeqID_81384
MYGSNVFQGYFDDAKESRVKQSFKQRFKNQVSSFKIQDSRIKFQESRIKKNQDQDSRIKRRLNQDKY

SEQ ID NO: 173070 - protein, 70 aa, Glycine max
  Coding DNA Sequence Number=SeqID_81385
MSVKPSEAINNGPLMQSYPARALGRRLQVDWARDPREGPRVLMSLRLLKEVFSKKLLKEVFSRKLLKEAT

SEQ ID NO: 173071 - protein, 54 aa, Glycine max
  Coding DNA Sequence Number=SeqID_81386
MEKEKDVNYVAPCGACRPWIFFINGFLCFLSPLIQDQVKDSPLSVLRCHEACKA

SEQ ID NO: 173072 - protein, 88 aa, Glycine max
  Coding DNA Sequence Number=SeqID_81387
MQQPGAIEQPKAYAANIYNRPPQPQQLNQSQQKNYDLSSNKYNLEWRNHPNLRWSSPQQQQQQEPAPSFQNVDGPSRPYVPPPIQQQQ

SEQ ID NO: 173073 - protein, 213 aa, Glycine max
  Coding DNA Sequence Number=SeqID_81388
  Homolog annotation: Hit_ID=A5C7Z4; Match level="QueryCoverage=53%, HitCoverage=40%, E-value=4e-07, Identity=28%"; Hit description =Putative uncharacterized protein
MSVVFNPDFPLYIKHEDLSEIAHGGQCLSISVLQLWILHLTETCMQVGNSDIYGFLEPQSIQRSEESQFESESYIKSWMQSSQRNVYLGAYLNGFHCSGHWQMVVILPKEHLVVWFCLLHNRPDNYHKGIISSAIKGLDDAPQPKSNASARWIVVKCNRQKGSTECDYYVMHWMPTIILGTFRNNWEAYFNDPRPLELERLKALRIQWAQFYL

SEQ ID NO: 173074 - protein, 114 aa, Glycine max
  Coding DNA Sequence Number=SeqID_81389
  Subcellular localization annotation: CTP_CleavageSite=57; ConfidenceScore=5.34e-01
HFSSSCSRLIFTLDPSLHLHNRALPFSSSSRNRTVSRCATHHKLIAPLDQVYDLPAVAAPGSHFRHWMGLNPAYEVEVKRVSQILVAFVNDIEEVFDAMVMPAQSIQNLIPEKG

SEQ ID NO: 173075 - protein, 71 aa, Glycine max
  Coding DNA Sequence Number=SeqID_81390
MGKEGLTEERYHHRLFSLTVAKDEKVADIRVWGEEGGIGDVFGVKVGFRRREFGEMIGVKYSRPDMWKMQR

SEQ ID NO: 173076 - protein, 211 aa, Glycine max
  Coding DNA Sequence Number=SeqID_81391
  Homolog annotation: Hit_ID=A7NY34; Match level="QueryCoverage=47%, HitCoverage=67%, E-value=3e-28, Identity=64%"; Hit description =Chromosome chr6 scaffold_3, whole genome shotgun sequence
  Pfam annotation: Domain name=GCN5L1; Domain location=15-130; Score =17.8; E_value=1.6e-06; Accession=PF06320.4; Description=GCN5-like protein 1 (GCN5L1)
METEPKGLEASLEHLIDLHHHKSLVLAHHTDKAKKDAIRKAEHVSDLLVEAVNGGVQDSFINQKRIELEIRTLATTITRFMKQTDQWLAATHALNTALKVLGNLYGLEGTCKKATTLVTIVGWQMGITPYTDEPLTWGGVFGGTCCLPCLRVIEQRIERKLIFDSGRNDFHNSILLHYCCDNNAMTNTNNNKANTYSIRVHTAYTRVGLSK

SEQ ID NO: 173077 - protein, 134 aa, Glycine max
  Coding DNA Sequence Number=SeqID_81392
MTLEDFLAKANVVNDASHNHDHNHDLDYDNDSKGVLNFDFEGNLNATPSSSFTTTHFGPLVSHNSSVVTYVVSNRGPVTPALSVEDPVGSDNVLEQRSFRLCGEYQEHDGSGEYTLEEEKAITGLLDGSEEYTL

SEQ ID NO: 173078 - protein, 382 aa, Glycine max
  Coding DNA Sequence Number=SeqID_81393
  Gene Ontology: Mol. function=transcription repressor activity; Cellular component=cytoskeleton
  Homolog annotation: Hit_ID=A7NY20; Match level="QueryCoverage=98%, HitCoverage=97%, E-value=1e-86, Identity=48%"; Hit description =Chromosome chr6 scaffold_3, whole genome shotgun sequence
  Pfam annotation: Domain name=DUF623; Domain location=322-382; Score =122.0; E_value=1.7e-33; Accession=PF04844.4; Description=Protein of unknown function, DUF623
  Subcellular localization annotation: CTP_CleavageSite=65; ConfidenceScore=5.43e-01
MGNNRFKLSDMIPNAWFYKLKDMSKSRKRNGSHAMKSKVSSPPTTTTSQRSLPRYSHYFSTEPIRAGKLYNTPIHTKDLDMPFTDSPRRSSKRRARRKTIYKPSPTVVSSSFIPSSGYDSANHWIKPCQVQSPDYDVSSAESSSESDLHEYAYSESECDSFSVPDLLNGMDTNCSCRVSSSTNDIIIDMNSESFLGNPEKQDGFDAISQLGLAPILTRPVKFDDKVIEAAEVRSSTDLDEMQDDQSFSIEINKEESIRTQRRRKSNHRKPFANSAGIRLRVNSPKLASRKVQACARRSVSSTASKGSRSTGFPDGFAVVKSSFDPQSDFRESMVEMIVENNIRASKDLEDLLACYLSLNSSEYHDLIVKAFEQIWLTWLNYD

SEQ ID NO: 173079 - protein, 459 aa, Glycine max
  Coding DNA Sequence Number=SeqID_81394
  Gene Ontology: Mol. function=metal ion binding; Biological process =double fertilization forming a zygote and endosperm
  Homolog annotation: Hit_ID=A7NY22; Match level="QueryCoverage=90%, HitCoverage=93%, E-value=1e-116, Identity=54%"; Hit description =Chromosome chr6 scaffold_3, whole genome shotgun sequence
  Pfam annotation: Domain name=DUF641; Domain location=85-217; Score =66.0; E_value=1.2e-16; Accession=PF04859.3; Description=Plant protein of unknown function (DUF641)
MVPTSTELQPRAPCNLVLFLSAPPTTLPLSARITVGFDLYEFKSIGVFSSEIPNLPHLQRSICNETLLSENSSEENRCYDQKVHPHPIEVPAKENACACLEVMRKMFDAVSVLKLAYLQLQQAHIPYDPQKIVAADDLVVAELEKLCKFKREYAQKHCKKVRFNAARSAPLMAEIVAKEALLGKLKSQNSAKDSEILRLWRELQDLEMGNKNLSEKIKQISSEKRRAGVLSVTKFQDVFNAASKSIHDFAKPLISLMKASGWDLDRAASSIENGAVYSKRCDKKYAFEAYIARRMFHGIVLTSYDVSDIMKFGDPFDALMENPHSDFAKFCQAKYLLVVHPKMEESFFGNLDHRTFIMSGKHPRTEFYQLFAKMAKWVWVLLGYAVSIDPEATLFSVSRGSAFSSLFMESVEEEKESAILSDEDEERATHKVQFMIMPGFQIGNMVVKSRVYISKHSSS

SEQ ID NO: 173080 - protein, 172 aa, Glycine max
  Coding DNA Sequence Number=SeqID_81395
AFRLTDSKKNVYTDNHSSIFARQRDSNVSMTDLVSAEDDTAKKNVYTDNHSGISARQRDSNVSMTDLVSAEDDTAKKNVYTDNHSGISARQRDSNVSMTDLVSAEDDGAEDDVSLCVLSSFSSYRQQKRMFIRITTRVLPSRQRDSNVSMTDLVRRKHVSAGYQLLGHGNKK

SEQ ID NO: 173081 - protein, 63 aa, Glycine max
  Coding DNA Sequence Number=SeqID_81396
MALISDMPPSTSISPHEKLEVLTNKVYTISMQCECFSKDLLSGNRLPEDVIDYQWPNTFYNSY

SEQ ID NO: 173082 - protein, 96 aa, Glycine max
  Coding DNA Sequence Number=SeqID_81397
LRSQDYLREATKGGIEGVFSTESLRRILRIPVRLQGSSRSGRLAASNDGSWWPPMVVGGGKEGVRVWVGVWRRGDAIPSWVEIALSMPLLAQCNSL

SEQ ID NO: 173083 - protein, 102 aa, Glycine max
  Coding DNA Sequence Number=SeqID_81398
MLRNLTNYVTIPFLPSGMLRNFTDCALTLPFNLRHVTKLHGLCYDAFLLAFGMSRNFTNCLTMGAKYLEVVKRGSHPNNGWSPDEIRGYISNETSEVYMHVT

SEQ ID NO: 173084 - protein, 49 aa, Glycine max
  Coding DNA Sequence Number=SeqID_81399
SWAREETNDSLGELTACWVSTSLTDPLLGFPIMLSKMHASLSGCHSLSA

SEQ ID NO: 173085 - protein, 97 aa, Glycine max
  Coding DNA Sequence Number=SeqID_81400
MLQCEGFSSKLRYDFEIPNGENVRNWIVNMVQTFHDDPTVNESKIVVFSETGLVDCGKKKGSPQKYWLMKHRFLRILSLFFMNNQIILSGRFNNNIL

SEQ ID NO: 173086 - protein, 157 aa, Glycine max
  Coding DNA Sequence Number=SeqID_81401
  Gene Ontology: Mol. function=phosphoprotein phosphatase activity
  Homolog annotation: Hit_ID=A7R978; Match level="QueryCoverage=59%, HitCoverage=41%, E-value=2e-13, Identity=43%"; Hit description =Chromosome undetermined scaffold_3458, whole genome shotgun sequence
MVTYYGCKLSMFQNMFGMGKKTGNYTSEELSLRIKGKKKSQRKLFISFDNLELLGVKPQEGKIKGSVVKLSWLAHHFAQINNHDDEEQVRRFTRAWILRFIGGVLFVNKSSNKVSLRYLQFLRDFRDCNTYAWDLPYLLFYTERCAVPPIIKLNQSE

SEQ ID NO: 173087 - protein, 120 aa, Glycine max
  Coding DNA Sequence Number=SeqID_81402
MSGFIRNSPQISASPHQLDLAPYDSEPYNAPWNALGLLRDQHTLRSSCILGEMEVDEPWLGLWLPLNYQVDMGSSLAYDNGIWGEPYRLSRCKIHFLLVFFWFVLKVVFVIGSAVDRLCG

SEQ ID NO: 173088 - protein, 105 aa, Glycine max
  Coding DNA Sequence Number=SeqID_81403
MNRCGISTNKVPVDSTLGLPSTLLLVTIWYPCQRVNKTASGDVVPINLKIEATCRRNNTARRRREQDTEESSYTSPPLSPDHAEMVGEPARRVTLEDFSNTATPQ

SEQ ID NO: 173089 - protein, 48 aa, Glycine max
  Coding DNA Sequence Number=SeqID_81404
  Gene Ontology: Biological process=transposition, DNA-mediated
  Homolog annotation: Hit_ID=Q1J7G7; Match level="QueryCoverage=66%, HitCoverage=45%, E-value=3e-11, Identity=100%"; Hit description =Transposase
VLQWLLFLSAVPPVQLLTGWCVTAKAPPDISAGKCSGHAARNHHTRRA

SEQ ID NO: 173090 - protein, 178 aa, Glycine max
  Coding DNA Sequence Number=SeqID_81405
MASRKRKSIGMRPTSQYDTRRFSSLDAWTRYTDNVLGRKILPERKVELYHTKLDDFKAELERRNFHKHLTNLADGSIDLALVKEFYAHLYTSEDRPPKQSRVRGHLVKIDADSLNAFLETPMVLAEGETLPTYSRYCRLPTDFREIEAALCIPGRGFILNFEGHPRRILRKDLTALAQ

SEQ ID NO: 173091 - protein, 56 aa, Glycine max
  Coding DNA Sequence Number=SeqID_81406
MENLHEIAHGKGKKGRWLPPSSPRRAGLLPPDGTTFCWNILEGPSGSDYYLHTPIY

SEQ ID NO: 173092 - protein, 135 aa, Glycine max
  Coding DNA Sequence Number=SeqID_81407
MTEREMITIMVDTLPMFCYEKLIGYMSANFADLVFARERIESGLRKGKFEYASNAGPNSNRRAPVVGTQKKEGDTHAVTTAPTWMKTPQNAQNSYQHNHLNFSIRAGSSLPTQVEGPATTEKMHAQYHSGAPASQ

SEQ ID NO: 173093 - protein, 76 aa, Glycine max
  Coding DNA Sequence Number=SeqID_81408
MNAYGDKQSDLGIIDKVLRTLTPTFDHIVVEIEQGILEAQEMRLNERNSQRLAEQAMQAQTTKGNNYDGVKNKKGK

SEQ ID NO: 173094 - protein, 78 aa, Glycine max
  Coding DNA Sequence Number=SeqID_81409
MMTTKDDDKGDEKKAQRSKNNSSESKNISSESRTSQEFKNQEEFKNQEESLESRIKIQDLNNQDQDSRLKNEEKTQSR

SEQ ID NO: 173095 - protein, 302 aa, Glycine max
  Coding DNA Sequence Number=SeqID_81410
  Gene Ontology: Mol. function=motor activity; Cellular component=cell projection
  Homolog annotation: Hit_ID=UPI00006A2D9E; Match level="QueryCoverage =94%, HitCoverage=87%, E-value=1e-16, Identity=16%"; Hit description =UPI00006A2D9E related cluster
FRGLRTLAIRGLHALTLRGLHVLAFRGLHALTCRGLHVLAFRGLHVLDLRGLHVLTFRGLHALAFRGLHALTFRGLHILTFRGLHALAFRGLHILTFRGLRTLTFKGLHALAIRGLHVLAFRGLHVLAIRGLHALAFRGLDVLAFRGLHVLTFRGLHALAFRGLHVLSFKGLHALTLGTRTLAIRGLHALTFRGLHVLTLEDYTSSLSEGGTLAFKGLHALTFRGLHVLAFKGLHALTFRGICVLTFRGLHALAFRGLHVLAIREMHALAFKGRHVLDFRGLHAYAFRGLRVPILVGSTSAP

SEQ ID NO: 173096 - protein, 94 aa, Glycine max
  Coding DNA Sequence Number=SeqID_81411
  Subcellular localization annotation: CTP_CleavageSite=17; ConfidenceScore=5.04e-01
MKNSGKFSRNRPRKHLRSVTEAPRLGFSSRKQFFSLILSESQIPGGGKEGGGCRPARLGELSSPGLLPPEGTAFCWNILEGPSGPDCYLHTPVY

SEQ ID NO: 173097 - protein, 66 aa, Glycine max
  Coding DNA Sequence Number=SeqID_81412
MMHLKYREWRRKRERRRHFKEKMSLEEAHHYRRPWIRAWRKKEMNEGRGREEHEILCSKRALKYEV

SEQ ID NO: 173098 - protein, 150 aa, Glycine max
  Coding DNA Sequence Number=SeqID_81413
  Subcellular localization annotation: CTP_CleavageSite=73; ConfidenceScore=5.72e-01
MQRNSPSSSSDTYFLPQPSFFSEKPFIGIFSFGVGITLSFFSSAIFTFPLTFAGCVGRLRPTRPTRLNGINCSPSMIGKRVRFHVGPVLLKRQPSGVYQMLDLVFKGQAVFGGVARGFSHGMRRLRQGYTTLGKEAGRSSREISQPSGWR

SEQ ID NO: 173099 - protein, 74 aa, Glycine max
  Coding DNA Sequence Number=SeqID_81414
MGRGGRGEGNKFEGTQGIELIPVYSVRVRVDAMHGECVLSTMNFKHMSGVLSTKVTHAKHVKGILSMKTHGVLV

SEQ ID NO: 173100 - protein, 346 aa, Glycine max
  Coding DNA Sequence Number=SeqID_81415
  Gene Ontology: Mol. function=transporter activity; Cellular component= mitochondrial inner membrane; Biological process=transport
  Homolog annotation: Hit_ID=A7PDA8; Match level="QueryCoverage=91%, HitCoverage=96%, E-value=1e-132, Identity=68%"; Hit description =Chromosome chr17 scaffold_12, whole genome shotgun sequence
  Pfam annotation: Domain name=Mito_carr; Domain location=107-216; Score=54.6; E_value=3.4e-13; Accession=PF00153.18; Description =Mitochondrial carrier protein
  Pfam annotation: Domain name=Mito_carr; Domain location=23-102; Score= 74.8; E_value=2.9e-19; Accession=PF00153.18; Description =Mitochondrial carrier protein
  Pfam annotation: Domain name=Mito_carr; Domain location=231-321; Score=111.1; E_value=3.4e-30; Accession=PF00153.18; Description =Mitochondrial carrier protein
  Pfam module annotation: Pfam domain module=Mito_carr::Mito_carr::Mito_ carr; Domain location=107-216::23-102::231-321
MAVQSSTSSESQASENVMHRHFFLWREFLWGAVAGAFGEGMMHPVDTVKTRLQSQAILNGIQVDGLKGFYRGVTPGIIGSLATGATYFGVIESTKKWIEDSHPSLRGHWAHFIAGAVGDTLGSFVYVPCEVMKQRMQIQGTIASWSSVVVNDGIAIKPGTQIYGYYTGMLHAGCSIWKAQGLKGLYAGYLSTLARDVPFAGLMVVFYEALKDAKDYVEQRWISSPNWHVNNSVEGLVLGGLAGGLSAYLTTPLDVVKTRLQVQGSTLRYNGWLDAIHNIWATEGMKGMFRGSVPRITWYIPASALTFMAVEFLRDHFYERVPNDNLEDVGRLSVDHKSAGGLKVSH

SEQ ID NO: 173101 - protein, 354 aa, Glycine max
  Coding DNA Sequence Number=SeqID_81416
  Gene Ontology: Mol. function=nucleic acid binding
  Homolog annotation: Hit_ID=Q53MN0; Match level="QueryCoverage=46%, HitCoverage=15%, E-value=2e-15, Identity=32%"; Hit description=PHD -finger, putative
MDLVGPPKECIGENQLPLSGVIPGKKVQTGDAQKENPTKGPFEALSAGKSSHIVGSGPPKECIGENQLPLDGVIPGKKVQTHDAQKENPTKGAPFEALSAGKSSPIVDSGDIRRADAECNKSNIEKSDLRSVQENLNLHCKFLPSSFPAWRGQFQILQTAVSSEFYDGLEAQPPCIVNKKAYKFSTEMPSVLQLESLPVLNALTDIFQDNSPRLQDIALYFFPSELTERSRKNLDSILKFLNAEKSMLRSYINGVELLVFTSNQLDMDSKGAIAAVNAGHFLWGMFRQKKIDKAIERVPDMEPVDMDIDMIGGKDVVERADVVRNCKPKSASLMEDYNKLDVPPGFEEFTKMSK

SEQ ID NO: 173102 - protein, 210 aa, Glycine max
  Coding DNA Sequence Number=SeqID_81417
MACSCICASYKVTHTGDMVVRINRTHQGWTLGFASPLEYQLGNYLTWVLVAMLLHTCHLSWVAQTGDIVADKTNGKQQHCVKDGPKVEPVPIVASSSIESLPFCEGMDYFSLGKDMEIANFWVDEFMKVNVESQKAQIECAKFEWALIEATKANNSLLQSIENSKKSLEDTETKLKKAEIQEEALKTSDLDEAESEIIKTQEANFEKAFP

SEQ ID NO: 173103 - protein, 206 aa, Glycine max
  Coding DNA Sequence Number=SeqID_81418
MDSAKVFLQRSLAILEENGQWHQEALHKVEKKDLDGKVESIAVERDGPSKVVIDLEAQLKESEYSKELEEELLVYKKEAVEQHEKGFNKDVKQARFFAKDLDMGLFDPFKDVKDGVLLDEEDIAAEEEAVDEAGCCRARRPCNYDNYFYFSSMHMLSFDDELRTVYACLVCMSCCHDDECGIFDGVGRVQTKGGPWVFAPRADLGF

SEQ ID NO: 173104 - protein, 36 aa, Glycine max
  Coding DNA Sequence Number=SeqID_81419
MVVRNATIEKPREEWDDDERRKVQYKAKNIITSALG

SEQ ID NO: 173105 - protein, 319 aa, Glycine max
  Coding DNA Sequence Number=SeqID_81420
MCCGRSGGRWFFRGWQRKKVLPRDSEEEPSSTRRKWNIFDTRGRRFFCGNPRKKLLPRVSRTLHFLLAEDGSSAAIRGRSFFHGSARMKVLPPVSAEEGSSAIRISFLRKNLLPRNLELLQDSLEKPYKYATSLVPRVKLYLIKDEKLEKTRWGQIVVYVRPERVIRQFGYIPTVPPPSVSDSLTDDDIDDQWLHFSDHLVGAGEICVVLGQVAPDYMDWFFRISHPFVTPTEETAEPRHHPLPHVEEFVKPPIPEVSVASDLPTHSVVDCQGCAAIAEELERVINLKMVTEGTDLYDIMARCLRIARGDAADKSLRPR

SEQ ID NO: 173106 - protein, 91 aa, Glycine max
  Coding DNA Sequence Number=SeqID_81421
MDEDQWTYYSTMSEEVDMDFKDEQDCGVNEGHVDYSDAFNTSQVFATREDVLQWARTVAHENGFVTVIMRSNTYTGSRGRTSFVLIGCERS

SEQ ID NO: 173107 - protein, 38 aa, Glycine max
  Coding DNA Sequence Number=SeqID_81422
MGVRSRNFIQNILEGIILKKPLGGNHLHFVNKWHPGLP

SEQ ID NO: 173108 - protein, 84 aa, Glycine max
  Coding DNA Sequence Number=SeqID_81423
MKSDDEWITKEGDDIFDEDNVQVEQPLGENGSGNNIDLVGGSLSDPTLDAFDIDNLILNDNVKDHFSIEKELEDDGDEDDDDVY

SEQ ID NO: 173109 - protein, 59 aa, Glycine max
  Coding DNA Sequence Number=SeqID_81424
MMSIEVADGGSMWGPCVESLFGNVEVKQLVPMVVVNGGASRDHLILMEYIVGIIPKSER

SEQ ID NO: 173110 - protein, 141 aa, Glycine max
  Coding DNA Sequence Number=SeqID_81425
MQEGGQISAIPCLSECGDVVLHEVVPHLCCRGEGSEIEDDIRLNKAYDPSHGLCIFDLSFGMCLLVHSFVRSRISSVNMTPKLLAFDKDLELECPGGVILSIKMNKEDIIFFSRHDALVNSTAQKARTGNLETGSATKKKI

SEQ ID NO: 173111 - protein, 254 aa, Glycine max
  Coding DNA Sequence Number=SeqID_81426
  Gene Ontology: Mol. function=phosphoprotein phosphatase activity; Cellular component=actin cytoskeleton; Biological process=actin cytoskeleton organization and biogenesis
  Homolog annotation: Hit_ID=A7PDI0; Match level="QueryCoverage=66%, HitCoverage=33%, E-value=2e-74, Identity=85%"; Hit description =Chromosome chr17 scaffold_12, whole genome shotgun sequence
  Pfam annotation: Domain name=FH2; Domain location=5-243; Score=42.1; E_value=5.6e-12; Accession=PF02181.14; Description=Formin Homology 2 Domain
MIDWLPVGMWKKKFVLLLPITTVETWIINKFFWSLLIQECYFLELMKVPRVESKFRVFSFKIQFRTQITEFKKSLNTVNAACEEVRNSFKLKEIMKKILYLGNTLNQGTTRGSAVGFKLDSLLKLTETRASNSKMTLMHFLCKVLADRFPGLLDFHLDLVNLEAATKIQLKSLAEEMQAIIRGLEKVKQELVASKNDGPVSEVFRKVAHKEATTKVGYGRPQVKIGAELCWTTGVKNFSLATSFNAIKGNTSVI

SEQ ID NO: 173112 - protein, 100 aa, Glycine max
  Coding DNA Sequence Number=SeqID_81427
  Homolog annotation: Hit_ID=A5AV22; Match level="QueryCoverage=53%, HitCoverage=4%, E-value=1e-09, Identity=58%"; Hit description =Putative uncharacterized protein
MFMRIIVADNIKTTFPKTDNAKEFMGLVGECSQTADKSIAGTLMSTLTTMKFDEMRLKNQGSHSVHYISHQGNQGAGKKFMKKHDKGKGSLKINDDSLQI

SEQ ID NO: 173113 - protein, 124 aa, Glycine max
  Coding DNA Sequence Number=SeqID_81428
MASTSGDATPPFPKTARLMEEIIKLGEQMRRMSYEDEERMERMRKENEESLERIHRSSEALSMRGMKKMREERGIRGIEREEIIEDMEVDKRKEEIEGVKVSIPTFNGTYDPEVYLEWEMKVEQ

SEQ ID NO: 173114 - protein, 167 aa, Glycine max
  Coding DNA Sequence Number=SeqID_81429
  Gene Ontology: Mol. function=methyltransferase activity
  Homolog annotation: Hit_ID=A7NZI6; Match level="QueryCoverage=89%, HitCoverage=18%, E-value=3e-27, Identity=46%"; Hit description =Chromosome chr6 scaffold_3, whole genome shotgun sequence
MTMMSTLWWRVEEPRSNVELSSSKTLNTTNDHDSTSESHQMTPEEVEPNREDDVVLTAKRKRNDDVVEDCSLHLLWKTSLYSYFQSHNRSCNHDGVCRYVHDKEKLCLHPNNTWDLTIERTKKALKTEAGEKRAISEEVMMTEAAIDDDNNDCGTNHTLSKCLVDLP

SEQ ID NO: 173115 - protein, 80 aa, Glycine max
  Coding DNA Sequence Number=SeqID_81430
  Subcellular localization annotation: CTP_CleavageSite=55; ConfidenceScore=5.03e-01
MTILLGGMISWWDPISTMMMLTKFVFFLSYPNFVRGPLLDDMRPFFGPCEERQVMVTRDSRQPRGAKLVSYTDFRPRTFA

SEQ ID NO: 173116 - protein, 160 aa, Glycine max
  Coding DNA Sequence Number=SeqID_81431
MCHEWLSIEAYNKTYHHFIEPVQGPQYWAQYTHLVPPHKRVQRGRPKKNRRRSVDEDNVTGHKLKRKLAELYMWKKYVAPSTSNEDDHLLSQDEQALNEAEEAAAHVQQDSVEINLSQPHLSQDSDMELMVPATIVPPIARNKLTITRAKQRKVAEFEGC

SEQ ID NO: 173117 - protein, 148 aa, Glycine max
  Coding DNA Sequence Number=SeqID_81432
  Gene Ontology: Mol. function=protein dimerization activity; Biological process=DNA integration
  Homolog annotation: Hit_ID=A3BRV8; Match level="QueryCoverage=95%, HitCoverage=24%, E-value=2e-21, Identity=37%"; Hit description =Putative uncharacterized protein
MTGKGVRVCQKVTIVKLIDLKKIDNEATLRVERSKTKSVSLPLVSTQHQMDTNTLGVDPKKRKTSSVENVFNLQVRETLDHEIARMFYSSGLPFHLARNPHYRKAFAYAANNQISGYQPPESGPMFLKAIDCSNAIKDKDFIAKHMRE

SEQ ID NO: 173118 - protein, 37 aa, Glycine max
  Coding DNA Sequence Number=SeqID_81433
MIEGNQDGGDTCIEVGSNKEGACAATMDLIGMIAVAA

SEQ ID NO: 173119 - protein, 596 aa, Glycine max
  Coding DNA Sequence Number=SeqID_81434
  Gene Ontology: Mol. function=two-component response regulator activity; Cellular component=nucleus; Biological process=two -component signal transduction system (phosphorelay)
  Homolog annotation: Hit_ID=Q56TL2; Match level="QueryCoverage=95%, HitCoverage=96%, E-value=1e-175, Identity=60%"; Hit description =Timing of CAB expression 1 protein
  Pfam annotation: Domain name=CCT; Domain location=516-560; Score =78.3; E_value=2.5e-20; Accession=PF06203.5; Description=CCT motif
  Pfam annotation: Domain name=CCT_2; Domain location=512-540; Score =15.7; E_value=0.037; Accession=PF09425.1; Description=Divergent CCT motif
  Pfam annotation: Domain name=Response_reg; Domain location=30-142; Score=45.2; E_value=2.2e-10; Accession=PF00072.15; Description =Response regulator receiver domain
  Pfam module annotation: Pfam domain module=CCT::CCT_2::Response_reg; Domain location=516-560::512-540::30-142
MESGDEINLNIESGNNGKSGGDGFVDRSKVRILLCDNDSKSSQEVFTLLLRCSYQVTSVKSARQVIDALNAEGQHIDIILAELDLPMKKGMKMLKYIAQDKEFRRIPVIMMSAQDEVSVVVKCLRLGAADYLLLWEMLKILEEPHCIPIIRLPHLCNSLGAMPNTLGLVEKNILNYDFDLVVSDPSDANTNSTTLFSDDTDDKSKRSTNPEVGISVQQEQEVGFFFQLWAFFANNSTFQSVNIDIHSTIAIAAAVEEPPDAHASECGPDVDGVNDHQTAHFSSGPKKSELRIGESSAFFTYVKASILKSNLEGVVNVDKNGATHVRMEVMHQTCAQQGVNDLQIRENGEAYESQSQDDLPSSTSIPDSLSIERSCTPPASMEVSQQKHYREENLHQGVMHPRNGTHCSELEVSGMASQQVYPYYISGVVNHVMMPSSAQMYHQKNIQDLQNHPSSAMISQYSHLPQGGPHGTGMTSFPYYPMSICLQPGQIPNPHSWQSFGNSSSSEAKLSKVDRREAALMKFRQKRKERCFDKKIRYVNRKRLAERRPRVRGQFVRKLKGANADLNGQPASIDYDEDDEEDEDDQGARDSSPEDA

SEQ ID NO: 173120 - protein, 156 aa, Glycine max
  Coding DNA Sequence Number=SeqID_81435
MKSECTNVEGLLIFHVDLAFNAGFCAKCTSELPRGPSRAKPGLHTEQNCTLSLDLPTKQECALSFINEKDPLKEAKFTKLDVRSDCQAKIRFKVEMVTKDKGNCIDDMVNSGISVIDAFNYMSQGVEGTENVGFTKRDCYNHMNKQKMMMIEAGDA

SEQ ID NO: 173121 - protein, 73 aa, Glycine max
  Coding DNA Sequence Number=SeqID_81436
  Homolog annotation: Hit_ID=A7PDJ4; Match level="QueryCoverage=84%, HitCoverage=6%, E-value=6e-13, Identity=51%"; Hit description =Chromosome chr17 scaffold_12, whole genome shotgun sequence
  Pfam annotation: Domain name=PPR; Domain location=40-73; Score=3.4; E_ value=3.1; Accession=PF01535.11; Description=PPR repeat
  Pfam annotation: Domain name=PPR; Domain location=5-39; Score=17.4; E_ value=0.054; Accession=PF01535.11; Description=PPR repeat
  Pfam module annotation: Pfam domain module=PPR::PPR; Domain location =40-73::5-39
MPTLQPCNALLHGLVKTQMFDSLWEVYVDMMSRRFSPTVITYGILMNCCCAQGDFSNAQKMFYAKWGVPSSNS

SEQ ID NO: 173122 - protein, 588 aa, Glycine max
  Coding DNA Sequence Number=SeqID_81437
  Gene Ontology: Mol. function=transferase activity, transferring glycosyl groups; Cellular component=integral to membrane; Biological process=cell wall organization and biogenesis
  Homolog annotation: Hit_ID=Q9M5Q1; Match level="QueryCoverage=80%, HitCoverage=83%, E-value=0.0, Identity=79%"; Hit description =Galactoside 2-alpha-L-fucosyltransferase (EC 2.4.1.69) (Xyloglucan alpha-(1,2)-fucosyltransferase)
  Pfam annotation: Domain name=XG_FTase; Domain location=75-556; Score =944.6; E_value=4.2e-281; Accession=PF03254.4; Description=Xyloglucan fucosyltransferase
MKRHWRNWSHDDEGEGLPDSDSDTRSSRRFSLTRLMAIFLFSLFLFSLIFLLPHPPIQSASTAKTLHQFKQTQQVLFRRMYALHKSMNVGDPTFTKDDMIKILTPCRGNVADSVELHKDKLLGGLIADGFDEQSCLSRYHSVTYSKGLSGNPSSYLISRLRKYEALHKECGPYTESYNKTVKDLRSGHVSESPACKYVVWISYSGLGNRILTLASVFLYALLTDRVLLVDPGVDMVDLFCEPLPHVSWFLPPDFPLNSQFPSFDQKSDQCYGKMLKNKSATNSVVPSFVYLHLAHDYDDQDKLFFCDDDQAFLQKVPWLVVRTDNYFAPSLFLMPSFEKQLSDLFPNKETVFHFLGRYLFHPTNKVWGLVSRYYQAYLADVDERVGIQIRVFDTRTGPFQHVLDQILACTLKENLLPDVNQKGDIVNSPGKPKSKAVLMTSLSYGYFEKVRDMFWEHPTVTGEVVGIYQPSHEGYQQTEKKMHNQKAWAEIYLLSLMDMLVTSSWSTFGYVAQGLGGLKPWILYKPENGTAPDPPCQRAMSMEPCFHAPPFYDCKAKRGTDTGALVPHVRHCEDMSWGLKLVDSNSWQ

SEQ ID NO: 173123 - protein, 99 aa, Glycine max
  Coding DNA Sequence Number=SeqID_81438
MENGVYMLGVAEDGDKNGTVRQCNAELVDIHGFGSGRESVGRVVAINEEVLETVRVHMAWVGREVKRGELRVAAVCRYFVSAHESLVAVGLVGKLIGDS

SEQ ID NO: 173124 - protein, 232 aa, Glycine max
  Coding DNA Sequence Number=SeqID_81439
  Homolog annotation: Hit_ID=A2Q1D6; Match level="QueryCoverage=48%, HitCoverage=26%, E-value=1e-11, Identity=29%"; Hit description =Ovarian tumour, otubain, related
MDEEQWMHDSIMSEEVDMNEQNEDEAVNERSGQYRAKKKDSVRTDTNSRKCGCPFKLRGKLVVGGQRWMEHNVNSYTAIKQIYNARSAYCSSIRGSDTKMQQLMKLLEQDQYIHWHRVKDEDVVHDIFWCHPDAVKLCNAYQGLSEPEAKITEEMETISKRFEELNVCGKVTLKSKLREIAYPTLNSMCHPPKKVKTKGVQKKPMTKHQRSTKASNSKKDYVDVGSISFMQS

SEQ ID NO: 173125 - protein, 97 aa, Glycine max
  Coding DNA Sequence Number=SeqID_81440
YILCGTSRGYIYLGCNTENKRGYISCGSVQVEGTSTWLFKENKGGYIPCGSLLVKDFTRYTESNLIKLDIRINGDCVEPLATIVHNDKAFELKRNDP

SEQ ID NO: 173126 - protein, 17 aa, Glycine max
  Coding DNA Sequence Number=SeqID_81441
MEFCLIVDDADTTTPTV

SEQ ID NO: 173127 - protein, 211 aa, Glycine max
  Coding DNA Sequence Number=SeqID_81442
  Subcellular localization annotation: CTP_CleavageSite=38; ConfidenceScore=5.30e-01
TRQLLAMFSQMQSQFQSQMQSQGLALLSEPLVGPSSPRVSTKESCVDPSGNDLETDDSDRYDLYIKANPACLVALRRVYKGSTVVHNTSLLPSQVKVGVEEVKDPDAPIPVPTNEVTWDATVFGVFNPDFPLYIKHEDLSEIAHGGQCLSIQHLTETSMRAGNSDLYGFLEPQSIQRLDNYLKGIINNALKGLDDAPQSKSKAPARWIVVK

SEQ ID NO: 173128 - protein, 141 aa, Glycine max
  Coding DNA Sequence Number=SeqID_81443
  Subcellular localization annotation: CTP_CleavageSite=20; ConfidenceScore=5.05e-01
MASPPTSPPPPPPSDASALPSAVKWTRKASRGHHVRELEEGPYCSEGLDLGGYSAEFEIPEASDSRMKKKLLQTVDERLRQFKLDLTRKWALVANQDGVDDTVCEKYDISKEKWAQFCQTRRDPSWEDVRKKALAIQKQNT

SEQ ID NO: 173129 - protein, 284 aa, Glycine max
  Coding DNA Sequence Number=SeqID_81444
  Homolog annotation: Hit_ID=Q2HTA0; Match level="QueryCoverage=28%, HitCoverage=13%, E-value=3e-10, Identity=43%"; Hit description=IMP dehydrogenase/GMP reductase, related
  Pfam annotation: Domain name=DUF1723; Domain location=123-165; Score =23.3; E_value=0.00089; Accession=PF08330.1; Description=Protein of unknown function (DUF1723)
MVIIRGLSRALGRVIGRALGKEVNIDLDEAPQRQRPTTSACRQREAAPVAEDVQHLDHAVDKVHEHVEEAVVDDVVPDAEGFPNRPHDTSVLIGYVHHVAVTVWNEDLSSYGRKVEKFGRPVPEIEGLVAAETSSFHLPVGEVTITLNDVTSLLHLPITCAFHSFEPLHMEKVMLMLVELLEVSADEARAETSRSYAWEVAALVHMYNNLNDASKNSARQLVGCITLLQSGKTLLVSTYRERLDRLTSDAVCWIPYGDHHAIREFELISLFSGHIRWGPSVVID

SEQ ID NO: 173130 - protein, 85 aa, Glycine max
  Coding DNA Sequence Number=SeqID_81445
  Subcellular localization annotation: CTP_CleavageSite=77; ConfidenceScore=5.86e-01
MRTQALVLSSHSVFLVLPRASVFLFFLASSSSRPHGTGFCNCTLPRYSLTVVTVRRFVLASCKVLKVVTFSPLVFTRCSQGASCS

SEQ ID NO: 173131 - protein, 130 aa, Glycine max
  Coding DNA Sequence Number=SeqID_81446
  Homolog annotation: Hit_ID=A5ADP2; Match level="QueryCoverage=73%, HitCoverage=22%, E-value=8e-07, Identity=34%"; Hit description =Putative uncharacterized protein
MSHQEYINVILEGLLREYDLVIAVIESKFESPLIAEVKALLLAHESCILESQKRIIISSPSINYTQDPSSNLNPYQNNNFSFDSYFVPNNSYGFDFDQSHNSNPNPGGGIGGGGGRCNNIRGHGGRYSNF

SEQ ID NO: 173132 - protein, 93 aa, Glycine max
  Coding DNA Sequence Number=SeqID_81447
  Subcellular localization annotation: CTP_CleavageSite=90; ConfidenceScore=5.71e-01
MATSSSNRQCYWLLPTAAQIASSTSAFNCKKVVPPATLPAARSMSKQSPTLNLPVKLVSPSSCKAPTALATPVSGVTSPREAPIRAAICMCST

SEQ ID NO: 173133 - protein, 89 aa, Glycine max
  Coding DNA Sequence Number=SeqID_81448
MVRYDKDIIRWCRKIDAQQIDPSSDEAHPSLHSHCRLTGQWPSYLPGIHSKPTTTFKFMQKKGKVPPHTKPMPHPGPKDNIVLRPIPYD

SEQ ID NO: 173134 - protein, 106 aa, Glycine max
  Coding DNA Sequence Number=SeqID_81449
HRNVDSDNGGCGSDGGNGGGMVEVIVVVVVVEEWLCWWRWWNGCGGGGGVGGNKVWWWWNGGGGMVVMVAVVEAATMMVVRIEPVGFYRGPSPTLEIFGDLAFFRR

SEQ ID NO: 173135 - protein, 58 aa, Glycine max
  Coding DNA Sequence Number=SeqID_81450
  Pfam annotation: Domain name=DUF1713; Domain location=4-37; Score =11.3; E_value=0.039; Accession=PF08213.2; Description=Mitochondrial domain of unknown function
MSSRCKSAIIAEQASLSQEKYRKERRARRGEKRRTRKRERGHDDGGRVNGSVAARRLY

SEQ ID NO: 173136 - protein, 109 aa, Glycine max
  Coding DNA Sequence Number=SeqID_81451
MCLLVEGPCVVVACTNNGVEGGVVRDYKGGGVTHAMVKLGGYGCTTVVVLSAWGKMKWLVRGWGSVGVEHVAKEGEGAGVSGVDSDHSGEEVGVGRGKVVKDELRIGEV

SEQ ID NO: 173137 - protein, 210 aa, Glycine max
  Coding DNA Sequence Number=SeqID_81452
MNLRNDGGDPSMLEQMEYMRRQMAQMKDIRRENVEVRMENAEARRPGESLKEYLTRFNGVIVRVVKSDERMIVAAFFKGLHSESLVRRKPDTMTDAFLKPCGNWNKGGVNHSSRRDGGGGWSRQTRSKEGANFEEWGYVDLDTTFGGMEVKKIMVKFALDDESAEIISVNQEIKCKCYEDSLKARRGIYGSMKHYGVNFVELDPRRDFID

SEQ ID NO: 173138 - protein, 132 aa, Glycine max
  Coding DNA Sequence Number=SeqID_81453
MTEDIVVFEMCVDYHVGRLRVPSDSQVTIAELCVWITISLGQKMLTSPERVQMTTLVSACQSDLGSSNDEVRITVRCLRMPPDSRVGVAKVGGASPHAIGLTSHDRKRWGGRQKWGFCSYVSSICDEELRPT

SEQ ID NO: 173139 - protein, 64 aa, Glycine max
  Coding DNA Sequence Number=SeqID_81454
MEVDEPWLGLWLPLNYQVDMGAMRKTDFVVDSGMAFVDNWAVGKEKEWQSQHGLLPHSHPLHLP

SEQ ID NO: 173140 - protein, 28 aa, Glycine max
  Coding DNA Sequence Number=SeqID_81455
VVDKSGTFTPTYPQFVVRNSDLRSSCEK

SEQ ID NO: 173141 - protein, 189 aa, Glycine max
  Coding DNA Sequence Number=SeqID_81456
  Gene Ontology: Mol. function=aspartic-type endopeptidase activity; Biological process=RNA-dependent DNA replication
  Homolog annotation: Hit_ID=Q69F85; Match level="QueryCoverage=85%, HitCoverage=11%, E-value=1e-14, Identity=28%"; Hit description=Gag -pol polyprotein
MKFSPDVENIITVHADQRTTKECYMTSHRLHPYTREKALEVIHYVETRMKTEEVEELELNSRTNDDNQVKPVKETSTFQLRPKEEQTCLGSMQAFIVISYPYVKMQSHLPKGRHRWGKRGVRKIDYSTWHSNVVMVKKPNKKWRMCVDYTNLNQACPMDAYLPGQWSNWTHDVEFSKCIFRLQADKDGS

SEQ ID NO: 173142 - protein, 85 aa, Glycine max
  Coding DNA Sequence Number=SeqID_81457
MVVMRITRMKRNFLWGGEEQGRRKIAWGETLAIKYRRIFLNSEQQNDCFNWELPVVDKFFEELNGATLVHQQQHKLAWRNGSGAI

SEQ ID NO: 173143 - protein, 146 aa, Glycine max
  Coding DNA Sequence Number=SeqID_81458
MDRCPPQPYNPVIMQSRNEMQQSEDLRRLCGAECEDKWFDKLSEWKLGDGGCGELDVEFVWRRGCFVWEESQVNQLKALLVREPSQENEEATEEWVFGGQILVADLEAIYSTEVEESADHAFMNCRKIYPLWKKMLCLAKMLFCPT

SEQ ID NO: 173144 - protein, 73 aa, Glycine max
  Coding DNA Sequence Number=SeqID_81459
MVVARLVRDHEHLDLELGAGHDAGGGVMFKSNRSKQSEDTLQQMVVAILDKAQVEKDKGPEALPRILIAEDPN

SEQ ID NO: 173145 - protein, 175 aa, Glycine max
  Coding DNA Sequence Number=SeqID_81460
  Gene Ontology: Mol. function=nucleotide binding; Cellular component =intracellular; Biological process=small GTPase mediated signal transduction
  Homolog annotation: Hit_ID=A7PKM1; Match level="QueryCoverage=64%, HitCoverage=18%, E-value=4e-52, Identity=88%"; Hit description =Chromosome chr7 scaffold_20, whole genome shotgun sequence
  Pfam annotation: Domain name=GTP_EFTU_D2; Domain location=64-125; Score=14.2; E_value=0.014; Accession=PF03144.16; Description =Elongation factor Tu domain 2
PEEGEDDVKSLCPGRHTCYNGRDKGSRSRKGELTPKPILSSDCRLQLACMKSESLVIAGQPYDDGTMKKGDRVYFMASGKDYFADEIGVLSPSQLQVEELYAGEVGYLSASIRTVADARVGDTVTHYGRKADNSLPGYEEATPMVSCGLFPVDADQFPDLCDALEKLQLNDAALK

SEQ ID NO: 173146 - protein, 55 aa, Glycine max
  Coding DNA Sequence Number=SeqID_81461
VVIIKRGEIVEAMSSKVILMMPKNQELSKVSSKDSRIKFQVSRIKFQVSRIKNQE

SEQ ID NO: 173147 - protein, 112 aa, Glycine max
  Coding DNA Sequence Number=SeqID_81462
MVKRRKLLSMENRRGLRYECSSNSKIQEKFLEGLISTNVKQGLLPSRKVFFLISSHLKCRETERIVKEVKSCFSPLPRNQSALERSLTMEKDMHCLSIICENHRFQDLVDFL

SEQ ID NO: 173148 - protein, 274 aa, Glycine max
  Coding DNA Sequence Number=SeqID_81463
  Gene Ontology: Biological process=regulation of transcription
  Homolog annotation: Hit_ID=A7PDL9; Match level="QueryCoverage=42%, HitCoverage=71%, E-value=8e-42, Identity=74%"; Hit description =Chromosome chr17 scaffold_12, whole genome shotgun sequence
  Pfam annotation: Domain name=RWP-RK; Domain location=139-190; Score =66.1; E_value=1.2e-16; Accession=PF02042.6; Description=RWP-RK domain
MENQQLTFWKSNYEIDDYPFAPTCQFSSYDYCSWGNANDGYHWPYEFPLQDSYLDAIPYMKCYYPHDILYESTLPIEPTSLSIRDYDFSDVKNVLSALNETDGSDHKPAFSSCNDGESVDEMQEDLKGKKCREEGISSSAKMLSRKTVSQYFYMPISQAARELNVGLTHLKKRCRELGIQRWPHRKLLSLQTLIKNIQEQRETGGHENDEKTRAAIEILEREQRKVEEMPDLELEDNTRRLRQACFKANYKKRKLMGMRLIEPDSSLSGLFNKY

SEQ ID NO: 173149 - protein, 29 aa, Glycine max
  Coding DNA Sequence Number=SeqID_81464
MRIGHENNNEHQNEGFVNEGDERKIEDNV

SEQ ID NO: 173150 - protein, 422 aa, Glycine max
  Coding DNA Sequence Number=SeqID_81465
  Gene Ontology: Mol. function=catalytic activity
  Homolog annotation: Hit_ID=A2XFN1; Match level="QueryCoverage=14%, HitCoverage=11%, E-value=2e-10, Identity=61%"; Hit description =Putative uncharacterized protein
  Pfam annotation: Domain name=DUF26; Domain location=292-322; Score= -1.1; E_value=0.0087; Accession=PF01657.8; Description=Domain of unknown function DUF26
GTFVPYGRDDILNTAIGKSEHPSRVRAVRSGMKISQYYGRAPRGSNSSSTSITQQQLAEIIGSLKEEWRNELEQENKWSIEKMKQELKQAIKIDTKGNNGEIAVNPSREEHVAHVIPTIGFVYASVAYPDDVVRVNVEKVFDGDVQVPFSTSEIKYVRQTLYTFIAWPTNLVKIVSHEDSYITPNKVVEPVQRSNNVVLGDSLHHLIRTMCDIYEKPVELLWDGTKFRIPNVDASFFLTYYDVNEIISVENRRLCRYHSDTDDRFARRPVLPRTPKEVLAAKGVKPTLFPNLNTLALVEGKRGGRVLYPRCNVRYELYPFYHVTASPPSPSPSPPTLLPPSTSPISPGSSGISAGTIVPIVVPITIVVLIFIVRICFLSRRARKKQQDSVKEGQTAYDITTMDSLQFDFSIIEAATTQVLCG

SEQ ID NO: 173151 - protein, 66 aa, Glycine max
  Coding DNA Sequence Number=SeqID_81466
  Subcellular localization annotation: CTP_CleavageSite=28; ConfidenceScore=5.16e-01
MEMQRKTKEKSGPSGRSAHFLSVGNGLSAALGRSAQLPSVGIALSTPFSLSGRPTIIILKIPTVRL

SEQ ID NO: 173152 - protein, 192 aa, Glycine max
  Coding DNA Sequence Number=SeqID_81467
MPYVDLLPSLISNQMVMVNPEKIYQSPFPGWYNPNATYTYHGGVPRHSIELCVAFKHKMMAPPDSIPIVEQFNEMVAWPGTQPSLHKEDEGQTAQVPQHMEDESSEATIPEPFDIGEEAEETQATSEPSAPVVNLPPPQPAADTSTPLLQMPKDPTTPVLAVDTSPPTTPVLQLTDEEDGQTQDTQDQSQEF

SEQ ID NO: 173153 - protein, 158 aa, Glycine max
  Coding DNA Sequence Number=SeqID_81468
MGIRGCINYNPILAIRQPGYPMRGALSEEIIVPFIAQGFSEGNEKMLQRIRKAWNTVERKDKELRGSSNGVIGDYHKWLKAQTQGITWLLKLKSPSGEEAKVPEESEEVQALKVELERLRVVKEKLKTAMTRVRKECDELRDINMTTAEALEWETKRA

SEQ ID NO: 173154 - protein, 70 aa, Glycine max
  Coding DNA Sequence Number=SeqID_81469
MEVMMMMVVIVDGSSGGGGDNNHDGDCNGGHNNDAEGHGDKGGGGCDGGDGGNEYGGGSDHDVDGLIEIF

SEQ ID NO: 173155 - protein, 279 aa, Glycine max
  Coding DNA Sequence Number=SeqID_81470
MDFFSNESFECIQAFENSNLIPFMSLKSPVYSELVKAFYYNLEIQESSLISEVFGIKMVIDQSLFYDLTQLSSEGVPFEGTLNDDWKFDFSVHDARRLVCTNQADMTGRLLVGSLTFESRILHYLIVCILLPRSSNLAQALRLNAPLPYPHLVTIFLQHFNIPLDFEPYVPIKRSFLIGAVVVASFDYRKERDGSWVKKGAQPHDDEGDLPVGEDSPLLQSILDRFDGLQTFVGERFDALEQQVDMRFDGMDSRVTKVEEDVTFIRTCFDLPPPPLPSS

SEQ ID NO: 173156 - protein, 245 aa, Glycine max
  Coding DNA Sequence Number=SeqID_81471
  Subcellular localization annotation: CTP_CleavageSite=63; ConfidenceScore=5.43e-01
MEKYIATMRRSDSRPVTATSVAIAACYSLNCMLRFFISFTVRGNSQSRSMSWNPKVHARVMVELMKVARAVDFALMREKRVALELVPPMEMRVVMVEPRVVVNFVRFVAVEFETCARVTVEQVRREKLLLQEREWELEAELFLMRTLLPNCPLNWLWAPIKCLDSSSPRAYPALVRVELRELSETTPHFALLAEGGDHDACHFVDQLRVVAVATYPLAGRQSKIERHGEGISTPHARHKGQQPLI

SEQ ID NO: 173157 - protein, 73 aa, Glycine max
  Coding DNA Sequence Number=SeqID_81472
MATPNAPLGQQWDVPGAIPPMGDLLGVDLRHEFSAEAEEQGRRQRARRNPDRQARRWDRPCGTSSRHHEHHDD

SEQ ID NO: 173158 - protein, 124 aa, Glycine max
  Coding DNA Sequence Number=SeqID_81473
  Gene Ontology: Mol. function=phosphoinositide phospholipase C activity; Cellular component=membrane; Biological process =intracellular signaling cascade
  Homolog annotation: Hit_ID=A7R978; Match level="QueryCoverage=67%, HitCoverage=36%, E-value=7e-17, Identity=50%"; Hit description =Chromosome undetermined scaffold_3458, whole genome shotgun sequence
MPPLPMEPTQQQLEAHCKAYILRLIGGVLMPNKMGNRVHLMYLTMLVDLERVRRYSWGSACLATLYREMCRATDPDAKTMGGFLVKFISPLFGCFGVDSFRRLLHMDSLHPSNLFLDSRMAPSG

SEQ ID NO: 173159 - protein, 107 aa, Glycine max
  Coding DNA Sequence Number=SeqID_81474
MPTTLVKEIPYPLVPSKKEREHYFARFLDIFKKLEITIPFGETLQQMPMTQLATGGDCSQFSSETAWVCYRGGARTRHGEQLTTYSQYLHTYPDHDTIATKLSTPGG

SEQ ID NO: 173160 - protein, 33 aa, Glycine max
  Coding DNA Sequence Number=SeqID_81475
  Homolog annotation: Hit_ID=A7NVK2; Match level="QueryCoverage=90%, HitCoverage=13%, E-value=1e-07, Identity=86%"; Hit description =Chromosome chr18 scaffold_1, whole genome shotgun sequence
MEAWVTLGRAQLNFGEPDNAIESFDRALALKVL

SEQ ID NO: 173161 - protein, 151 aa, Glycine max
  Coding DNA Sequence Number=SeqID_81476
MGFFRYYFRQRALFYVKSMPCSDQLARTSGEFGLSEQIAHAAGDTLRREPPVKLVSSNGLRVQTSPARAGMAVQGKQGAGQIATPIGDLPCTGIASYAGGLLLRFENFHSSSSIIKAEGPSEELPSFACSLLFFFPTTLHSSYCVAVFCFW

SEQ ID NO: 173162 - protein, 230 aa, Glycine max
  Coding DNA Sequence Number=SeqID_81477
  Homolog annotation: Hit_ID=A5C5V8; Match level="QueryCoverage=95%, HitCoverage=31%, E-value=8e-26, Identity=31%"; Hit description =Putative uncharacterized protein
  Pfam annotation: Domain name=zf-C2HC_plant; Domain location=20-75; Score=69.0; E_value=1.5e-17; Accession=PF07567.3; Description =Protein of unknown function, DUF1544
MAKPSSDAAIVSATRKNKADPGWKYCHSLVEGDTNTIVCNFYGKITKGGITRAKQHLIGKSGNVAACKKTPPNVVEELKEYMATKKSGTTYSTSGSGNMTNIRDFEFGKPIGCDGSEEDEFADSCNAAASAKTKCGTKKGPMDKFCKNPENAINRRKMEMLRQMNIRESMDKNEVLKVHRHIACFWYQAAIGQYGPHLSIPSYHDIRVPLLKKEVEYTKNLMEGHREQWV

SEQ ID NO: 173163 - protein, 101 aa, Glycine max
  Coding DNA Sequence Number=SeqID_81478
  Subcellular localization annotation: CTP_CleavageSite=31; ConfidenceScore=5.24e-01
MDQDDDNDVGNDLAKKAKTTSVAVTQTSKKQAMVVGSSSRKQRAVQENVEDLDFEENIDLESEEEEIMVNFEVSDGEEGERHTPLPYDNNEDDYVGIREDD

SEQ ID NO: 173164 - protein, 221 aa, Glycine max
  Coding DNA Sequence Number=SeqID_81479
  Gene Ontology: Mol. function=ATP-dependent helicase activity; Cellular component=nucleus; Biological process=RNA-mediated posttranscriptional gene silencing
  Homolog annotation: Hit_ID=A7PDE9; Match level="QueryCoverage=60%, HitCoverage=20%, E-value=2e-56, Identity=79%"; Hit description =Chromosome chr17 scaffold_12, whole genome shotgun sequence
  Pfam annotation: Domain name=HA2; Domain location=1-69; Score=14.9; E_ value=0.01; Accession=PF04408.14; Description=Helicase associated domain (HA2)
MAKFPLDPMLSKMIVASENYKCSDDIISIAAMISVGNSIFYCPKDKQVHADNARLNFHTGNVGDHMACLKVYNSWKETNYSTQWCYENYIQVRSVKRARDIRDQLAGLLERVEIKLTSNDNDLDAIKKSITSGKLIKLKISCNGFSHTLHDCKRMDHIEWLNIHRLFTYILVQGYHRCWMPTSSYLAMTITNIDNKCNMAFRRMNEEDRVISHANCGKAEL

SEQ ID NO: 173165 - protein, 59 aa, Glycine max
  Coding DNA Sequence Number=SeqID_81480
  Homolog annotation: Hit_ID=A5BSW9; Match level="QueryCoverage=100%, HitCoverage=6%, E-value=5e-10, Identity=40%"; Hit description =Putative uncharacterized protein
KLHERVRNQIENQTKVYATKGNRGGKELVLSEGDWVLERINNNAYKLDLPEEYGVSTTF

SEQ ID NO: 173166 - protein, 273 aa, Glycine max
  Coding DNA Sequence Number=SeqID_81481
MALLEGGKSTKIQVPFLSNVLYSAFITISQVGFERAKLVVLGSREGSEVALSCVGALSGVDDSGSVGQNDGLGSLLVRMVKTIRVKVMLGGYGPLIWNLIVAGRRMKLVDKIDTRNEGMLPIMKRHVNLRESLRNLVKGLNSPPQSDWTALIGRLNQTQVDVPSTCTTKDVPSNVLRQRSQVVKPLILCEWGYKRILRREKGDTKEFRRLVLRSFGKGRRETQKEFRRLVLGKFFLAKGEENEKMNSISFQGLENQKAFGTKKKKKFKEIQGL

SEQ ID NO: 173167 - protein, 62 aa, Glycine max
  Coding DNA Sequence Number=SeqID_81482
MASTSGDATPPSPKTARLMAQMIKLGNQMRRMSYDNEERIERMRKKNEESLGRIHRSSEALS

SEQ ID NO: 173168 - protein, 209 aa, Glycine max
  Coding DNA Sequence Number=SeqID_81483
MDSLMISCLIWSRLRSLSEEQERITEIVTHGPASERRFPPQEFHMLQSSVETRGFDRRREAVEAQEFSQQIEERDHGMYYSPPTFSQYPSQMYQYLFEGHHTNMSASEHSFGGVAETHPHFSWPTMTPSQQHDAPMATPNAPLALQWNAPGAIPDMSDLLGIDLRQEFSAEAEEVEAGRYRGRRNPDHQAQRWDRPCGTSSRHHGHHNE

SEQ ID NO: 173169 - protein, 138 aa, Glycine max
  Coding DNA Sequence Number=SeqID_81484
VAFDPGLRAFVWGSRMGTSRLNASSRIVLVQVGLGLCYALVALLSCLVDFILKSEHFFHLDVALGLFAQFVYATGSMECNTTSGLRFRIWTAVRPNLSMNFLRDLLSTCRRLAKAAEVNAAPLRDVGKIRHRIASLLV

SEQ ID NO: 173170 - protein, 118 aa, Glycine max
  Coding DNA Sequence Number=SeqID_81485
MTRWMTLKNLVLKDIGTQCSDGVSSLNECINKNDQQDMEQDREQGIEGGINYDNKETEDTNENNSEGAAQGLERPKANFVEAMPSKIILMMPKNQKSNKFQESRSRFKNNQDQDSRFK

SEQ ID NO: 173171 - protein, 60 aa, Glycine max
  Coding DNA Sequence Number=SeqID_81486
  Gene Ontology: Mol. function=aspartic-type endopeptidase activity; Biological process=DNA integration
  Homolog annotation: Hit_ID=Q10M26; Match level="QueryCoverage=65%, HitCoverage=3%, E-value=8e-10, Identity=75%"; Hit description =Retrotransposon protein, putative, Ty1-copia subclass, expressed
  Pfam annotation: Domain name=zf-CCHC; Domain location=5-22; Score =20.3; E_value=0.0013; Accession=PF00098.14; Description=Zinc knuckle
MKNEFTCYFYNKFGHMKKECPRYDGSRECLGPFGLFLKECGIVPQYIMPGKPSMNGVAER

SEQ ID NO: 173172 - protein, 45 aa, Glycine max
  Coding DNA Sequence Number=SeqID_81487
MSNLTSRLKALKLELGEDLLVHLDLISLLAHFGQFKEERLQKDKS

SEQ ID NO: 173173 - protein, 162 aa, Glycine max
  Coding DNA Sequence Number=SeqID_81488
DAQVKVEYVKRLYDQVKVQIAKKNESYTKQANKKRKEVVLEPGDDPGHLRANVFQEGGNDENPEIGQIQAKGPSGEGRRPNSLLNQSQTYQGNPCGVYPDLSSFTGSGVIQTSVACIKRSAPTQVHIRFALIPFCNAPNCRLLNDLHYNTSHGDISLNILIG

SEQ ID NO: 173174 - protein, 205 aa, Glycine max
  Coding DNA Sequence Number=SeqID_81489
MEEQLAFVSTAKEEGATIQVEAFVKVVDDNIVNKVIIDLINTGVMNESPEVSNAAIADEVVHQDKEYASNQSTTLNEAMLREKGAPDAVIVYSTSSSPTPLNYARPSAMTRDQVQKMIGQAMDFFFQRQRLENDQFRISMQNTITTQFSNLDGVLLQNLQVQMTMLGVIAALAPLALVHQPPPPKPTPPYVEPTPPPLSPAPPQV

SEQ ID NO: 173175 - protein, 401 aa, Glycine max
  Coding DNA Sequence Number=SeqID_81490
MLKENSQRVLLLTLKDKMRAKDHSWLCVSLRQEPHQEFGNSGGEQIVAPRGNAKGGILGGGAHQVANAIVAFAEVVRANHQLSSKAEKMDLGGRVESMVAKKDGLAKRIAKLEARLRESESKLEESKLWVAKERKASKELKEELILYKKEVVEQHEKGFQKAVRQASFFAKDLDLGLFDPFKNVRDGVLLEEEEIDAVDEAADERQGAMEQEDDSRMTRSNLRFDFNLIEGLVTDLVGLPSVLWSFSPDGCEKLCLNCPWLKVLPNQYGDRSLDLLCSSSNGYEDGPRGCLELGRSMHQGRTLGFARMCTKGRPWVLQECVPMVDLGPPNQSQKNDDLEPVHRWIVVKFEYHVRNTIKRILTVGKFDIIILSEQSEEKLEESQGTAIDAAIVVGRHVSPLR

SEQ ID NO: 173176 - protein, 114 aa, Glycine max
  Coding DNA Sequence Number=SeqID_81491
MTSRSDNDYGYNCPSASVTYFMHHTLSWKLPRRLIKVILVASTRTYLPSLEVASSKISTTCIKRSAPTQVRDEDITKGKDHEALEGPMTRGRLKQATHVIETRLVIYITAIDDD

SEQ ID NO: 173177 - protein, 67 aa, Glycine max
  Coding DNA Sequence Number=SeqID_81492
MWITTTSIDMTKGEADEESGYGLQLVVKERNNGLGLERKKHGRKSQGVTRNMFRESASNVSDNSKME

SEQ ID NO: 173178 - protein, 459 aa, Glycine max
  Coding DNA Sequence Number=SeqID_81493
  Gene Ontology: Mol. function=catalytic activity; Cellular component =endoplasmic reticulum membrane; Biological process=metabolic process
  Homolog annotation: Hit_ID=A1X859; Match level="QueryCoverage=28%, HitCoverage=20%, E-value=5e-49, Identity=74%"; Hit description=ACS1
MFSIGKISKIFRKGVHFREQHRDANLEARANLVVHRGQHRPHRLPEYHSGDADTLRVLEDLVAGVRRLARGALCAFVQWIRSSAVIGIGEEHGEGDDDGDGNGGEMESAICIVTSAVISFTYSTIGLGLGIGKVIGMNSCYSHVHHDDICSSSITGHSEIPSIRVKNNLGTVVSKKGYVLNTTEAETLLSTTLIHEVMHVLGFDPHAFAHFRDERKRQHNQAAKRVHMENNSPRVGFLKSPSSKEDVNPDAYGNGFVTARTKLETPLKGRAHSIIDQVTKVGNSIRSCGYGEGQTQSFDLPIKKRMVIEEIFIWHGASIGFWRGDVKFVIDDVGKLKLTIFYVVPCVLDRVYSGLTQKISSGGFLKKTLFNFAYSYKLNNMEKGLRHGEASPLLDIIVFDKQGLGGRVRHILSGAAPLSAHVEGYLQVVTCAHVLQGYEDIIDIFMVLVLDYGLDVLSL

SEQ ID NO: 173179 - protein, 202 aa, Glycine max
  Coding DNA Sequence Number=SeqID_81494
  Gene Ontology: Mol. function=aspartic-type endopeptidase activity; Biological process=DNA integration
  Homolog annotation: Hit_ID=A5BIS3; Match level="QueryCoverage=41%, HitCoverage=8%, E-value=3e-14, Identity=40%"; Hit description =Putative uncharacterized protein
  Pfam annotation: Domain name=zf-CCHC; Domain location=54-71; Score =9.8; E_value=0.051; Accession=PF00098.14; Description=Zinc knuckle
MILKNQGSHLVHYVSHQENQGAGKKFMKKHDKGNEPLKINDASVQIQKKASENSNCHFCGKAEQFQKDCPKHKAWFEKKERQLNRKVKVVRSDKGGKYYERYDETGATPSSFAKFLQKHGICVQYTIKIKGHRFYCPNHSMRIVETGNARFIENGEINRSTIPWNVKIKEVRVKVKVSVPLHVVPNNNEEEQHNNESMIQNV

SEQ ID NO: 173180 - protein, 234 aa, Glycine max
  Coding DNA Sequence Number=SeqID_81495
MRYKGCHQEVPREDPEWLWELMVLIDVGYEKVYTGLLKGIFGYGVVVGAGGGGLKGVRAEQRRSANLSSYNLARAIVWDKDRGWKAWTSWCNSRWRPKMKQLRREDGGDPMIRFAICSKLVSSLRVIVVRGCEMRFQGLEHGGPGGEEAIVVHPLAPQVSDGVWDGRGEVWVVFWEKVGDGKGGNSIHDGFELTVQLCMTLRKGSDCFIEALNGGLTGVMLRHIVVARIGRERQ

SEQ ID NO: 173181 - protein, 48 aa, Glycine max
  Coding DNA Sequence Number=SeqID_81496
MNARMHEFGEGDDAGSVLKISGKALSEPERRLVSQRGSLSRTARLAQV

SEQ ID NO: 173182 - protein, 154 aa, Glycine max
  Coding DNA Sequence Number=SeqID_81497
  Gene Ontology: Mol. function=transferase activity, transferring glycosyl groups; Biological process=metabolic process
  Homolog annotation: Hit_ID=Q9FUJ6; Match level="QueryCoverage=29%, HitCoverage=9%, E-value=8e-13, Identity=71%"; Hit description=UDP -glucosyltransferase HRA25
MEGNSALGIDLTDRPFLWVMHQDNKRVYPNEFLGSKGKIVGWAPQQKALNKEGNLQNGNCERLDANKAEELNMEADMMREALEENVVLCEPNNNAESGEVVVVNHGKEVQQEIQEPTHKNKEDEQIDESLHLDLPICDHIEGHILLAIERSRLR

SEQ ID NO: 173183 - protein, 115 aa, Glycine max
  Coding DNA Sequence Number=SeqID_81498
MDEWSSSLGHASMYGFLEPQSIHNAKDRHTECQQYIETWVKESQREVYLGAYLNHAMKTLKTTVDGKTNQSAPQWIEVKWFGDGTPLDKETITTICNKWVNKFEVRQLHSYNGLS

SEQ ID NO: 173184 - protein, 66 aa, Glycine max
  Coding DNA Sequence Number=SeqID_81499
MDEDEWMYEIMSERADMDYENAEACGANEPHTKDQAESFDDAKGLHESYASQRFTQDKAIRDIQDG

SEQ ID NO: 173185 - protein, 124 aa, Glycine max
  Coding DNA Sequence Number=SeqID_81500
MARTRGLGRALGHVTGRGVGRGDRDDSDDAPQRRRPTASARRQRVPVTAAHDEPVVPAPDVEVDVFLDDPMAPADVEDTGADIPTDTGAQAAEDEHEGFPGGPSDLSMLTQYANHVACSIWTGK

SEQ ID NO: 173186 - protein, 336 aa, Glycine max
  Coding DNA Sequence Number=SeqID_81501
MQSQMQSQGLALPPEPLAGSLAPRVSTKESYVDPSGNDPETGDSDRCSLYIEANPARLVALRRVYKGSTVVHNTPLFPGQVKLGVEEVKDLDAPVPVATDEVSLVGQTIHTFLAWLIHLVKPLSQQAVVSLAKPPQTPDPGVDDLLYLMTLIIPEFFLRPYQVTWDATMFGVFNPDFPLYIKHKDLSEIAHNGQCLSISVLQLWILHLTETSMRAGNSDLYGFLKAQSIQRQFKSDLTRKWALTVDQDGVDDTVYEKYDISKEKWAQFCQTRRDPSWEDVRKKAQTIQKQNTAPHVLSRGGYEYLEQKLLAEKTKKKLEEAAQSGIVDGVIDPSSP

SEQ ID NO: 173187 - protein, 199 aa, Glycine max
  Coding DNA Sequence Number=SeqID_81502
  Homolog annotation: Hit_ID=A5AGG9; Match level="QueryCoverage=37%, HitCoverage=8%, E-value=1e-10, Identity=50%"; Hit description =Putative uncharacterized protein
MEAEAEIKQRDYEEGGELACTEVDPASKIGATGSIVGLELALRRELELEFESVVGSTEVGLATELLERELGSFGVVVLEIVSELKAMDFRQPEVLLVKKVHEFEVRKTPLEALVDMGLNGEYNLKELMRLLKKVPGQSLNEINQLYHVRVDDSLACYNGVTDSTVAINRMYGSIIENSSSSRMKLSCYANFIIRIWSLY

SEQ ID NO: 173188 - protein, 132 aa, Glycine max
  Coding DNA Sequence Number=SeqID_81503
  Homolog annotation: Hit_ID=A2Q2U3; Match level="QueryCoverage=98%, HitCoverage=26%, E-value=8e-66, Identity=93%"; Hit description=CENP -B protein; Homeodomain-like
  Pfam annotation: Domain name=CenpB-DNA-bind; Domain location=77-132; Score=48.9; E_value=1.8e-11; Accession=PF09091.2; Description =Centromere binding protein B, DNA bind
MTSHLKGVAKSTMSDQIPKELCEYKRDNPASTQKDLQRWLEGNFELKVSQGTISNTLKRSDDYLSVEIEKGRAEIKRHKPAKYPDMEKVVYEWFLQHQERVNITGELILQKARDTMKLVYPHDDSDFNFSIR

SEQ ID NO: 173189 - protein, 262 aa, Glycine max
  Coding DNA Sequence Number=SeqID_81504
  Gene Ontology: Mol. function=hydrogen ion transporting ATP synthase activity, rotational mechanism; Cellular component=proton -transporting ATP synthase complex, catalytic core F(1); Biological process=ATP synthesis coupled proton transport
  Homolog annotation: Hit_ID=A9PBF4; Match level="QueryCoverage=97%, HitCoverage=80%, E-value=1e-112, Identity=79%"; Hit description =Putative uncharacterized protein
  Pfam annotation: Domain name=ATP-synt; Domain location=38-259; Score =189.9; E_value=6.2e-54; Accession=PF00231.10; Description=ATP synthase
  Subcellular localization annotation: CTP_CleavageSite=3; ConfidenceScore=5.04e-01
MAMAAALRREGRRLTQPINALRSSLISQDQSPHGARFISTQVVRNRMKSVRNIQKITKAMKMVAASKLRAVQTRAENSRGLWQPFTALLGDNPSADVKKNVVVTISSDKGLCGGINSTSVKISRVLYKLNSGPDKETKYVILGEKAKAQLLRDSRKHIVLSLTELQKNPLNYTQVSVLADDILKNVEYDALRIVFNKFHSVVQFLPTVSTVLSPEVIEREAESGGKLGELDSYEIEGGETKAEILQNLAEFQFSCVSNFQKL

SEQ ID NO: 173190 - protein, 57 aa, Glycine max
  Coding DNA Sequence Number=SeqID_81505
MDNMLILQHTELKASFQKNINMANHRTSLGLQGINETLGLIQILVVDLKRANKAALT

SEQ ID NO: 173191 - protein, 108 aa, Glycine max
  Coding DNA Sequence Number=SeqID_81506
MHKYRIAFLDAHLPWWHCRMKLPENAQQLALADMEKSSEQATTTKRQRRRRRSDSAWETNSFVNPNLFGEEEKATLQEREFIDADLSATLDSLRGTELPLMHLTNAVT

SEQ ID NO: 173192 - protein, 185 aa, Glycine max
  Coding DNA Sequence Number=SeqID_81507
MRYDDFPESFMNEDKKLNLTILDKLPRRLLAKAIVTLHKSSTLMEDLPAIPNLLGWTPSMKLTQMLARATAVAQHMVLCKSSFHQEIPKLNKSLEVMKSKKDEFLVVNLLLTTDNEGLKVEKQKLKRSVNLISELKDKINNLEDALEKVERKRDSDRAIDEYEVLLRSAWMKVIEEHNAGFKKAI

SEQ ID NO: 173193 - protein, 287 aa, Glycine max
  Coding DNA Sequence Number=SeqID_81508
AKGHLRAVTACPGELKLNPEAVSSLRQAGPLALKLFGGPGESNVGLGELGPRKNKEKTLLPSFLGPITLNHNKRGELATHSHGGEAFDGGRIKMHPKLSPRLGSLSLSILSKVWKPRLGQKASKILPIKLIVESPLLDLDFKKDPTKHKQATQRLSAKEGDDFAENDAKVLDNKVPFVGAIGDMDDEKVPPSVVKLFFQRSSYLSSMNSGEKYIKSQDTVIVEEVPLPLLVEELTEDHHREKEKLLLQPPSMAINDDKTPTIQLEKPPQEQASAILRMPIMGTLKNE

SEQ ID NO: 173194 - protein, 206 aa, Glycine max
  Coding DNA Sequence Number=SeqID_81509
  Homolog annotation: Hit_ID=A7PY44; Match level="QueryCoverage=70%, HitCoverage=33%, E-value=2e-57, Identity=68%"; Hit description =Chromosome chr15 scaffold_37, whole genome shotgun sequence
  Pfam annotation: Domain name=C2; Domain location=85-154; Score=5.7; E_ value=0.038; Accession=PF00168.21; Description=C2 domain
MEETYSGITTNINNELHSKPKPRIDYTLKAIGGSLTAIPGISDMIDDTVNSIVTHMLQWPHRIVVQLGGIPIDTSELELKSQGKLALTVVKATALKNMEMIGKSDPYVVVHIRPLFKYKTKVLDKDIGQDKRLGIAQLPLIGLEIQTEKEIELRLLPSLDTLKLVALEAEKKILEERKKLKEAGVIGCTMDVLDGAVSVVGSGVGL

SEQ ID NO: 173195 - protein, 98 aa, Glycine max
  Coding DNA Sequence Number=SeqID_81510
  Homolog annotation: Hit_ID=A7QNS3; Match level="QueryCoverage=29%, HitCoverage=2%, E-value=9e-09, Identity=89%"; Hit description =Chromosome undetermined scaffold_134, whole genome shotgun sequence
MAAEWRRRKDDGRRHFKEKMSQEERRDVYGAWEQYLGLEHTDNAPKRSYVVNQKHGPTRHIPRTVKFLGSPCEMVTFPHPFMHKKVMKCPIVATCSTF

SEQ ID NO: 173196 - protein, 110 aa, Glycine max
  Coding DNA Sequence Number=SeqID_81511
EDFEDSTPIKVFLLVWGFGDKKRWLAAATDARGWWRKRCQFSLNAIPSRVGIALSAPFALREASKVVIFKIPTGVTNSATFFGHAVSKDGISINIKKVEAIQGWPKPTSM

SEQ ID NO: 173197 - protein, 43 aa, Glycine max
  Coding DNA Sequence Number=SeqID_81512
MPPLCCSLHHCMPVALHSRALVLALTHSSTHSHSCFRSRKARS

SEQ ID NO: 173198 - protein, 111 aa, Glycine max
  Coding DNA Sequence Number=SeqID_81513
MWGTYLRGLIPGIWSVPSADMEGYIHKVLQVKSSRTLELECLITFEVPDPTSILTVLSTTQPVSTTNVTSHTKSSPSTSPDLSNPQPTTSSTIPDTQSLTTNIDQLQTTVL

SEQ ID NO: 173199 - protein, 204 aa, Glycine max
  Coding DNA Sequence Number=SeqID_81514
MTKGDRVHANGPLARYCLCRRITSVWIDWPERVVQQFGYIQTILPHPTVSMVSDEEIDDRWMQFSEYIAPVGQLCAVPGHCSPDYMDWFYMNLPPFMSPAQPGDPPRVSSIQQYDTFVKPYVYQQPMATAAPNESEVDVHHIRHAVDGFVAIANKLERLLNLRILTKGTEAYIVAEECLGITKSYISQPTVGHRSRRRRHTDDH

SEQ ID NO: 173200 - protein, 73 aa, Glycine max
  Coding DNA Sequence Number=SeqID_81515
MGGAVMMMDIVGGGNKVFLMRGNTCIWGLVTRFGTTQGFGITQVDHHWSGGVAYARQGDPNTYCLVFLIESVV

SEQ ID NO: 173201 - protein, 111 aa, Glycine max
  Coding DNA Sequence Number=SeqID_81516
  Subcellular localization annotation: CTP_CleavageSite=77; ConfidenceScore=5.10e-01
MGQDNRKLGAVDKSEVVVPTCPQFVTMNSDLRSSFKSNGADNRKASPHATGLLGRDSKRCVWVTIGCLRMPSDSWVMVTKGGVVDKSRAYALTYPQFVMRNSDLRSSFIIY

SEQ ID NO: 173202 - protein, 92 aa, Glycine max
  Coding DNA Sequence Number=SeqID_81517
MDVVRAVYIGFMDVIPARDRGSNMVNHASTAKCSFIALSAKENLAEHQHQGRVLSARSGTMLRAQNSTAHHSAYFEKIALEAAIGAAFAEIP

SEQ ID NO: 173203 - protein, 98 aa, Glycine max
  Coding DNA Sequence Number=SeqID_81518
MSNESISVGHLPVGHLSAGHLPGPVADPDAIGELLPQAVNLCSIFSATGRSLHMLHEAVIFAFVSMSKVSSTIKGSLILWSCNCNPTPTPKSLFFSRV

SEQ ID NO: 173204 - protein, 124 aa, Glycine max
  Coding DNA Sequence Number=SeqID_81519
  Subcellular localization annotation: CTP_CleavageSite=28; ConfidenceScore=5.53e-01
MDSVSPHLFFSSTLSDAVEDRDTNNVISSSSFSNPFTTSSTTLVAKSVCEREELRFDALLVVWGEVMGCYGVTNPCGPPSWSYVYCSGGRVTQIQTKNLDYSCNSTICIHGCFKGKSVLLNHLQ

SEQ ID NO: 173205 - protein, 91 aa, Glycine max
  Coding DNA Sequence Number=SeqID_81520
MATDVRDGQKLWRIEVGEGWGFVTKENSGCYSINRMHTNSPIHLYLIMSGKINTSPSRKPASSRTSHTVIFVCKVKHRSQPQIVAKNRNQT

SEQ ID NO: 173206 - protein, 45 aa, Glycine max
  Coding DNA Sequence Number=SeqID_81521
MVAELGQQTVELSTFVTHATNDKSSDMFCGMQPYLGCLMATSLCT

SEQ ID NO: 173207 - protein, 191 aa, Glycine max
  Coding DNA Sequence Number=SeqID_81522
SGAPFEGTIVDDWKFDYSSHDARRMEDLTLMWAFLTGRQIDWAHLVRYRMHKALRANAPLPYPQLITLFLRHFQIPLDDEPFVQVKRSFAIGAGAVTSFGYRKDRNGQWLKKDALPPQDERTPSPPPQREDSALLNEVLTELRGLRSYVGEHFDSLDTRFAGMDIRLTQVEEDVSFIRTCFDPPPPPPSSS

SEQ ID NO: 173208 - protein, 94 aa, Glycine max
  Coding DNA Sequence Number=SeqID_81523
MVVVWRSRIDGERCEGMVSCEREEMQRQEMERLRVRCLWREEKKKESEEYGKKCGGKKKRKRVTSGTYKTSLKDIEITEVNLVSLNCNTLKFSS

SEQ ID NO: 173209 - protein, 100 aa, Glycine max
  Coding DNA Sequence Number=SeqID_81524
GPTASKGGSWRSPVVVEEEVEEGFREQRTHPTTNNFHVMTMPSTPRHLRAQCSLQRERVIEDRGDHSDMSSEEMKEYWELLRQLKSASEEESDNSFESTY

SEQ ID NO: 173210 - protein, 132 aa, Glycine max
  Coding DNA Sequence Number=SeqID_81525
MSILASFIYLFFYSASLALSLYSHPQVLPPQPAGTITGHNHFSSHRHYSVWERDSEFGSNTALKVIVVTHNAQCGINLQWHVHGGKVGEMGYVREREIQRREKGYTGTENVITKEREIGYMNYGGEKIEILF

SEQ ID NO: 173211 - protein, 113 aa, Glycine max
  Coding DNA Sequence Number=SeqID_81526
  Gene Ontology: Mol. function=protein kinase activity; Biological process=protein amino acid phosphorylation
  Homolog annotation: Hit_ID=A7Q345; Match level="QueryCoverage=50%, HitCoverage=24%, E-value=2e-16, Identity=73%"; Hit description =Chromosome chr12 scaffold_47, whole genome shotgun sequence
MLYNRCVYPIFNISLTAETFFNYISSNPKINPHTPALSESECDNVDKIYKKVSSGVRPAALNKVKDPEVKAFIEKCLAQPRARPSAVELLKDPFFDEIDDDDDKNDDCSCSYQ

SEQ ID NO: 173212 - protein, 121 aa, Glycine max
  Coding DNA Sequence Number=SeqID_81527
MANMILMQADQTVNFKLMMVQPMACPWWQGGRNGYVRECEIQRRHKRSYENRIATTTITISAATTTIIVVMTIVVATNLIIVAATGRGDSHVGGNDGGHGGDHSSGGSGSRDDDGDNSHVG

SEQ ID NO: 173213 - protein, 113 aa, Glycine max
  Coding DNA Sequence Number=SeqID_81528
MTRGNPSNLQPFDLEIDRTFHRLVRHHFVPFEHPEHSVIGESKHSEVGYSFEHFDFEHSENMAQPPPRERTLREMAAPDFTYESLCIQYPDEDVPCVLKTGLIHLLPMFHGLA

SEQ ID NO: 173214 - protein, 23 aa, Glycine max
  Coding DNA Sequence Number=SeqID_81529
MGRRPLPSSGQMESAAARTARRG

SEQ ID NO: 173215 - protein, 154 aa, Glycine max
  Coding DNA Sequence Number=SeqID_81530
DDVSLYVLFRLFVYRQQKIYTDNHLGFFRRQRDSKVNMTDLVSAEDDAFQSYRQQKVYTDNHSGISARQRDSKVSMTDLVSAEDDGAEDDVSLCVLSGFSSYRQQKVYTDNHSGISARQRDSKVSMTDLVSAEDTQQKVYTDNHSGISAVSVTQ

SEQ ID NO: 173216 - protein, 270 aa, Glycine max
  Coding DNA Sequence Number=SeqID_81531
MRSWVRGQWIPFDADAIGQLLGYPLVLEEGQECEYGQRRNRSDGFNEEAIAQLLCIPGQDFSRTAAGRRVRIMRTNMTTLTQIWMTLLLSNILPTDHNSDLPMPKCQLVYAILTRMSIHVAQLIADAIYIFAGLCQSFGVPVAPTKRQAQGDAPQAAGAPPPPHQAGQAGAFDMEQYLRHLVRQQAANHRAHVQTHDCLYQMSLSMQSQGFASFSCPTPDQFRAEVAWPGDWPEAQAGEAPPEAPGDGEEAHEDEEMVDLLDLLGGSGDT

SEQ ID NO: 173217 - protein, 159 aa, Glycine max
  Coding DNA Sequence Number=SeqID_81532
MGTNASGDRVTTDRLLPLPGVKQGPGISRISPTGPWDKSNRALGFPALITGLCQSFRVPVTPSKVIRPPITRAFIEKYCTQRQARGNAPQAADVPPPHQAGPAGSFDTEQYLRHLVRQQAANHRAHIQTHDCLYQMSLSLQSQGFTSFLCPTPDQFRAE

SEQ ID NO: 173218 - protein, 125 aa, Glycine max
  Coding DNA Sequence Number=SeqID_81533
MVGYAPSSFVDLDFAGERIEAGLKRDKFDHPILMNEKTRANEEDKNEEGTHVVASIPTWPNFPPAQQCHHSTNIGPSHYSSPNHQQKPSPNQPQGMPAYHTPNAQTPPIAQTKKEYCSKKPVGSP

SEQ ID NO: 173219 - protein, 68 aa, Glycine max
  Coding DNA Sequence Number=SeqID_81534
  Subcellular localization annotation: CTP_CleavageSite=31; ConfidenceScore=5.08e-01
MASYGGELSSRLIFSLKWHLLSLFLSPFRCHSSSKKQRNPLMKKILGLQAPMELASVSFYKRENVEVV

SEQ ID NO: 173220 - protein, 15 aa, Glycine max
  Coding DNA Sequence Number=SeqID_81535
GSLEVKPSPLTLDEE

SEQ ID NO: 173221 - protein, 108 aa, Glycine max
  Coding DNA Sequence Number=SeqID_81536
  Subcellular localization annotation: CTP_CleavageSite=75; ConfidenceScore=5.18e-01
MRGNCHTLISSGDHCLVACNLRLTTSRYLTPVVRILSKSKPRCFRNAFVKILHRSSSFFGLQPTTPFRVFQHFPRINVGGDSAHFRFLDDTPVSPASPSRRRVGCDNW

SEQ ID NO: 173222 - protein, 104 aa, Glycine max
  Coding DNA Sequence Number=SeqID_81537
AATGRGTSNCLSYLKPSAPFDLLDSEWRLLFLVEIAYSGWSFVSLTLLRKVEEGPQLLVVFVVVAATTVALEEEHMACLDQQHSGKEGQVVVVVEDLSISDLKK

SEQ ID NO: 173223 - protein, 75 aa, Glycine max; identical to SEQ ID NO: 112764
  Coding DNA Sequence Number=SeqID_81538

SEQ ID NO: 173224 - protein, 81 aa, Glycine max
  Coding DNA Sequence Number=SeqID_81539
MSKSCGFGMTGPLDESISCFLIRVDPWVLVPITLRGLHVLAIRGLHVLNFRGLHALAIRGLHVLALRGLHALTLGTSYPPR

SEQ ID NO: 173225 - protein, 48 aa, Glycine max
  Coding DNA Sequence Number=SeqID_81540
MIALTIEHKRPIYRISLTKWKVFAQEFLLREHLTMKFSWNLSHFLLRG

SEQ ID NO: 173226 - protein, 123 aa, Glycine max
  Coding DNA Sequence Number=SeqID_81541
MLGFTNDSPQISASPHQLDFAPYVSGPYNAQWNALGLLHDKHALHSSRILGEMEVEEPWLGLWLPLNYRVDMGASHHRTPELGWIFIVDLGKLGRIGMAVTAWVSPSFSPSSFAPVFSFVQAR

SEQ ID NO: 173227 - protein, 96 aa, Glycine max
  Coding DNA Sequence Number=SeqID_81542
  Pfam annotation: Domain name=zf-CCHC; Domain location=70-87; Score =23.0; E_value=0.0005; Accession=PF00098.14; Description=Zinc knuckle
MVDSEIYKQIYTPHQYHKEIRRKRPQYRPPIKKNPTRRYSIRAFNSRKPTLNNDRHVRKIKDTKTYTKQLECYACHQPGHYSRDYPNKTNLFTREA

SEQ ID NO: 173228 - protein, 165 aa, Glycine max
  Coding DNA Sequence Number=SeqID_81543
MAPCKIKATVTLSQASYDSSRFVSRDAWDRYTDNIIDQNILLKRNVKLYINEFDDFKREVERRNWHRELTNFSDGSIDVAIVKEFYANLYVPKDKEQKQVRVQRHLIKFDADSLNTFLKTPMVLEQGENLPFYSRFCRLRPDPQELAGRLCILGRGFVLNTEGLP

SEQ ID NO: 173229 - protein, 46 aa, Glycine max
  Coding DNA Sequence Number=SeqID_81544
MPHNGETSQGHAVLREYSNRMTPKAYTPKSPSGPLPPDSGPTKKNI

SEQ ID NO: 173230 - protein, 49 aa, Glycine max
  Coding DNA Sequence Number=SeqID_81545
MENAKHMAIPMSTACYLDKDETGQSIDIKQYQGFNQIPNNHILVPLKEV

SEQ ID NO: 173231 - protein, 94 aa, Glycine max
  Coding DNA Sequence Number=SeqID_81546
MESRMTKVEEDPCILAILLWYLNNLLFPYLHEVVIIKKGEIVEAKLHGESKVIQRCFDDNNDDDRGDDKKLKDQSKNKFKSSRIKKNSRLKKKV

SEQ ID NO: 173232 - protein, 124 aa, Glycine max
  Coding DNA Sequence Number=SeqID_81547
MDGHTDATLIKEFYVNLYDPEDKSPKQVRVRGKMIKFDTASLNAFLETPPVLELGEQYTTYTRFYSTRIDPQELAARLCIPGKGFILNAEGAPWKLLRKDLTTLAQTWSILSYSNLTPPLTRPI

SEQ ID NO: 173233 - protein, 334 aa, Glycine max
  Coding DNA Sequence Number=SeqID_81548
MLSCLIGESSNDDPSHHHGGFDATDDQGSSVVVGGIIAIADVVATTRPNIRVDEAESPLPIPPTNVINLDSKTTTVHVYNEVRSYSTSFLTYESITNFLEEVKFRLIDGPNVMIIDSCLKSEHIFMCSYSAKTHFISNTVCLILGIMPKIDYQSVKKTQAEKEVVEKAKADKGKMNVMVEEQWVPLVSLLKTCSIAPSSSLETSTSSVAVGETFGVASPPPKGEGWTPGQPNHGYSASPGISHGGGSIASALERAGTNVGAGMGVGAGGGGAEEGVEEEGAEASDGPRALALRVPGKVIVGSSGDSKVNEYGTTPQAMHKAVISAGNPSLEELD

SEQ ID NO: 173234 - protein, 198 aa, Glycine max
  Coding DNA Sequence Number=SeqID_81549
MDEVVVGGNEGDIMQGFNFIKLWAQTSEANKHNIPPALVDLVKPKKKKENEKEVPEKEIPRIINVEKPTTKSRDVDVIQPHNIDELTTNSDAANKNMEKPTTSSFSPTPPIQDQGEESVPQNTLSKSEVEASLEERRNLVKALNEKNSLMIKKIELVKAIESLNMKFNISIKDLLKTNNNVNALNNQLTTEEKKKKNS

SEQ ID NO: 173235 - protein, 40 aa, Glycine max
  Coding DNA Sequence Number=SeqID_81550
MVKQIKKILKDFAGEDVRQSHSPRVSLAIYKIFSIRNNFI

SEQ ID NO: 173236 - protein, 218 aa, Glycine max
  Coding DNA Sequence Number=SeqID_81551
MGKWGLRRRLPKDPLGVLPELPEEAVKKPKVFRKNPSSGSLPEHLFRKVSGRSTSSERIPEEGFLRMTFEISGKTRGLGRAIGRLIGRDRHDDHDATDVPERRRPTALARRQRVHQMIADACDMAKDVADMTEDVPDLAEEAPKMRADVQGADGAEGSDADDAEGYPGGPCDPSVLTSFADHVAHAVWSGHECPDLKLVSHGRKVTLIGRPVPEIEGL

SEQ ID NO: 173237 - protein, 101 aa, Glycine max
  Coding DNA Sequence Number=SeqID_81552
  Gene Ontology: Mol. function=amino acid binding; Biological process =metabolic process
  Homolog annotation: Hit_ID=A7QJF3; Match level="QueryCoverage=46%, HitCoverage=11%, E-value=1e-14, Identity=82%"; Hit description =Chromosome chr8 scaffold_106, whole genome shotgun sequence
MVVDVTEVLCELELTIKKVKVSTTPDGKVIDLFFIIDTRELLQRKKRNDENPKTTQIQGPMTPGVGPNSWWIPSNKWYQAYLTRPKWRRLKAQRQRHYQEF

SEQ ID NO: 173238 - protein, 94 aa, Glycine max
  Coding DNA Sequence Number=SeqID_81553
  Gene Ontology: Mol. function=argininosuccinate lyase activity; Cellular component=cytoplasm; Biological process=arginine biosynthetic process via ornithine
  Homolog annotation: Hit_ID=A7NUM0; Match level="QueryCoverage=65%, HitCoverage=11%, E-value=1e-13, Identity=64%"; Hit description =Chromosome chr18 scaffold_1, whole genome shotgun sequence
MPQKKNPDLMELVCGKSARVIGDLVTLLTLCKGLPHAYDCNLQNRSSPLKYVSSKICLDFLKPFLRIGEETKAQWEDDSSNCNKFEGKNFSPIN

SEQ ID NO: 173239 - protein, 92 aa, Glycine max
  Coding DNA Sequence Number=SeqID_81554
MSIKGGAGGASGGVRISTSREAGGSTTGGCDSAGAGSVLVGMGLRGTTSGDLKIDPWILLACYETTAAGGLDDEGMSSALVLFLEAIYKKRM

SEQ ID NO: 173240 - protein, 84 aa, Glycine max
  Coding DNA Sequence Number=SeqID_81555
MELQVDMRFDAMDSRITKVEEDVSFIPCLDFRDCHHQTGGDCRQRIKLNVLMMPKDHIFLKALFKTKKLKIFKMDDQDSLQSLR

SEQ ID NO: 173241 - protein, 62 aa, Glycine max
  Coding DNA Sequence Number=SeqID_81556
MGLQGFCKILVTLGCIRKLPEETTCLPGRAGRQAPPPFSINRPRGLFQRTPDPYAMHFNYFW

SEQ ID NO: 173242 - protein, 80 aa, Glycine max
  Coding DNA Sequence Number=SeqID_81557
DGLSLCGSDFVKDFTKIVEISSGLLEYWTPQGPTYPPISNPSKWQGLPSKSRLTWTTGLSAPGGLVAKDHGRVALHVRFK

SEQ ID NO: 173243 - protein, 117 aa, Glycine max
  Coding DNA Sequence Number=SeqID_81558
  Subcellular localization annotation: CTP_CleavageSite=33; ConfidenceScore=5.25e-01
MYLFLFSVTTTQVDVFSTCTTKDVPSNVFRQISQAVSPSKLCEGDTKDISGGRRETQKEFRRLVLGEFFLAKGEENKRYSTLLFSRFGKPENFRKLLQRKKKKKKKFKKMFKEIQRL

SEQ ID NO: 173244 - protein, 74 aa, Glycine max
  Coding DNA Sequence Number=SeqID_81559
LKPKGIEEQWGISGVATYPSAGGRCGARRCVFQERKMRGVATNVYSRKMTEKPEKVWSTNFKYERFGSGIYARG

SEQ ID NO: 173245 - protein, 46 aa, Glycine max
  Coding DNA Sequence Number=SeqID_81560
MVGDEDISTKDITTPRPNDKMSTCHRMKIVFAFASCTASNSNKHNH

SEQ ID NO: 173246 - protein, 158 aa, Glycine max
  Coding DNA Sequence Number=SeqID_81561
MVAITPTKVHQPPFLREYDSNAMCACHGEAPGHSIEHCRALKRKVQGLIDMGRLKFEENRVSILTLTRDATHGAILKAVWVQAIGLFAQATCAPEFGLPRPFNQRLLILRIGGAVVKQQGQPFPCVQESPTTRDPRSLNPFSEIRRREEEISLKRDRL

SEQ ID NO: 173247 - protein, 143 aa, Glycine max
  Coding DNA Sequence Number=SeqID_81562
ITGLCQSFGVPVTPSRVIRPPITRAFIEKYCTRRQVQGDVPQAADTPPPHQASPVGLFDIEQYLRHLVRQQAANHRAHGFTPFPCPTPDQFRAEVTWPGDWPEAQAAEAPAGAPAEAPDEADEAREDEEMTDLLDFLGGSGAA

SEQ ID NO: 173248 - protein, 142 aa, Glycine max
  Coding DNA Sequence Number=SeqID_81563
  Gene Ontology: Mol. function=NADH dehydrogenase (ubiquinone) activity; Cellular component=mitochondrial respiratory chain; Biological process=ATP synthesis coupled electron transport
  Homolog annotation: Hit_ID=P15688; Match level="QueryCoverage=92%, HitCoverage=39%, E-value=7e-43, Identity=51%"; Hit description=NADH -ubiquinone oxidoreductase chain 2
  Pfam annotation: Domain name=Oxidored_q1; Domain location=1-98; Score= -102.3; E_value=0.015; Accession=PF00361.11; Description=NADH -Ubiquinoneplastoquinone (complex I)
MWAPDIYEGSPTPVTAFLSIAPKISIFANISRVSIYGSYGATLQQIFCFCSIASMILGALAAMAQTKVKRPLAHSSIGHVGIPPLAGFCSKFYLFFAALGCGAYFLAPVGVVTSVIGCWAAGRLPRVSQFGGPKAVLRAPDT

SEQ ID NO: 173249 - protein, 104 aa, Glycine max
  Coding DNA Sequence Number=SeqID_81564
GGVCALAKGSFPLGLVAILVIDAFWIIVCKFDSESSSDSEAMSAQDFLIIFGNLVDDPAWVGDPEEVDDFLVVGSERASLDPLPVLRPPLREIPDALGGITTFL

SEQ ID NO: 173250 - protein, 111 aa, Glycine max
  Coding DNA Sequence Number=SeqID_81565
MGTKDYKIKESKDLATMTMEVLFGKLLAYEHKLIQQSHVEETEKKRKGIALKVNSSNEDYKDMSNSEEEAENFNLMVKKFGKFLKKSKDRKFSKSFKKIENNNNNFTCFKC

SEQ ID NO: 173251 - protein, 173 aa, Glycine max
  Coding DNA Sequence Number=SeqID_81566
TPAVIEEGESLLSYSKFCKLRPDPQELETHLCIPRRGFELNADGMPLKILRKNLTTLAQTWSVLSFSNLAPTSHTLDITLDRAKLIYGLVMQMNMDLGSLILDDPLVTFWGTRKSRARGFEAPSTSAPPTSAPSTSPLSPAPAAPVLLDPSSQSFEPSLSMLQSLHQGQLLIM

SEQ ID NO: 173252 - protein, 283 aa, Glycine max
  Coding DNA Sequence Number=SeqID_81567
  Gene Ontology: Mol. function=nucleic acid binding; Cellular component= cytoplasm; Biological process=regulation of transcription, DNA -dependent
  Homolog annotation: Hit_ID=P0A974; Match level="QueryCoverage=22%, HitCoverage=92%, E-value=4e-27, Identity=92%"; Hit description=Cold shock-like protein cspE
  Pfam annotation: Domain name=CSD; Domain location=217-283; Score =157.0; E_value=5.1e-44; Accession=PF00313.13; Description='Cold -shock' DNA-binding domain
  Pfam annotation: Domain name=OB_RNB; Domain location=220-266; Score= -5.1; E_value=0.059; Accession=PF08206.2; Description=Ribonuclease B OB domain
  Pfam module annotation: Pfam domain module=CSD::OB_RNB; Domain location=217-283::220-266
MQCADDLAGEIDSVDALLKFGGVLAFADDEDLEAIDVGVERPGAGGAGAGGQLRRVMQAKYRRNVIQRASVDQMPGTEEGLFRRLEEDAHRAGQVASRALSRCVHHAAVLRAEGHVGDFVDRQGVNVTAQRDDRPLAAANLRHDAGFQRQRQQANARLLQPAGQPGGGGEFVIGKLRVLVQLTPIGDDFVCQLAGHRLGSQWEINPNPSAAAAEAKRPSGSVKWFNESKGFGFITPEDGSKDVFVHFSAIVSNGFKTLAEGQRVEFEITNGAKGPSAANVTAI

SEQ ID NO: 173253 - protein, 255 aa, Glycine max
  Coding DNA Sequence Number=SeqID_81568
  Homolog annotation: Hit_ID=Q84VH5; Match level="QueryCoverage=100%, HitCoverage=42%, E-value=1e-106, Identity=73%"; Hit description =Envelope-like protein
MIPGQAPIPEKLVPKRQQGVKISENPSLATSPREVDMEMDKKIRSIVSSILKNASVPDADKDESTEEEDQATEETPAPRAPEPAPGDLIDLEEVESDEEPIVNKLAPGIAERLQSRKGKTPITRSGRIKTMAQKKSTPITPTTSRWSKVAIPSKKRKEISSSDSDDDVELDVPDIKRAKKSGKKVPGNVPDAPLDNISFHSIGNVERWKFVYQRRLALERELGRDALDCKEIMDLIKAAGLLKTVTKLGDCYESL

SEQ ID NO: 173254 - protein, 67 aa, Glycine max
  Coding DNA Sequence Number=SeqID_81569
MKILMTNTSTPYHRGEPERSSFLTHNALGIMAHLQSLPWCPMHAIKKAIQTFRLPVTMMTKTNAMHE

SEQ ID NO: 173255 - protein, 27 aa, Glycine max
  Coding DNA Sequence Number=SeqID_81570
MKKQQWRRSHGVAVEDKGEEVKGGAIH

SEQ ID NO: 173256 - protein, 90 aa, Glycine max
  Coding DNA Sequence Number=SeqID_81571
MTKAIQQISQLLQGGILKKPQQAFMWEECKGGYQTSKYTDVPIEERFPRHALKLQPSERQKTTTKTKFLGPPRKVGRSLDKTHRSGHHQP

SEQ ID NO: 173257 - protein, 155 aa, Glycine max
  Coding DNA Sequence Number=SeqID_81572
MALIPKIDIPISMKYSKLIEQSAFVEGHSIIDNVLVTIETIHHMKYKVKGKTVDYNVIVAIKGLRPFLLGDSGGRFIAARPQVYQGDPTPQEAKVVASLTALKWISNSQLANVIVELACKANMEAINIKNFANNKARDRLRQCLDNKNSLINYQT

SEQ ID NO: 173258 - protein, 160 aa, Glycine max
  Coding DNA Sequence Number=SeqID_81573
  Gene Ontology: Mol. function=transferase activity, transferring glycosyl groups; Cellular component=cytoplasm; Biological process =multicellular organismal development
  Homolog annotation: Hit_ID=O82039; Match level="QueryCoverage=66%, HitCoverage=23%, E-value=2e-43, Identity=61%"; Hit description =Probable UDP-N-acetylglucosamine--peptide N- acetylglucosaminyltransf erase SPINDLY
  Pfam annotation: Domain name=TPR_1; Domain location=26-59; Score =21.7; E_value=0.0028; Accession=PF00515.19; Description =Tetratricopeptide repeat
  Pfam annotation: Domain name=TPR_1; Domain location=60-93; Score =30.5; E_value=6.1e-06; Accession=PF00515.19; Description =Tetratricopeptide repeat
  Pfam annotation: Domain name=TPR_2; Domain location=26-59; Score =13.5; E_value=0.63; Accession=PF07719.8; Description=Tetratricopeptid e repeat
  Pfam annotation: Domain name=TPR_2; Domain location=60-93; Score =20.9; E_value=0.0046; Accession=PF07719.8; Description =Tetratricopeptide repeat
  Pfam module annotation: Pfam domain module=TPR_1::TPR_1::TPR_2::TPR _2; Domain location=26-59::60-93::26-59::60-93
MVKLEGDINQDVTLYKKALYYNWRYVDAMYILGVAYGEMLKFDMAIVFYELAFHFNPHCVEACNNLRVIYKDRENLEKAVDCYQLALSIKPNFSLSLNNLNVVYTVQVYEHITYDNLNHISLASFTGRQEQTVITSSLSKSFSVICNGSKLYEPNYTGSF

SEQ ID NO: 173259 - protein, 204 aa, Glycine max
  Coding DNA Sequence Number=SeqID_81574
MDTDFAVRSINATLSLSKIGPSLEPMPNYDPEDVLELYANAWPIEEGVLDKRSKVRGQWIPYDTDAINQFLGNPLILEEGQQYGYTSRRGQTTSFDEEAIDVPPPPPQQPPSLESISAHLQRMELQIHTYMRHLAYQQATNHRGQMQLNDNFYCYTLHQHHQDPNPYLWPTPKQFRSTVARPGDKPIFKEKEIELPNHDLQKKL

SEQ ID NO: 173260 - protein, 98 aa, Glycine max
  Coding DNA Sequence Number=SeqID_81575
  Subcellular localization annotation: CTP_CleavageSite=33; ConfidenceScore=5.70e-01
MAEPSKKRKGVATSSAVCRNLPFGRRATRGLTGASSKGGRKMRGVATNVYSRKTSKKPERCGLQTLIVKCSGVVFTHGEGCFPRSYVFLNCNEEIRPT

SEQ ID NO: 173261 - protein, 97 aa, Glycine max
  Coding DNA Sequence Number=SeqID_81576
MYVLRTLAILMLPKGERKWDCHHLKGGDCGSNAFQGYFDEAKESRVKQIAKDSRFKNQVSRSRFNNQVSRIKIHEQSRSRFKTQDSRIKRRLNQDKY

SEQ ID NO: 173262 - protein, 54 aa, Glycine max
  Coding DNA Sequence Number=SeqID_81577
MDARDWVDNNLGRLVYNSSLHVLTVEIAHITFLYSSLSETSALSAIPNLRGKFA

SEQ ID NO: 173263 - protein, 1740 aa, Glycine max
  Coding DNA Sequence Number=SeqID_81578
  Gene Ontology: Mol. function=oxidoreductase activity, acting on the CH-NH2 group of donors, NAD or NADP as acceptor; Cellular component =chloroplast; Biological process=nitrogen compound metabolic process
  Homolog annotation: Hit_ID=Q93WZ7; Match level="QueryCoverage=99%, HitCoverage=75%, E-value=0.0, Identity=84%"; Hit description=NADH glutamate synthase precursor
  Pfam annotation: Domain name=GATase_2; Domain location=98-542; Score =644.6; E_value=8.4e-191; Accession=PF00310.12; Description=Glutamine amidotransferases class-II
  Pfam annotation: Domain name=GXGXG; Domain location=1446-1642; Score =362.9; E_value=5.2e-106; Accession=PF01493.10; Description=GXGXG motif
  Pfam annotation: Domain name=Glu_syn_central; Domain location=638 -931; Score=635.2; E_value=5.9e-188; Accession=PF04898.5; Description= Glutamate synthase central domain
  Pfam annotation: Domain name=Glu_synthase; Domain location=995-1366; Score=844.7; E_value=5e-251; Accession=PF01645.8; Description =Conserved region in glutamate synthase
  Pfam module annotation: Pfam domain module=GATase_2::GXGXG::Glu_syn _central::Glu_synthase; Domain location=98-542::1446-1642::638 -931::995-1366
  Subcellular localization annotation: CTP_CleavageSite=37; ConfidenceScore=5.58e-01
MSNALSFTLPALNNPQLNALNSPNKARLRHGLRIRVVASCIERKRFLGTRVRPSGSDRIWLLQSGRVPKLRVAVRSAFSAVPEKPLGLYDPAMDKDSCGVGFVAELSGESSRKTVTDALEMLVRMTHRGACGCEANTGDGAGILVALPHVVDFELPPQGKYAVGMLFLPKSEKRREESKKMFSKVAESLGHTILGWRSVPTDNAGLGKSALQTEPVIEQVFLTPSAKSKVDLERQMYILRKLSMAAITSALNLQNDGITDFYICSLSSRCVLKRQPHFLEKTVVYKGQLTPAQLRDYYFADIGNERFTSYMALHGKQPVTEEKQGWGMTSEALSLDAGLDAMVELIHSRFSTNTFPSWDRAQPMRVLGHNGEINTLRGNVNWMKAREGLLKCKELGLSENELKKLLPIVDANSSDSGAFDGVLEFLLHSGKSLPEAVMMMIPEAWQNDKNMDSQRKAFYEYFSALMEPWDGPALISCNILGLWFYHMSMFSSFWFYDLALIQSNITTVTDGHYLGATLDRNGLRPGRFYVTHSGRVIMASEVGVVDIPPEDVRRKGRLNPGMMLLVDFEKHIVVNDDALKEQYSLARPYEDWLKRQKIELKDIVNSVDESERVPPPIAGVAPLSNDDADMENMGIHGLLAPLKAFGYTVESLEMLLLPMAKDGVEALGSMGNDTPLAVMSKREKLTFEYFKQMFAQVTNPPIDPIREKIVTSMQCMVGPEGDLTEITEEQCNRLSLKGPLLSTEEMEAIKKLNYKGWRSKVIDITYSKECGKRGLEEALDRICAEAHHGISEGYTTLVLSDRAFSKKRVAVSSLLAVGAVHQHLVKNLERTRVALIVESAEPREVHHFCTLVGFGADAICPYLAVDAIWRLQVDGKIPPKASGEFHSKDELVKKYFKASNYGMMKVLAKMGISTLASYKGAQIFEALGLSSEVIAKCFAGTPSRVEGATFEMLARDAFQLHELAFPSWVFSPGSAEAVALPNPGDYHWRKGGEVHLNDPLAMAKLQEAARTNSVDAYKQYSKLIHELNKACNLRGLLKFKETAVKIPIDEVEPASEIVKRFCTGAMSYGSISLEAHTALAMAMNKMGGKSNTGEGGEQPSRMEPLPNGSMNPKRSAIKQVASGRFGVSSYYLTNADELQIKMAQGAKPGEGGELPGHKVIGDIAVTRNSTAGVGLISPPPHHDIYSIEDLAQLIHDLKNANPAARISVKLVSEAGVGIIASGVVKGHADHVLISGHDGGTGASRWTGIKNAGLPWELGLAETHQTLVANDLRGRTVLQTDGQLKTGRDVAIATLLGAEEFGFSTAPLITLGCIMMRKCHKNTCPVGIATQDPVLREKFAGEPEHVINFFFMVAEEMREIMSQLGFRTVNEMVGHSDMLEFDKDVVKSNEKLENIDLSLLLRPAAELRPEAAQYCVQKQDHGLDMALDNKLISLSNAALEKGLPVYIETPIYNVNRAVGTMLSHEVTKRYHLAGLPTDTIHVRFTGSAGQSFGAFLCPGITLELEGDSNDYVGKGLSGGKIVVYPPKESNFDPKENIVIGNVALYGATCGEAYFNGMAAERFCVRNSGAKAVVEGVGDHGCEYMTGGTVVVLGKTGRNFAAGMSGGIAYVLDVDGKFQSRCNLELADLDKVEEEEDILALRMLIQQHQRHTNSLLAKEVLDDFENLLPKFIKVFPREYKRVLASMKSEETSKDALVHAAKDDQDDEAQAVEKDAFEELKKLVMASLNEEPSQVFYKCFKGT

SEQ ID NO: 173264 - protein, 152 aa, Glycine max
  Coding DNA Sequence Number=SeqID_81579
  Homolog annotation: Hit_ID=Q9LHC7; Match level="QueryCoverage=57%, HitCoverage=11%, E-value=2e-08, Identity=34%"; Hit description =Retroelement pol polyprotein-like
MRGKFLADKLLSDPEITKTERKKRNKKKQATTRPPGESSSVDYPSTEKQLVEDNMACRGGEGNRPPRKTLGDYAYQQGPKHYNSIVLPPFSNKVVELKPALLNLIGSHPFARMDHEDPYTHLSTFMELCSTMGASSEDAKAVYLRAFPFSLT

SEQ ID NO: 173265 - protein, 139 aa, Glycine max
  Coding DNA Sequence Number=SeqID_81580
MRESKIKLRREIKAMLNKPTKGERRLFSNPEIGLGAHEKRKVSGTKEIKASTKGRWTISNGESDLRTNPSQEGENDEDMTKSKGKDPLEGLGRPMTRASARKAKEALQQVLSILFEYKPKLQGEKSKVVRCSMAQMEED

SEQ ID NO: 173266 - protein, 113 aa, Glycine max
  Coding DNA Sequence Number=SeqID_81581
MTEIPKEVIHAFGHIENPSPPNALSLKTERRLSHVKYPLPPSAHTLTHQLKIAHSTNCGHLTTLRTGPHLLVTTSDKLTHELEKSLLAPQSHNLRTPVLFTTLGVHCHPTFTS

SEQ ID NO: 173267 - protein, 22 aa, Glycine max
  Coding DNA Sequence Number=SeqID_81582
RGSRQNPYAMHMQKVQYGNVKR

SEQ ID NO: 173268 - protein, 221 aa, Glycine max
  Coding DNA Sequence Number=SeqID_81583
  Subcellular localization annotation: CTP_CleavageSite=30; ConfidenceScore=5.45e-01
MEAQTLTPQMRTRQCGCSHGSAAQFATNTNSGRRRNNNNALGVPFSGLFPFLLFFDLRNHGSAGQFDTKTISGRSRKKKNDRVQARGYNIRVAWRLTHAFKKATRTLRWFDKVRGSRRNPCMMQMRKAEHGDGKIGRWLPPSSPRRAGLLPPEGTVFCWNTLEDCATMLPFDSRHIVELHELRNDGFQVPRSGQAKVASHQTDGPWMKLGYDTNFQGLFNS

SEQ ID NO: 173269 - protein, 75 aa, Glycine max
  Coding DNA Sequence Number=SeqID_81584
MGSLVHMLTLPMREGDFSLHWLMIAQDSLGYFCLSTNLKLQSMCNNFSPCFSHQQNPFTITTTLLTLQYSVKKGT

SEQ ID NO: 173270 - protein, 103 aa, Glycine max
  Coding DNA Sequence Number=SeqID_81585
MILSLEDKSAKVDVSLSELNALSECHPLSEASTRLVDRRNLEGNLSRKHVLSASSARSASRLSPSRLSTSLALSENSLTRAKRDVKELPCYGRLNPQLGILAE

SEQ ID NO: 173271 - protein, 120 aa, Glycine max
  Coding DNA Sequence Number=SeqID_81586
MLGFTRDFPQISASLHQLDLAPYALRSYNAQWNAPGLLHDKHTLRSSRNLGKMEVRKPSRGYGYHCIIEWIWEQVSIGHRNWGFVVDLGMTFVDSWVVGKEKGCYWLSNDIIGLVGNFAV

SEQ ID NO: 173272 - protein, 47 aa, Glycine max
  Coding DNA Sequence Number=SeqID_81587
MEVEEPWLGLWLPLNYGVDMGASFVADLVMAFVDDWVVGNEKANVAE

SEQ ID NO: 173273 - protein, 506 aa, Glycine max
  Coding DNA Sequence Number=SeqID_81588
  Homolog annotation: Hit_ID=Q1LQA0; Match level="QueryCoverage=22%, HitCoverage=20%, E-value=3e-07, Identity=36%"; Hit description =Putative uncharacterized protein
MDQAGAVGGVGAGDAGHRVAVDMPDLAELLVGAVQHLAQGGVVRLPAGFDAVRHFLDAQLAVVQRRAVVQHAPDQALAQLDLGRGIDRAGPGLVEQQFVDFVRGAIGIDVGARKARGDHGHAHVDGVAPQIINPGVLGGAQGPEIHGGREIGRDRGWVIRIWGCCVRESETPARRADAAGAEDRSVDLHVGFFGDALVLGDLGRDLFGKRFGAVGGRLGAQRFQARLDVGFGADLLHGGVQLGQDRGGQLGRGDQAEPRGVVDGGQADFGEGGHVRQAGHALGRGDGHGDQAAGLHVRQGRGQVVVHDVDLAGQRIVQRRAHATVGHVHQVGARGHLEQFAHHVRDRAVAGRGVGQLARLALGQLDELGHVLGLHLRVDGHDVRHGGQVRDRREVLLAIERQVRVDGRIDAVRADGGDAQGVAVRRAAGHEGAADRAAGAAAVFHHHGLVQFLAELVGEQAADDVGGAAGRERHDQADRLARVGVFGMGDARGQRRGQGRGGDTET

SEQ ID NO: 173274 - protein, 135 aa, Glycine max
  Coding DNA Sequence Number=SeqID_81589
MSVLELYIENDVVGGYVFHSANSIRSCGNNLSNNESEPPRNVSNLHEDEDEDDDDDYLVSNSYVEDSLDEDDSVDGISDTDDEVADMVQPVTIVQPRENGIQNPFWNDVFHYNNINWSHPDEEDICGLEMPLKML

SEQ ID NO: 173275 - protein, 93 aa, Glycine max
  Coding DNA Sequence Number=SeqID_81590
  Homolog annotation: Hit_ID=A5BEV8; Match level="QueryCoverage=97%, HitCoverage=17%, E-value=5e-10, Identity=32%"; Hit description =Putative uncharacterized protein
MQQLMMLLDRYQYIHWHRMKDDNVVCDLFWSHLDVGLFMRVYALPVVIVTDRDLSLMNAVKTVFPDATNLLCRFHIDRNVKAKCKTLVAQKKA

SEQ ID NO: 173276 - protein, 67 aa, Glycine max
  Coding DNA Sequence Number=SeqID_81591
MGALITNDDSRDSKLAKQIRSNKIHNNLSITKDQADVLMMPKGYMFHKALFKTKKSKIFKMDDQDSL

SEQ ID NO: 173277 - protein, 160 aa, Glycine max
  Coding DNA Sequence Number=SeqID_81592
MWAFLTGRQIDWAHLVRYRMHKALRGNAPLPYPHLITLFLRHFQIPLDDEPFVQVKRSFTIGAGAVTSFGYRKDRNGQWLKKDALPPQDERTPSPPPQHDDLALMNEVLSELRGLRSYVGDRFDSLDTRFADMEIRLTQLEEDVGYIRHSFDLPPPPPPS

SEQ ID NO: 173278 - protein, 100 aa, Glycine max
  Coding DNA Sequence Number=SeqID_81593
  Homolog annotation: Hit_ID=Q2HVN2; Match level="QueryCoverage=44%, HitCoverage=13%, E-value=5e-07, Identity=54%"; Hit description =Putative uncharacterized protein
MAGKKKEPINILQYADDTVFVGEAEWENVIVLKAMLRGFELASGLKINYAKSQFGIIGGRVNWLLTSSSYGLGSLNLNMVVGKSFSRAEIEGAAHTGGGT

SEQ ID NO: 173279 - protein, 113 aa, Glycine max
  Coding DNA Sequence Number=SeqID_81594
MGSSQKPSLKNRFYQVKVKSLGITSLKKLGKLKGQLQWQAFRKAYGKIWDLAKYYDQPMRCFTFRNFQLSPMAEEFEEILGCPLGGEETIPLHRVLSLINFQDSPNLGAGIRP

SEQ ID NO: 173280 - protein, 158 aa, Glycine max
  Coding DNA Sequence Number=SeqID_81595
  Subcellular localization annotation: CTP_CleavageSite=80; ConfidenceScore=5.11e-01
MDFYTCGCNTVPASCALHKLFIVTVLRASPTWAKFLYSRVPLWGDMLGAPSNSLKHSFFSLSLFRKSFFSSLFPDELLLREASLAALGPICIREVLVFRKAPGTPIPKSFRNKWLFRKHSGRRVLPDDLSVVPEALSGRALLPEYFRKNHFFRKFFFF

SEQ ID NO: 173281 - protein, 106 aa, Glycine max
  Coding DNA Sequence Number=SeqID_81596
MERDEVVVMAEAPRSHKEGSCYVHPALLLGHPANSEVAKLPFRNSSSGRHFFQKHSGIPFFRKLSGRRICDFRKYSETPSGRMSSGMFLEEASSGRWVFRNERNYD

SEQ ID NO: 173282 - protein, 155 aa, Glycine max
  Coding DNA Sequence Number=SeqID_81597
MAFLGETSSQTIVNSTLGFIFPNGSIVHNGSGVYFQIPTPVPIRVPNTCDFQKLKTRIHNTVQLTDKQYLDEIYYRQPFTDTATMTPTHDVLLYYNERWNMSHQHEFVGYLFTGKSPKKFDIPFGCTMDELKDLIKQVAPHGIPPYGIHETQMVR

SEQ ID NO: 173283 - protein, 134 aa, Glycine max
  Coding DNA Sequence Number=SeqID_81598
  Gene Ontology: Mol. function=nucleic acid binding; Cellular component= nucleus; Biological process=mRNA processing
  Homolog annotation: Hit_ID=A7QTW3; Match level="QueryCoverage=99%, HitCoverage=50%, E-value=2e-59, Identity=67%"; Hit description =Chromosome undetermined scaffold_171, whole genome shotgun sequence
VFSAFGFVHKITTFEKTAGFQALVQFSDAETATSAKDALDGRSIPRYLLPEHIGPCGLKITYSGHSDLSVKFQSHRSRDYTNPYLPVAQSAMEGSGQPMVGLDGKRLEAESNVLLASIENMQYTVTLDVLHMVL

SEQ ID NO: 173284 - protein, 863 aa, Glycine max
  Coding DNA Sequence Number=SeqID_81599
  Gene Ontology: Mol. function=nucleoside-triphosphatase activity; Cellular component=membrane; Biological process=protein catabolic process
  Homolog annotation: Hit_ID=Q6A167; Match level="QueryCoverage=84%, HitCoverage=86%, E-value=0.0, Identity=76%"; Hit description=Ftsh -like protease
  Pfam annotation: Domain name=AAA; Domain location=408-602; Score =261.4; E_value=1.9e-75; Accession=PF00004.20; Description=ATPase family associated with various cellular activities (AAA)
  Pfam annotation: Domain name=AAA_5; Domain location=408-555; Score =5.6; E_value=0.0011; Accession=PF07728.5; Description=ATPase family associated with various
  Pfam annotation: Domain name=FtsH_ext; Domain location=218-382; Score= -19.2; E_value=0.029; Accession=PF06480.6; Description=FtsH Extracellular
  Pfam annotation: Domain name=Peptidase_M41; Domain location=609-808; Score=331.3; E_value=1.7e-96; Accession=PF01434.9; Description =Peptidase family M41
  Pfam module annotation: Pfam domain module=AAA::AAA_5::FtsH _ext::Peptidase_M41; Domain location=408-602::408-555::218-382::609 -808
  Subcellular localization annotation: CTP_CleavageSite=60; ConfidenceScore=5.77e-01
MATLQASLLSKPSLPFPFLSPNHSPFSLSFPPTRRVPSTLLCCTFRPEPNPSELEPEPGSANTEEEPGINSPEEEKEGAASVSDLGLEEEGAEALDSGADSEKIANGRRLSIVAFFVGLWVKARESLKRAFSELLDWWPFWRQEKRLERLVADADANPQDAAKQSALLVELNKQRIDEKLWIVVRYMDLVLLESVVHVMLYRKKERCDIRENSASPESVIKWFEQRDRAVDSRGVAEYLRALVVTNAISEYLPDEDSGKASSLPTLLQELKQRALGNSDETFVSPGISDKQPLHVVMVDPKVSNKSRFAQELISTILITVAVGLVWFMGAAALQKYIGSLGGIGPSGVGSSSSYAPKELNKEVMPEKNVKTFKDVKGCDDAKQELEEVVEYLKNPSKFTRLGGKLPKGILLTGAPGTGKTLLAKAIAGEAGVPFFYRAGSEFEEMFVGVGARRVRSLFQAAKKKAPCIIFIDEIDAVGSTRKQWEGHTKKTLHQLLVEMDGFEQNEGIILMAATNLPDILDPALTRPGRFDRHQGGKWLGSKYGKRCDTIDVRGRQEILELYLQDKPIADDVDVKAIARGTPGFNGADLANLVNVAAIKAAVEGAEKVTAAQLEFAKDRIVMGTERKTMFISEESKKLTAYHESGHAIVALNTDGAYPIHKATIMPRGSALGMVTQLPSSDETSISKKQLLARLDVCMGGRVAEELIFGQDYVTTGASSDLHTATELAQYMVSNCGMSDAIGPVNIKERPSSEMQSRIDAEASVVVKLLREAYDRVKALLKKHEKALHVLANALLEYETLSAEEIRRILLPYREGWLPEQQEQEAAEGDLEKGYAALDICEATIPVYNSKGLLLEYDRPLLRA

SEQ ID NO: 173285 - protein, 51 aa, Glycine max
  Coding DNA Sequence Number=SeqID_81600
MESRENETELKETIKIELSQRGSQYSPPIEADIQSIVSRHPSAQGSLKHFT

SEQ ID NO: 173286 - protein, 323 aa, Glycine max
  Coding DNA Sequence Number=SeqID_81601
  Homolog annotation: Hit_ID=UPI00016621D1; Match level="QueryCoverage =47%, HitCoverage=40%, E-value=2e-11, Identity=32%"; Hit description =UPI00016621D1 related cluster
MTGPLDESISCFLIRLDPWVLVPITFRGLYALTVRGLHVLAFRGLHVLTFRGLHAFAFIGLDVLKFRGLHVLAIRGLHVLAFKGLYALTFRGLHVLTFRGLHALTFRGLHPLIFRGLHVLTLRGLHALAFRGPNILIFRGPNILIFRGLHVLIFTGLRVLAIRGLHIHTIRELKFLFISFWATPDIGGRPTVQAQPEREAITQLLCIPGQDFTRTAAKRQVWIMRTNMTTLTQIWMMLLLSKHFVQRPQCRSPPAKVSGLRPQDTQQTRRSPTGPWGVQLWLRASVSPTGCPFPPARDRARKTPSGPGEVQQGPGVSSSDYEP

SEQ ID NO: 173287 - protein, 99 aa, Glycine max
  Coding DNA Sequence Number=SeqID_81602
  Homolog annotation: Hit_ID=Q9FYC9; Match level="QueryCoverage=36%, HitCoverage=16%, E-value=4e-07, Identity=58%"; Hit description =Putative uncharacterized protein F22J12_60
MADNTRNQTHICEIEERLNTRMEEQFMDIGASLQCTIEDMFRRHENSCSSGSSASSRPYSCNTRLARLDFPRFNGEGVKNWIIQCDTFFSVDQTPEEYK

SEQ ID NO: 173288 - protein, 167 aa, Glycine max
  Coding DNA Sequence Number=SeqID_81603
MNLESIAQVSSYVREGSTYHDSWEVTYEKHVPRAFYKEKSVEYVGTKKIVYHTMCERVKIWANITNKSFLHKVGSKTTLSDLHKFILFHLMEQLLFDLPHIVFINILKNLRTLGGMDDIYYATLVNKLFWEQGVYHVLKKIDKDSKHQVTVKGSFIAKQQQFSKVEL

SEQ ID NO: 173289 - protein, 56 aa, Glycine max
  Coding DNA Sequence Number=SeqID_81604
MKVAQGHNFSKMGSKQITFKEGTFIPSKEVNGELVPKEWDEMKNDEKRKVQDDQKN

SEQ ID NO: 173290 - protein, 123 aa, Glycine max
  Coding DNA Sequence Number=SeqID_81605
MNVFTSNFADWSIDYDHKDTIQMLHPTKKSNEVTSAYKEVVVYSTSSSIPKDIAHINYSTLVIVTEDQIQEIMAQAMMKQQEETKKELVKQKEETRQELQSFTKQQRLKNEQYQLSIQNFIAS

SEQ ID NO: 173291 - protein, 293 aa, Glycine max
  Coding DNA Sequence Number=SeqID_81606
MQSQGLSLPPEPLVSPSGPRVSTKGSCVDPSGNDPETGDSDRRGLYIEAYPARLVGVEEVTNADAPVPVPTDEVSLVGQALHTFLAWSTHLVKSLSQQVVVSLAKPPPKPDLEVDDLLYLMTLTIPELFLRPYQVTWDATVFGVFNPDFPFYIKHEDLSKIAHGGQCLSISMLQLWIMHLTETSMRAGNSDIYGFLEPQFIQRSGQSQFESESYIKTWMQSSKRDVYLRAYLNGPDNYLKAIINSALKGLDDAPQPKSKALARWIVVKYFNDPRPLDPERLKALRIQWTQYYL

SEQ ID NO: 173292 - protein, 65 aa, Glycine max
  Coding DNA Sequence Number=SeqID_81607
MEGVQEVLTLRPRAKHIIVHALSRESQALSAQLLHLKLIHSAKLAKAELSQIQFDLDLAKRKPNR

SEQ ID NO: 173293 - protein, 99 aa, Glycine max
  Coding DNA Sequence Number=SeqID_81608
MKFFRNYEAFAPMLVNTLDSLDGRIDAIDARFEGMDTRITQLEKDVQIGWLVFGSVSWPLLGFLEVSKRRRSLGAEKFLRDRECGKFAKGLIVKGRIDL

SEQ ID NO: 173294 - protein, 104 aa, Glycine max
  Coding DNA Sequence Number=SeqID_81609
  Homolog annotation: Hit_ID=A2Q1D6; Match level="QueryCoverage=93%, HitCoverage=20%, E-value=1e-08, Identity=31%"; Hit description =Ovarian tumour, otubain, related
MTFSAGFAYLEGERLNNVVWALERFRGIFLRRDVSPGVIVTDKDLSLMNAVKTNVKAKCKSLIGQRNAWEYVMDAWGTLVDCPSEQQFDECLKKFEMLEQVALE

SEQ ID NO: 173295 - protein, 49 aa, Glycine max
  Coding DNA Sequence Number=SeqID_81610
MEGAKPMKTPMHASNPLSKDESVYVYVLDFNLILQRYISKLLRGSYIIY

SEQ ID NO: 173296 - protein, 174 aa, Glycine max
  Coding DNA Sequence Number=SeqID_81611
MVGYTPSSFIDLVFASKRIEVGLKRGKFNHPAWTNEKTGANEEGEKEGETHAVTAIPIRPSFPPTQQCHYSVNNKPPPYPPPSYPQRPSLNQPQSLSIALPMTNITFSTNQEHQPRNEFCNEKTSITPTKVHQPSFLREYDSNATCACHGEASGCPIEHCRALKCRVPGLIDAG

SEQ ID NO: 173297 - protein, 79 aa, Glycine max
  Coding DNA Sequence Number=SeqID_81612
MERFDGLQTFVGERFDTLELQVDMRFNEMESRMTKPCVLAILLWYLNNLLFPYMHEVVIIKKGEIVEARLHGECDSKVF

SEQ ID NO: 173298 - protein, 152 aa, Glycine max
  Coding DNA Sequence Number=SeqID_81613
  Pfam annotation: Domain name=Transposase_23; Domain location=37-107; Score=10.0; E_value=9.5e-05; Accession=PF03017.5; Description =TNP1ENSPM transposase
MQSQGLALPPEPEVGPSTARVSTKESFVDPSGNDPETGDSDKCGLYIKENPPRLIVLGRVYEGSTTVHNIPLLHDQVKVGVEEVKDADAPVPVPTDEVNLVGQALNTFLAWLTHLVKRLSEHVMWDATVFGVFNQDFLVYIKHEDLSEIAHG

SEQ ID NO: 173299 - protein, 67 aa, Glycine max
  Coding DNA Sequence Number=SeqID_81614
EFVDVFLEEIPYGLPPLRGFFISLKGISVDEENVKAIREFLVLKNANEDSKPVAYFSDIAICGQGNS

SEQ ID NO: 173300 - protein, 53 aa, Glycine max
  Coding DNA Sequence Number=SeqID_81615
  Subcellular localization annotation: CTP_CleavageSite=21; ConfidenceScore=5.05e-01
MPQPYGINIGLKELSNRVTPKAYTPKSPSRPLPPNSVHNSVRQVASDILRRRG

SEQ ID NO: 173301 - protein, 111 aa, Glycine max
  Coding DNA Sequence Number=SeqID_81616
MKLAKYRLKAQVEKDEGPSGEGQSPRVEKDEGPEAETLSRLLIVAEGPSNPCGVYPDLSSFIGSGVYPDLSSLTGSGVYPDLSSFTGSGVYPDLSSFTGSGVIQTFVACIK

SEQ ID NO: 173302 - protein, 143 aa, Glycine max
  Coding DNA Sequence Number=SeqID_81617
LGGVDGDLVLRMTRIRAMYEYVSSVEGGQLGMWYLEICRGGQETLGTSGELLTVNNKEQRPQSKEACVVAGQLWILSGIWNLASGNRLPRIAMAAQLIHDHVEMECLEGVWETFEVNERCRFRGSLSRTSAARICAKLLKGCA

SEQ ID NO: 173303 - protein, 16 aa, Glycine max
  Coding DNA Sequence Number=SeqID_81618
MKKILGLQAPMELTSC

SEQ ID NO: 173304 - protein, 73 aa, Glycine max
  Coding DNA Sequence Number=SeqID_81619
MMITKDDDKGDYKKLEDGIKNNSRLKKKKLKHTSRFKKKVEFKNQDQDSRFKIQESREDLIKISMKRIFQKTE

SEQ ID NO: 173305 - protein, 55 aa, Glycine max
  Coding DNA Sequence Number=SeqID_81620
MLRNFTDCATMPFLTFEMLQNFTDYLTMGVKYLKAVKRRLHATKQWSPDEIRDCK

SEQ ID NO: 173306 - protein, 236 aa, Glycine max
  Coding DNA Sequence Number=SeqID_81621
FPDSIHFAEGGHVGEVDDGLQDLRLVGTGSSQQAVDFSESRLALFRHARTFTNLAGQINGVAVNDGAAHALARLDTLDDRRGARAGTAIAEHRALQFIERIHHAGNGIGIDAVAADRHMHDRQAKLLCTLGNIGKKRLTVFFAVRAVADDRLEAECLDLIQIGDADLSSYRIFVVYAPDIHVMPPETGVRAAGQDGKAQTEGTAFPRLKNIELTGGLKLATPHPAMRNRLDAEHVR

SEQ ID NO: 173307 - protein, 112 aa, Glycine max
  Coding DNA Sequence Number=SeqID_81622
  Homolog annotation: Hit_ID=A5C8K0; Match level="QueryCoverage=91%, HitCoverage=6%, E-value=1e-13, Identity=38%"; Hit description =Putative uncharacterized protein
MEIFVQSIDPGVWNAIIKLHFVPTKYVNGELIPKEWDEMRDDEKRKVCKNEKEIWNMLEVTHEGTMDVGRERKLTLVYEYKAFRIKNGKTISKLQTRFTHIVNHPTWSRKNV

SEQ ID NO: 173308 - protein, 19 aa, Glycine max
  Coding DNA Sequence Number=SeqID_81623
MVTSKPYTGAMRGIVHEPQ

SEQ ID NO: 173309 - protein, 35 aa, Glycine max
  Coding DNA Sequence Number=SeqID_81624
MAALGGFTDITGAQNSIDIENLKWKNKLSLEGISF

SEQ ID NO: 173310 - protein, 142 aa, Glycine max
  Coding DNA Sequence Number=SeqID_81625
SEFLIGGYVGARASLLSTTPPFVVMTQELVACGDTLRLSAPRHSVTPSVIDEQRPVWSEFLIGGYVGARASLLSTTPPFVVMTQELVACGDTLRLSTPRHSVTPSVIDEQRPVWSEFLIGGYVGARALLLSAAHKICYTDPE

SEQ ID NO: 173311 - protein, 146 aa, Glycine max
  Coding DNA Sequence Number=SeqID_81626
PVLMMDESPQEKVQMVEMAEGSELECSPPLLLLVMMLVLWAPQSQAPGLWRPHPFQRKKAGQAQALKALHDDGLPSMDALEHGVKHLRSAGGITGISMEEEGGSVEEEGVGASNAAMKRTLDLFPLAFLGPLKVTVGSSRFQQFLI

SEQ ID NO: 173312 - protein, 150 aa, Glycine max
  Coding DNA Sequence Number=SeqID_81627
MGEPQATQPIVHGLQSKVQSLIEAGWLTFQEDRPNVKTNPLANHGGGAVNVVKSGRLRRSNPLKDVTTPRRFIYEALQKGGVIPRGGHEKDSCLMHPGVPHSMEACLAVRDLLQHMIDQGRLKDGDEGGEEQHICMQFTDEEGLRKPKPL

SEQ ID NO: 173313 - protein, 179 aa, Glycine max
  Coding DNA Sequence Number=SeqID_81628
  Homolog annotation: Hit_ID=UPI00006A2939; Match level="QueryCoverage =68%, HitCoverage=75%, E-value=6e-09, Identity=32%"; Hit description =UPI00006A2939 related cluster
MVVITPAKVHQPPFLRGYDSNATCAYHGGSPSHSIEHCRALKHKDGPSGTSTLVFRGLHVLANRGLHALTLRGLCVLTFRGLHVLTFRGLHALAIRGLRVLTFRGLHALTIRGLHVLTFRGLHALAIRGLHVLTFVGLHALTFRGLHVLANRGLHALTLRGLHVLANVGLHALTFRGLH

SEQ ID NO: 173314 - protein, 844 aa, Glycine max
  Coding DNA Sequence Number=SeqID_81629
  Homolog annotation: Hit_ID=A7NYA5; Match level="QueryCoverage=18%, HitCoverage=17%, E-value=2e-55, Identity=67%"; Hit description =Chromosome chr6 scaffold_3, whole genome shotgun sequence
  Pfam annotation: Domain name=RRM_1; Domain location=228-298; Score =34.4; E_value=4.1e-07; Accession=PF00076.13; Description=RNA recognition motif. (a.k.a. RRM, RB
MKLTFRTLPYDDDNMKDAKISKSGENLTGPMCNGTQWDDDCSWSEWYSAEDPVKGFELIAIWSEKMVESSMEMAELENASPHEAEKWLISLRLEGSSGNRVGFASELCLLVDALQVSFEAQFMEDFVSVENPGSDNLKSMVIPPPTVRDRVLKELFIEEGLYQRKRVREREDVREGEWTTVRKRGRGNLRVVSTERKDPRQSYGGARQRQYANQVYPNWRNRADITSFYFTRFPEEVHEAELWNHFKKWEDVREIFVSKQRNKEGRRYGFVRFKGVDDVSRLERQLDNTIIGGLKLHVNIPKYARGKLEKGESNNRWQGTNQKQKEGMKTIATTAAHTTVPTRTYAVILATRSGNAGQHRNKVTTQARHGGSHSSIQLDIPKEEDKWYKNAWVGRLRKPEIFERLEDELTWILGSDVTPKYLGDDMVILPGLQDAKAEELIKEEIDNGASLFYSLEKWKPEMRLGNRLVWMHCWGILLAAWGIEHIRKIIVAVGELVDVDDEVEELRRLDRARVLIRTPWCPTIHHSVTVDIHGKSHLVFMVEETSRVTVDEANDGSNDPRSDRFPSGRLGTEDPLGNDQYGPTHENPVTDVTDANQTGATPDPQTDVQTCNEGQQTPKQQVTLDQIERDCADTQTEIAVNKKGRRKYRWYTTGEKRGVHTSPQPQQEKGSDWKVYSRGKGCRKKWTPTNSQQISSNPDSKDLDPQSTTRGGSTVGKQKYSTMNILSYNIRGLGRGALWGDTDLSWEIYPAINSAGGLLCIWNDGMFKAAAKRELWLSIKQIKQLHTDGKWCIVGDFNSIKHPDERLTMSQREGDSNSISEFNEWISDLEVEEVPSVGRRFTWI

SEQ ID NO: 173315 - protein, 80 aa, Glycine max
  Coding DNA Sequence Number=SeqID_81630
  Gene Ontology: Mol. function=zinc ion binding
  Homolog annotation: Hit_ID=A0FK64; Match level="QueryCoverage=88%, HitCoverage=25%, E-value=6e-10, Identity=50%"; Hit description=PHD4
MVTSILYCGKRLFSLISGIPSIFEVVTDRKPVKDKPTTDSESKYRGSAKIKQVNNTRELLTQFGATSPTSGGYQAREEIH

SEQ ID NO: 173316 - protein, 519 aa, Glycine max
  Coding DNA Sequence Number=SeqID_81631
MGTLPHQKDEGGVRHTSTTATLDDVVGVIKHLTQTLENMDNQNRTRLDAIENTNHTMLKAICNFVRQDQHESTKDAMDDVAMSGTQNTCVNDQRLPCENPKKPTSTPTVKSMKNEAYSKSMGSFKNIETIFIPGDDDDEFIKPLPIGMKGSKSSYSSPRTLNLSGPNQVNTIDNSSPPEPFMSNYVTGLTAKAKNNKETLMAPRKLSFPQHSYRTSKKPKIEQHSEHLNAKKMQQTRGSSSRNMTNNNQSRMFHRCRTTSSRGYTHTIPKDMPCCFKPTVDMNLIFEETQVCAYVFNPNLDPSGKEILYKVGNNLGTRQTFQSLCPNKPVREEVYGSFQTMHFAKTCYKVLTTFEVLKFGFQCIADNTIHVFEGCLQPTVPHQECLVSPAFAVDVINGSPVETLIEHYGKDWMPPFSDLKLANVMLSVLEIVFPTQEFVIGFDGMDCWDIIEARGIPNCGSSEKSTLWVLEWMQMEESFVSLLYRVLEEKAVRMKVTMILLLGTHNQCRGELITNAERN

SEQ ID NO: 173317 - protein, 235 aa, Glycine max
  Coding DNA Sequence Number=SeqID_81632
  Homolog annotation: Hit_ID=A7NYA4; Match level="QueryCoverage=61%, HitCoverage=62%, E-value=1e-76, Identity=93%"; Hit description =Chromosome chr6 scaffold_3, whole genome shotgun sequence
  Pfam annotation: Domain name=DUF640; Domain location=30-162; Score =292.8; E_value=6.7e-85; Accession=PF04852.3; Description=Protein of unknown function (DUF640)
  Subcellular localization annotation: CTP_CleavageSite=46; ConfidenceScore=5.39e-01
MDSASGEAPPPPQPTSVEAPPPSGSSAPATSAPAPTQPEGSSPAPLSRYESQKRRDWNTFLQYLQNHRPPLTLARCSGAHVIEFLKYLDQFGKTKVHVTGCPYFGHPNPPAPCTCPLKQAWGSLDALIGRLRAAYEENGGRPESNPFGARAVRTCLREVREGQAKARGIPYEKKKRKRTTMTVSAVSSGGGSSSAVAATSGGGDSGDTIIGGGVGSSASLASTTTATANVTTTTV

SEQ ID NO: 173318 - protein, 199 aa, Glycine max
  Coding DNA Sequence Number=SeqID_81633
  Homolog annotation: Hit_ID=Q6XKE6; Match level="QueryCoverage=63%, HitCoverage=5%, E-value=1e-07, Identity=25%"; Hit description=Genome polyprotein [Contains: Movement protein (MP); Capsid protein (CP); Aspartic ...
  Homolog annotation: Hit description=protease (EC 3.4.23.-) (PR); Reverse transcriptase (EC 2.7.7.49) (RT)]
MDISNILMARSTEEPFYDSPVEEEPFISKGSSSKSNARPWFTLDDTPPREWRKKLIEMGAWLDTKFMKDADPYKVIEEFCCRMRGTLKEWYHNLRTVRQDQFHELGSIVAVLGTLHQEFIGEGKIIERKIRQEFFEMMGCFCQLGLKPEDRYKTDAIVPRKGPVTRAMSKRLQENWARAAEEGYKVLMNLRVDFVAHGP

SEQ ID NO: 173319 - protein, 171 aa, Glycine max
  Coding DNA Sequence Number=SeqID_81634
  Subcellular localization annotation: CTP_CleavageSite=24; ConfidenceScore=5.17e-01
MTFKILKIPIPSYQFNTSYKPQKNLMKLEQNRTNLRNNLKNLQLKQKNLILTRNKRRRTSDLKGFILQAKCKTLVYPYDTPPREWRKKLIEVGAWLDTRFMKDAYPYKVIKEFCCRMTGTLKEWYHNLGVVRQNQFHELGSTAAILGTLHQEFIGEGMIIERKIRQEFFET

SEQ ID NO: 173320 - protein, 70 aa, Glycine max
  Coding DNA Sequence Number=SeqID_81635
MTVRVKAKVSEERQRENKHTRSNVEERAQNLKGRHHSTTVWVELGSGHVQVLKKSILEGGQGEDETQDLK

SEQ ID NO: 173321 - protein, 141 aa, Glycine max
  Coding DNA Sequence Number=SeqID_81636
  Gene Ontology: Mol. function=protein binding; Biological process =protein modification process
  Homolog annotation: Hit_ID=A9PGU0; Match level="QueryCoverage=70%, HitCoverage=27%, E-value=1e-19, Identity=48%"; Hit description =Putative uncharacterized protein
MGLVRIVTQSEQFDGDGPVWKKAQVVPKSRKDDSGSNNDMKKIPVKNRMERWKATGVVALSECNLEVIPDEVWVCGSSARVLDCNNNSITDVPDEIARLTGLDVSVSSPSRLGTLSEQSEEKLKESQEIARDVAIAVTIHT

SEQ ID NO: 173322 - protein, 147 aa, Glycine max
  Coding DNA Sequence Number=SeqID_81637
MALPKGRICILLRLLEHYYFMPMYLSDIGVLISLLLEPSNVFFLDIPDYRKITDSNTLQEVFPIPYLGPSPSLQESESTIGSTIDIPDNPPLEKTQRSPIVYRHHPRILDVELEGNERPSESCLTPVDNPTMDLLEENLDSPIALRK

SEQ ID NO: 173323 - protein, 115 aa, Glycine max
  Coding DNA Sequence Number=SeqID_81638
YILCGTSRGYIYLGLTENKRGYISCGSVLVEGTSTRFKENKGGLFQDHDEDQVNLCLMTKSDENNKEDSVRKKWYIDSGCSKYMTSDVSKFTTILPRKVDMLHRRQQQGQNYWSQ

SEQ ID NO: 173324 - protein, 276 aa, Glycine max
  Coding DNA Sequence Number=SeqID_81639
  Homolog annotation: Hit_ID=Q6WAY6; Match level="QueryCoverage=48%, HitCoverage=28%, E-value=1e-14, Identity=31%"; Hit description =Putative uncharacterized protein
GKEKALADQEEWASFIDVFALLIFGVILFPYVEGLVDLAAIDAFLAYHHIKESPVIAILADVYDTPTCPLQGHRLCAEKGKVNWEQLLASVEGRTGVLSSCEGFSIVPLMGTRGCINYNPILAIRQLGYPMRGAPSEKSIMPFIVGGFSDPNARVLQGAAREEETETPEESEEVQTLKAELQKAQIVKEQFKSTAINYKEKLSLAATHEQRLEDEYAKVSILQAEREARERVIDSLHREAMMWKNRFAFTLNGSQELPRLLAKAKAMGDVYSAPDK

SEQ ID NO: 173325 - protein, 36 aa, Glycine max
  Coding DNA Sequence Number=SeqID_81640
MARSSEKKDPKELELLELEGDERDSKVRESDVTPRA

SEQ ID NO: 173326 - protein, 163 aa, Glycine max
  Coding DNA Sequence Number=SeqID_81641
MKVHISSPSKDYMSSPSKDYMSSPSKDYMSSPSEGCVPSPLEDYTSSPLEDYTSSPSEDYMSSPLEDYTSSPSEDYTSSPLEDDTAARPRLQRTTRPHLWWTTRPLLKRTTRPHLQRTTRPRLQRTTCPHLYRATRPRLQRTTRPCLQRTRRPHLQRATRPRL

SEQ ID NO: 173327 - protein, 66 aa, Glycine max
  Coding DNA Sequence Number=SeqID_81642
  Subcellular localization annotation: CTP_CleavageSite=59; ConfidenceScore=5.65e-01
MGVQIATRSTWAFQNIPLEGSCFRRKQPSSPGKSKPRRFRNVSVGDFAKIFNRSSFVLRRSSVLNR

SEQ ID NO: 173328 - protein, 57 aa, Glycine max
  Coding DNA Sequence Number=SeqID_81643
MCVIVSSTRFLTFKDLAEMGIRAQLYPRSDGKKIYLSLACLLCQEMRRQVSISVRAV

SEQ ID NO: 173329 - protein, 101 aa, Glycine max
  Coding DNA Sequence Number=SeqID_81644
MWEYKTMHPDVNSNLSQMKQMRLLPIYYKPTLRQKGDARAHGCVFQERKMRGVATNVYSRKTSEKPERRGLRTLSVKGLGVVFTHGEGIRTLCARHKGRQP

SEQ ID NO: 173330 - protein, 47 aa, Glycine max
  Coding DNA Sequence Number=SeqID_81645
MGTLRDPRCRIQCPDILPENTGVAVQCKIKVKCRSEAAGSTMSDTMS

SEQ ID NO: 173331 - protein, 67 aa, Glycine max
  Coding DNA Sequence Number=SeqID_81646
  Gene Ontology: Mol. function=RNA-directed DNA polymerase activity; Biological process=RNA-dependent DNA replication
  Homolog annotation: Hit_ID=A5AZG1; Match level="QueryCoverage=86%, HitCoverage=17%, E-value=2e-10, Identity=48%"; Hit description =Putative uncharacterized protein
MKVEQVFACHHTSEERKVPLATLSFQGYAIYWWTSLVKERRIHGDPPVEYWNDLKSSLREEAHALLL

SEQ ID NO: 173332 - protein, 152 aa, Glycine max
  Coding DNA Sequence Number=SeqID_81647
MFIRGKHRKNQKEKVKGLRILEMRVWESFTHGEGTHGTLYFSLLTLIYSKRGVEVAQKLAQASSAHPDKLLAYSRSNLLAHASSARPIELVTSSLSFLVGPGEMRGGGCTAARPSELLASSRSNLAHPSELVTSSLSFLVAQASQGPEKVTK

SEQ ID NO: 173333 - protein, 148 aa, Glycine max
  Coding DNA Sequence Number=SeqID_81648
MFVKFLIFFCKASICSLKSATTIVSLETEDELEIRIAARLPWWHCRMKLPENAQQLPLANMDKSSEQAAGTEPQSRRRRSNSAWEEEEEEETTSRTKLPIHSASPLSLPSPFRCHSSSMKQRNPLMKKILGLQAQMELTSCGIKSIFI

SEQ ID NO: 173334 - protein, 85 aa, Glycine max
  Coding DNA Sequence Number=SeqID_81649
MVGYTPSTFVDLVFTGERIKVGLERGKSDHPALMNAKNGANEEGENEGETHVATAIPIRPSFPPTPQCHYSANNNPSPYQPPSYP

SEQ ID NO: 173335 - protein, 106 aa, Glycine max
  Coding DNA Sequence Number=SeqID_81650
MEERSLLSEIAVTEILISMRTDVVPDVTTSRFRTWRLYLTGDIKVAHKTLKSQNSQNNSSIPDLVQNSCSLHVYIAVCVSGLQQLALDEIYHSPEKSALKDLKDQV

SEQ ID NO: 173336 - protein, 92 aa, Glycine max
  Coding DNA Sequence Number=SeqID_81651
VVPFVVVLMNPAILLPFEEQTQEVSYMGNQQRQGYNQGGFSSFQQGPYNQQRQWGSHPGNQFNKDLGGPSNRLPQQGPNIFQMWKQFLPRLF

SEQ ID NO: 173337 - protein, 58 aa, Glycine max
  Coding DNA Sequence Number=SeqID_81652
MACNLCLTASRYLAPIVAQYVKFHNVPEVKREHCCTIRKGMQIATRPTWAFQDVPLEG

SEQ ID NO: 173338 - protein, 212 aa, Glycine max
  Coding DNA Sequence Number=SeqID_81653
  Gene Ontology: Mol. function=motor activity; Cellular component=cell projection
  Homolog annotation: Hit_ID=UPI00016621D1; Match level="QueryCoverage =97%, HitCoverage=41%, E-value=2e-18, Identity=31%"; Hit description =UPI00016621D1 related cluster
LHALAFRGLHVLTFIGLHALTFRGLDFLAFRGLDFLAFRGLDVLAFKGLDILAFRGLHALAFKGLHAFAFRGLHALTIRGLHVLAFVGLHALTFRGLHVLTFRGLHVLTFRGLHVLAFRGQHILTFSFVGLHALTFKGLYILAIRGLHALTFRGLHILHFRGLHVLAFRGLHVLTFRGLHSLAFRGLHVLVLRGLHVLIFRELHVLAFTGLQ

SEQ ID NO: 173339 - protein, 105 aa, Glycine max
  Coding DNA Sequence Number=SeqID_81654
MRFFNGDFPPWRCSGRQRRRGERRRHPLGNKPWKKELHHQDEPWIRSLEGCFNGGKERGRERERGEHEIEGIKEGEKWNFEVASLRSFLEKNSLRSFFEKTSLRS

SEQ ID NO: 173340 - protein, 196 aa, Glycine max
  Coding DNA Sequence Number=SeqID_81655
MIPYGEHKEDSCLMHPGVLHDMETCPVVRDLVQQMIDQGHLEVNNEGEEEKHIRMQSTDKEGSKRPKPLVIHFTKGTASQRPRHPSAVSGVRPIPFAYKNSHAVPWRYAPPGGKAKVTEGQNVKVIPTPDEEVPTEEFTEGREGCGKKEVSLEEASEFLHIIQQSEFKVREQLNKTPARVSLLELLMSSEPHRALL

SEQ ID NO: 173341 - protein, 156 aa, Glycine max
  Coding DNA Sequence Number=SeqID_81656
RKMQGSCMSKHENKRNDTFITMPWRDAYAMHDMNAFTDTRARKILSSYLHIWGHSAPCIIPFENTYCGSRDYQQQHAIKEKTLDEGSLLSSKSETQHDHRFTSTPYVPMDPVESPTVATYPSAGGQRGAHGCVFQEMKMRGVATNVYSRKTSKKPE

SEQ ID NO: 173342 - protein, 54 aa, Glycine max
  Coding DNA Sequence Number=SeqID_81657
MEVEEPWSGLSQPLNYQVDMGARRCLALDVRQTGFVADLGMAFVVDWVVGNEKG

SEQ ID NO: 173343 - protein, 143 aa, Glycine max
  Coding DNA Sequence Number=SeqID_81658
MHYLIVHILLPRSSNLAQVFEEDLIVMWAFLTGRQLDWPILYVKRSFAIGVGVVTSFGYRRDIDGQWLKKDAQPQQEERTPSPPPQRDDSSALMHEVLSELRGLRTYVDERFDSLDSRLDAIDAHLAGMDTRIIQLEENMSFI

SEQ ID NO: 173344 - protein, 42 aa, Glycine max
  Coding DNA Sequence Number=SeqID_81659
MTPLPVKEDKSGLKAQVEKDEGLSGEGQSPRVEKDEGPSGER

SEQ ID NO: 173345 - protein, 106 aa, Glycine max
  Coding DNA Sequence Number=SeqID_81660
  Subcellular localization annotation: CTP_CleavageSite=52; ConfidenceScore=5.12e-01
MEPGQWLLMTHDMQKIYVPIPSPMSGGVVTFGRNQKDLITGVDTMSPLTRVCVSSKTRTTLQSSLLRDKEISIRVNLVICPVKRCHAYSKSKSIIGYGIRSLDMLA

SEQ ID NO: 173346 - protein, 64 aa, Glycine max
  Coding DNA Sequence Number=SeqID_81661
MQTLVSSLQSKFEGDPTVNESEIEVLPKQALDLLHQWSSLLLEDQWQQNGEGGKVIGDATSTRR

SEQ ID NO: 173347 - protein, 109 aa, Glycine max
  Coding DNA Sequence Number=SeqID_81662
MASRKRKATSFVSRAGHLIKFDVDSLNTFLETPMVVEQGESLPSYSRFARLRPDPQELAARLCIPWRGFVLNAEGLPWKLLRKDLTTLAQTWSVLSYSNLTPTSHTVGS

SEQ ID NO: 173348 - protein, 54 aa, Glycine max
  Coding DNA Sequence Number=SeqID_81663
MEVEEPWLGLWLPLNYRVDMGARWCLVLDVRQAGFVADLGVAFVVDWVVGNGKG

SEQ ID NO: 173349 - protein, 39 aa, Glycine max
  Coding DNA Sequence Number=SeqID_81664
MDTGVGLAIYAASPSLDEAEGFLEVSKRKRRFWVQRFLR

SEQ ID NO: 173350 - protein, 74 aa, Glycine max
  Coding DNA Sequence Number=SeqID_81665
MLKRRTPNVKTKGRTSMDKCQRRSPQTRSPQCGCSHESAGDFDTRRKKKNDRVQAQGERRRMIGFKRKEKEEER

SEQ ID NO: 173351 - protein, 177 aa, Glycine max
  Coding DNA Sequence Number=SeqID_81666
MASRKHKSIGSRPTSQYDTRRFSSLDAWTKYTDNVLGRNILPERKVELYHIELDDFKAELERRNFHKCLTNLVNGSIDLVLVKEFYANLYSFEDHPPKQSRVRGHLVKIDVDSLNTFLETLVVLAEGETLPAYSKYCRLPTDFREIKVALCILGRGFILNSEGHPRKILRKDLTTLA

SEQ ID NO: 173352 - protein, 207 aa, Glycine max
  Coding DNA Sequence Number=SeqID_81667
  Homolog annotation: Hit_ID=Q1STP6; Match level="QueryCoverage=54%, HitCoverage=58%, E-value=5e-30, Identity=55%"; Hit description =Harpin-induced 1
  Pfam annotation: Domain name=Hin1; Domain location=30-158; Score =28.7; E_value=5.9e-06; Accession=PF07320.4; Description=Harpin -induced protein 1 (Hin1)
ESSFKGSIVCLMVALCVAIALVLLRVILALTVFKPRHPITNVDSIRLQNMSLGMDMFSMSVNVNFTLEVDVLVNNPNKLGFNYYNSSAQLNYRTQLIGEAPIPNGDILVEEIKGLNLTLTVMADRLVSNSKVTKDVALGSLPLNTLGGVAAFAEEVRALGERDDSENGHKKRGNSCADFLAKLGAALDDALCILEVVPGGLIIFFGG

SEQ ID NO: 173353 - protein, 24 aa, Glycine max
  Coding DNA Sequence Number=SeqID_81668
MTANECKSMFYSNYKAIYVSKLKY

SEQ ID NO: 173354 - protein, 316 aa, Glycine max
  Coding DNA Sequence Number=SeqID_81669
MDQDLAMIEVSVEAIASLTQYYDQPLRCFTVGDFHDAILPRKGPVTRAMSKRLQEDWARAAEEGPRVLMNLRSTKFRALLFLSLHSSPSSSKLLSMASYGEAKESIDEGDPRPTSSNGTYIISVGIDCRRVRRDLGMPARRKPYLFSGLYPSMVRVSKVVKISTQELDRVKKNRNRVVGIPRKNLEEKVKALADQGEWTSFIDVLALLVFRIVLFPNVDGLVDLAAIDAFLAYQHNKESPIVAILADAYDMFDRRCEKSRRELSVAHPLFMYGWSPTLFVMKVDPSVPYKVITCLAIHPLSAPLLRLSARKNVEEG

SEQ ID NO: 173355 - protein, 114 aa, Glycine max
  Coding DNA Sequence Number=SeqID_81670
  Subcellular localization annotation: CTP_CleavageSite=36; ConfidenceScore=5.27e-01
MAYQIAKVPRVFDTRFLPFYTTCAIWCTFRKPNSTLCNSRARLTGALSKGGKMREVATNVYLWETSEKPKETGRNENSKFGSCIYVDKSGAFAPTYPPLERKSDLRSSFLCVNQ

SEQ ID NO: 173356 - protein, 201 aa, Glycine max
  Coding DNA Sequence Number=SeqID_81671
MTDRFLAGSLTFDCRIMHYIIVRILLPRPSNLAQASKEDLILMWAFLTGRQIDWPHLVRYRMHKALQANAPIPYPQLVTLFLHHFQIPLDDEPFVQVKHSFAIGAGAATSFGYRKDRNGQWLKKDALQDERTPSPPPQRNDSSTLLTEVISELRCLRTYVGERFNSLDVRFEGMDTRITQLEEDVTYIRQSFDLPPPPPPS

SEQ ID NO: 173357 - protein, 40 aa, Glycine max
  Coding DNA Sequence Number=SeqID_81672
MGGSDNCDCGGVDDDDDDGGGRMMIDPIGQTGSTMTQRSG

SEQ ID NO: 173358 - protein, 90 aa, Glycine max
  Coding DNA Sequence Number=SeqID_81673
MWHKPSFFIVVATYPSAGGRRVTRGMRVPRKEYARSRHQHLFEENVGKTGKDAIYELLSERFGSCIYARGRVFPFAPTYSSICDEEIRPT

SEQ ID NO: 173359 - protein, 231 aa, Glycine max
  Coding DNA Sequence Number=SeqID_81674
  Gene Ontology: Mol. function=RNA-directed DNA polymerase activity; Biological process=RNA-dependent DNA replication
  Homolog annotation: Hit_ID=A5BYV1; Match level="QueryCoverage=36%, HitCoverage=7%, E-value=1e-09, Identity=39%"; Hit description =Putative uncharacterized protein
VPLGVGVQRQATAAYNGHRCSWVVENKVLGFGRRFWEKRRVKIRKNLGLAQPPCTKARLAHLWVAQRNSPRLELGLAQLWPAQCNSPRLELRLALHSRLGVTGAGDGGGEYHQLDGSQCLLLDVMTTQMQHLLNRNNEELYKRIEGLEHQMNPNARRPYGGNRRANDGSNRMEGQNRIEGVKLNVTPFKDRSDPDAYLDCEMKIEHVFSYNDYNEEKKAKLAALEFSDYAL

SEQ ID NO: 173360 - protein, 115 aa, Glycine max
  Coding DNA Sequence Number=SeqID_81675
MELYHTKFDDFKTELERRNLHKRLTNLVDGSIDVALVKEFYANLYSSEGPSPKQARVRGHLVKIDTDSLNIFLETPVVLAEVDTLPTYSRYCRLPLEPREIESALCIPGRGFILN

SEQ ID NO: 173361 - protein, 105 aa, Glycine max
  Coding DNA Sequence Number=SeqID_81676
MADTTNKSHIILLSNSLPIDTQSMAFLGETSSQTIVNSRLAFIFPNGSIIHNDTGVYFQTSTPVPIRVPNSCDFASLKTRIHNTLQLSDKEFLDEIHYRKPFTDT

SEQ ID NO: 173362 - protein, 122 aa, Glycine max
  Coding DNA Sequence Number=SeqID_81677
  Pfam annotation: Domain name=G-patch; Domain location=60-104; Score =12.5; E_value=0.0059; Accession=PF01585.14; Description=G-patch domain
MAEGQLVIVLGEEKILVSCPSSTPYVEATKESLETSFQALEIVDNAYMEAPPMQSHLSGASLMVARVMLRDGYEPGMGLGRNSDNTTSLVRFIENHGRYDLGYEPTQADKRRVALERKGGIL

SEQ ID NO: 173363 - protein, 110 aa, Glycine max
  Coding DNA Sequence Number=SeqID_81678
MNASKLMGGGCMNENAIHEAPKKGRDWRIALKDHYARLQTRGRRMNERSKLLGGICMNENAIHGDSKKGREWRIALSNHYAWLKTSGRRMHERKRNSWGSEKRVENGELH

SEQ ID NO: 173364 - protein, 99 aa, Glycine max
  Coding DNA Sequence Number=SeqID_81679
GIGRIKRILRLCRVEFFDKGDTKEFRRLVLPSFGKERRETQKEFRRLVLGEFFLAKGEENEKMNSTSFQVLENQKPSESFWYKEEEEELQRDFKACKEL

SEQ ID NO: 173365 - protein, 155 aa, Glycine max
  Coding DNA Sequence Number=SeqID_81680
  Homolog annotation: Hit_ID=Q2HW90; Match level="QueryCoverage=30%, HitCoverage=10%, E-value=2e-09, Identity=54%"; Hit description =Putative uncharacterized protein
MAPIPTRHKAPVSAPKLSLKEGKEEVLFSCGDYPNIPLIGTRGCINYNLELAIRQLGYPMRGAPTEESLSPFLVRDFGVQSFKINIHLKNQDSRFKFKNQDQDSRLKISRIKIKISRIKIKIQESRIKTQDLKISRIKIKIQDSRFKNEEKTQSR

SEQ ID NO: 173366 - protein, 40 aa, Glycine max
  Coding DNA Sequence Number=SeqID_81681
MALREVSMMPKYYPKMVVIIKKGENMNEYHTGFGDAKKVT

SEQ ID NO: 173367 - protein, 131 aa, Glycine max
  Coding DNA Sequence Number=SeqID_81682
MSLATLFGKLQEHEMELMRLHQHEENDIKRKRIAFRASSSFIQEESDKEDLTEIEEDDDDFRLFVKRFNKFLRNKRNKRKSNINTKKKEEDSSLAPSCYESNQPWHMRSDYLVFERRIEKSDKRNLKKKKA

SEQ ID NO: 173368 - protein, 61 aa, Glycine max
  Coding DNA Sequence Number=SeqID_81683
MERRKRPRMSWLEKTERRQVQAKGRRCHIHCENIIVEGNCSVVIQRILPPKHKDPETVTIP

SEQ ID NO: 173369 - protein, 97 aa, Glycine max
  Coding DNA Sequence Number=SeqID_81684
MKQGFTVNVIQRCFDKNNDDKGDKQKAQRSKNNSSESKNISSESRTSQEFKNQEEFKTQEESLESRIKIQDSRSQESRSRFKTQDSRMNKILNQDKY

SEQ ID NO: 173370 - protein, 64 aa, Glycine max
  Coding DNA Sequence Number=SeqID_81685
MGQNTPKDYDDGWLKFPQSQTPPPFATSWMWKGYLVKISYKAPVESCMTKKRSHLSHARGVRQL

SEQ ID NO: 173371 - protein, 101 aa, Glycine max
  Coding DNA Sequence Number=SeqID_81686
  Homolog annotation: Hit_ID=A5BIE2; Match level="QueryCoverage=78%, HitCoverage=22%, E-value=1e-08, Identity=34%"; Hit description =Putative uncharacterized protein
MKSFQDYDEDQANLCLMTKSHENNKEEFVRKKWYIDSGCSKHMTEDVSKFITISPKKSRHLTYGNNNISKISKELEVENGSYWKLKVENGNGSYWKLEVGI

SEQ ID NO: 173372 - protein, 88 aa, Glycine max
  Coding DNA Sequence Number=SeqID_81687
MSNHKSTESALKNLEVQMGQLAKPIADKSSNSFGANTENNPKEECKAVMTMSKRFVEAKDEENVVEKEQLSAKVGAEVKKNDVKGNWK

SEQ ID NO: 173373 - protein, 60 aa, Glycine max
  Coding DNA Sequence Number=SeqID_81688
MDICEDNDIPVILGSPFMLTASYIVDIGRKKLELGFEDQKIDFDLFVEDKPALEQNVCLQ

SEQ ID NO: 173374 - protein, 174 aa, Glycine max
  Coding DNA Sequence Number=SeqID_81689
  Subcellular localization annotation: CTP_CleavageSite=61; ConfidenceScore=5.51e-01
MDGSLGQKIGLARGRNLKSQRLLIVGRKRSYFRLSVRDRGSLNQTSRGNGPLQPTRTVWTTLSMRNTAYARKNGPSFAKLVETLLERYKLLVEKTKKKLEEATQSGSVDGVIDPPSPVRSHVKRKMARTKKTGEITTEAAKEIAEKIDSFEELASQGSFVPMDVRMFSPLLLDV

SEQ ID NO: 173375 - protein, 81 aa, Glycine max
  Coding DNA Sequence Number=SeqID_81690
LVVSFKTRKGKQGSKGLSKELIQASTRIKPRLLCKQSMGQNTPNDYDDGWLKFSQRALGRRLQVDWARDPREGPKVLMSLR

SEQ ID NO: 173376 - protein, 173 aa, Glycine max
  Coding DNA Sequence Number=SeqID_81691
SKKNFYTANHSGISASHRDSNVSMTDLVSAEDDAFGLTDSKKNVYTANHSGISAGQCDSNVSMTDLASAEDDTAKKNVYTDKHSGISAGQRDSNFSMADLVSAKNDVNLRVPTGLSAAIDEGRRRRCQSSHAIRLFVLQTAKKNVYTDNHSGISARQRNSNVSMTDLVRAEDD

SEQ ID NO: 173377 - protein, 31 aa, Glycine max
  Coding DNA Sequence Number=SeqID_81692
MDEPIPNRLKKCSLCRTEGHNRSNCPYKQII

SEQ ID NO: 173378 - protein, 115 aa, Glycine max
  Coding DNA Sequence Number=SeqID_81693
  Subcellular localization annotation: CTP_CleavageSite=61; ConfidenceScore=5.77e-01
MKQVSIKASFSGHASQGCQQSFQPLGFSSYIPQYSFQVPSTSNVFYGSSQMFATTFNTPPSAYNLAPSSSCYRPSLPTQIRDISHKDEDENKDEDEDNNNNNDDDDDDNNGHHVP

SEQ ID NO: 173379 - protein, 123 aa, Glycine max
  Coding DNA Sequence Number=SeqID_81694
MLLIVNGAFNVKLMVKIRGLGRTLSRVIGRALGREPQEAIVDDVVANVESFLGESHDTSVLMDYVYHVALTVWNGERWYEKTSSFHLSEEEVTITLDDLASSLHLLIERIERLLNLRIVTEGT

SEQ ID NO: 173380 - protein, 225 aa, Glycine max
  Coding DNA Sequence Number=SeqID_81695
  Gene Ontology: Mol. function=hydrolase activity
  Homolog annotation: Hit_ID=A2Q1D6; Match level="QueryCoverage=97%, HitCoverage=42%, E-value=7e-26, Identity=31%"; Hit description =Ovarian tumour, otubain, related
LFLRCDAFLGIIAIDKDLALVNAVKIVFLKTTNLLCQFHIDKNVKAKCKTLAGKNNAWDYVMEAWGSLVYCPSEQEFDECFKKFEIVCSPWPMFVDYVNQTWLIPHKERYALNQIAAEFEHVHYVDKNPSRYGCIMRTTHGLPCACELARYVVGIMPLETIHMFWRRLSFSDQGLSELEVSIIKEMETISKRFEELDVCGKVTLKSTLWEIVYSDLNSMCAPPEK

SEQ ID NO: 173381 - protein, 437 aa, Glycine max
  Coding DNA Sequence Number=SeqID_81696
  Gene Ontology: Mol. function=protein disulfide oxidoreductase activity; Biological process=cell redox homeostasis
  Homolog annotation: Hit_ID=Q2HVR5; Match level="QueryCoverage=91%, HitCoverage=90%, E-value=3e-89, Identity=47%"; Hit description =Thioredoxin fold
  Pfam annotation: Domain name=Glutaredoxin; Domain location=274-344; Score=53.2; E_value=9e-13; Accession=PF00462.15; Description =Glutaredoxin
MGCANSKPKGCQHCHCNTPYYSSSMARSFSVHVHHPPQTKGDSYHVVALTSTTLGSLDQDVPHNNNYHGNGLRFPNGKVIGSDSFRPQNQDHDDDDDDDEVEVEEKKNEPKTWSEMIEQMLPKAMMKSPISTPPCEPETINTWELMEGLEDTTSPFRSPKHFKSFSFDVNVNRHVDVADVDPPLIQNGNDSAKPISVSDSDDEPQENQESMDRKRFFSIEEEMISDDVVSSFKKSSQEKQEGMDRKGFSVGEEKISDDDDVVVDLKSCGKDKVVLYFTSLRGVRKTYEDCCHVRLILKGLGVRVDERDVSMHSGFKEELKELLGHGYGKGGLGLPRVFVGRNYIGGAEEIQQLHEEGKLEKLLDCCGKIEDGIDGDGLCEACGDVRFMPCETCYGSCKIYYEGDEEEDYDGEVVRFCLYSEVLVWLIMLEKKKEIKE

SEQ ID NO: 173382 - protein, 179 aa, Glycine max
  Coding DNA Sequence Number=SeqID_81697
IERQRGISEDHIENLVSIVIIHRPYFMEQGKLWSRNEAQVWGTFEVYPLEESYRHQLARHLCEINNYSYKNVDPNLPSSSQRPKESYPTDRIIPQNTDDGQIRTEFYVPEPEFQKAEDLADDYSSLEQDWKDYNAQLMEDLLHKKRYRYHHPMYRSLTRSEDKDDRNLILVIVCHVSVV

SEQ ID NO: 173383 - protein, 68 aa, Glycine max
  Coding DNA Sequence Number=SeqID_81698
  Gene Ontology: Mol. function=sequence-specific DNA binding; Cellular component=intracellular; Biological process=negative regulation of transcription from RNA polymerase II promoter
  Homolog annotation: Hit_ID=A7QMG3; Match level="QueryCoverage=82%, HitCoverage=17%, E-value=2e-22, Identity=96%"; Hit description =Chromosome undetermined scaffold_125, whole genome shotgun sequence
  Pfam annotation: Domain name=CBFD_NFYB_HMF; Domain location=12-68; Score=52.2; E_value=1.8e-12; Accession=PF00808.14; Description =Histone-like transcription factor (CBFNF-Y) and archaeal histone
MQKLEEVGSSVKARIKKIMQADEDVGKIALAVPVLVSKALELFLQDLCDRTYEITLQRGAKTMNSLHL

SEQ ID NO: 173384 - protein, 92 aa, Glycine max
  Coding DNA Sequence Number=SeqID_81699
MENSKKKKEKRRKNKFFGINKYLNHMITKDDDKKLKGQSKNEFKIFKIESRTLQDSRGKLISRIKIQEIKISRIMIQEIKIQDSRFKNQEKA

SEQ ID NO: 173385 - protein, 73 aa, Glycine max
  Coding DNA Sequence Number=SeqID_81700
MEDISFSPEGIYPISSPINESPSPSPSPIDQTHSPIQVDLAPSPSPVNVDHTPSPHEDEVNNVEAQGGICRLK

SEQ ID NO: 173386 - protein, 330 aa, Glycine max
  Coding DNA Sequence Number=SeqID_81701
MAPRKLASKRSRKDKAAEGTSSAPEYDNHRFRSTEHQQRFEAIKGWSFLWERRIQLRDDEYTDFQEEIVRRRWASLVTPTAKGGRARYAILGEGSVDPVRCGCSQPVPGIPFSAGGGLGMRVWPEEEPDFSRTAAGRRVRIMHTNMTTPTQIWMTLLLSNIQPNDHNSDLPLPKCQLVYAILTRMSIHVAQLIADAIYIFAGMAPIRHPLDPDKSNRALGFPALITGLCQSFGVPVTPSKVIRPPITRAFIEKYCTQRQVQGDAPQAADAPPPHQAGPAGLFDTEQYLRHLVCQQAANHRAHPAEPGLYFFSVPYSGPVQGKGRMAWRLA

SEQ ID NO: 173387 - protein, 171 aa, Glycine max
  Coding DNA Sequence Number=SeqID_81702
MEKEERCVEASFMMMNQAILMMPKAQMIDSRFQDQASRIQSKIQDSREEIKKQQVETSYRIRYILYGTSRAYIYLGCNTENKRGYISCGSVQVEHTSTWCFKENKGGYIPCGSLLVKDFTRLLEISRTDGCLGTGCRHGLLLNQYKSCVCLLLPYTFIFPLCTFDFRFTFV

SEQ ID NO: 173388 - protein, 98 aa, Glycine max
  Coding DNA Sequence Number=SeqID_81703
MSFPETHKGLMNDASSSNFNPQFDYITEDYNMGFPPREKVITPVDLTLGENIKSKGKRMSIEPTFNMPSLLSNIGSIDPQLLPNYIEQWNSAVIRDYK

SEQ ID NO: 173389 - protein, 54 aa, Glycine max
  Coding DNA Sequence Number=SeqID_81704
MGEIVEAMSSKVILMMPKNQESSKIQRFKNQVSRIKIQDSSFTNQDSRIIQIKI

SEQ ID NO: 173390 - protein, 123 aa, Glycine max
  Coding DNA Sequence Number=SeqID_81705
MCNQLQQGRLSVIDYQKDRSFLIGVGVVASFGYHKECDGSWVKMGAQPNDDEGHFPVEGDPSLLQSILDRFDGLQTYVGERFDSLERQVDTRFEVMNSRIAKVEEDVTIIRDCFDLPPPPPSV

SEQ ID NO: 173391 - protein, 40 aa, Glycine max
  Coding DNA Sequence Number=SeqID_81706
MSKRLQEDWARAVEEGPRVLMNLRGTLEIKGTLPYKLRVP

SEQ ID NO: 173392 - protein, 19 aa, Glycine max
  Coding DNA Sequence Number=SeqID_81707
VDLETVEPQAQQSEQTSGF

SEQ ID NO: 173393 - protein, 57 aa, Glycine max
  Coding DNA Sequence Number=SeqID_81708
MSVMVSMGRSLTFKARRKDGLNTHQDLVEKACYTLSRNEKMSFCQCMCHVKVPQGYS

SEQ ID NO: 173394 - protein, 210 aa, Glycine max
  Coding DNA Sequence Number=SeqID_81709
  Subcellular localization annotation: CTP_CleavageSite=49; ConfidenceScore=5.65e-01
MATPPSSPPPPPPPDSTSHSPSTMKRTRKVTRLRSLATRPVGAEKPLVQVDPATGKANGPHRKKLRTYLGIVTRDKVDVTYENWKQAGFDIPEASDLRMKNKILQTMGKQWRQFKTDSTLKWDVRKKAQTIQKQNIASHVLSCEGCEFLENKLMEEKKTKQLEEAAKFGSTNIVIDPPSPIRRHMKWKMACTKKTDQMTSEATKEIDDKI

SEQ ID NO: 173395 - protein, 36 aa, Glycine max
  Coding DNA Sequence Number=SeqID_81710
MGLTENKRGYISCGSVLDFYKVERNLKDRRSLGDWM

SEQ ID NO: 173396 - protein, 90 aa, Glycine max
  Coding DNA Sequence Number=SeqID_81711
ELKLCMPSDSRERKVQVPESFERFCCVKIYRDQSLKRKRLPGYGKLKSSVGSSLGNWSDSDDLDRTGLSCHTITRNEGRGREEHEILCSK

SEQ ID NO: 173397 - protein, 770 aa, Glycine max
  Coding DNA Sequence Number=SeqID_81712
  Gene Ontology: Mol. function=siderophore-iron transmembrane transporter activity; Cellular component=cell outer membrane; Biological process=siderophore transport
  Homolog annotation: Hit_ID=Q8VRJ1; Match level="QueryCoverage=86%, HitCoverage=93%, E-value=0.0, Identity=96%"; Hit description =Putative uncharacterized protein
  Pfam annotation: Domain name=Plug; Domain location=8-120; Score=96.5; E_value=8.5e-26; Accession=PF07715.6; Description=TonB-dependent Receptor Plug Domain
  Pfam annotation: Domain name=TonB_dep_Rec; Domain location=418-667; Score=111.8; E_value=2e-30; Accession=PF00593.15; Description=TonB dependent receptor
  Pfam module annotation: Pfam domain module=Plug::TonB_dep_Rec; Domain location=8-120::418-667
MAQPTGLTELGSPVSVSVIDGEDLRNAAPQINLSENLGSVPGLQIQNRQNYAQDLQLSIRGFGSRSMFGVRGVRMYVDGIPATMPDGQGQTSNIDINSVERIEVLRGPYSALYGNASGGVINVDTITGTQPPTLEAGGYFGSDNTWRYGVKATGATGDGTQAGDVNYAISGTRFTTQGYRDHSAARKNLGNGKLGVRLDDVSTLTLMFNSVSIDAGDPGGLTEAEWKENPRQAPRADQYNTRKSLDQTQAGLRYQRQMSERDELTLTAYHGERHTTQYQSIPMGPQLNPTHAGGVIVLERKYQGIDTRWKHEDTLASLPVTLIGGLDYETMTERRQGFENFILRDGTVDYGEKGDQRRNEKNRIWNLDPYLQTSWQLTPHWTLDAGLRYSTVSFDSTDYYITPLNGDDSGSKRYHQWLPMGSLNYKINPAWNLYLSAGRGFETPTINELSYRPDGQAGLNIGLQPSTSDTVELGSKLRLGNGLVSAALFQTETDNELVVAESSGGRTSYANAGKTRRRGLELALDQEFALDWRLNMAWTLLDATYRSDMCGKSGCTPAGNRLPGIARNMGYASLAWAPPEGWHAGAELRYMSDIQANDANSAQAPSYTVAGVNAGYRFTWNRWALDVFSRVDNVFDRRYVGSVIVNEGNGRYFEPAPGRNWGGGATFVTIAAYRHNGAICRAERALSARRRHLAGQVGRFAVLHHRRAGAAGDLLAAVPPPRHRAAAVRGIPAGHHYLGPVGSRPGLLGADAAPGRHLLLRPVAGAAVYL

SEQ ID NO: 173398 - protein, 97 aa, Glycine max
  Coding DNA Sequence Number=SeqID_81713
MPRQARKPRKEQQQQLAADAPPPPLQQPSSLESISAHMQRMELYMQHLDDQQAANHRALGSQSLPMAYSQAVRGHSCIAWRQTQFSGKGRARRGPRR

SEQ ID NO: 173399 - protein, 89 aa, Glycine max
  Coding DNA Sequence Number=SeqID_81714
KNESYAKQANKNRKEVVLEPGDDPGHLRENAFQEGGNDENPKTGQIQAKGPSGEGQSPRVETDEGQVEKDEGPETETLSRLLTIVKCPD

SEQ ID NO: 173400 - protein, 30 aa, Glycine max
  Coding DNA Sequence Number=SeqID_81715
MWVFDPEPCLRGIDEQGQKGIFKWRGEESA

SEQ ID NO: 173401 - protein, 64 aa, Glycine max
  Coding DNA Sequence Number=SeqID_81716
RPVRVTLFCENTPTIWDQHRLKGALKPGIFTHKAYTPKSPSGPLPLDSGPTQKTYLHINSIYEL

SEQ ID NO: 173402 - protein, 113 aa, Glycine max
  Coding DNA Sequence Number=SeqID_81717
MGSSWNQWVFHNKKFQQVQETLSKASSIQLPSESVLHRPGFKPKSWIHLPKGFIKANFDASTGLGVLFRDQSGEILAAASLLLPHCHDPLTVETIAFRWEIDNFGFLLCHLRI

SEQ ID NO: 173403 - protein, 155 aa, Glycine max
  Coding DNA Sequence Number=SeqID_81718
MLLRKGFHQVKVKYGSNQLAKVGAKDGLSLHSFFGYCQHMIELRTDEGRHGGHERANDHNDGRLDEYEKNDGGQHDYNRCCKYRHEVDPTHPSGLNQVNHPVSNMVQSKHSFPPYGLPPNYASPNVAHTPNENVDNSAPIPIKRQQPQFGHAQVP

SEQ ID NO: 173404 - protein, 172 aa, Glycine max
  Coding DNA Sequence Number=SeqID_81719
VRLLGLLTENKRGYISCGSVLVEGTSTSLFKENKGGYIPCGSLLVKGFLQGSIQAYADEMNFLSGAEMVINATVWKEVARMDMGGVRKFEESADGYNKMQTYRSTLLDPTRNLRNRVGVGDLTAEDIMLIQTQVDVPSTCTTKDVPSNVLRQRSQAVKPLILCEWGYKRILR

SEQ ID NO: 173405 - protein, 94 aa, Glycine max
  Coding DNA Sequence Number=SeqID_81720
MSSPANLTVEISSPQRGSGMLASMKNDKHKHKPHITKVYTRKQRAKEAITMNHQQQGAQNPRGTNHPTVTTHPKGVNHPTVTFHPKGARSEDVN

SEQ ID NO: 173406 - protein, 143 aa, Glycine max
  Coding DNA Sequence Number=SeqID_81721
MVVATPRVFLPWKMHSRASSRPPTEGKSEDPYHFLKCIHGALHCQMLQVRRDNLSGSRVHKIHLCHASHKHLFMHSSISPMVDVRVVLHAGLFHSSEHGIKSNTFVQEKVISSQNQELRGHQSARVGAIDGSTSTKSLSQSLW

SEQ ID NO: 173407 - protein, 189 aa, Glycine max
  Coding DNA Sequence Number=SeqID_81722
MGLKRKKGSDDQLLARGGGRFDGGDLSGEGSRTVVGGGGGGLIAGLLKAQYFLDPLFRHTTWSNDSQGSDFHWSTGSDDSGKCIIRYGLRRNFNHQRFNNINLWSKMSIKVIEQLLRFELLLLLLDSDLFLYIHELPVGLVLLAFKFRSHALSWNPMVLIRREKALLKFRMVCAGCANDSSYCCFRITV

SEQ ID NO: 173408 - protein, 134 aa, Glycine max
  Coding DNA Sequence Number=SeqID_81723
MASGKRRASTFRPQEPYDTSRFVSEVAWERYEQNIHARNILPERNVELQVTQYDEFRQELERCRWHRVLTRQLDNHIDVALVKELYANVFDPEEKSPRQCRVWGKLIKFDVVILNEFLETPVVLEPREQYSTYS

SEQ ID NO: 173409 - protein, 133 aa, Glycine max
  Coding DNA Sequence Number=SeqID_81724
MTKEEGHEMRDFDNHCHNQSHWPACPPVQIRLAMLDWSSDGSFVGAPPLEGEGKARSKGASSVGELETSPLDPVLEEKVLGLGVGSKLLVERPRDDYMGLETLLMIIKVEIVVSRKKGKHQVVIHMIHKRLSN

SEQ ID NO: 173410 - protein, 161 aa, Glycine max
  Coding DNA Sequence Number=SeqID_81725
  Homolog annotation: Hit_ID=A2Q3G4; Match level="QueryCoverage=77%, HitCoverage=28%, E-value=3e-12, Identity=36%"; Hit description =Ovarian tumour, otubain
MVSRYALNHIVAEFEQVNYTGIANSCCGYIMRTNHGLPCAYELSRYVVGSIPLDTVHMFWRRLRFSNQGLSESKVCITEEMKAISKRFEELHVCGKVTLKSKLWEILYLDLNSMCASPEKVKTKGMGEDSWSLVRNHLLKEVVQWFDEYIDLLGGIDKYEH

SEQ ID NO: 173411 - protein, 356 aa, Glycine max
  Coding DNA Sequence Number=SeqID_81726
  Homolog annotation: Hit_ID=Q5XM22; Match level="QueryCoverage=30%, HitCoverage=94%, E-value=4e-14, Identity=31%"; Hit description =Resistance-like protein HAAS-2
MREKPFNVDDRQHQHAGPKSVLTDYAYHMASKVWAGEVVDLLVELLEVSRQDAKDETEQCRGPYVCLAWLQDIYRSKCDTRQWIIVAQAYVLHLVGCTLFANKSATHISVHATKHLAGYITLLQSWIYGYFPIVANIIANEDYHERKSRACRWKCGKALPVMTNRKHLDRLTPDAFCWIPYVDHHAFKEFELISLFSGHIKWGSSIFSQYLAPIGEFCSFPGQCAACYIEWFYRMSHPFMSLPQLGEPPRHPPMVHDNIYIIPNPLVLPVQTTAMPQLPAPTAVDANMPRHAVVAYQKIVESLEYMINMRMVTTETDAYTLTKHCLRLATSVTEQGNVYVHSRRRRDTQDKDGGGR

SEQ ID NO: 173412 - protein, 471 aa, Glycine max
  Coding DNA Sequence Number=SeqID_81727
  Gene Ontology: Mol. function=glucose-6-phosphate dehydrogenase activity; Cellular component=cytoplasm; Biological process =carbohydrate metabolic process
  Homolog annotation: Hit_ID=Q42919; Match level="QueryCoverage=100%, HitCoverage=100%, E-value=0.0, Identity=78%"; Hit description =Glucose-6-phosphate 1-dehydrogenase, cytoplasmic isoform
  Pfam annotation: Domain name=G6PD_C; Domain location=226-463; Score =423.0; E_value=4.4e-124; Accession=PF02781.7; Description=Glucose-6 -phosphate dehydrogenase, C-terminal domain
  Pfam annotation: Domain name=G6PD_N; Domain location=36-224; Score =338.0; E_value=1.7e-98; Accession=PF00479.13; Description=Glucose-6 -phosphate dehydrogenase, NAD bindi
  Pfam module annotation: Pfam domain module=G6PD_C::G6PD_N; Domain location=226-463::36-224
MGTSEWHIERRSSFGTESPLAREAGNVPETGSLSIVVLGASGDLAKKKTFPALFHLYRQGFLPADEVHIFGYARTKISDDELRNRLRGYLVPNKGASPQLLEDVEKFLQLIKYVSGSYDSEDGFRLLDKEISEHEYLKKSVEGLSRRLFYLALPPSVYPSVCKMIKTCCMNKSDLGGWTRVVVEKPFGKDLESAEELSTEIGKLFEEPQIYRIDHYLGKELVQNLLVLRFANRFFLPLWNRDNIDNVQVLCLVAMEKPVSLRPEHIRDEKVKVLESVLPIRDDEVVLGQYEGYKDDPTVPDKSNTPTFATVILRIHNERWEGVPFILKAGKALNSRKAEIRVQFKDVPAKPNTTRPMNTPIQVKQPGLEMSTVQSELDLSYGQRYQGVTIPEAYERLILDTIKGDQQHFVRRDELKASWQIFTPLLHRIDEGEFKPLPYKPGSRGPAEADQLLEKAGYVQTHGYIWIPPTL

SEQ ID NO: 173413 - protein, 95 aa, Glycine max
  Coding DNA Sequence Number=SeqID_81728
MSVKHLQVVNQGKGGGAKAFTTRENKVMEGGVEEGEEGESLLREEGILGECGGSRGEVSPLIQGHEVKVGEAGLTLDGQGSNTGKRVVARQGNTT

SEQ ID NO: 173414 - protein, 189 aa, Glycine max
  Coding DNA Sequence Number=SeqID_81729
  Homolog annotation: Hit_ID=A7PCL2; Match level="QueryCoverage=31%, HitCoverage=9%, E-value=5e-07, Identity=48%"; Hit description =Chromosome chr17 scaffold_12, whole genome shotgun sequence
  Subcellular localization annotation: CTP_CleavageSite=81; ConfidenceScore=5.04e-01
MLKQFLRKLPRKASKLNSDESCRADSSRSDDSPRVAGKNSHHPGDGGPSSTKKTSSSTVFPTKCNGSETVRMAQSLIVTCHAGTGWAVEDAEDKIMKRGQEAERRKEKETGAGGGERNRCGDVDMRQSTSELNGQRLIENPYLQNPQNYLVTSTSCKTLAHPLVGVPPPNVVVHRVACLSELLPASAFL

SEQ ID NO: 173415 - protein, 212 aa, Glycine max
  Coding DNA Sequence Number=SeqID_81730
  Gene Ontology: Mol. function=hydrolase activity
  Homolog annotation: Hit_ID=A2YMY3; Match level="QueryCoverage=56%, HitCoverage=29%, E-value=1e-42, Identity=67%"; Hit description =Putative uncharacterized protein
MDEYLSLVLQVAISKCYHDTSKVTDELVQIILGPGLEPGAAEVFLEFICYSGGPLPEELVPQVKCPILIAWGDKDPWEPIDNGRNYESFDSVEDFIVLPNVGHCPQESQIFKPTNPDLDLAYIPIVLSHLTRTLAWSSAQQGGWGGFVLKNKLRYLKDVIKQWSKDYGFINAKGIQKIKQKLNEVEDLASNRSLSEDEIKAKRALQPLCFLT

SEQ ID NO: 173416 - protein, 113 aa, Glycine max
  Coding DNA Sequence Number=SeqID_81731
MPELFLRPYQVRWDATVFGVFNLDFPLYIKHEDLSEISHGGQCLSISVLQLWILSGQSQFESESYIKSWMQNSQRDVYLGAYLNGPDNYLKGIINSALKGLDDAPQPKSKASA

SEQ ID NO: 173417 - protein, 101 aa, Glycine max
  Coding DNA Sequence Number=SeqID_81732
MCHLTAYVCVYYDDQICNTNEGTTFVSNNTKTFMVNKLFAIICHNNNPPGNQHGSTSNLEDLSDEYETCWVKNHDSDIDSSSRPEGCNLSPSHEPIFKRDW

SEQ ID NO: 173418 - protein, 106 aa, Glycine max
  Coding DNA Sequence Number=SeqID_81733
MLIPQGTIQNTGDSDKCRLYIEENYPRLVSLGRVYERSTTVHNILLLHDQVKVGVEEFKDEDAPVPVPTNEGAVGPAKPVDRLDHEVDDPLYLMTLTIPRLFLKPL

SEQ ID NO: 173419 - protein, 120 aa, Glycine max
  Coding DNA Sequence Number=SeqID_81734
MVVDEVKMKRCNELHTKKHTSFDDAEKNSLDNDCHHQKGGDCECCFQDHFNKYSMVKHCFKIKTRLLQQTSIASRFIQDQFLPQNTLFPACQGSGNRLPGSVIDYQKISLQISFLTGFEI

SEQ ID NO: 173420 - protein, 134 aa, Glycine max
  Coding DNA Sequence Number=SeqID_81735
  Gene Ontology: Mol. function=RNA-directed DNA polymerase activity; Biological process=regulation of transcription, DNA-dependent
  Homolog annotation: Hit_ID=Q8H6Q8; Match level="QueryCoverage=96%, HitCoverage=3%, E-value=4e-16, Identity=35%"; Hit description=CTV.20
MDKNILDSLFLNIHFHGLDMKEGSIPTALIYRIQYKVMNTCASRVLLQPQKGETTLFITDMTKANVSLPRVIKWDEVTLPEKWVMEKATPSDPRPTPIIEKIKQDNSGKNNLQSGTGVMQSYLARALARRLQVD

SEQ ID NO: 173421 - protein, 33 aa, Glycine max
  Coding DNA Sequence Number=SeqID_81736
MEEEFSLQEKNITMKIIALHVLKALCFKARLGL

SEQ ID NO: 173422 - protein, 59 aa, Glycine max
  Coding DNA Sequence Number=SeqID_81737
AEFDIPEASDVRTKKKIPQTIGDWWRQFKPDLTSKWALAADKDGVDDTVCEKYNISKEK

SEQ ID NO: 173423 - protein, 224 aa, Glycine max
  Coding DNA Sequence Number=SeqID_81738
MKPRGYIESDHVQDDVPYQVEEMSHVNKVIKVESISRLQDLRGGVEEVDLANLLTNEKESNNLNGESNNIEQDNEGKLEDDFEIYHQVVLILPDPCHMTPVGKGQLQRKNDMWLDYYHLEIVCHHLPHSHLLYLSQLGLPMLHLHHLDLRLKLHHLHLMSMHVDRPRFHPSKVAEKAVTLSIRQQFGQPWPTWGAIPKDHQELFFQRFRLEELGQSAYVDEVFQ

SEQ ID NO: 173424 - protein, 84 aa, Glycine max
  Coding DNA Sequence Number=SeqID_81739
  Subcellular localization annotation: CTP_CleavageSite=65; ConfidenceScore=5.54e-01
DLIEAQRSSLHRSPTSKLPLAALAQSSWSLLVMALVTGTFLGMIASGFEFTTLRLAPPSRLAGVSGFELSASRALSLAEDNCCA

SEQ ID NO: 173425 - protein, 148 aa, Glycine max
  Coding DNA Sequence Number=SeqID_81740
MAVQLIRDRVMMECLEGVWETLEGNERCQFRGIVRLTATSLVHPEQPARTLQQPVEWILPTPTPYRLVEPVQLIEVSSSEEDPEGDPEKSSPEPAMHAPDLPEDDEDPLPDVDSPEDIMPAPEADSTEESGPRGMANSDDSSSQQTTP

SEQ ID NO: 173426 - protein, 104 aa, Glycine max
  Coding DNA Sequence Number=SeqID_81741
MVKEECKEVSVSSKRQPPHFLLCKKTLVSIATSLRLEFIPQVKELLDEGLVHKSIKSLCFVGAQNRDSLGVEEKSPEFQEPRDLRSNPFQGGGNDAILPRKGIG

SEQ ID NO: 173427 - protein, 166 aa, Glycine max
  Coding DNA Sequence Number=SeqID_81742
RKVVSIPQGQALDTGDSKKCGLYVDENPPRLVDLGRVYEGSMTIHSFPLGNDQVKDKQGAKGPTKLVDRLDPDVDLLYLMALTIQQLFLNPLQVSWDVTVFRVYNDSFPLYINHEDLLEIALGGQCLSISVIQLWIMHMTETSMRAGNASIYGFLEPQSIQKYGKS

SEQ ID NO: 173428 - protein, 103 aa, Glycine max
  Coding DNA Sequence Number=SeqID_81743
GSIDVAIVKEFYANLYVYDDKFPKQVKVRGHLIKFDVDSLNTFLDTLVVVEQGESLPSYSRFARLRPDPQELTARLCIPRRGFFLNAKGLSWKLLRKDLTTLA

SEQ ID NO: 173429 - protein, 205 aa, Glycine max
  Coding DNA Sequence Number=SeqID_81744
MGPVHGYSRTVDLQGSPLSKYGWPTYMTPSTEDVRRAVRGLFAILQLFMYGLFHTFFAKRISECSLDGDEGLHQLQSRSCYKETWLPYRGAPLEEELALVISRGFDKTNVETLQKVCKAWEVVQKKDKELRGSNNEPIGGYRKWLRAHVQGLDWLPSWRTAKREEVEAPDEDEEVQALRVELEQAQTIKERFKSAALKIRKRMPN

SEQ ID NO: 173430 - protein, 114 aa, Glycine max
  Coding DNA Sequence Number=SeqID_81745
RNTSTWVVVTENKRGYISCGSVQVEGTSTWLFKENKGGYIPYGSLLVKVFARLKRTLKDHRGYLITYSANEGNIQVGRQRRRGEGRHHPLGNKPRKKELHHQELPWIRSLKRML

SEQ ID NO: 173431 - protein, 212 aa, Glycine max
  Coding DNA Sequence Number=SeqID_81746
MAEPSEKRKGSSSRRQRHSEAQETQIPSSIPSSSLFSMEEQRIRYTNIFSSHSIIDPKFIDMDFFSNESFECIQAFENSNLIPFMSLKFPVYTELVKAFYSNLEIQEGTLISEVYGIKMVIDQSLFYDLTQLSSEGIPFEGNLPVGEDSSLLQRILDRFDGLQTFVGERFDALELQVDMRFDEMDSRITKVERDVSYIRTCFDLPPPPPPSS

SEQ ID NO: 173432 - protein, 34 aa, Glycine max
  Coding DNA Sequence Number=SeqID_81747
MWKLIKERMENKVKWWLDRNIEMAITEATGLQMR

SEQ ID NO: 173433 - protein, 27 aa, Glycine max
  Coding DNA Sequence Number=SeqID_81748
MSSKYLANLKMKNVPAITLGRHVKIKE

SEQ ID NO: 173434 - protein, 161 aa, Glycine max
  Coding DNA Sequence Number=SeqID_81749
  Homolog annotation: Hit_ID=Q6WAY6; Match level="QueryCoverage=84%, HitCoverage=27%, E-value=2e-14, Identity=29%"; Hit description =Putative uncharacterized protein
MEVSVEAIASLTQYYDQSLRCFTFGDFQLAPTIEEFKGILGCLIGGRKPYLFFGNEVAGIPRKCLEEKAETLASQGEWVSFMDVLALLVFGTILFPNVDGLVDQVAIDAFLAYHHSKESPVTAVLADAHDTFNLRYLYVPYKVIARVQERIKKIGKNSWQA

SEQ ID NO: 173435 - protein, 36 aa, Glycine max
  Coding DNA Sequence Number=SeqID_81750
HNIKIPNGENGQNWVANKVLKVHNDPTVNESEIVIF

SEQ ID NO: 173436 - protein, 247 aa, Glycine max
  Coding DNA Sequence Number=SeqID_81751
MSQRGSLMPTHIQPDIHGLGARVSTKGSNAESVLNPCLPNDVAPVKPPMGLYVQRQDSIELVALGKTYDGGSTIHNVAYADDVVRVSVEQVIDGDAEVPFPTSEFNMRAVVQLKTLKLLKRSTMLLIDDPLRELIKSLVDIYEKPVELVWDVTKFGIPNATASLFVTCADVNEIISGVQCLNIAILQLWTMYMDQLSQRDGVGSVYGFLEPQAILNANDKRGQCQEYIEKWLKESNRDVYLGAYLNQ

SEQ ID NO: 173437 - protein, 169 aa, Glycine max
  Coding DNA Sequence Number=SeqID_81752
MTTLTQIWMTLLLNNILPNNHNSDLPLSMCQLVVPVIPSKVVRPLITRAFIEKYCTPRQAQGDAQQAADTPLPQQPDLAANHHGQVQLHECFYHFSLSQQGQGSTLFVCPTPEQFGAEVMWPRDWPIEEGTKPAGSPSEAEEAHMDEDMTDLLGYLGEGKATRLRSPHL

SEQ ID NO: 173438 - protein, 118 aa, Glycine max
  Coding DNA Sequence Number=SeqID_81753
MSLHEAHHHRRPWIRAWRNKEMNEGRGREEHEILYSKRALKSEEHGTGQTIGVGHESHGLYCLKPNLSWRRAFSISLLVLILLNRMALPKGRIGILLRLLEHYYFMSMYLSSIGVMQF

SEQ ID NO: 173439 - protein, 77 aa, Glycine max
  Coding DNA Sequence Number=SeqID_81754
MAIYRKMRELELAQASQLLMAEGISLPRRVGCLGLKAFHDLSELDASLGKLGSRKVHKMTLLPLFPCTFCFLDQNPK

SEQ ID NO: 173440 - protein, 177 aa, Glycine max
  Coding DNA Sequence Number=SeqID_81755
  Gene Ontology: Mol. function=serine carboxypeptidase activity; Cellular component=extracellular region; Biological process =proteolysis
  Homolog annotation: Hit_ID=Q9XH61; Match level="QueryCoverage=85%, HitCoverage=31%, E-value=3e-47, Identity=63%"; Hit description =Serine carboxypeptidase
MAHSSVIVFLCTLLLFFSPSIRASDDDVALHAKKLIRDLNLFPDADVNIVPVANCTLQPRRIVEKRLRFPKLLASDSEPSVEDLGHHAGYYPIQHSHAARMFYFFFESRNRKEDPVVIWLTGGPGCSSELALFYENGPFKIADNLSLVWNEYGWDKGSTYHTSATPYNQVQEFQLTV

SEQ ID NO: 173441 - protein, 80 aa, Glycine max
  Coding DNA Sequence Number=SeqID_81756
  Homolog annotation: Hit_ID=A2Q4L4; Match level="QueryCoverage=75%, HitCoverage=6%, E-value=2e-10, Identity=45%"; Hit description=RNA -directed DNA polymerase
MYINIKQKKIAWVSWTQCCASRDVGGLGIKDLRILNNSLLIKWKWYMFHQPEQLWNRILISKYQGWRGLDQGPHKQHFST

SEQ ID NO: 173442 - protein, 86 aa, Glycine max
  Coding DNA Sequence Number=SeqID_81757
MEHIVQMNGRLKLNVTTTNTGIFSVLEVLKDRKLELLPAMVREQELDVLLKGSIKVHRRSNDDGGRWLTVEDDIERRPVVYTVTRH

SEQ ID NO: 173443 - protein, 282 aa, Glycine max
  Coding DNA Sequence Number=SeqID_81758
MGRATSSKTHKAFGGQGMFYHPIPITMENFSIDHALLDLGASCNLMPRSFLLEKIGHLNLNPTNMTLQFSNGGPQVPIILGRSFMRTTHVTINVRKGVYTLREGKKQILINGQLIWSTMYSLFKEVARLQWGGGCRPARPGELGCFHQKAPPSFGTFRKAENVVKLYGLRNNACFVGSEGSKQDDEGKTCKDFQNNQHRTTNIIPILPDMFALVDEGVDNHEVSPHTTGPLSLTIETRLLCSLGRKKLTSSGKSRPEDADISGKGADDDVSLCVSTGSLASS

SEQ ID NO: 173444 - protein, 103 aa, Glycine max
  Coding DNA Sequence Number=SeqID_81759
MPTFKTFNKKTTMIHNTLHLLHQIRRQKETKKMQKKKECKKRETNDDDDDELREAFSSMYDKSGGSGDNNSCGGCGSNGGGDGSSSSNTDNNNDNDYNNNGKW

SEQ ID NO: 173445 - protein, 115 aa, Glycine max
  Coding DNA Sequence Number=SeqID_81760
MNVLSLRSGAEKPDGLSATHALSQGALSSGMKHTEPRDYEHTKELIKRKGLASSSKPTKNSQKGMNSLSAQGRKGEVGGMGRVGGLRMFTKLPTVMDCTLSTQSDNNNNIKGLRA

SEQ ID NO: 173446 - protein, 49 aa, Glycine max
  Coding DNA Sequence Number=SeqID_81761
MRKSKWRKEYAFPEPRNVVGFNLKIPCASLMVPPFEEVQGRVVIDYNIR

SEQ ID NO: 173447 - protein, 288 aa, Glycine max
  Coding DNA Sequence Number=SeqID_81762
MLLIPHDVSSIGACRPRIFFINGFLCFLEDEWQRNGERNRERRRHFKEKMSLEEAHHHRRPWIRAWRKKEMNEGRGREEHKILHPKKLGMRFVEHEWIMARVPPAVNMGQMKEEAEDEAHQEPVYQWGPSESLMIQKMDAMFHHHQEHSADVHSTLENITTRLESIGTRLTLSNLFNPNEDEAAIGQTIAKLFNWLFRSHQGEPKGEEEEDEVEERTMLEEEMKAQANPSTQGMQSSLNPPLFDFSKLSIHKQEDCERMAKFEKYMEMLQGKKEEPPIEKLTWDVLHQ

SEQ ID NO: 173448 - protein, 323 aa, Glycine max
  Coding DNA Sequence Number=SeqID_81763
  Gene Ontology: Mol. function=serine carboxypeptidase activity; Cellular component=extracellular region; Biological process =proteolysis
  Homolog annotation: Hit_ID=Q41005; Match level="QueryCoverage=36%, HitCoverage=40%, E-value=3e-45, Identity=78%"; Hit description =Serine carboxypeptidase-like
  Pfam annotation: Domain name=Peptidase_S10; Domain location=8-183; Score=-228.4; E_value=0.069; Accession=PF00450.13; Description =Serine carboxypeptidase
MKNERAAPRGRMEEEEALEGGRSSSSRRRRITKKKKSLAEEGEEEKPRGKEEEMARWQQPFSSMEKFLNQNSVRDSLGVGKIHFVSCSTKVSLAMFVDWMRNLEIGIPPLLEDGTNLLVYAGEYDLMGNWLVGNSRLVRAMEWSGQKEFATSLKVPFVVDGSEAELLKIYGPLSFLKVFFFSLYPTYTLSLLQTGLRFRDYNHIVEFVFVEFVSATYRLSSKKTGKGKSPRKGVNRFWKSIVVGLKTPRAFFFFLLLPEFVFVANWAALPSKKTRKGKSPGKGWNRFWKSIVVGFKTPREAIKVAVKVRCCFCSVCWLVISAD

SEQ ID NO: 173449 - protein, 55 aa, Glycine max
  Coding DNA Sequence Number=SeqID_81764
MRLKRYRIATAIIPYFVACSAFFAPSKLAPTGAEKREGLEPEKWHASRGRILAFQ

SEQ ID NO: 173450 - protein, 106 aa, Glycine max
  Coding DNA Sequence Number=SeqID_81765
MEDRKSNRHHKQRGLISLDRGSPQELGEFLIRSVGSRKNPSRDNAHTFDKNHNCPLHSVPKVTICSKAFGPFALLLLSWVLLCLVLGLGLPSGHESGSGGCHGLGL

SEQ ID NO: 173451 - protein, 38 aa, Glycine max
  Coding DNA Sequence Number=SeqID_81766
MQWQFQSQKRCKDKLKLTRNKCRTMVTSKENERKCLGR

SEQ ID NO: 173452 - protein, 48 aa, Glycine max
  Coding DNA Sequence Number=SeqID_81767
MAAECRRRKCYWRCHFKENMSQEQAHHHRKPSMVQPTNPRSNPRFSTK

SEQ ID NO: 173453 - protein, 38 aa, Glycine max
  Coding DNA Sequence Number=SeqID_81768
MTVKKRLSHEALEVIVELSSSVGLSAHPRLSIASTHLA

SEQ ID NO: 173454 - protein, 81 aa, Glycine max
  Coding DNA Sequence Number=SeqID_81769
MAASQPTTSGLGACAGIGVADEARLCGSRVLSGRPLWLSGNPLFDGCRIGRVSDMGRIAWLVWGILLSVVRSLLGLRPSRS

SEQ ID NO: 173455 - protein, 164 aa, Glycine max
  Coding DNA Sequence Number=SeqID_81770
  Homolog annotation: Hit_ID=Q6WAY4; Match level="QueryCoverage=74%, HitCoverage=22%, E-value=3e-11, Identity=32%"; Hit description =Putative uncharacterized protein
MGSSQKPSLKKRFYPVKVKSLGITSLRELGRLMGQLQRQAFRKAYGKIWDLAMVEVSTEAIASLAQYYDQPLRCFIFRDFQLSPMVEEFEEILGCPLGGRKPYLFSGFYPSLARISKKVQISAQELDRQRQVENGVEGIPRKYLEQSTLFSPIITTKKARLLLC

SEQ ID NO: 173456 - protein, 100 aa, Glycine max
  Coding DNA Sequence Number=SeqID_81771
MGTNKNGKRLYQVKIKGLDVTNLKELGRLMGPLQRQAFRKVYGKILDLIAAEPLRCFTFGDFQIVPTAEEFEEILGCPLGGRKPYLFFGFLPSLSKIAAV

SEQ ID NO: 173457 - protein, 219 aa, Glycine max
  Coding DNA Sequence Number=SeqID_81772
  Homolog annotation: Hit_ID=Q6WAY6; Match level="QueryCoverage=29%, HitCoverage=11%, E-value=4e-08, Identity=44%"; Hit description =Putative uncharacterized protein
GVEVLAIKISILANMGKVYGKIWDLTMIEVSVEAIASHTQYYDQSLRCFTFKDFQLAPTVEEFEGILGCSIGGRKPYLFSGNTKEVLGGEGGDSGKPKGVAIDAFLAYHHNKESPIIAILADAYDTFNLRCEKSSARIVCCMPGLYWKEGGAGALCSCEGFPNVPLIGMKGRINYNPVLAIRQLRYLMSGAPLEETIAPFIARGFDEANTKMLQRIRKA

SEQ ID NO: 173458 - protein, 354 aa, Glycine max
  Coding DNA Sequence Number=SeqID_81773
  Homolog annotation: Hit_ID=A5ASR8; Match level="QueryCoverage=64%, HitCoverage=51%, E-value=6e-07, Identity=23%"; Hit description =Putative uncharacterized protein
MAEPSKKRKGTSSRSQRHSETQETPIPSSIPSASLFSSKEQRIWYTNLFSSRSIVDPKLIDMDFFSNESFECIQAFENSNLIPFMSLKLHVYSELVKVFYSNLEIQEGTLISEVYGIKMVIDQSLFYELAQLSSEGVPFEGTLIDDWKYEFSVHDARRLVCTNQANMTGKLLAGSLAFESRILHYLIVRILLHEIFKPCSGLQIDWAHLVRYRKHKALRLNAPLPYPHLVTLFLQHFNIPLDSEPYVPIKRSFLIGASVIASFGYQKEHDGSWVKKGTRHVGEEGHDGEDSSLLSKIMDRFDGLQTFVGERFDTLELQVDMCFNEMESRITKVEEYVSYIRSSFDLPPPPPPSS

SEQ ID NO: 173459 - protein, 104 aa, Glycine max
  Coding DNA Sequence Number=SeqID_81774
  Subcellular localization annotation: CTP_CleavageSite=61; ConfidenceScore=5.22e-01
MKVWVIGGRITLVGVTGTPNDCQRPVINARNPRARLDLSGSRGCLVKVVMLVRMIRTRLPVAVRAKSCPGVHNNWAMASSSNPSALSPLTELALIASSNTSGHP

SEQ ID NO: 173460 - protein, 92 aa, Glycine max
  Coding DNA Sequence Number=SeqID_81775
MMLLFRFTCIEIVRVKLGWFICWLRFLTLLSLSQCNGTHIFGILDRLRRIRPSKVGMIPPPGIVPVAGEHKLQDVQLLQIVAQKGKGLCGGR

SEQ ID NO: 173461 - protein, 136 aa, Glycine max
  Coding DNA Sequence Number=SeqID_81776
  Homolog annotation: Hit_ID=Q84VI1; Match level="QueryCoverage=72%, HitCoverage=14%, E-value=1e-35, Identity=80%"; Hit description =Envelope-like protein
MLSQHPNMLNYTDSVMKRESPLSLHYKLFEGTHVPDIVSTSVSTSGKAAASGAVSKDALIAELKDTCKVLEATIKATTEKKMELELLIKRLSESGIDNEEAAEEEGEAAEEEEEAAEEEEDAAEETESDDDSEATP

SEQ ID NO: 173462 - protein, 150 aa, Glycine max
  Coding DNA Sequence Number=SeqID_81777
MAKFDPDIVLEFYANAWPTEEGVRDMRSWVRGQWIPFDADAIGQLLGYPLMLEEGQECEYVQRRNRSDGFDEEAIAQLLCIPGQDFARTAAGRRVRIMRTNMTTLTQIWMTLLLSNILPTDHNSDLPSAEVSAGVRHPDADERPCGSVDR

SEQ ID NO: 173463 - protein, 100 aa, Glycine max
  Coding DNA Sequence Number=SeqID_81778
MAEVSTEAIASLAQYYDQSLRCFTFGDFQLSPMVEEFEEILGCPLGGRKPYLFSGFYPSLARISKIVQILAQELDHRKSPLSKCGWVGGPSGDRRFSRLS

SEQ ID NO: 173464 - protein, 56 aa, Glycine max
  Coding DNA Sequence Number=SeqID_81779
  Subcellular localization annotation: CTP_CleavageSite=39; ConfidenceScore=5.06e-01
MQWMYPVERYMKILKGTMATPPASPPPLPSPPLPPSPTVASVPTSTLKRTHKATRL

SEQ ID NO: 173465 - protein, 144 aa, Glycine max
  Coding DNA Sequence Number=SeqID_81780
MTRGNPGDLQHFDPKIDRTFHRLLRHSVHPDHSMHFEHCEYFEHSEYSVVGDSEYSDFEHSTTNFHTENMAQPQPCERTLREMVALDFTYESLCIQYPDEGVPYVFKTGLIHLLPKFHGLAGEDPYKNLKEFHIVCSTMKPPDV

SEQ ID NO: 173466 - protein, 133 aa, Glycine max
  Coding DNA Sequence Number=SeqID_81781
MASGNRLPMETLEGNQRCRFRGTIRLTATSLVHPEEPARTLQQPVEWILPTPTPYRLVELVQVIEVSSSEEDPEEDPEELPPEPAVDALDFPEDDEDPLPDVDSPEDIMSASEADSTEESGPGGTTNSEDSSS

SEQ ID NO: 173467 - protein, 244 aa, Glycine max
  Coding DNA Sequence Number=SeqID_81782
MGTPSVNEYRHSEVVNKPKESECVESRGTGKGIKANLGEGGVWGGWYGRCPLLVTIITQTVLTLMGHFLRVGTGEGKNGGWAMWMMVIEAGGHGQKLRQRSSSLSSSDDVVGEALKLMECMVIVEELGDLEDPSHGVVAVEMRDVKFDVVVGRKGKKGGGGKGGGEGGGSYNYSCMESRRKERSWWVWVRRRTASSKRLVVLEQGVSSYADAASRIGEIGVPLFAIARSVLGGEKMVPPLSLAR

SEQ ID NO: 173468 - protein, 109 aa, Glycine max
  Coding DNA Sequence Number=SeqID_81783
MTEFVMCCIFQLCCLNAKTRHSDEVKWCINLNLSKFAAPKLIHGSIGWMQYSNMKEGDNVSRQWEQRDSFHVSYLANDNGGTIFSPPSTLLAIANSGTPISPILLAASA

SEQ ID NO: 173469 - protein, 709 aa, Glycine max
  Coding DNA Sequence Number=SeqID_81784
GTSTWVAVTENKRGYISCGSVLVEGASTRLFKENKEGYIPCGSLLVKDFTRLKRYLKDCRLLGDWMRGSSGGDIKASPHMRRSHSVGSLSSPPVVIGYEWVRDDVLKYKSSLTSATSVTALQCQVKLASPEDSWKIVIQACDSDDFPFLRVALGSPPFFFMYKCLFEDHCFKVLDAGVVADGLPLMLNKDGESCFPFYCPLVKQARLANGTMPPSTAAPTEGSQPVVKVGPIVVGIVEIAPTAPSSVLVKRKRDDGVGLSGRKKPRDPSCPKASYKVDTRCGSPFKCARCASDSTNLQGSCEHANCFGWFCCGSLVSHRCTTPLLSVDVATISALMVPPSSSSAPMILPSTALALTSTSSRSYVSLDHIYISNDVDSLSAEFQHATNFAKAKVGKWRATACTIWRVERPKVASATAAFAEAMRLNHQLSSKVGSALAKLLCTKLDSDELSNCYKDLQEEKKNLAKKVDSMAIKKDELAKAAREGKANKELEEELLVYKKEIMEQHEKGFNEAFRQAGFFAEELDLGLFDPFKDVKDGVLLNVEEIVAEEEVAAIMMISVESLTTHEVRPSQNRGKIVVVKGLVTHLVELPSASRSFSLDVFEELNGVLLRTCHSLWVACTRGLMACCHHEWAIPIETKLSRLGIFSGFTLNSSYKVTSLLVDGSPTSTGIMAFMSYTLRLVESSAQGPKDDFVGCLCLTVDLRMFNKGD

SEQ ID NO: 173470 - protein, 86 aa, Glycine max
  Coding DNA Sequence Number=SeqID_81785
  Homolog annotation: Hit_ID=A5BPY5; Match level="QueryCoverage=58%, HitCoverage=3%, E-value=3e-08, Identity=46%"; Hit description =Putative uncharacterized protein
MNYPIKHVLQKPKLTGRMVLALKLNFKASNNQTKRKLLCTKMVRAGYYWLTLEADALDFTKRCRRCQEFADIPRTPPDNLHNLISP

SEQ ID NO: 173471 - protein, 129 aa, Glycine max
  Coding DNA Sequence Number=SeqID_81786
MNELLKLAKGYIQMEEMSRFRNEVRQARQKRDKREGSTKTDLHKLDKRHKPDKSHSLPKGPEYEHYTPLMANHTIILEESFNLEKLLDPKGQDRRAYTGWVLSPAFKKARQPPSRSKTWRTPKGAIEES

SEQ ID NO: 173472 - protein, 129 aa, Glycine max
  Coding DNA Sequence Number=SeqID_81787
MRSFNGDFPPWRCNGRQRRRGERRRHPLGNKPWKKELHHQECVLDKKLEEDALMEEKKERSGEHEIEGIKEGEKWNFEVIQRCFDDNNDDDKGDDKKLKDQSKNNSSESRTIQEFKIRIKKNSRLKKKV

SEQ ID NO: 173473 - protein, 146 aa, Glycine max
  Coding DNA Sequence Number=SeqID_81788
MMMNKCNVEDAVDGVSDVVDELVIVNTNKQVSDYKDTELLMLTYFYFLHPLFASYIRTPTQLQHSNLKCIKNSENRGAYGATLRERACSKRVYVRKSKAEVDCEEDQLEAKDAAPPVPTPLVGFWVIGGTGGTINIFVYWGCRKTI

SEQ ID NO: 173474 - protein, 162 aa, Glycine max
  Coding DNA Sequence Number=SeqID_81789
  Gene Ontology: Mol. function=structural constituent of ribosome; Cellular component=ribonucleoprotein complex; Biological process =translation
  Homolog annotation: Hit_ID=A9P8K6; Match level="QueryCoverage=22%, HitCoverage=22%, E-value=2e-09, Identity=77%"; Hit description =Putative uncharacterized protein
MSLLTSVSEKPISSLSQTGLHFRDCNHIVEIVFVEFVSATYRLRVGIDFGSPLWFALRLPGRSSSFSFCLSSSLSQTGLHFRDCNDIVDFVFVEFMSGTYRLSSKKTRKGKSPGKGGNRFWKSLVVGFKTPKEAIKGDLFVFFSRCQGSLLLVFCVLLSDQC

SEQ ID NO: 173475 - protein, 253 aa, Glycine max
  Coding DNA Sequence Number=SeqID_81790
MGHFTHDSWRWDMRWRRNLFDHESHLAVQFMEEISSVLIQRQEDVGHLFFNCNLTKGLWWESMSWIRVVGPLPITPVCHFSQFYDGFGAVVNHSTRRRNALRGLHIEGSWVDKPAVVKAVVLQHFQGKFAEPSLNKPNLDGVSFNVLSSNQRDIMGFHERWIGWIKGCLSSASISILVYGTPTEEFLSFIVCRSEEWTISTDGNAESRTTKPETDATVMTNTNILIATDLYQQMRLPYTDQYTLIILPQAQGG

SEQ ID NO: 173476 - protein, 112 aa, Glycine max
  Coding DNA Sequence Number=SeqID_81791
MIESFQQQEQMSVLELYIEKDVAGGSMFHSANSVTSCGNNLSNNESEPPRNVSNLHDDEDDYFVSNSYIEESLDEDDSVDDISDTDDKVTDMIQLVTIVHPTEGVEGIQNPF

SEQ ID NO: 173477 - protein, 80 aa, Glycine max
  Coding DNA Sequence Number=SeqID_81792
MKEVFDAVKLSVAVKNEGGFRCSQDHRKPPLAAECGGFREKPRERIGQWRVVAALDKQNLISMDNIVKLQEHYGIHNLLG

SEQ ID NO: 173478 - protein, 214 aa, Glycine max
  Coding DNA Sequence Number=SeqID_81793
  Homolog annotation: Hit_ID=Q9M0H8; Match level="QueryCoverage=68%, HitCoverage=26%, E-value=7e-41, Identity=56%"; Hit description =Predicted proline-rich protein
MASGSSGRGNSASKGFDFASDDILCSYDDYANRDSSSNGNHTDPDDFGTVVCRWVQGLGVALGDVDSGVDFHKSRRMFPTTAYNPPEDSLSQDVIATVEKSMKKYADNLMRFLEGISSRLSQLELYCYNLDKSIGEMKCDINRDHVEQESRLKSLEKHVQEAGSVGPIPWVKVGGALMRVRTYLDAIKSLLGYPSIGMRCQVWGASWGNSLVDF

SEQ ID NO: 173479 - protein, 130 aa, Glycine max
  Coding DNA Sequence Number=SeqID_81794
  Subcellular localization annotation: CTP_CleavageSite=49; ConfidenceScore=5.73e-01
MAFNETRFPYTGLSRPSSVSSNTLSSSTHCSLQFIRLVSSSPTPSPYVSVDTFTSNEHFVSSPPAPDSSSIPIEHFVSAGHLSSNSTLPSIGGITSGKSDLSESAPDRQVFKIKTDESEYRTQGTSLRQG

SEQ ID NO: 173480 - protein, 206 aa, Glycine max
  Coding DNA Sequence Number=SeqID_81795
MKQQVLNFPNTHYLTSITALTNGGFFTNEFGLSHLIDLAHISYHGHHVLKKERDVEKEEKARIQQKAYDDVYKAHASGFNHSLYQVIFHCEVLDESIFDIDKDVYNKQLVLIDDSMEDGALIGWVYPRLKRLFRRVRMFSDLGEREYSGGYFGRQLLINITSSSSYEEVIQERIDDERNEFFLNRIEYSGGNCKKMTSIIVEKRIH

SEQ ID NO: 173481 - protein, 157 aa, Glycine max
  Coding DNA Sequence Number=SeqID_81796
MASSKGCLREPEELGSRVRGPRSNFTSLMGSFAERDSTDFSTFFDSLPEQVANNIIHNIERFANNIIVVMNVVVGPSKHLHRRVITEKEYPPITLPGFSWVDGKVGTFFSRYNDKLDIDNLLRQLTICRIKKDKLFPIDLRTCWTDVDPLDLVFLSK

SEQ ID NO: 173482 - protein, 168 aa, Glycine max
  Coding DNA Sequence Number=SeqID_81797
LAAGVSLSEACAVSENHALNEALNPFSKKGESGGESKKHLRAQRVISSLSEAFVSSCAKTEAQNRARKPKTLAFKRILGLEVNSRFLEAKFDETSENKAIKGNNDKIKVIDGMTNKRKFIRYERIGSVASDVSIEILGLKKVSDLSVPSVVIGGSEFNEKGGCNGYFH

SEQ ID NO: 173483 - protein, 102 aa, Glycine max
  Coding DNA Sequence Number=SeqID_81798
MTGESISPYIWAILLKCQPSRVNQALYLMLEGHALLNRMPQNTPVICTSCIGIVPSGEGRLVDLPERVRIVWETNFVGEAFLVEWEIFVGQAPVATFPSEGG

SEQ ID NO: 173484 - protein, 82 aa, Glycine max
  Coding DNA Sequence Number=SeqID_81799
QGTVSTALGSPAGGQPLGQGQGFVPFACPTPDQFRAEVAWPGDWPEAQAGEAPAEAPGDAEEACMDEEMTNLLGFLGGSRAT

SEQ ID NO: 173485 - protein, 97 aa, Glycine max
  Coding DNA Sequence Number=SeqID_81800
  Homolog annotation: Hit_ID=Q84VH5; Match level="QueryCoverage=39%, HitCoverage=5%, E-value=2e-11, Identity=94%"; Hit description =Envelope-like protein
GKLLLRCCVQGCLIAELKDTCKVLEATIKATTEKKMELERLINRLSESGIDDGEAAEQEDEAAEEEVEASEEEEEAAEEEEDAAENTESDDDSEATP

SEQ ID NO: 173486 - protein, 121 aa, Glycine max
  Coding DNA Sequence Number=SeqID_81801
MSASDHAILRDRVHQPTKKNLLELSTQDVVLAQNKLLSRQHEILTETLSKLPTNLSNGQPLQPSVLQVMGCTICGCTHESDLCIPFEEQTQEVSYMGNQQRQGYNQGGFSGFPQGPYNQQG

SEQ ID NO: 173487 - protein, 64 aa, Glycine max
  Coding DNA Sequence Number=SeqID_81802
MMVLRASHVDLIITFVMHSISKKHALRCPYRMRAKARVKSEIAEVQKQMKADMEAMKEQMTGIL

SEQ ID NO: 173488 - protein, 69 aa, Glycine max
  Coding DNA Sequence Number=SeqID_81803
MKLCFYTLDVLICDHPKEFIFMGQCVNINCAFMFYGFNKDLHSGFLVVVTLTIKDRWPMDGVSFGKQRI

SEQ ID NO: 173489 - protein, 88 aa, Glycine max
  Coding DNA Sequence Number=SeqID_81804
  Pfam annotation: Domain name=zf-CCHC; Domain location=16-33; Score =21.0; E_value=0.001; Accession=PF00098.14; Description=Zinc knuckle
HNFNNGKRSQEVSPTLKCYKCNQLGHIKANYPSNESWPKKNEKKSYKERRSKKAYIAWDDNASSDGSEKEINLLSKDYESDENISQEV

SEQ ID NO: 173490 - protein, 77 aa, Glycine max
  Coding DNA Sequence Number=SeqID_81805
MKSLREKREELEPERQHANRGKISASNKVQFFSSFMAEYVVKSKKMKKKRGGRKRELCWKFLEKEREDLATNCGVPK

SEQ ID NO: 173491 - protein, 79 aa, Glycine max
  Coding DNA Sequence Number=SeqID_81806
MYVLMMSKRNHFIVIIKKGKNVNVRIHDFDDVKEESNKAASKDKHLLQDFFKIKPCLKTKGFKVMQGSGNRLPGSVVDY

SEQ ID NO: 173492 - protein, 152 aa, Glycine max
  Coding DNA Sequence Number=SeqID_81807
  Gene Ontology: Mol. function=nucleic acid binding
  Homolog annotation: Hit_ID=A5AYU6; Match level="QueryCoverage=74%, HitCoverage=20%, E-value=5e-14, Identity=38%"; Hit description =Putative uncharacterized protein
GTSFVVQVEGTSTWVVVTENKRGYISCGSVQVEGTSTWLFKENKGGYIPCGSLLLKDFTRLKRNLKDRRSLGDWMNRLFQDHDEDQVNFCLMTKSHENDKEESVRKKWYINNGCSKHMTGDVSKFTTISPKKSGHVTYGDNNKGKIIGVGKI

SEQ ID NO: 173493 - protein, 82 aa, Glycine max
  Coding DNA Sequence Number=SeqID_81808
MAELSDSKVRESDVTPQALHKINLALSRVISEVWDVGDRLEKDKTLQVLARVVRFFLKIFRGKPSALSSNPLLGIHNRAASS

SEQ ID NO: 173494 - protein, 111 aa, Glycine max
  Coding DNA Sequence Number=SeqID_81809
ARGVQLDSRSLESLSPAINLAYIKKNCWNLDDPTITFRGPRKARGDQPSSSGGGGASAAQEPVTEEPPALAEEQTTPDQTPQPSPSFTPAPEETQPSALDLNEDQPQEEQD

SEQ ID NO: 173495 - protein, 200 aa, Glycine max
  Coding DNA Sequence Number=SeqID_81810
VINLAYIRKICWNPDDLTVTIRGAKRARTRPAEAPSTSTAPPPACTPAAPSAPASADFQRLEAMLQSIHQGQIILLQSLQMVAPPDSIPLVEQFNEWVPQQMEDESPETTTLDPLVRRKKADETQEATATSEKSLEATSEPSKPVADTASPQQETNPSTPEDQTTPVLSPNTSPTATHVLHLTDEEDVQTQDTQDQSQDF

SEQ ID NO: 173496 - protein, 76 aa, Glycine max
  Coding DNA Sequence Number=SeqID_81811
MVSFFLTHLLLEVASPIIFLPSPFRCHDLQEAKDSIDKEDPGLTSSPWSYIMWYQEHLRLSDILLLPLSFCSVNSL

SEQ ID NO: 173497 - protein, 100 aa, Glycine max
  Coding DNA Sequence Number=SeqID_81812
MEAGSLSFNEVLQWKRKREGDVSSIGACRPRIFFINGFLCFLEDEWQPNGERKRERRRHFKEKMSLEEAHHHRRPQIRAWRKKEMNEVRGREDHEILCSK

SEQ ID NO: 173498 - protein, 87 aa, Glycine max
  Coding DNA Sequence Number=SeqID_81813
SNQWCPPPVPYFLLEISILVVPELDASLLEKRPSLDGLEALLVYSTPKAVTVILRSGTSSEILILRTDVVQDVTTSRFRTCRLYMTV

SEQ ID NO: 173499 - protein, 62 aa, Glycine max
  Coding DNA Sequence Number=SeqID_81814
MKMLLIPHDVSSIGASEWRRKTERRRHFKEKMSLEEAHNHRWPWIRAWRKKERERRAPNFVL

SEQ ID NO: 173500 - protein, 76 aa, Glycine max
  Coding DNA Sequence Number=SeqID_81815
  Subcellular localization annotation: CTP_CleavageSite=42; ConfidenceScore=5.08e-01
PPQQQQQPVPPIQNAAGPSKPYIPPPMQQQQSGNQIQVPPPVAAPAPEPVKLHSTPEKEDEIVAQKRKLPNKIFHA

SEQ ID NO: 173501 - protein, 434 aa, Glycine max
  Coding DNA Sequence Number=SeqID_81816
  Homolog annotation: Hit_ID=Q6WAY6; Match level="QueryCoverage=88%, HitCoverage=67%, E-value=4e-26, Identity=26%"; Hit description =Putative uncharacterized protein
RQKQVENGVFGIPRKCLEAKARILAGKGEWALFIDILALLIFGGVLFPNVDGLVDLAAIDTFLAYHDHKESPVVVMLADLYDTFDRRCEKSSTRIVCCTPALYVWLVSHLFCQEVRHAYPLESHRSCIEKGRANWDQLLANKEGASVNWFPRWKEGRTGVLISCRGFSNVPLMGTRGCINYNPILAIRQLGYPMRGAPLEEELAPVISRGFSETNVETIRKVRNAWEVVQKKDKELRGNNNGLIGGYREWLKAHAQGLDWLPSLRSAKREEVEALEEDEEVQALRTEIEQAQTVKERFKSVALRIQKENAELRDVNVATTKALEQETKRARREEHGRNKFRGALWGSNNELKLRREERDQSRVDSLILKDELKACSRSKRSLSQRLCEIETNMLAIISKYQEELSLATTHEHRVADEYAQVYAEKEARGRVIDS

SEQ ID NO: 173502 - protein, 149 aa, Glycine max
  Coding DNA Sequence Number=SeqID_81817
  Pfam annotation: Domain name=zf-CCHC; Domain location=77-94; Score =16.9; E_value=0.0041; Accession=PF00098.14; Description=Zinc knuckle
MELQHLNQNEETDKRKRSIALEASSSMQEEEEKKEFDDEEKFSLFVKKFHKFVKNKRMERCHNFDNGKRSQEGSPTLKCYKCNRPGHIKAHSPTNESWPEKNEKKTHKERRSKKAYIAWDDNDSSDGSEKEINLLSKEYESDENISQED

SEQ ID NO: 173503 - protein, 395 aa, Glycine max
  Coding DNA Sequence Number=SeqID_81818
  Homolog annotation: Hit_ID=Q6WAY6; Match level="QueryCoverage=63%, HitCoverage=53%, E-value=2e-31, Identity=30%"; Hit description =Putative uncharacterized protein
YYDQPLRCFTFGDFQLSPMVEEFEEILGCPLGGRKPYLFTRFYPSLARISKIVQISAQELDHRKQVENGVVGIPRKYLEAKARILAGKGEWALFIDIFALLIFGGVLFLNVDGLVDLATIDAFLPYHDHKESSVVAMLADLYDTFDRPKITGVLISCGGFPNVPLIGTRGCINYNPVLAIKQLGYPMRGAPLEEEITPVISRGFNKTNMETLQKVRKAWEVVQKKDKELRGSNNGPIGGYHEWLKAHVQGLDWLPSLRTTKREEVEAPEEDEEENVELRDVNVVTTKALEQETKRAHREEHGRNKFRGALWGSNNELKLRREERDQSRVDSLILKDELKACSRSKKSLSQRLCETETNMLAIISKYQEELSLATAHEHKVADEYAQVYTEKEARG

SEQ ID NO: 173504 - protein, 25 aa, Glycine max
  Coding DNA Sequence Number=SeqID_81819
MGFKDRSLVCKLNKALYGLKQAPRQ

SEQ ID NO: 173505 - protein, 337 aa, Glycine max
  Coding DNA Sequence Number=SeqID_81820
MAKFDPDIVLEFYANAWPTEEGVRDMRSWVRGQWIPFDADAIGQLLGYPLVLEEGQECEYGQRRNRSDGFDEEAIAHLLCIPGQDFARTAAGRRVRIMRTNMTTLTQIWMTLLLSNIQPSDHNSDLPLPKCQLVYAILTRMSIHVAQLIADAIYIFAGMAPTRHPFGPDKSNRALGFPSLITGLYQSFGVPVAPTKVIRPPITRAFIEKYCTQRQAQGDAPQAAGAPPPPHQAGQAGAFDMEQYLWHLVRQQAANYRAHVQTHDCLYQMSLSMQSQGFASFSCPTPDQFRAEVAWPGDWPEAQAGEAPPEAPGGGEEAHEDEEMADLLDFLGGSGDT

SEQ ID NO: 173506 - protein, 102 aa, Glycine max
  Coding DNA Sequence Number=SeqID_81821
MLWKLGRIDGDPVLRETRIWATWEYVSSVGGGQQGMVGLCAHCGCGKTSCAPSPDRHLVPHVMEWYLEICRGVRRPWGRQVGCYCPKTKLDQSRPNPGIVGQ

SEQ ID NO: 173507 - protein, 152 aa, Glycine max
  Coding DNA Sequence Number=SeqID_81822
MDARVGAVDVEGRSASLALALLALQIETAKLMIRLNRSKVRLSKTTPLALHRAMIREGNPSLVVLDWAIEVIWPEIRAPMFMSMRETRPKINLPLSTIRSEVCDVGARLEYERTLHTWAKVVKSFLTILPGWPSVFKMNPRPGMHKVASISL

SEQ ID NO: 173508 - protein, 335 aa, Glycine max
  Coding DNA Sequence Number=SeqID_81823
  Gene Ontology: Mol. function=zinc ion binding; Cellular component =intracellular; Biological process=regulation of transcription, DNA -dependent
  Homolog annotation: Hit_ID=Q52ZI8; Match level="QueryCoverage=94%, HitCoverage=86%, E-value=3e-55, Identity=44%"; Hit description =CONSTANS-LIKE a
  Pfam annotation: Domain name=CCT; Domain location=266-310; Score =90.3; E_value=6e-24; Accession=PF06203.5; Description=CCT motif
  Pfam annotation: Domain name=zf-B_box; Domain location=29-76; Score =63.9; E_value=5.2e-16; Accession=PF00643.15; Description=B-box zinc finger
  Pfam module annotation: Pfam domain module=CCT::zf-B_box; Domain location=266-310::29-76
MLKEGTNNVWWQQHWHHLVTSNRVASRHKRVWVCEACERAPAAFLCKADAASLCSSCDADIHSANPLASRHNRVPILPISGSLFREPEHNHKRVEHAFVNEVEEEEEGVFDEYEDEVEAASWLLPHPMKNNDEIEENDCGDEGFLFVDEYLDNLVDCCNSCGHNDNQFSNVYQHQQNYNTVPQNYVVVPVQVPQHFQPGLDFDSSKAGFSYDGSLSQSVSVSSMDVGVVPESTVSGISMSHSKSPIGTNDLFPPLLMPSHLTPMDREARVLRYREKKKTRKFEKKIRYASRKAYAETRPRIKGRFAKRTDVEAEVDQMFSTKLFNEVGGSIFPTF

SEQ ID NO: 173509 - protein, 76 aa, Glycine max
  Coding DNA Sequence Number=SeqID_81824
MSKLSSMRLIGVAGVRKHIIEMRDLATQLKSLQEEERLALEIGEGAPTMTQDKGKKEKNHIPSIVKIKKESRCFFL

SEQ ID NO: 173510 - protein, 1029 aa, Glycine max
  Coding DNA Sequence Number=SeqID_81825
  Gene Ontology: Mol. function=hydrolase activity, acting on acid anhydrides, catalyzing transmembrane movement of substances; Cellular component=integral to membrane; Biological process=calcium ion transport
  Homolog annotation: Hit_ID=A7NWV7; Match level="QueryCoverage=99%, HitCoverage=97%, E-value=0.0, Identity=67%"; Hit description =Chromosome chr5 scaffold_2, whole genome shotgun sequence
  Pfam annotation: Domain name=Cation_ATPase_C; Domain location=878 -1017; Score=40.1; E_value=7.7e-09; Accession=PF00689.12; Description= Cation transporting ATPase, C-terminus
  Pfam annotation: Domain name=Cation_ATPase_N; Domain location=92-179; Score=44.8; E_value=3e-10; Accession=PF00690.17; Description=Cation transporterATPase, N-terminus
  Pfam annotation: Domain name=E1-E2_ATPase; Domain location=194-443; Score=186.6; E_value=6.3e-53; Accession=PF00122.11; Description=E1 -E2 ATPase
  Pfam annotation: Domain name=Hydrolase; Domain location=447-782; Score=58.8; E_value=1.9e-14; Accession=PF00702.17; Description =haloacid dehalogenase-like hydrolase
  Pfam annotation: Domain name=Hydrolase_3; Domain location=594-806; Score=-75.8; E_value=0.038; Accession=PF08282.3; Description =haloacid dehalogenase-like hydrolase
  Pfam module annotation: Pfam domain module=Cation_ATPase_C::Cation _ATPase_N::E1-E2_ATPase::Hydrolase::Hydrolase_3; Domain location=878 -1017::92-179::194-443::447-782::594-806
MSMPLLTNLQHIETLLNAPNPTVSASIKRWHSAFMAIYCSRAIMSHSTLKKPNKTKAKASPSPTPTPTPSFTVVDLNPHHSFDIDQTALTDIVKEKELENLDRFGGVEGVAKALQTHVEYGIKGGDDDAEDITRRRQVFGSNTYHKPPSKGFFHFVVEAFKDVTILILMVCAALSLGFGIKEHGIKEGWYDGGSIFVAVFIVISLSAVSNFRQNRQFDKLSQVSNDIQIDVVRSGRRQNVSIFEIVVGDVICLKIGDQVPADGLFIEGHSLKVDEASMTGESDHVEISRQNHPFLFSGTKVADGYAKMLVTSVGMNTTWGQMMSSISQDIDEETPLQERLNKLTSSIGKVGLAVAFLVLVVLLVRYFTGNTKDETGIKEFNGSRTKFDDIMNAVVGIVADAVTIVVVAIPEGLPLAVTLTLAYSMKKMMADQAMVRKLSACETMGSATTICTDKTGTLTLNEMKVTKVWLGLEPVLESAYTKVAPFVLQLIQEGVALNTTGSVHKSNKSGSEFEFSGSPTEKAILSWAVLELNMEMENLTRSCSIIHVETFNSKKKRSGVLLRRKVDNTVNAHWKGAAEMVLKMCSRYYDASGIVKDLDNDRMLKFEHIIQGMASSSLRCIAFAHVEVAEEELVDEEGNAMAKVKENGLTLLGLVGIKDPCRQGVKNAVEACQNAGVNIKMITGDNVFTAKAIATECGILRPNQDTDGAVIEGEEFRNYTHEERLEKVEKICVMARSSPFDKLLMVQCLKQKGHVVAVTGDGTNDAPALKEADIGLSMGIQGTEVAKESSDIVILDDNFASVVTVLRWGRCVYNNIQKFIQFQLTVNVAALAINFVAAVSAGKVPLTAVQLLWVNLIMDTLGALALATEKPTMELMHKPPVGRTKPLITNVMWRNLLAQALYQIAILLTLQFKGESIFGVTSGVNDTLIFNTFVLCQVFNEFNARKMEKRNVFKGIHRSKLFLGIIGITIILQVVMVEFLKKFADTERLNWGQWGICIGLAAVSWPIGWVVKLIPVPDKPFLSFLSKKK

SEQ ID NO: 173511 - protein, 91 aa, Glycine max
  Coding DNA Sequence Number=SeqID_81826
MGHLKFAKLKMGFNQNKKFNTRTQKGIEKCRKKNRGTYRVIVRCGGVGGKEDRKGGNEEKRNMAEMKIRNENKLRKLDPPLAPLVATAIGS

SEQ ID NO: 173512 - protein, 223 aa, Glycine max
  Coding DNA Sequence Number=SeqID_81827
  Gene Ontology: Mol. function=metal ion binding; Cellular component =cytoplasm; Biological process=ubiquitin cycle
  Homolog annotation: Hit_ID=A7PAH4; Match level="QueryCoverage=67%, HitCoverage=54%, E-value=5e-49, Identity=64%"; Hit description =Chromosome chr14 scaffold_9, whole genome shotgun sequence
  Pfam annotation: Domain name=zf-C3HC4; Domain location=150-190; Score= 24.7; E_value=0.00014; Accession=PF00097.16; Description=Zinc finger, C3HC4 type (RING finger)
EVEERVNEREDLGLVVDEVEIEIEGDDGDGNSVASGFTNAVEEEEEEEEEDAGEEALRYLEWEILLAVNNSERNVNGVLEHEGNAVGGADFLTIQDGYVYAAEYDVLFGQFLENESALKGSPPAAKSVVESLPLVELSKEELLQGKNVACAICKDEILLEEKVRRLPCSHCYHGDCIFPWLGIRNTCPVCRFELPTDDPDYEQGKVNRAARGLLELAAARMQF

SEQ ID NO: 173513 - protein, 536 aa, Glycine max
  Coding DNA Sequence Number=SeqID_81828
  Gene Ontology: Mol. function=nucleotide binding; Cellular component =myosin complex; Biological process=keratinization
  Homolog annotation: Hit_ID=A7PAH2; Match level="QueryCoverage=99%, HitCoverage=83%, E-value=1e-115, Identity=46%"; Hit description =Chromosome chr14 scaffold_9, whole genome shotgun sequence
  Pfam annotation: Domain name=Tropomyosin; Domain location=271-489; Score=-93.1; E_value=0.0024; Accession=PF00261.11; Description =Tropomyosin
MSTESAEHDASVVDLEGVAVSSPSGNVMGDLGDVYSTMLTSLDLGLACFSEKVSNLSNFVMHVETKECELEALEKEDHIGEKGLEFDLLSVVLDSEVRELEGVLDTLQGGVDEAREWGCSCTHLGEGFVAMQEKLGDYEQQLKQFEEEFNGIKMQSASFQRNLSSLKKAENGEIIREDDKSLSANAEIKLQTVEQQRHILRMLEKSLAREMDLEKDINDSREIQENLRLKMFFSEQEFVNMEGEAIDVWERWLEADNASEILLGISKGLLGKLHISQFSLNGQSHRESELRANLKDAEDKLTFANSEVSALSNKVSSLEKQLKESEFQLLNAKASADEYQKQYNVKCSEARDMGSVIVELKEAVYNAESRANSAETKCKLLTETNSKLDEELALLRGSSTRAELLERQLKESNLRLQKMTASAKGSQEKQSKLYSTIRDMENVIKDLKSKVSKAEGRADSTEDNCIILSESNAELNEELSFMRSRLESLEGSLQREEEVKMATVEDIGKQAKFFKKLVTQLAVERERLKQKIDALV

SEQ ID NO: 173514 - protein, 70 aa, Glycine max
  Coding DNA Sequence Number=SeqID_81829
MVMTLLTVVVIAVDGHGGSSGCGHDGSSGCGHDNCDENNMTMVMVMERKSAKENCTVPPLFACFPWNHIF

SEQ ID NO: 173515 - protein, 24 aa, Glycine max
  Coding DNA Sequence Number=SeqID_81830
MDDQGDGGTCAANFDRWVWKRFGS

SEQ ID NO: 173516 - protein, 1263 aa, Glycine max
  Coding DNA Sequence Number=SeqID_81831
  Gene Ontology: Mol. function=histone acetyltransferase activity; Cellular component=nucleus; Biological process=regulation of transcription, DNA-dependent
  Homolog annotation: Hit_ID=A7PAN0; Match level="QueryCoverage=31%, HitCoverage=82%, E-value=4e-84, Identity=42%"; Hit description =Chromosome chr14 scaffold_9, whole genome shotgun sequence
  Pfam annotation: Domain name=DUF906; Domain location=766-976; Score =195.0; E_value=1.9e-55; Accession=PF06010.3; Description=Domain of Unknown Function (DUF906)
  Pfam annotation: Domain name=PHD; Domain location=711-757; Score=7.9; E_value=0.0015; Accession=PF00628.20; Description=PHD-finger
  Pfam annotation: Domain name=Pkinase; Domain location=1083-1262; Score=-32.3; E_value=1.1e-06; Accession=PF00069.16; Description =Protein kinase domain
  Pfam annotation: Domain name=ZZ; Domain location=1084-1128; Score =3.6; E_value=0.087; Accession=PF00569.8; Description=Zinc finger, ZZ type
  Pfam annotation: Domain name=zf-RanBP; Domain location=1099-1123; Score=9.6; E_value=0.075; Accession=PF00641.9; Description=Zn-finger in Ran binding protein and others
  Pfam module annotation: Pfam domain module=DUF906::PHD::Pkinase::ZZ::z f-RanBP; Domain location=766-976::711-757::1083-1262::1084-1128::1099- 1123
STILHSRHPNDQGQASVLANFLENRLFVEAASKDEYINRQTIMQRLDTQLKKLYAPKCSQVNSSIACTSQMVPSFGLLQARSNGSVPEPAFHNVAGPITNATNYCAVPVDNKNSFPNGGLSYSSFVPQPVFLPDNHPSIATCTDLDVLPNSFVSGGRSNLKACSKSISSYFPQRQADDWKTLLVKYGDCSRTTTGKSVQSESSNLMTPQDALREFSKVFDLPPVPRSLGDIRQHQHRKRDFQRNLKPFMQPYGLPGKTNMAQPNAFSNQGERCSQMLGHKTLKQPQLFKRSLNGDQQFTSGSSVDLFGLDDSDNMNSCGSSKVSVEQRIMLEYLYLKNFNNISRGNVMKYLHSTVCLKGTCNCGWYIKLLLHFDDCKDDGCRTCYSWKLHGTDILGGHLKFPDIMGSVERKNDAPSGNTEAMLPPEKRRKMEPAFGVPLINNASLDQSTQKMVHPRSSEALSELPLSQKADQEMEMSPNPTANSVHMEDNQGKIRLNQDEINATKEAIKPKVDEEKERKSPNPTLNTAYMEDIKGRIELDQDEINATKEIIEPKVDQEMERMSQNPTVTVDMEGIQAITGFNQDGINATKEVIEPKFDEEKERKSPNSIVNTADKEDTQGRTKFIQHGINVDLEMERKSSKTTHMQADASLNRVQWLKNQEVMFTHANYVEWEHFLLPPCQSIAFVVASASSETHAITIEEKKMIHSIAFAVFALGLLEWVECNKCKCWQHQICALYNDKRDLDYRAEYTCPICRLKEIGNGMHAPLPKTAAMFSANDLPRTMLSDHIESRLFKRLWQEDEDWAKAGYKNLDEVFEAESLSVRVVLSVDKQLKVKKQFLDIFGEENYPSEFPYTLKVSPEVILLFQKIEGVDVCLFAMYAQEFGSECGYPNQRSVYISYLDSVKYFRPKRVTKSGEALRTIVYHEILAAEENIVVGLTNLHDHFFVTTGSCDSKVTAARLPYFDGDFWSGAAMDKARHIEQECGGDYKMIFDKVVSKRCLKSMGHVNPPSEGTAKDILVMHKVLMDDVLGDTKENDIILDNGLFDSRHNFLSFCQRNRFQFDSLRRAKYSSMMILYLVKNPTLLIVGTTCRVCSKNNVSQRYWKCENCPEFTVCSACYNERGASCHAHTLSEAYSPAQSPSGNQELQQNSAMILHGRLSEADSRRYFQQLIDGVDYCHSKGPENLLLDSLGNIKISDYGLSAFPEQGASILRTTCGTTCGSPNYVAPKVLSHKGYNGAVADVWSCGVILFVLLTGYLPFDELY

SEQ ID NO: 173517 - protein, 209 aa, Glycine max
  Coding DNA Sequence Number=SeqID_81832
  Gene Ontology: Mol. function=binding
  Homolog annotation: Hit_ID=A7PAH0; Match level="QueryCoverage=79%, HitCoverage=7%, E-value=1e-79, Identity=87%"; Hit description =Chromosome chr14 scaffold_9, whole genome shotgun sequence
MAYRFYSKKQIGFSSVTERFFMELNTRRIDTSATRSETLSIINGMRYLKLGVKTEGGLNASASFVAKAHPINRQAHKRKSELHHALCNMLSNILAPLADGGKSQWPPSGVEPALTLWYEAVGRIRVQLMHWMDKQSKHIAVGYPLVTLLLCLGDPQIFHNNLSPHMDQLYKLLREGCQEAYVSVDDVRHSGIGIRKLANETLGESRAGL

SEQ ID NO: 173518 - protein, 136 aa, Glycine max
  Coding DNA Sequence Number=SeqID_81833
MKSLRGKEIALVKVQWGPDEGDSTWELEDRVRELETRGTGTRETTRKPMQDFSISKAKSSEAFPSPSRCFFSPSSSPEASIKAPNFTHHFCSKSQKEAIFGVVKRTSTLWDFEFQVWVDFFSHKFLWVLGFGRYDG

SEQ ID NO: 173519 - protein, 138 aa, Glycine max
  Coding DNA Sequence Number=SeqID_81834
MEKGLKPPFGLSSCDSFFSLQEHYLANPNGQSVRNCISNNISKIHNNPTVDETGIVVLPRQLWVSARKERLQCEGFCLFFVVTISCIYLCIGYSHSKKCAETDKQALLKLRDGFIHGRQILSSWKGEDCCKKESHATI

SEQ ID NO: 173520 - protein, 70 aa, Glycine max
  Coding DNA Sequence Number=SeqID_81835
MEDSGVWGEYMMMVMEMGNGNWGVFGWLERNCVATNAKGKNLRWAVTCCADMTQARFEMAIQTKVIIIKV

SEQ ID NO: 173521 - protein, 133 aa, Glycine max
  Coding DNA Sequence Number=SeqID_81836
MLQPYGISIGLKEHSNTVTPKAYTSKSPSGPLPPDSGFTLNTIAYQFHKNWQRLQRQRYFSHLKDDIKIPNGENARNSAANVFLKFYNDPTVNESKIIVFLRQVRWPTGKKEDFGRRKKKRNCEAEEAEESEN

SEQ ID NO: 173522 - protein, 87 aa, Glycine max
  Coding DNA Sequence Number=SeqID_81837
  Gene Ontology: Mol. function=binding; Cellular component =mitochondrial inner membrane; Biological process=transport
  Homolog annotation: Hit_ID=A7QMX7; Match level="QueryCoverage=91%, HitCoverage=19%, E-value=7e-22, Identity=61%"; Hit description =Chromosome undetermined scaffold_129, whole genome shotgun sequence
  Pfam annotation: Domain name=Mito_carr; Domain location=6-69; Score= -7.3; E_value=0.015; Accession=PF00153.18; Description=Mitochondrial carrier protein
MTQVRGVGVSKVVAVMYDGVSATVKEILKEEGWVGLTRGMGPQVLHSACFSALGYFSFETTRLSILREYLRRKELGEREIEVPVSDG

SEQ ID NO: 173523 - protein, 132 aa, Glycine max
  Coding DNA Sequence Number=SeqID_81838
MATPMSTACYLDKDETGQSIDVKQYRGYLNTKEGLSLCGSDIVKGILQDSGTLKRVAWGLDIGTRATCPTTGGSGSMLQHKLSCWRSAPIQLLALPTILDTCGRGGREVGSMGEEVPHQVKEYKVYKENVEH

SEQ ID NO: 173524 - protein, 202 aa, Glycine max
  Coding DNA Sequence Number=SeqID_81839
MTSTSGDATPPSPKTTRIMAEMIKHGNQMRRMIYEDKEMMERMRKKNGESFRRIHKSNEPLIVRVENIKRREDRSSNSSHAKDEGYEEDEGGRRNERYRERRNHRRYGGRQREKGIEGVKVKIPTFKGTYDPKVYLKWEMESNIQLTRELPYNEEGPPICRHKTLEYDPRPLAKSTCKSQDSIQLKAFLAHSRRKHQYHSSK

SEQ ID NO: 173525 - protein, 58 aa, Glycine max
  Coding DNA Sequence Number=SeqID_81840
MGEEEKKPEENKVEEKKAEEEEKKEEEKKPEETKDDKESKEESVPPEIVQGITFAHWC

SEQ ID NO: 173526 - protein, 50 aa, Glycine max
  Coding DNA Sequence Number=SeqID_81841
MDNTKGNQKSLAEIMGSSQKSLAEIIGSSQLSRLHLIMGGESYGLNATPS

SEQ ID NO: 173527 - protein, 82 aa, Glycine max
  Coding DNA Sequence Number=SeqID_81842
MHCLLDLGAVWDGHRPALDYDYHLNLLHHDGHLASRKWLQRSSQLKGQGKMPLEKVLVLPHRWMWSSIDIREAGPVEGWRVR

SEQ ID NO: 173528 - protein, 52 aa, Glycine max
  Coding DNA Sequence Number=SeqID_81843
  Homolog annotation: Hit_ID=A5BSK0; Match level="QueryCoverage=78%, HitCoverage=3%, E-value=4e-07, Identity=58%"; Hit description =Putative uncharacterized protein
MEIVNLGVGEERKELKIKEEVKKQAVTGFLAVARYSEWVANIVSVPKKDGTV

SEQ ID NO: 173529 - protein, 53 aa, Glycine max
  Coding DNA Sequence Number=SeqID_81844
METLVAAIAAALFSIIHFILNRAYIMEGEEAKIMGQSVCLQGRKGEESPPTFI

SEQ ID NO: 173530 - protein, 63 aa, Glycine max
  Coding DNA Sequence Number=SeqID_81845
MSSSDVFMLLVFSKDRYMIKSKSFNTCGMRERGRVYEQGMILVSIRKQCGVNGVTSNLLGKAA

SEQ ID NO: 173531 - protein, 81 aa, Glycine max
  Coding DNA Sequence Number=SeqID_81846
MYIELCRASSEVGKVIGGCAILLQSWAWYRMPFIAPRVSRPQTTYPLAKRWKGGRLEYKAAPHGDLVGYRSRIDHMESHGV

SEQ ID NO: 173532 - protein, 484 aa, Glycine max
  Coding DNA Sequence Number=SeqID_81847
  Gene Ontology: Mol. function=transferase activity, transferring glycosyl groups; Cellular component=cytoplasm; Biological process =metabolic process
  Homolog annotation: Hit_ID=A4F1R6; Match level="QueryCoverage=99%, HitCoverage=99%, E-value=0.0, Identity=70%"; Hit description =Putative glycosyltransferase
  Pfam annotation: Domain name=UDPGT; Domain location=11-483; Score= -24.9; E_value=2.4e-09; Accession=PF00201.9; Description=UDP -glucoronosyl and UDP-glucosyl transferase
MSNSTERKPHALLTPLPLQGHINPLLRLAKLLHLRGFHITFVHTEYNIKRLLNSRGPKALDGLQDFHFETIPDSLPPTYGDGDVTEDAVSLAKSVREKMLVPFRDLLARLHDSSTAGLVPPVTCLVSDCWMFFTIQAAEELSLPIALFSPISACSLMFVLHYRSLFDKGLLPLKDKSYLTNGYLDTKVDWIPGMKNFKLKDLPEIIWTIDPNDFMLKFLIEVGDNMQRSSAIILNTFAELESDVLNGLTSMFPSLYPIGPLPSFLNQSPQNHLASLGSNLWKEDTEYLEWLKSKEPKSVVYVNFGSITVMSPEQLLEFAWGLANSKRPFLWIIRPDLVVGGSMILSSEFVNETLDRGLIASWCPQEEVLNHPSIGGFLTHCGWNSTIEGICAGVPMLCWPFFADQPINCRHICKEWGIGIEINTNAKREEVEKQVNELMEGEIGKKMRQKVMELKKKAEEGTKLGGLSHINLEKVIWEVLLKKN

SEQ ID NO: 173533 - protein, 72 aa, Glycine max
  Coding DNA Sequence Number=SeqID_81848
  Subcellular localization annotation: CTP_CleavageSite=38; ConfidenceScore=5.03e-01
MVLTSARLKRSAFKDGAYISTVLEGQHSKTVLTSTRLRRSAFKGGAYISTIFKRRFKELLQYLHPGVKVPSR

SEQ ID NO: 173534 - protein, 53 aa, Glycine max
  Coding DNA Sequence Number=SeqID_81849
MYFKETTSNVDLSQGSSQETMTTTSTSSIAQVDVMDEFIHLKMKICHCWTVTQ

SEQ ID NO: 173535 - protein, 90 aa, Glycine max
  Coding DNA Sequence Number=SeqID_81850
MFSEQLLSKVPEEPLTGLPEASAVSPLSPFFSASSPLVFYPKQWGVRETNLEGSFAEKKKKLGSQCHGGATGIGRSKEAGSGLLGRGAPF

SEQ ID NO: 173536 - protein, 74 aa, Glycine max
  Coding DNA Sequence Number=SeqID_81851
MSVNEGFQWGSNPFTFNGVSQKRGMKKVASDLFLYADGDMHAPENVDRRRGAVLTLQELLRLGIDVEASCQVHD

SEQ ID NO: 173537 - protein, 523 aa, Glycine max
  Coding DNA Sequence Number=SeqID_81852
  Gene Ontology: Mol. function=transferase activity, transferring glycosyl groups; Cellular component=cytoplasm; Biological process =metabolic process
  Homolog annotation: Hit_ID=A4F1R6; Match level="QueryCoverage=90%, HitCoverage=97%, E-value=0.0, Identity=72%"; Hit description =Putative glycosyltransferase
  Pfam annotation: Domain name=UDPGT; Domain location=11-483; Score= -18.3; E_value=1.1e-09; Accession=PF00201.9; Description=UDP -glucoronosyl and UDP-glucosyl transferase
MSNSTERKPHALLTPYPLQGHINPLFRLAKLLHLRGFHITFVHTEYNIKRLLNSRGPKALDGLQDFHFETIPDSLPPTYGDGDVTEDAVSLAKSVREKMLVPFRDLLARLQDSSTAGLVPPVTCLVSDCSMLFTIQAAEELSLPIALFSPVSACALMSILHYRSLFDKGLIPLKDKSYLTNGYLDTKVDWIPGMKNFKLKDLPTFIRTTDPNDFLLKFLIEEGDNMQRSSAIILNTFAELESDVLNALTSMFPSLYPIGPLPSFLNQSPQNHLASLGSNLWKEDTEYLEWLKSKEPKSVVYVNFGSITVMSPEQLLEFAWGLANSKRPFLWIIRPDLVVGGSMILSSEFVNETLDRGLIASWCPQEEVLNHPSIGGFLTHCGWNSTIEGICAGVPMLCWPLFADQPTNCRHICKEWGIGIEINTNAKREEVEKQVNELMEGEKGKKMRQKVMELKKKAEEGTKLGGLSHINLDKLMISVYWISILQTRLRPRRTEFGDTKLRAPHPIYRVCPSQSSTCYQNVR

SEQ ID NO: 173538 - protein, 142 aa, Glycine max
  Coding DNA Sequence Number=SeqID_81853
METLFTSLDVLELVKEGYEELVATTKATVTQCEELKKKKITNVGVLGMIQRGVSIAKFPRIIRAKPVIKHGKFCSKSLKEIQRSYEQRLLQRIEMSIEKAEEEVETLVEMEEAPMEGKEAMKDQIDGVEFAKGALMKRKIVG

SEQ ID NO: 173539 - protein, 201 aa, Glycine max
  Coding DNA Sequence Number=SeqID_81854
  Homolog annotation: Hit_ID=A5AIH8; Match level="QueryCoverage=56%, HitCoverage=15%, E-value=2e-31, Identity=56%"; Hit description =Putative uncharacterized protein
MCLHPRESAAPHHHIDHEITSSIQAVASFDLSCHTPQAPTKPSKEQHKIQAPTKKVNANGTVEEPEKSSKLRTSIGKKSAKVSNSGLPGNLVKVTLSNRKVKDGSVQWASLPSSISKIGREVMKHRDATQIASTEAMQEATTAESLLQCLSSPNKQTKKKNNKKKKNKKKTTKTKVGKKKKKLYLGNVATFHGREKALQRS

SEQ ID NO: 173540 - protein, 39 aa, Glycine max
  Coding DNA Sequence Number=SeqID_81855
MVLESVSGIKAVDFRQPEVLLVKKVHQFEVGSVKLKKKG

SEQ ID NO: 173541 - protein, 265 aa, Glycine max
  Coding DNA Sequence Number=SeqID_81856
NLLAEKTKKKLEEAAQSGSVDDIIDPLSLVRRHVKWKMVRTKKIREMTTEAAKEIAEKIGSFVPHGCQDVFSTAIRCPEHLGRVHAAGGPARGVDTEKVTQQLMALFSQMQSQMQSQGLALPLEPLVGPSGPRVSTKESCVDPSGNDPETGDSNRCGLYIEANLARLVALGRVYEGSTVVHNTPLLPGQVKVGNSHLLCLADTSGKAFIRMVVSPAKPPQKSDPEVDDPLYLMTLTIRELFLRPYQVTWDATMFEIFNPDFPLYI

SEQ ID NO: 173542 - protein, 111 aa, Glycine max
  Coding DNA Sequence Number=SeqID_81857
MAILPKEHLVVWFCSLHNKLDNYLKGIISSALKGLDDAPQPKSKAAARWIIVKCNRQKGSTECGYYVMHWMSTIILGIFRNNWKAYFNNPRPLETEIKGASDPVGTVLSPS

SEQ ID NO: 173543 - protein, 116 aa, Glycine max
  Coding DNA Sequence Number=SeqID_81858
MERCSKGCDFAIRQQFGQPWPTWGVIPKDHQELFFQRFKSEELGRSVYVDEIFQQTHFRKDNGQFVDDRSRKTHEEFEARLSQARSDAASSVGESQLTPLDPAEEQRLRSQSWVVA

SEQ ID NO: 173544 - protein, 129 aa, Glycine max
  Coding DNA Sequence Number=SeqID_81859
EEFEARLSQARSDAASSVGESQLTPLDPAEEQRLRSQSWVVAVGPKHKGRLYGIGDLAHTYKCGNDSFMQHTQGSSSRTEDAAEINRLREELRQSKEKMRVFQSVVLQFLSLEARNIIHQQQQQQPHQQ

SEQ ID NO: 173545 - protein, 126 aa, Glycine max
  Coding DNA Sequence Number=SeqID_81860
MIQTRVTRTNTGCTLKKILPAWLPYEEFMRDPQPFTTFLCCMIKSREAMRPAKPADRPDHEVDDPLYLMTLTIPQLFLKPLQVMWDVTVFGVFNEDFPLYIKHEDLSEIARSGQCLNISVIQLWIL

SEQ ID NO: 173546 - protein, 80 aa, Glycine max
  Coding DNA Sequence Number=SeqID_81861
MAEDQPRRVTLEDYSSSTVPQFFTTKRWLHSFKGNRLKTWDEVVEKFLKKYFPDSKTAEGKAAISLFHQFPDESLSEALE

SEQ ID NO: 173547 - protein, 166 aa, Glycine max
  Coding DNA Sequence Number=SeqID_81862
  Subcellular localization annotation: CTP_CleavageSite=35; ConfidenceScore=5.09e-01
MPLHTPQRCRKGTLHSGTSPPFETTQTWNRLSSTRGNELVYEVVRFVGENYRSVQGEILMCLEQLGGRMMEDVGELNTLVRYLERLGETREKLVLLFLNKRKNNEFWDLVKKTKENGVAKRKEIEGKWLVVVVAGDAPKFTSIIKVQEPNAYKEIMKKAKEFEVCD

SEQ ID NO: 173548 - protein, 148 aa, Glycine max
  Coding DNA Sequence Number=SeqID_81863
  Gene Ontology: Mol. function=protein serine/threonine kinase activity; Biological process=protein amino acid phosphorylation
  Homolog annotation: Hit_ID=A5BK84; Match level="QueryCoverage=37%, HitCoverage=6%, E-value=5e-14, Identity=69%"; Hit description =Putative uncharacterized protein
MSKKDLFSVLDGGEVKEKEIFILEEENFSPNALQLWLLKKKDKFCPNLYPDENMSPTSTKDNQTLKGVQGQKLKRKSFSVHMKFAQEQDYKDRVERGILSNTKPIAVKQLSPKSEQGTHEFINDIGTISAFQHPNLVKLYGRCVEGKQ

SEQ ID NO: 173549 - protein, 94 aa, Glycine max
  Coding DNA Sequence Number=SeqID_81864
MRHIQGKLTAEKAKTRKVKQVEDSSLIQQVIQGIDSYDDKEDQQILIGYPTEIAPKKPLYIQPEKFNKVTSAPQEVVVYSTSLRRLLKTIVHST

SEQ ID NO: 173550 - protein, 42 aa, Glycine max
  Coding DNA Sequence Number=SeqID_81865
MVAVVVSLVVVDLVVVKVQIEQDQSGRVEVEYLVFMDGVEVE

SEQ ID NO: 173551 - protein, 474 aa, Glycine max
  Coding DNA Sequence Number=SeqID_81866
  Gene Ontology: Mol. function=receptor activity; Cellular component =nucleus; Biological process=regulation of transcription, DNA -dependent
  Homolog annotation: Hit_ID=A5B053; Match level="QueryCoverage=27%, HitCoverage=44%, E-value=7e-52, Identity=75%"; Hit description =Putative uncharacterized protein
  Pfam annotation: Domain name=AP2; Domain location=362-413; Score =74.0; E_value=4.8e-19; Accession=PF00847.11; Description=AP2 domain
  Pfam annotation: Domain name=Glyco_hydro_81; Domain location=1-454; Score=-325.3; E_value=0.00073; Accession=PF03639.4; Description =Glycosyl hydrolase family 81
  Pfam module annotation: Pfam domain module=AP2::Glyco_hydro_81; Domain location=362-413::1-454
MNHLMIKGETKHERNPAITTDIGLLVGHTHGKESLAGLSSPKAIPFSHTKYGACISECLEGSPYITASDSKYVETLDKFSSCYPVSADAALKKPFSVEYKWKKKRSGDLLMLAHPLHAKLLSYDHDVTMLNDFKYRSIDGDLVGVVGDSWVLETNPIPVTWNSNKGVEKESYGEIVTTLFKDVQALNSSAIGTNSSYFYEKQVGRAARTTDIRFQFRLDVVFIGTNVWVQKKPIVFKKPDSGRSVLKQWSKEYGNISVKRIQNIQHKLNEVEDLASNRILSEDELKAKKSLQRNYNALQGILIDGVWVQQPNVVKNEAVNFFLKRFTEHHFSRTMNTCKKSPLKPWKKGPTRGKGGPQNASCEYRGVRHRTWGKWVAEIREPKKRTRLWLGSFATAKEAAMAYDEAARRLYGPDAYLNLPHLQPRSTSTITLGKLKWFPSKNFISMFPSCGLLNVNAQPSVHLRGYKSLSEIQL

SEQ ID NO: 173552 - protein, 120 aa, Glycine max
  Coding DNA Sequence Number=SeqID_81867
MEAGRDFQFSFVGKMALGFISQAAGALGKNTNIKIWGLEGIGGRHDRKTTINLVEGSDINSAATTDSINQKGNKMEGGEWGEIQILGRPLDTKCYSIKGEIPQAVSELMPTKGNHHEYGE

SEQ ID NO: 173553 - protein, 560 aa, Glycine max
  Coding DNA Sequence Number=SeqID_81868
  Gene Ontology: Mol. function=transporter activity; Cellular component= integral to membrane; Biological process=transport
  Homolog annotation: Hit_ID=O81186; Match level="QueryCoverage=38%, HitCoverage=88%, E-value=6e-90, Identity=78%"; Hit description =Aquaporin
  Pfam annotation: Domain name=MIP; Domain location=334-554; Score =396.0; E_value=5.7e-116; Accession=PF00230.11; Description=Major intrinsic protein
MDGKVQSETPCQEIPSIASSLNYTHSNQSGSIDQCSRPSEGVIESGSSASAVYSNLKLDLSMSDGEICLDKLSIRELHELFKVTFGRETTVKDKQWLKRRIAMSLTNSCDVSATTFIIKNNKIVRKFEEESSGNMNAGSLISSGNMTEEEDVNFKDSSAVNACGIEDNQVVSETRPKIGLEDENYQTGQRAAKTNCMNIVGGIEAYLEGGFLCSSYMDFQPLKLMFQEFKDKLIELGNEQVNLHFNRKRMGKQGLGAGIEFDIDTVKHGLLAGQADKAPREPNVLLLLPKVKEGPELEMNVPQHFLILSSPPPALRFSKKLLKMAGIAFGNFNDSVSFASIKAYIAEFISTLLFVFAGVGSAIAYAKLTSDAALDPTGLVAVAICHGFALFVAVSVGANISGGHVNPAVTFGLALGGHITILTGLFYWIAQLLGSIVASLLLKFVTGYDTPIHSVAAGIGAGEGVVTEIIITFGLVYTVYATTADPKKGSLGTIAPIAIGFIVGANILAAGPFSGGSMNPARSFGPAVVSGDFHDNWIYWVGTLIGGGLAGLIYTYAFIM

SEQ ID NO: 173554 - protein, 147 aa, Glycine max
  Coding DNA Sequence Number=SeqID_81869
  Homolog annotation: Hit_ID=A5BMG6; Match level="QueryCoverage=67%, HitCoverage=7%, E-value=6e-07, Identity=31%"; Hit description =Putative uncharacterized protein
MRAGNSGIYGFLEPQSIKRSGQSQFESESYIKSWMQSSKRDVYLGAYQNGPDNYFKGIINSALKGLDDAPQPKSKAPARWIVVKCNRQKRSTECGYYVMHWMSTIILGTFRNNWEAYFNDPRPCGSERLKALRIQWAQFYLRVIDQA

SEQ ID NO: 173555 - protein, 93 aa, Glycine max
  Coding DNA Sequence Number=SeqID_81870
  Homolog annotation: Hit_ID=Q2HSE9; Match level="QueryCoverage=100%, HitCoverage=21%, E-value=8e-32, Identity=70%"; Hit description =Pollen Ole e 1 allergen and extensin
MSWFLVILFLSITHGSASETSHDKKLPSAVVVGTVFCDTCSQQEFTIGSHFISGASVAVECKDGNSIPRFKKEVKTDEYGEFKLQLPFKVRKH

SEQ ID NO: 173556 - protein, 63 aa, Glycine max
  Coding DNA Sequence Number=SeqID_81871
  Gene Ontology: Biological process=steroid metabolic process
  Homolog annotation: Hit_ID=A7NYY3; Match level="QueryCoverage=100%, HitCoverage=14%, E-value=5e-16, Identity=66%"; Hit description =Chromosome chr6 scaffold_3, whole genome shotgun sequence
MVNHGGITFLVERVTWDLAHNKVSHHPSMSVMYAKNEHFTYDVTSKLKTKFLGNSVDVYPVGR

SEQ ID NO: 173557 - protein, 548 aa, Glycine max
  Coding DNA Sequence Number=SeqID_81872
  Homolog annotation: Hit_ID=A5AWV0; Match level="QueryCoverage=80%, HitCoverage=31%, E-value=7e-13, Identity=20%"; Hit description =Putative uncharacterized protein
PCDERWSVVLHGKTIGVNVEDDDLYIDTYVSPLSTQMSANIVGEEEADDQMAIPPSSPPPPAGAASQSPSTLKRTRKATRLRSLATRPGSSLVISSMSHTRIGSKSWLLRRIGYGRIFRQFKSDLTLKWAVAADKEIVDETVCEKYDISKEKWAQFFQTRRDPSWEDVRKKAQAVIDPPSPIRRHVKWKMTCTKKTGQMTSEAAKEIAEKIASQGSFVLHGRQDVLTATIGRPEHPGHVRAVGTSVTIKQYFGPAPRTSHMSSSMAPEDLEQLTQQIRGQLEDSITEKSRMQSQELALPPEPEVGPSAARVGTNKSCVDSLGNDPDMGDLDKCGLYIEENPPRLVALRRVYEGSTTVHNIPLLHDQVKVGVEEVKDADASIPVPIEDVKLVGQTLNTFLAWPTHLVKRLSEQGAVGPAKPADRPDHEVDDPLYLMTLTIPQLFLKPLQVMWDATVFGVFNEDFPLYINHEDLSGITHGGQCLSISIIQLWILHMNETSMRAENVDMYGFLEPQSIQRSGQSQFELESYIKNWMQNSTWNVFLGAYLNG

SEQ ID NO: 173558 - protein, 39 aa, Glycine max
  Coding DNA Sequence Number=SeqID_81873
MAKTQATRLQMRNKVEDEMVEGKNHSFQQGQHTKDVKDL

SEQ ID NO: 173559 - protein, 54 aa, Glycine max
  Coding DNA Sequence Number=SeqID_81874
MQSLKLNNKTTVACYEEIIMNPIISAASVVVVGLVVGLASIGPGLVKALLQGKL

SEQ ID NO: 173560 - protein, 114 aa, Glycine max
  Coding DNA Sequence Number=SeqID_81875
MTAAYDEPVVLAPDVQDDPMEAPAAVEDIVADIPADTGTEAAEDEHEGFSGGPSDPSVLTQYADHVACSVWTGEECPELKISFHGRKVHSLSRHVPAIEKLVAGTGLSPLIACS

SEQ ID NO: 173561 - protein, 126 aa, Glycine max
  Coding DNA Sequence Number=SeqID_81876
MGTWNPKQEFGHLRLDWTSPKWLDSTLDLLHLLSKYPNTSIKLITVLTPAMTPSSQAYSCEDTSFKRYGSDLILHIVPPPSPSHVGNNLVIHCINPYTLLTTPHHHLPPLSFVPSMDLDEFQVFGV

SEQ ID NO: 173562 - protein, 98 aa, Glycine max
  Coding DNA Sequence Number=SeqID_81877
MVQGVLMIQLHQLAFPLHVILKVHHNKGQKLLHNHKDMKLQHNKGKDNNLNLKSAQAEEKLKHVLSANKQMVSLTTDTWMSIQNMNYMCVIAHYIDER

SEQ ID NO: 173563 - protein, 235 aa, Glycine max
  Coding DNA Sequence Number=SeqID_81878
  Gene Ontology: Mol. function=receptor activity
  Homolog annotation: Hit_ID=A0EJF4; Match level="QueryCoverage=78%, HitCoverage=31%, E-value=4e-67, Identity=69%"; Hit description=Beta -glucan-binding protein 5
  Subcellular localization annotation: CTP_CleavageSite=44; ConfidenceScore=5.01e-01
MHFILSLSSNNSLTKHTLQLNNGQTWLIHTSSPISLNHSLFEIASTEFSGIIRITVLPDSDPKYEVILNRFCSCYLVSRDAAFTKPLCVEYKWEKKGWGELLMLAHLLHLQLLNDSDCGVTVLHDLKYRSIDGLVGDSWLLKTNPVSVTWHSTGGIREEFQEDIFSTLSEDVDGLNPLGITTTSFGFGVYNNHYNLGYFLYGIAMLAKIGEGSTSLKPILFTCSRSHELQKKIEL

SEQ ID NO: 173564 - protein, 90 aa, Glycine max
  Coding DNA Sequence Number=SeqID_81879
MGLFWKYFLHDVVFDVKSMQIAEAIGDFGLAVTHGTGLASATSDFRMHGTHQFDWRVALGELELPAALASCPWSSHYQWRVHLLYIGMLL

SEQ ID NO: 173565 - protein, 60 aa, Glycine max
  Coding DNA Sequence Number=SeqID_81880
MVSLDLDLDVDIPSFLNMKQKNVKKKKRCHSLAWVGKKGKLSDEAVKRHMLHHMELCIYE

SEQ ID NO: 173566 - protein, 189 aa, Glycine max
  Coding DNA Sequence Number=SeqID_81881
MDCGDGKRGWLSHREGQKGASPNKEKPQIGRRDIQCNTEIIVGRDGVVQMGRVGFLRGRDGWSPFLRTKFWKKEFVGSGFETRFEEKKLEGSGTTVESTWGNRKGVCFLGLEPFLEPPARAVLTLRLIVEGLDKDNNGFIGLGFCIGCGEAKEEGIGYDGAARYVNLTMSRKKTQKGGFSIGKCKEGMA

SEQ ID NO: 173567 - protein, 304 aa, Glycine max
  Coding DNA Sequence Number=SeqID_81882
MWWHLLHPKIVIEFRLTKFYFSSTILHSQHPNEQGQTSVLANCLENRLFVEAASKEDYVNRRAIMRQMDTQLKKLHAPKFSQVNSFIACTSQMVPSSWLLQARSNGSVSKPAFQNMVSSITNATDYCAATIDNKNGFLNGGLSYSSVVPNQFFHLITIHQSLHALIWTCFLTLLFLVGEAIQKLVARMTLLVKYEDCSRTTMGKSVQFESSNSMTPQDTLKEFSKFSDLPPVPRSLGDIRQHQHQKRDFQQNFKPFVQPYGLPGKTYMARPNAFSNQGERCGQMLGSKKLKQPQLFRRSLSGDQ

SEQ ID NO: 173568 - protein, 147 aa, Glycine max
  Coding DNA Sequence Number=SeqID_81883
MVLDLFGNTQVVLPPAKRTKMDPAFGVPLINNANLDWLTQKMVHPRSSEAFSELLQQAQSFLFYESMECKADHISPLSLHSNMHPICKESMPADVEGIHGKTEFNQDGINVAVEPKADQEMERMSLNPTANTANMEDMQGRTRFNQD

SEQ ID NO: 173569 - protein, 150 aa, Glycine max
  Coding DNA Sequence Number=SeqID_81884
MEIGNITRNIWMGDLNATVPFCKGHYQCTQRYFTEEKHMTVEARSLVQFRHPRVYSCHKMKEITTKEGTFNIDLPSCEEMIVEKCLNMTTFCYGSVTTARLIHIYKGSYEYVDIMGDLNMTIYHANEGLKVALQTSETMTSIEHDQHLLP

SEQ ID NO: 173570 - protein, 84 aa, Glycine max
  Coding DNA Sequence Number=SeqID_81885
MKAITLMVDDYEVDPNCYHIFQAVKEHSGHPVKVEFRHVLRECNGVANAIAKLGFSMQQEIVFYIKPSVAILPCLEADVSTLGI

SEQ ID NO: 173571 - protein, 176 aa, Glycine max
  Coding DNA Sequence Number=SeqID_81886
MSKIEAQPVPAMVVVEAVASVVVVVDVVADGARPSLDSEKNPNQAWRNLMLDGIVAEQDGVIAVRDFAAMVVAVTIEREVAVGRMKAGKWQRSHGKKGRGDWVATAVLGEGHPLRIRGGVERQQGWPRRPQGGRRQPWKLRLASGSHGRQVEVIENRVHLAGKFCIFIIEGSLTIG

SEQ ID NO: 173572 - protein, 105 aa, Glycine max
  Coding DNA Sequence Number=SeqID_81887
MFAHLPGAGYFEAKEIYNLIDPLASIWKPLRDFGLSLLVREKLDDLQMHVVIINSYNKFAIVAGWLSSQSNVSSTNFGFLDLCSRARISLEIGKKLHSTQLDNCY

SEQ ID NO: 173573 - protein, 124 aa, Glycine max
  Coding DNA Sequence Number=SeqID_81888
MWDFQHTHLPTCKTRIAPHLYGLSRHYFHSMWDFNMSHFFSWLPAMWDFQHTPLSRCDYTSLHAQGYLPRGKWVFHELNSTLQNRLVSMPYFSSWLPTMWDFQHTPLSKCDHISPHAQGYLPRV

SEQ ID NO: 173574 - protein, 39 aa, Glycine max
  Coding DNA Sequence Number=SeqID_81889
MGNYTTTYFRNFAKGEKTSIGLEMCDRDTSIAMDPTIID

SEQ ID NO: 173575 - protein, 90 aa, Glycine max
  Coding DNA Sequence Number=SeqID_81890
MQWVIPPCPYPTAPWARPNYQQPPHQQPSILGSRPQQAYITTAPTLTDIEAAMHTLGITSPYPNWYMDTGATSHMTSTSGFSDRDASNEV

SEQ ID NO: 173576 - protein, 109 aa, Glycine max
  Coding DNA Sequence Number=SeqID_81891
MLLHMSMGMGLSGMDNEEGMINKIANLKNKDKENAQQGRGKGGYKYGWRVVMCMKVRGVCDGGCVPWVWVLMCERSLYLGSFGILIKRGARVMGNFNAMRHMEENRDDW

SEQ ID NO: 173577 - protein, 327 aa, Glycine max
  Coding DNA Sequence Number=SeqID_81892
  Homolog annotation: Hit_ID=A7PAJ7; Match level="QueryCoverage=85%, HitCoverage=55%, E-value=1e-106, Identity=61%"; Hit description =Chromosome chr14 scaffold_9, whole genome shotgun sequence
  Pfam annotation: Domain name=DUF231; Domain location=142-312; Score =121.4; E_value=2.6e-33; Accession=PF03005.6; Description=Arabidopsis proteins of unknown function
MAITVLQYYTYSFCFGSLEYAIIRYERLGTKGSFSILEVLGGSKVSKGFCGEIVSRLRASAMHAVVEWPIDVSYTDDFSFKRWKYSSYNFTMTTFWSPYLVRAKQVDSNGGLYNVYLDEFDEKWTTQIKEFDYVIINVGQWFLRPMVFYEKQKIVGCQYCSLENVTHLSWHYGYKKAFGTTFKAIINLENFKGVTFLRTFAPSHFENGVWDKGGNCVRTKPFKSNETRLEGNNLELHTIQLEQFKIAEKEARKKGLKFMLLDTTQAMLLRPDGHPNKYGHWPHENVTLFNDCVHWCLPGPIDTWSDFLLEMLKMEDVRSTSKERFHL

SEQ ID NO: 173578 - protein, 425 aa, Glycine max
  Coding DNA Sequence Number=SeqID_81893
  Gene Ontology: Biological process=intracellular signaling cascade
  Homolog annotation: Hit_ID=A7PAJ7; Match level="QueryCoverage=99%, HitCoverage=88%, E-value=1e-164, Identity=59%"; Hit description =Chromosome chr14 scaffold_9, whole genome shotgun sequence
  Pfam annotation: Domain name=DUF231; Domain location=240-410; Score =130.5; E_value=4.9e-36; Accession=PF03005.6; Description=Arabidopsis proteins of unknown function
MKFQDIELLFGKITPKQMLPKVTLLVLLSILIFVVTPMCYPLFSYSSLLKINKYNKHPESLPSTSVKKCNIFSGEWVSNPEAPYYTNNTCWAIHEHQNCMKYGRPDTDFMKWRWKPNECELPIFNPFQFLEIMKGKSMAFVGDSVGRNHMQSLICLLSRVEWPIDVSPTTNDYFRQWKYPSYNFTVAAFWTPYLVKSKMVDSIGPSHNGLFNLYLDQVDETWATQIEEFDYIIINAGHWFFRSMIFYEKQNIVGCCDCLLKNVTDLTTYYGYRQVFRTAFKAINSLQNFKGVTFLRTFAPSHFENGTWNKGGHCVRSKPFKNNDIRLESTNLELYMIQLEELEIAKKEGRKKGLEFRLFDTTQAMLLRPDGHPSRYGHWPHEKVTLYNDCVHWCLPGPIDTWNDFLLEMLKMEDMKFSSGERLHV

SEQ ID NO: 173579 - protein, 354 aa, Glycine max
  Coding DNA Sequence Number=SeqID_81894
  Homolog annotation: Hit_ID=A7PAK0; Match level="QueryCoverage=87%, HitCoverage=90%, E-value=3e-71, Identity=50%"; Hit description =Chromosome chr14 scaffold_9, whole genome shotgun sequence
MAGLLAWAVGGGGGKEAEDDGIIPILFSADQQKYVNELDQKASSLRRWIHDLRQRLPPQDISQSLPHLHAHSLASNAALALQLNSHSTTRQQAQLREVTLKEENAAFENAISDCENKIKEKLQEADLLREKLKEMDETEKKLKAEVENMKQPSWVSDGWEEEKKANSKAGLEAESALLDELEKKKKDMSSMENAVHELEKKWAQVQENALKQPSPGQREKTLDKHLHGLIEQLAVKQAQAEGLLGEIHLKEMELERLNGLWRRTESSNSEANTAARNRFSKGSSDKLHSLSDYEGHQRLPYHSAGRTESQQRLMLLRSAFVLYILALHILIRSIDSRNPVGAPIASPPLCASTG

SEQ ID NO: 173580 - protein, 81 aa, Glycine max
  Coding DNA Sequence Number=SeqID_81895
  Homolog annotation: Hit_ID=A7QZ76; Match level="QueryCoverage=91%, HitCoverage=6%, E-value=4e-07, Identity=40%"; Hit description =Chromosome undetermined scaffold_265, whole genome shotgun sequence
MTRPIYFDWKDMCHTYLGVVPPKDDAIVGSTIKLKWLCDNKPPLPQQLETHCKAYILGLIWGVLMPDKIGMQVDIVRAPLV

SEQ ID NO: 173581 - protein, 159 aa, Glycine max
  Coding DNA Sequence Number=SeqID_81896
MKDLKWLSTEYDINRSLKMLVNYEGLQIADGLRPQSKQLLDASVGEKIKLKTPEEAMELIENMAASDHAILRSRTHIPTKRSMLELSSQDALLAQNKLLAKQLETLIETLTTQEVNYMGNQHRPGFNAGGFANFQQGSNFNQNQGKWRSHPGNQFNKDQ

SEQ ID NO: 173582 - protein, 57 aa, Glycine max
  Coding DNA Sequence Number=SeqID_81897
MIDGEDEYAQNNKGGPLRAKGHFGAVAARPGELKVNPAAVSSPRKARAHPGELVSSP

SEQ ID NO: 173583 - protein, 92 aa, Glycine max
  Coding DNA Sequence Number=SeqID_81898
  Pfam annotation: Domain name=MIB_HERC2; Domain location=22-77; Score=- 13.4; E_value=0.076; Accession=PF06701.4; Description=Mib_herc2
MVLVVNGKVRSRHGCLALLHRRGAWKWNQHGRQGQLGCVCGRRMTSSLAAMEAWVATKWEMAASSRSRTGFQRSDSAIGTLNESTELLCAHN

SEQ ID NO: 173584 - protein, 416 aa, Glycine max
  Coding DNA Sequence Number=SeqID_81899
  Gene Ontology: Mol. function=transcription factor activity; Cellular component=nucleus; Biological process=determination of symmetry
  Homolog annotation: Hit_ID=Q84N90; Match level="QueryCoverage=92%, HitCoverage=93%, E-value=6e-97, Identity=55%"; Hit description =LEGCYC1B
  Pfam annotation: Domain name=TCP; Domain location=93-340; Score =154.5; E_value=2.8e-43; Accession=PF03634.4; Description=TCP family transcription factor
  Subcellular localization annotation: CTP_CleavageSite=14; ConfidenceScore=5.21e-01
MFPYSSNPYPSFPSSSSSSYPPFPFLNLENASASNTLLHDPLSVPYIPTHHHNPSSIQEALNNLPVTDHNCGGGGGSAMTKPDSNGGGAPHYGISCFLTKKPPKKDRHSKIYTSQGLRDRRVRLSIAIARKFFDLQDMLGFDKASNTLEWLFNKSKRAIKELARSKHSNNNSDEGAKSFSSSSDCDDDCEVVSEIKQKQQQLITCDAATTQHNLQQGLDSGDNKSPTTLVAARERMKLKRTQKEPAKIKESREKARARARERTSNKIIMCNVNTNNNNTGRRVQQQDLKKKCPAIENNHSQIMHQSSSSPTHNLVGNETPRDDFNVIEESIVIKRKLKPSLMSSSHHHHHHHQSLMIPKEPPSFNNCEYHPFSNLSPNWDANGSTGRSNFCAVASMNLSTGLQIFGKSWEECINPR

SEQ ID NO: 173585 - protein, 316 aa, Glycine max
  Coding DNA Sequence Number=SeqID_81900
  Homolog annotation: Hit_ID=A2Z3N8; Match level="QueryCoverage=37%, HitCoverage=16%, E-value=8e-13, Identity=31%"; Hit description =Putative uncharacterized protein
MNTIERLKDDHENFFDDEKDIDNVITERDVGVVLNEAFMEDEVVIALSQMHVMKTLGPDGNPTLIYKHLWDIVGRARMWWTRGWKKLKDWKEEALSKRGREEIESMTIRFFWGGDIDERKVHWMSWKKLSRHKKEGGVRLEDWEWMKVNVLKDRWVPSLLRSRITQYEDKAIKAIPLKLCSSEDWLFWKFSNNGIYSVKSGCQLATRRFNLVRGNLITKRMNLDPTCPRFGVEIELKLLSMLLLLVLKKEASWISKIRLLKCLKDVEEEVKVMFSKEAMPIAWKPPVEGVYKVNFDASIKKNVVTGMGLIVRDWEG

SEQ ID NO: 173586 - protein, 419 aa, Glycine max
  Coding DNA Sequence Number=SeqID_81901
  Gene Ontology: Mol. function=hydrolase activity; Cellular component =cytoplasm; Biological process=metabolic process
  Homolog annotation: Hit_ID=Q1KUX4; Match level="QueryCoverage=89%, HitCoverage=86%, E-value=1e-134, Identity=62%"; Hit description =Putative uncharacterized protein
  Pfam annotation: Domain name=Abhydrolase_3; Domain location=127-342; Score=21.5; E_value=7.3e-09; Accession=PF07859.4; Description =alphabeta hydrolase fold
  Pfam annotation: Domain name=Peptidase_S9; Domain location=141-359; Score=-63.7; E_value=0.0075; Accession=PF00326.12; Description =Prolyl oligopeptidase family
  Pfam module annotation: Pfam domain module=Abhydrolase_3::Peptidase _S9; Domain location=127-342::141-359
MATLSDHRRRMLPPENVDAQPITSDSVSNNHRTTHRRDAGNNGLRHRLVRQESLRRNIEHVAAETYLVSRLAFTLLRYLGEEGGERGVAYYYFFTSKVKRSIVYGDQPRNRLDLYLPANIGEPKPVLIFVTGGAWIIGYKAWGSLLGLQLAERGIMVACIDYRNFPQGTISDMVNDTSRGISFIINNIANYGGDPNRIYLMGQSAGAHISSCALLEQAARESEKEDSVSWSISQLKAYLGLSGGYNLLDLVDHFHNRGLDRSIFLSIMEGENSLKEFSPEIKIQDPCLKSSIPHFPPVYLVHGTADYSIPSVASERFAEALKKAGVRAELILYEGKTHTDLFLQSSTMCYPFVLPIEVLILNHAAQDPLRGGKDDLFDLAVAIMHSNDSDALANDAIAPPRRRFVPEILLKLARKISPF

SEQ ID NO: 173587 - protein, 602 aa, Glycine max
  Coding DNA Sequence Number=SeqID_81902
  Gene Ontology: Mol. function=nucleic acid binding; Cellular component= spliceosome; Biological process=mRNA processing
  Homolog annotation: Hit_ID=A7PAL0; Match level="QueryCoverage=65%, HitCoverage=47%, E-value=1e-100, Identity=51%"; Hit description =Chromosome chr14 scaffold_9, whole genome shotgun sequence
  Pfam annotation: Domain name=PSP; Domain location=272-321; Score =82.3; E_value=1.6e-21; Accession=PF04046.7; Description=PSP
  Pfam annotation: Domain name=zf-CCHC; Domain location=212-229; Score =20.7; E_value=0.0011; Accession=PF00098.14; Description=Zinc knuckle
  Pfam module annotation: Pfam domain module=PSP::zf-CCHC; Domain location=272-321::212-229
MEGDEHMNEVPSENSNLGSDSLEKENILEDEKEDLQDGLKLKVVTEEVSGGLLAENGCISLEDGSLKRSLETPLAATGMAVTECFSFVADFMARKDASEVLESGEETFFPALHVGLEKTSAVSFWMENQTRNDKNKDFIPLADNTVPLYDRGYALGLTSADGSSNVDGKFSSDDILICKKSLLGQLMLPSAADCVVVGMLCMYGLGIIDAAARCFNCGSYNHSLRECPRPRDNIAVNNARDKLKSRRNQNSSSRHPTRYYQNSPAGKYDGLRPGSLDDATRKLLGLRELDPPPWLNRMRELGYPPGYLDVDNEDQPSGITIFTDSEIADQEDGEIMEANASKPKRKKTVKFPGINAPIPEKADERLWGTRAGPSSSDISRNLSLPQHRSNYSTDYGSRGYHREHRLGDLRDEGPPGDPGHSSFMFSFHPRFGGHDSALRSPSMARSQSDRSRSPMHDEESSMPFSFHSLHYSSSERHFSPLDRDSGSTIVTTAVGGEDGTNRINHIGRVLAKLAALTIFLESTSVDVRDNTMMVMRSCVCGASKVERMFRTWALCDSDDGGCGSAGHGGDGIRLWCIAEVVDGDDGCMIVVKGGRSCSSRFC

SEQ ID NO: 173588 - protein, 392 aa, Glycine max
  Coding DNA Sequence Number=SeqID_81903
  Gene Ontology: Mol. function=histone acetyltransferase activity; Cellular component=nucleus; Biological process=regulation of transcription, DNA-dependent
  Homolog annotation: Hit_ID=A5C9C3; Match level="QueryCoverage=80%, HitCoverage=14%, E-value=1e-114, Identity=65%"; Hit description =Putative uncharacterized protein
  Pfam annotation: Domain name=DUF906; Domain location=111-329; Score =320.7; E_value=2.6e-93; Accession=PF06010.3; Description=Domain of Unknown Function (DUF906)
MQADASFNRVQWLKNQEVMFTHANYVKWEHFLLPPCQSIAFVVASASSETHAITIEEKKMIHNIAFAVFALGLLEHQICALYNDKRDLDYRAEYTCPICRLKEIGNGMHVPLPKTAAMFSANDLPRTMLSDHIESRLFKRLWQENEDWAKAGYKNLDEVILLFQKIEGVDVCLFAMYVQEFGSECGYPNQRSVYISYLDSVKYFRPKRVTKSGEALRTIVYHEILIGYLDFCKKRGFATCYIWACPPMKGEDYLLYCHPDTQKTPKKDKLRHWYHSMLRKAAEENIVVGSTNLHDHFFVTTGSCDSKVTTARLPYFDGGFWSGAAMDKARDIEQECGGDYKMIFDKVVSKRCLKSMGHVNPPSEGTAKDILVMHKVCLPCLSPSSIFYIGSS

SEQ ID NO: 173589 - protein, 189 aa, Glycine max
  Coding DNA Sequence Number=SeqID_81904
  Gene Ontology: Mol. function=DNA binding; Cellular component=nucleus; Biological process=regulation of transcription
  Homolog annotation: Hit_ID=A7PW69; Match level="QueryCoverage=39%, HitCoverage=19%, E-value=1e-30, Identity=85%"; Hit description =Chromosome chr8 scaffold_34, whole genome shotgun sequence
  Pfam annotation: Domain name=Myb_DNA-binding; Domain location=36-87; Score=35.6; E_value=1.8e-07; Accession=PF00249.22; Description=Myb -like DNA-binding domain
MHALRMHSPTERHMMMHGGNGSGDSGLVLSTDAKPRLKWTPDLHERFIEAVNELGGVDKATPKIVLKLMGIPRLTLYHLKSHLQTVVLLLPPPSMLASVAVRARVRGALVPRRVRGAEFAVVAVVVQVLMRGVASRLRGAVPARAAHPFCMRKSAMAAAMAPPSATRNATAIWWRFFKFPQRYSAIAAI

SEQ ID NO: 173590 - protein, 366 aa, Glycine max
  Coding DNA Sequence Number=SeqID_81905
  Gene Ontology: Mol. function=Rab GTPase activator activity; Cellular component=intracellular; Biological process=regulation of Rab GTPase activity
  Homolog annotation: Hit_ID=A7PAI7; Match level="QueryCoverage=91%, HitCoverage=91%, E-value=1e-137, Identity=69%"; Hit description =Chromosome chr14 scaffold_9, whole genome shotgun sequence
  Pfam annotation: Domain name=TBC; Domain location=104-304; Score =55.5; E_value=1.8e-13; Accession=PF00566.9; Description=TBC domain
MEKKRLDDYEPGPVPSPRALDRFGFVKQDVNTSEGLVKNRSAYEYESMSEYKKCGHWFYLYFHLPLIRYREERRVRKWRKMIGVGGSDWKHYLRRKPHVVKRRIRKGIPDCLRGLVWQLISGSRDLLLMNPGVYERHGPGQRSLYNVLKAYSVFDRDVGYVQVLLRTPSPCCACYKGMGFLAGLLLLYMSEEDAFWLLVALLKGAVHAPMEGLYLAGLPLVQQYLFQFECSVREHLPKLGEHFSYEMINPSMYASQWFITVFSYSFPFHLALRIWDVFLYEGVKIVFKVGLALLKYCHDDLIKLPFEKLIHALKNFPEGAMNPDTLLPLAYSIKSLSKKGITEPNFVFILTSVPALLPLSNSWTWD

SEQ ID NO: 173591 - protein, 48 aa, Glycine max
  Coding DNA Sequence Number=SeqID_81906
MPPWKMCSYSNCKNKEEPRKNNRMMLNLIKYHIIGYTSLVLIALMFAN

SEQ ID NO: 173592 - protein, 318 aa, Glycine max
  Coding DNA Sequence Number=SeqID_81907
MMGLYVQREDGTLGLVSMGKIMDGDSIIHTVAYADDVVRVSVETIIDPDVEIPYGTSEIQYVKQALDTFVAWPTHLVKVVLDEDAEIIPHKVDAHVAKPANVDADDLMRGLIKYSFDIYDKPVEFEFDGSNFGIVDAPTSIFLTYYDVSEIIAGDKSLNISVQQLWLIQILGQGSMYAFLEPQSLVVSKDTRGECQQYLERWLKESNREVYVGPYFHQKPDMHIKAAINSVMTKLKTSSSPESKAAAPKWIEVKSQVQTGCYECGYYMMHWMWNIITSEIKSDWSMWFGDETPLDKDNITTIRKKWARYFLKTACKNG

SEQ ID NO: 173593 - protein, 85 aa, Glycine max
  Coding DNA Sequence Number=SeqID_81908
MESRRETGTRGIHHHTRPQYSINSARHDPVLRTPYAHTRSMLCEFKRCFLKKRIIGVREESRVRERDFENLLSSRREDEGYKGNT

SEQ ID NO: 173594 - protein, 44 aa, Glycine max
  Coding DNA Sequence Number=SeqID_81909
MGLSGLKEHSNPVTPKAYTPKSPSGPLPPDSGPIPKIILAHRHC

SEQ ID NO: 173595 - protein, 477 aa, Glycine max
  Coding DNA Sequence Number=SeqID_81910
  Gene Ontology: Mol. function=acyltransferase activity; Cellular component=cytoplasm; Biological process=paclitaxel biosynthetic process
  Homolog annotation: Hit_ID=Q69FA1; Match level="QueryCoverage=98%, HitCoverage=99%, E-value=1e-136, Identity=52%"; Hit description =Anthocyanin acyltransferase
  Pfam annotation: Domain name=Transferase; Domain location=11-471; Score=16.8; E_value=9.5e-12; Accession=PF02458.6; Description =Transferase family
MAHPADLCQKLKVIEQCQVSPPPGSVPPTSLPLAFLDLPWVYCDTVQSIFFFEFPHSCNHFLQTVLPNLKHSLSLTLQQFFPFVGNLVIPPKPNFPHILYTSENSISFTIAESTADFPHLIADTARDVKDSHPFVPILPTPTTKEDGTWLLPLMAIQLTIFPEYGFSICISFRHVVADARAFLHFMKFWSYVCRTKHDVAATQDLLPLLNRDIIKDPKGLKFVFSEELWNSPIESIIKTPPKVVDKNDDKVRHAFVLRRDHVAKLKKWVSIECKSTYGLELESLHISTFVVTSALMWVCKVQSEEEVNAITIANNNNNDEIYSLKFLGDCRNRPEFSIPSTYFGNCIVIRIVSLNRSKLMGEKGIVEAAISIGRAVRDFQFDAMKDVENFMSLGRSGRKVKHSSTIAGSPKLGTYETDFGWGKPKKCEILHIEYSRTISLSDSRDEEGGVEVGLALGRAQMSKFSAILEEYLRNIAI

SEQ ID NO: 173596 - protein, 364 aa, Glycine max
  Coding DNA Sequence Number=SeqID_81911
MAPKKLSTKSAASEFDSHRFRSVEHQHRFEAIRGWSFHKERRVQLREDEYTDFQEEIARRRWTPLVTPMAKFDPEIVLEFYANAWTTEEGVRDMRSWVRGQWIPFDEDALSQFLGDPLVLEERQQCEFSQRRNRADGFNEEAIAQLLCTPGQDFARTAAGRRVRIMRTSMTTLTQTWMTLLLNNVLPSDHNSDLPLPKCQLVYAILTRMSVHVAQVIADAIYLFAGMVPTRHPLDQDKSNRALGFPALIRGLCQSYGVPVTASKAADAPPPPRQADPAGSLGVERYLQHLVRQQATNHCGQGQGSTPFVCPTPEQFGAEIAWPRDWPNAQPGEEPAGSPGEADESHMDEDMTDLLDFLGGSGAT

SEQ ID NO: 173597 - protein, 28 aa, Glycine max
  Coding DNA Sequence Number=SeqID_81912
MGKGRLRWRLPEDPFRVLPEEELVIGIN

SEQ ID NO: 173598 - protein, 199 aa, Glycine max
  Coding DNA Sequence Number=SeqID_81913
  Gene Ontology: Mol. function=oxidoreductase activity, acting on the CH-OH group of donors, NAD or NADP as acceptor; Cellular component =cytoplasm; Biological process=malate metabolic process
  Homolog annotation: Hit_ID=P12628; Match level="QueryCoverage=55%, HitCoverage=28%, E-value=3e-33, Identity=53%"; Hit description=NADP -dependent malic enzyme
  Pfam annotation: Domain name=malic; Domain location=60-186; Score= -8.7; E_value=2e-08; Accession=PF00390.10; Description=Malic enzyme, N-terminal domain
MVKHLCPSQNPRAKNLGEVDHRLKAFLSFSEVGSLSLDLSITRLLQSVPSNGDSDLINCALKMASLFFDIARHSSRKRASNHNSLSWPLPPDLTIKTNDEHILGFGDLGCQCLPITIDVGTNNENLLNDEFYIGLKQKRTTGQLLKEFMRAVKQNYGEKVLIQGTQSVVLAGLLASLKLVGGTLADHTFLFLGAKEIRV

SEQ ID NO: 173599 - protein, 678 aa, Glycine max
  Coding DNA Sequence Number=SeqID_81914
  Gene Ontology: Mol. function=translation initiation factor activity; Cellular component=eukaryotic translation initiation factor 2B complex; Biological process=cellular metabolic process
  Homolog annotation: Hit_ID=Q9FFV8; Match level="QueryCoverage=60%, HitCoverage=64%, E-value=1e-152, Identity=68%"; Hit description =Similarity to guanine nucleotide exchange factor
  Pfam annotation: Domain name=IF-2B; Domain location=417-665; Score =187.4; E_value=3.6e-53; Accession=PF01008.8; Description=Initiation factor 2 subunit family
MDPSRRAPRAVIDPIPKIRQVGFFAPPERSQSGPPDPTHSSPPISSSLSPVMIPPPRHLSDNLLLHAPRPASSPLSAAAAAGGSGNSFDYGAVFFPAPLSPAIPSSSYSSRIIATTGEGGFFKGNGAGGGKVAASSFPRGGFDLTAMKKAAAASVVVPASELTTVSVVNDSLGIPGEVRFVFVARFVNLKWVWMRNGGGCDIGCTWQVNRGAHTYEAWTLQPLGVSGVRQASVSVSDTDMTPVLQKEKGNKAGGSAVEVKDQPNSSKQQKPKLSKAERRALQESQRAAKAAAKGSKASGTVATMNAKPAKAVKPAQKVDNAAVAASEKKGGEIPPEKDRKKDAPQPRMQYDDKSRVEKAKRRAVVKQTEARNRVELFRHLPQYEHGSQLPDLEAKFFHLSPVHPSVYKVGLQYLTGDIAGGNARCIAMLQAFQEAIKDYKVPHEKTLVRDLTAKISSYVSFLIECRPLSISMGNAIRFLKSHIAKLPLTLSESEAKASLQSDIERFISEKIILANKVIVKHAVTKIRDGDVLLTYGSSSAVEMILLHAHELGKQFRVVVVDSRPKLRGQLLLRRLVEKGLSCTYTHINAVSYIMHEVTRVFLGASAVLSNGTVYSRVGTACVAMVAHAFRVPVILYKMRILFTLPGRFLHCVSKKVDVSMMFLQAIQMSFQMYWVERM

SEQ ID NO: 173600 - protein, 125 aa, Glycine max
  Coding DNA Sequence Number=SeqID_81915
  Gene Ontology: Mol. function=metal ion binding; Biological process =metal ion transport
  Homolog annotation: Hit_ID=A7PR64; Match level="QueryCoverage=61%, HitCoverage=52%, E-value=1e-27, Identity=77%"; Hit description =Chromosome chr14 scaffold_26, whole genome shotgun sequence
  Pfam annotation: Domain name=HMA; Domain location=27-92; Score=41.2; E_value=3.7e-09; Accession=PF00403.17; Description=Heavy-metal -associated domain
MGALDYLSNFCTVTSTRTKQKAMQTTEIKVRMDCDGCERRVRNAVSSIKGVKSVEVNRKESRVVVRGYVDPKKVLKRSNKFTELNYAFDCRVTRLVKLIGNEMDFDVQPKDIANSQSLACVANEL

SEQ ID NO: 173601 - protein, 97 aa, Glycine max
  Coding DNA Sequence Number=SeqID_81916
MTMKISPRVMRIMKLAKYRLKVQVEKDEENFWHLIKFGESFSPGSLLNQYQTYQGNPCGVYLDLSSFTGSGVYPDLSSFTGSGVIQIFVACIKRSAP

SEQ ID NO: 173602 - protein, 49 aa, Glycine max
  Coding DNA Sequence Number=SeqID_81917
MRQIHRIKRGKEVEGLEILAQQAMFAQRDTLAQWATSYYKKSHEKPDIT

SEQ ID NO: 173603 - protein, 137 aa, Glycine max
  Coding DNA Sequence Number=SeqID_81918
MVTNLEGCALCKANFYAFLWISRAISTFGLLVEAEAVAFHVAIELGDQSSNMHPEKSALSLRPSTSSSETETSSHCCGGAWTRTMRRGGPSTGSWRWMHRRIKSASLSSSPTWVRRCIRLPQHPQPWHPCHNLKFAQ

SEQ ID NO: 173604 - protein, 149 aa, Glycine max
  Coding DNA Sequence Number=SeqID_81919
  Subcellular localization annotation: CTP_CleavageSite=64; ConfidenceScore=5.03e-01
RRKVGKERVPERVGIDFGSPLWLALRLLGRSSSFSFCMSSSLSQTGLRFRDCNHIVEFVSATCRLSSKKSRKGKSPGKGGNRFWKSIVVGFKTPREAIEVDDPDFLHPRKEFPPQRQDFNTSEEQMRGRLRLAVAEWAKVTVNLDLSLS

SEQ ID NO: 173605 - protein, 101 aa, Glycine max
  Coding DNA Sequence Number=SeqID_81920
  Subcellular localization annotation: CTP_CleavageSite=69; ConfidenceScore=5.40e-01
MVILACIGNRRSNWRVSLGRGFSFVGNSGFSFAGMFSAFAGMAGVGQGNHHSYGRVSLNWSCQWYWRVRRGSFSKTLNSKFPPSHVYIYSAISFPNLVVRV

SEQ ID NO: 173606 - protein, 53 aa, Glycine max
  Coding DNA Sequence Number=SeqID_81921
  Subcellular localization annotation: CTP_CleavageSite=34; ConfidenceScore=5.27e-01
MAILPCIGNRQFDWRVPLGRLRRFSFAGVRPCRRSSMTDSTVAFLALLSSSSS

SEQ ID NO: 173607 - protein, 63 aa, Glycine max
  Coding DNA Sequence Number=SeqID_81922
MGCYRCSGATTFGQAMSASCDQLKKYCAMSVGATLCSNYLSTTYCIITTGAIHAYINPRFPPI

SEQ ID NO: 173608 - protein, 44 aa, Glycine max
  Coding DNA Sequence Number=SeqID_81923
MPNAPMGPPWSVSGNIPNITDLLGADERRGDRRRNPDRQARRWE

SEQ ID NO: 173609 - protein, 118 aa, Glycine max
  Coding DNA Sequence Number=SeqID_81924
  Gene Ontology: Cellular component=integral to membrane
  Homolog annotation: Hit_ID=Q9FNN8; Match level="QueryCoverage=54%, HitCoverage=10%, E-value=5e-10, Identity=53%"; Hit description=Cleft lip and palate associated transmembrane protein-like
MYLPKSQADKKKSLLGSSPDFSEAQVTSKVVDESEDDNDSNDDGSVEWASYWKPNITINLVADFTHILAFGMLLFFLFTMFKFLTMSLFNRVVYEELGKYGDVDNQLLCRERVEELGN

SEQ ID NO: 173610 - protein, 54 aa, Glycine max
  Coding DNA Sequence Number=SeqID_81925
MYGLRLKESIQLTITQPGEKMKNKKVAAAGISLSEAYALSEQHPLSETSAHLAS

SEQ ID NO: 173611 - protein, 52 aa, Glycine max
  Coding DNA Sequence Number=SeqID_81926
MDEDQWAYNNTMFEEVDMDFEDEQHCGVNEGYVDCLDAFNTSQVFATRDDIL

SEQ ID NO: 173612 - protein, 644 aa, Glycine max
  Coding DNA Sequence Number=SeqID_81927
  Gene Ontology: Mol. function=microtubule motor activity; Cellular component=microtubule associated complex; Biological process =microtubule-based movement
  Homolog annotation: Hit_ID=A7Q5T0; Match level="QueryCoverage=100%, HitCoverage=100%, E-value=0.0, Identity=58%"; Hit description =Chromosome chr14 scaffold_54, whole genome shotgun sequence
  Pfam annotation: Domain name=Kinesin; Domain location=102-425; Score =415.5; E_value=8e-122; Accession=PF00225.14; Description=Kinesin motor domain
MPVPNGEEQILLPETENASEVSKSPSLDLNPDSVDGSPPVSTVYTDVGVVPEHQKNELEHLISNLEGEIEELRLKQKKLDKKRREELSKILDIKGSIRVFCRIRPNLVTEKRKFSEPVSAGPEKIRVKFGGTRKDFEFDKGACALVGTSAESVFVEVEPILRSAMDGHNVCVFAYGQTGTGKTFTMDGTNEEPGIIPRALEELFRQASLDNSSSFTFTMSMLEVYMGNLRDLLSPRQSGRPHEQYMTKCNLNIQTDPKGLIEIEGLSEVQISDYAKAKWWYNKGKRFRSTSWTNVNEASSRSHCLTRISIFRRGDALEAKSEVSKLWMIDLGGSERLLKTGAKGLTLDEGRAINLSLSALADVVAALKRKRCHVPYRNSKLTQILKDSLGYGSKVLMLVHISPSEEDVCETVCSLNFAKRARAIESNKEVPVEVKKQKEKKIMELEEDIKEAEKQSQNLREQIQQIELKLNESKKLLFTTYSLVESDHIATSISPKDDVKEVIETPKASKKSIKRNFTNSMPRFMTSTVASRQRQSAAERDIGTVRLKSFRSIASKSSINFSYSQSLSYSDIRIKAILRSSNGKSRYAEADSVPIPKTVLTEKPKCNNDLEPKVTTPRSKMVTSSDQNFRVSLGRHRRRMSDLI

SEQ ID NO: 173613 - protein, 372 aa, Glycine max
  Coding DNA Sequence Number=SeqID_81928
  Gene Ontology: Mol. function=transcription regulator activity; Cellular component=integral to membrane
  Homolog annotation: Hit_ID=A7Q5W0; Match level="QueryCoverage=82%, HitCoverage=75%, E-value=6e-69, Identity=49%"; Hit description =Chromosome chr14 scaffold_54, whole genome shotgun sequence
  Pfam annotation: Domain name=DUF573; Domain location=91-188; Score =178.5; E_value=1.8e-50; Accession=PF04504.5; Description=Protein of unknown function, DUF573
MESDLNDAVFPEEDLDDDDDDETPEDEEDYDDETEPPPFVLAVVAVAPPASTASETLDTTLIPISAVADSSLKPLHPELIEEKKALDDSRRLFQRLWTDEDEIGLLQGFLDYTAQRGSSHHSDTALFYDQIKSKLQLGFNKNQLVEKLRRLKKKYRNVVTKISSGKDVSFKSPHDKATFEISRRIWSNTAPISGPVEDDDEINPNPNFGNSAKTPISRKRSRPQKRELNDGSTLNRDNNCIGNNNNNSNSNNNNNENCNGRHNLQGLIEETVKSCVSPVLKELVCGTGGMELGRGFGVGGGLGVGGGLALNSLQTQMTMPMTLLNLRIGETTMDEKWRKQQILELEVYSKRLELVQDEIKVALEELRSAGGV

SEQ ID NO: 173614 - protein, 385 aa, Glycine max
  Coding DNA Sequence Number=SeqID_81929
MLSSGPPKLPKWIPQEIIPTIGPVPTWKAHPEFDATQAKQLLPKRANENKVIDKIERKVLPWHIWDGKRVMNGLSDGSHIFLWKKMRLRSTVKPSCLAGRNNARQGVCHNVTGIGFVFDRVVVAKMIKEFPSRPVWEPGSLSPLDGQKHFKPLGSTESALCGAMLQPWLESSLDSMPLPFQKRCGQGFEDECLHQKPGFGGTPIGDQASETNMPILADKIGSEHRGHLFFQFSFLGIGITIRAYIDEDKIGNWVSFGDGEGLSEVGDIFGLYWNTCVNGSGLTQVVHRGRPRNDGHVSPPRPVDKRSGREAEEFRNVGPYKIVGTPTIDEDKNTVVVDGELKEVWFRTRVGFLSRTSLSSSAMNNWSGSRGHDRGATPVPSRIVA

SEQ ID NO: 173615 - protein, 349 aa, Glycine max
  Coding DNA Sequence Number=SeqID_81930
  Gene Ontology: Mol. function=binding; Cellular component=cellular _component; Biological process=protein transport
  Homolog annotation: Hit_ID=A7Q5U9; Match level="QueryCoverage=72%, HitCoverage=25%, E-value=1e-118, Identity=85%"; Hit description =Chromosome chr14 scaffold_54, whole genome shotgun sequence
MAIEIGNFQFKGWTRGERSATLWGGGGDTDGRKAIQDGFNFLGKFGEVVGEGVEAMGEAEDGVLKVVGGGFFGIVFSHGGQDTMSQALGICLRLLENTRSSDSVRNTAAATFRQAVALIFDHVVLAESLPTGKFGFGGQLSRTNSVTGDVNRSINLSESLDHESVSGRPPVMRETLTETGKLGLRLLEDLTSLAAGGSAIWLRVNILQRTFALDILEFILSNYVAVFRTLLPYEQALRRQICSLLMTSLRTNAELEGETGEPSFRRLVLRSVAHIIRLYSSSLITECEVFLSMLLKVTFLDLPLWHRILVLEILRGFCVEARTLRILFQNFDMNHWYIGMPYNYCALTN

SEQ ID NO: 173616 - protein, 398 aa, Glycine max
  Coding DNA Sequence Number=SeqID_81931
  Gene Ontology: Mol. function=binding; Biological process=protein transport
  Homolog annotation: Hit_ID=A7Q5U9; Match level="QueryCoverage=54%, HitCoverage=20%, E-value=6e-94, Identity=83%"; Hit description =Chromosome chr14 scaffold_54, whole genome shotgun sequence
MGLPCWSTPPFFFPWQGSSMTEVAPKKENKREMSIDVNQAIFLLTLKFSLMLIRIDLQSIEWSLDNDASNAAVLVASEAHAITLAVEGLLGVVFTVATLTDAAIDVGELESPRCDNDPPVKWTGKTAVLCISMVDSLWLTILDALSLILSRSQGEAIVLEILKGYQAFTQACGILRAVEPLNSFLASLCKFTINFPVETEKRSALPSPVSKRSELSVDQRDSIVLTPKNVQALRTLFNIAHRLHNVLGPSWVLVLETLAALDRAIHSPHATTQSSHCCALFFSLFSLRCRIIFGSLATVRFGEGSGVQCCGGWRRHTRNATTTPPNASRGECTRKKQNELTKSPSGICQGIPPSISSVLTYYGPQTDISIKSYNRLSLLINLIRETLLKNQLADQLDP

SEQ ID NO: 173617 - protein, 225 aa, Glycine max
  Coding DNA Sequence Number=SeqID_81932
MAILVDDKDFRSRGKLSCGRDSHLRGRCVGLQCGVRSPYVVTRGSQDGLIEANPDGPNEVTPAGCSNSAFLACSNTKTSDDTPLTNQAMDIVSSPSGTAIQLPINGVDTVSAKTASELPIEPANQLLIKAASETPIRAEKESGYQGRKRIEAASETPIEAEKESGYCLAEFQPDWALAENHVSNSPQLGTGLSDKRYKPSYGWISNDDEEEEELIELPLAPWLSE

SEQ ID NO: 173618 - protein, 188 aa, Glycine max
  Coding DNA Sequence Number=SeqID_81933
  Homolog annotation: Hit_ID=Q2HSV3; Match level="QueryCoverage=66%, HitCoverage=19%, E-value=8e-15, Identity=35%"; Hit description=IMP dehydrogenase/GMP reductase, putative
MTGIKGIPYRARIEALTVTDVCWMPYAEHRVVRGFDLISTYTGQLRWGQIVVYVRPERVLRQFGYIQTVPPLPVCDSFTGPDIDDRWLHFSDHLVPAGEICVVPGQVAPDYMDWFFRISHPFVTPTEDGVVVDCQGCQVIAEDLERIFNLRMVTEGTELYDIMTRCLRIARGDTTDGSLRPRQRRRIE

SEQ ID NO: 173619 - protein, 169 aa, Glycine max
  Coding DNA Sequence Number=SeqID_81934
MVIDQSLFYDLTQLSSEGVPFEGSLNDDWKFDFSVHDAHRFVCTNQADMTRRLLAGSLAFESRILHYLIVRILLPRSSNLAQVSEEDLIVMWAFHKGRQIDWAYLVRYRMHNVLRLNAPLPYPHLVTLFLQHLSIPLDSEPYVPIKRSFLIGAAVIASFGYRKEHDGSW

SEQ ID NO: 173620 - protein, 75 aa, Glycine max
  Coding DNA Sequence Number=SeqID_81935
MASDRKLRWSRVIDYQGCVSQRALRGRARARLTGALPKGGKMRGVATNVYLWKTSGKPKETGQNENSKSGSCIYA

SEQ ID NO: 173621 - protein, 16 aa, Glycine max
  Coding DNA Sequence Number=SeqID_81936
EYADEILITTNEILDV

SEQ ID NO: 173622 - protein, 77 aa, Glycine max
  Coding DNA Sequence Number=SeqID_81937
  Homolog annotation: Hit_ID=UPI0000ECBAF8; Match level="QueryCoverage =53%, HitCoverage=48%, E-value=1e-16, Identity=100%"; Hit description= UPI0000ECBAF8 related cluster
MFLSVLWFSGKQRQLVVAISGGGGGMQAWHWPSFYNVVTGKTLALPNLIALQHIPLSPAGVIAKRPAPIALPNSCAA

SEQ ID NO: 173623 - protein, 127 aa, Glycine max
  Coding DNA Sequence Number=SeqID_81938
MFNTHRCVTRKVSQHSGSQKEYCCVIRKVPQHSRSQEEHCCVILKVPQYSEGQKEYHCIIRKVSGCFGEKPAKNMKLGVLLHHNFIRGPLLIASEGLTPIAMESVKFREVFEGKQPKHKNRGVNLSR

SEQ ID NO: 173624 - protein, 166 aa, Glycine max
  Coding DNA Sequence Number=SeqID_81939
MEEPSKKRKGSSSRSQRHSETQETQIPSSISSSSLFSSEEQRIRYTNIFSSRSIIDPKFIDMDFFSNESFECIQAFENSNLIPFMSLKLHVYTELVKAFYSNLEIQEGTLISKVYGIEMVIDQSLFYDLTQLSSKGVPFEGTLNDDWKFDFSVHDARRLVAPTKRI

SEQ ID NO: 173625 - protein, 76 aa, Glycine max
  Coding DNA Sequence Number=SeqID_81940
  Subcellular localization annotation: CTP_CleavageSite=33; ConfidenceScore=5.32e-01
MSKRSSSDVLPKDGGIFYGPKVVNALLSRQLSRSSSGVVHQSGSFSDPVMERLGNYFIRQYQYNTDMAPDRNNFRA

SEQ ID NO: 173626 - protein, 61 aa, Glycine max
  Coding DNA Sequence Number=SeqID_81941
LHRVGRVPFMEACLWSFNGGWIFELQWVPSMVIFHHGDAMKGKGEKERGGTICWIKWPRNN

SEQ ID NO: 173627 - protein, 68 aa, Glycine max
  Coding DNA Sequence Number=SeqID_81942
  Homolog annotation: Hit_ID=A5BEV8; Match level="QueryCoverage=94%, HitCoverage=8%, E-value=4e-09, Identity=42%"; Hit description =Putative uncharacterized protein
MFVDYVNQTWIIPHKEKFVKAGMNEIMHLGNTTTNRVESTHWALKRLLQNSHRNLCSVWEAMNNMITV

SEQ ID NO: 173628 - protein, 177 aa, Glycine max
  Coding DNA Sequence Number=SeqID_81943
MAPRKLSSKRSRKDAAASGTSAAPEFDSHRFRSAEHQQRFEAIKGWSFHRERRVQLRDDKYTDFQEEIARRRWTSLVTPMAKFDPDIVLEFYANAWPTEEGVRDLQSSVRGQWIPFDADALSQFLGYPLVLVEGQECEYGFCPDRCRETGADHAHQHDYLDPDLDDVAAQQHPAQRS

SEQ ID NO: 173629 - protein, 216 aa, Glycine max
  Coding DNA Sequence Number=SeqID_81944
  Gene Ontology: Mol. function=chitin binding; Cellular component =extracellular region; Biological process=chitin metabolic process
  Homolog annotation: Hit_ID=UPI000069F178; Match level="QueryCoverage =73%, HitCoverage=93%, E-value=2e-14, Identity=33%"; Hit description =Mitochondrial antiviral-signaling protein (Interferon-beta promoter stimulator ...
  Homolog annotation: Hit description=protein 1) (IPS-1) (Virus-induced- signaling adapter) (CARD adapter inducing interferon-beta) (Cardif) (Putative NF-kappa-B- activating protein 031N).
  Subcellular localization annotation: CTP_CleavageSite=79; ConfidenceScore=5.53e-01
MLVRMIRTRFFAAARVKSCPSMHSSSVIASLSSCARTVGPPPISGGGPGTVWIWSPLKVRTRSPLKARACSPLKFRTCRLSKARECSPMMARTCNPLKVRACSPTKVKAHDPLTARTCSPLKLKVHDPLKARTCSPLKVKARTYSPLEVRACSPLVVRTCSPLKARTCSPLTVRVRACSPLMVRTCSPLKARTCSPLTVRVRACSPLIVRTCSPLK

SEQ ID NO: 173630 - protein, 96 aa, Glycine max
  Coding DNA Sequence Number=SeqID_81945
MVLFCTWFAWILHAKRNLHWRHRGQWTRGWQPAAAAGDFSFDWRFPRLRVVGCRGTEAIEAISEALNGAAAAGSRQQDLRLGEFPKPPTGTAVCFA

SEQ ID NO: 173631 - protein, 257 aa, Glycine max
  Coding DNA Sequence Number=SeqID_81946
  Homolog annotation: Hit_ID=Q6WAY6; Match level="QueryCoverage=57%, HitCoverage=25%, E-value=3e-15, Identity=31%"; Hit description =Putative uncharacterized protein
MVEVSTEAIASLAQYYDQPLRCFTFGDFQLLPMVEEFEEILGCPLGGRKPYLFSGFYPSLARISKIVQISVQELDHRKQFENGVVGIPRRYLEGKARILAGKGEWALFIDILALLIFGGVLFPNVDGLVDLAAIDAFLAYHNHRESPVVAMLADLYDTSTEDVRHACPLESHRSCIEKGGANWDQLLANKGRFGVTSMKRRESRSSYFMRRISECSLDGDEGLHQLQSRSCYKTTWLPYERGTTRGRARACHFTRFQ

SEQ ID NO: 173632 - protein, 88 aa, Glycine max
  Coding DNA Sequence Number=SeqID_81947
LIIVSGKKDILVSCSFPTPYVEAVEESLETSFQALEVMSNAYVESSLVQPRLSGVALMVARAMLGHKYEPGMGLGRNGDGTASLVEFT

SEQ ID NO: 173633 - protein, 246 aa, Glycine max
  Coding DNA Sequence Number=SeqID_81948
  Homolog annotation: Hit_ID=Q2HW90; Match level="QueryCoverage=79%, HitCoverage=39%, E-value=2e-19, Identity=30%"; Hit description =Putative uncharacterized protein
MGSNQTPLIKKRFYQVKIKSLEVASLQELGQLMGQLQCQAIRKTYKKIWDLAMVEVSVEAIASLTQYYDQPQRRFKFGDFQLVPTVEEFEEILGCLLGGRKPYLFSGFYPSMARVSKVVKISVQELDHVKQNRNGVVRKPRKHLEEKAKALANQGEWTSFIDILALLIFGVILFPNVEELVDLEAIDAFLAYHYSKESSIIAILADVYDTFDQRCKKSGARIVCCTPVLYVWLILHLFRQESRGIH

SEQ ID NO: 173634 - protein, 92 aa, Glycine max
  Coding DNA Sequence Number=SeqID_81949
MEACLWGFYGGWIFELQWGPLMVIFHHGDAAEDKGKEAQKKEKPILTFTKKNGSNLDPWAQKSTLRFMRTLGPSLVALAQASWSLLSNALGG

SEQ ID NO: 173635 - protein, 190 aa, Glycine max
  Coding DNA Sequence Number=SeqID_81950
AILGGEAPSSLAYSLVDGASPILFSFAFRCISMDEELRGSSNGPIDGYRRWLKAYTQGLDWLPNLRTTKAVEGEAPEEDEEVQALKTELERAQTTKEKFKLAAVRIRKENAELRDINIATIKEGPQGRTWPEQVPRGYVGQGVCLSGYARPKQIAIISKYKEELNLATAHEHEVADEYTRVYAEKEARGK

SEQ ID NO: 173636 - protein, 221 aa, Glycine max
  Coding DNA Sequence Number=SeqID_81951
DKDDVEDNVYEKYGISKDKWAQFYQTCRDPSWEDVQKKTQAIQKQNTAPHMLSREGYDYLEQKLMAEKTKKKLEETTQSGGTEGVINPPSPIKRHVKWKMASTKKTGQMTSEAAKEIAEKIASQGSFVPHGHEDVLTATVGRLEHPGRVHTGGVGVTIKQYFGSAPRSSRSSSSIPPEDLEQLTQQIRDQLEESITEKVTRQLMASFSQMQFQLQSQMQSQ

SEQ ID NO: 173637 - protein, 85 aa, Glycine max
  Coding DNA Sequence Number=SeqID_81952
  Subcellular localization annotation: CTP_CleavageSite=52; ConfidenceScore=5.54e-01
MTATVLGALSTNSASRPSRDGHFSGSDVSSSGTTRGRARYTILGEGSVDPVRCGCSQPIPGIPFSAGGGLGMRVWPEEEPVRWVR

SEQ ID NO: 173638 - protein, 292 aa, Glycine max
  Coding DNA Sequence Number=SeqID_81953
MEAEAENNDLKKEENNNDNNNNNNESNRKIGNSSECLSKPKHQMKMPFQLETLEKAYAKLPIGDYEGGVVREVRVVGSVVTDVVLSLAVERQEGVIGKEAAKGSGVAGFSGGGAQVGVEEVTADSKASKVVVKGKAADPMKVCERLQKKSGKKVELISPLPKPPEENKEEEITTTRGEKGGGLWDIINLHMRRSDSAANLIFSLLEILPMETRNIFAITLLCIWKMRNERVWEWMSTPPAISIVQCLQYLHECNFKEGIFGAGMVLRDGKGYFMKAKKVTAQRNPDTKEAKA

SEQ ID NO: 173639 - protein, 386 aa, Glycine max
  Coding DNA Sequence Number=SeqID_81954
  Gene Ontology: Mol. function=heat shock protein binding
  Homolog annotation: Hit_ID=A7P2B8; Match level="QueryCoverage=34%, HitCoverage=61%, E-value=3e-35, Identity=59%"; Hit description =Chromosome chr1 scaffold_5, whole genome shotgun sequence
  Pfam annotation: Domain name=DnaJ; Domain location=157-219; Score= -3.2; E_value=0.0086; Accession=PF00226.22; Description=DnaJ domain
  Subcellular localization annotation: CTP_CleavageSite=34; ConfidenceScore=5.04e-01
MNYLQHQQLGVATDLDQSNNPVNPKSKLIQTGKSANLMSSDLISDFTFENPIRSNPPDYLAEEVQRLRKRRKAEKRLLDMQRRQKERIEEVRETQKKDEEVMNLKEQLRVEIQKGLNQLEMRCHDMPSLLRGLGIQVGGSFIPLPNEAIQSMPAGHLSLNRKKPSLRERRAYKRALLKFHPDRASKTDVRAQVEAEEKFKLISRLKEKFGMTSLVTLLLKWFGFNVDGHDRDVCNTCADKTQPVPAMVVMEVVASVVVVDVVAGVAADVVVDDGQSKRLRVDDANHDENGARGRETKRREMGLLAMEGDGADALLDVHGGDESGAKTREGVGVRADSQSRMTSTLAVISRVLVVISKVWVVMVDRFWVEAAMDDRLDQIVTNRGQS

SEQ ID NO: 173640 - protein, 156 aa, Glycine max
  Coding DNA Sequence Number=SeqID_81955
MERNLGSWSTSEGTCAFSMLKLENRWNPCFGCDGVNEINGLIWEAKAFHSNSPAQWSPPPTGVLKCNIDVFKTSVLKSGNIMTNCTTLFGAFPNCHIDYVCRLIRLIVQPSIGADSENLKHPLPIRVQYENRSDFQIHHWLLEPISPLKDEVEPLS

SEQ ID NO: 173641 - protein, 355 aa, Glycine max
  Coding DNA Sequence Number=SeqID_81956
MSIAGLIDPEMNHNKSFHRRNNSGELDVFEAARYFSGYSEVLGSTTTTYTQKINMREERHHHHHHHGHRAARISLDMPMRSLLPQQFHGMEKQIIMKEKKHKQPSSPGGRLASFLNSLFSQSASKKKKSNKSSSQSMKDEDESPGGRRRRRSSISHFRSSSTADSKSLYSSLSSGFRTPPYVQTPTKSCKEFRTFSSENKHALSFSAKYNNNKNNNGQHVRSSTATTTLQNEFLWDEKKKREPTTTTTLLDDNSNHKHLSEKQKNNNNKGSHELLLEKDRMLVDNKYSSEEKETTTQFKNFNEVVVDDGAESDSSSDLFELQNYDLRYYSSGLPVYETTNMDSIKRGAPISNGPL

SEQ ID NO: 173642 - protein, 320 aa, Glycine max
  Coding DNA Sequence Number=SeqID_81957
MQFFVSQVEFDIPEASDLRTKKKILQNVEEWWRQFKSDLTSKWALAADKDSVDDIVCEKYDISKEKWAQFCQSHRDPSWEARAIQKQNSAPHVLSRGGYEFLENKLMEEKKKKQLEEETKFGSTNTIIDPPSSIRQHVKWKIRQDVLIVAAFGQPKHPGHVHAAGASVMIKQYFGLAPRTSRTSSSMTTNGLALPPEPKVAPSTARVSTKENCVDPSGKDPDKDKGNLDKYGLYIKEYPPRLVALRILYEGSTTVHNIPLCHDKVKVGVEEVRDADALIPIPTKEGAMGLKKPVDRLDHDVDDPLYLMTLIIPQPFLMLL

SEQ ID NO: 173643 - protein, 113 aa, Glycine max
  Coding DNA Sequence Number=SeqID_81958
MVFTDERIDVGLKRGKFSHPAWTNEKTGANEEGEDEGKTYAVTAILIRPAPGRCIEHCRALKRKVQGLIDAGWLKFEENHVIFNFHRKWVQAIGQFAQATYAPELGTSKTVGG

SEQ ID NO: 173644 - protein, 146 aa, Glycine max
  Coding DNA Sequence Number=SeqID_81959
MWQWRVDCINKKAVCAGKLSQGSKGVEEYYKEREALMIQAKIEEDEEEFVEIEDLLHKTIRVEQQLKRKGVAKRSSTNYGLGHYAYECPNKKAIILRDGEYISESEVEKGEESEDDEEEVEKTLEGELLMIWRLLGHQLKSMEESQ

SEQ ID NO: 173645 - protein, 76 aa, Glycine max
  Coding DNA Sequence Number=SeqID_81960
MMEENTSPTNKGQWQPHSTNHPIVEEYPCGTFALRRHRQKLLFSIVDIVWHVGGRYVHRSYDIGCNCSRIPMSTRS

SEQ ID NO: 173646 - protein, 78 aa, Glycine max
  Coding DNA Sequence Number=SeqID_81961
MLEGDSSRETVREFAKCNLQWLSARKNPEEDELSSSLSAPLQVIKHTASAHPLSETSALSQNPLMRAKRSGSALSARA

SEQ ID NO: 173647 - protein, 55 aa, Glycine max
  Coding DNA Sequence Number=SeqID_81962
MATKGWSFVGASMVEEEEENGNFLAFLCARRGQFSKVGNIYIKTLRIKPRVWFRG

SEQ ID NO: 173648 - protein, 98 aa, Glycine max
  Coding DNA Sequence Number=SeqID_81963
  Homolog annotation: Hit_ID=A5B5G3; Match level="QueryCoverage=83%, HitCoverage=5%, E-value=2e-07, Identity=37%"; Hit description =Putative uncharacterized protein
MVVIVNVEACGYVSMNYYQYIDVVYTNEHILKAYSAQWWPLGNEAAIPPSDDAWTLIPDPTTIRAKGRPKSTRIRNEMDWVEPSEHRTKCSRCGAEWA

SEQ ID NO: 173649 - protein, 95 aa, Glycine max
  Coding DNA Sequence Number=SeqID_81964
MQKLIKERMTNKVVNFVGLNKVVLGIKWNNEMRKRRLSDGWTEYRNGKNSSYRAPNEVIPKRGERLKMKGRKESLFPARATHKGCESPLIQPGCS

SEQ ID NO: 173650 - protein, 55 aa, Glycine max
  Coding DNA Sequence Number=SeqID_81965
  Subcellular localization annotation: CTP_CleavageSite=38; ConfidenceScore=5.36e-01
TQKSRARRSEAPSPSAAPTPPTSSLPSALAAPVLLGPSAQSSEPFMSMLKSLHQG

SEQ ID NO: 173651 - protein, 62 aa, Glycine max
  Coding DNA Sequence Number=SeqID_81966
MGEKKPGENKMEEKKAEEEEKKEEEKKPGESKDDKESKEEFAPPAIVQGTTFAMHEHFKHDF

SEQ ID NO: 173652 - protein, 96 aa, Glycine max
  Coding DNA Sequence Number=SeqID_81967
MLGKLGRINGDPGLRKTRIWATWEYVSSVGGGQQGMVGLCAICGCGKLVVHHRPTATQYHIVVPGDMSRGSGDLGDVRWGAIAPKPSLTNPDPTRA

SEQ ID NO: 173653 - protein, 179 aa, Glycine max
  Coding DNA Sequence Number=SeqID_81968
  Homolog annotation: Hit_ID=A5BSZ8; Match level="QueryCoverage=47%, HitCoverage=8%, E-value=2e-13, Identity=47%"; Hit description =Putative uncharacterized protein
MLEEKSVTIIDANSNEEKAHYKAWERSNSLNLMLMRMTIADSIKTTLPKIENAKKFMGLVGEHSQTADKSVVETLMSTLITMKFDVKEEMRLKNQGSHLVHNVNHQGNQGAGKKFMKKHDKGKGSLKINDDSLQIQKKVSNDNNCQFFRKSEHFQKDFLKCKPWFEKKGIPYNPNHKPK

SEQ ID NO: 173654 - protein, 77 aa, Glycine max
  Coding DNA Sequence Number=SeqID_81969
MEIAMNVLSAPVTLNLFIATVKILDSQMNALSGPCRAKRAKRPFASAKCTLCAKPECYSIKVELSAPCCAKLRLSSI

SEQ ID NO: 173655 - protein, 85 aa, Glycine max
  Coding DNA Sequence Number=SeqID_81970
MAGSGQQTHHRHLQSPSAHLQRMECCLRLMADQQATKSKAKEVLLGGNLELATKKLPAKWSRKGTIEEDSSVAPQADTSFDKHRF

SEQ ID NO: 173656 - protein, 176 aa, Glycine max
  Coding DNA Sequence Number=SeqID_81971
MVGYTPSSFADLVFAGEIIEVEGENEGETHVVTAIPIQPSFPPTQQCHYSANNKPSPYPPPSYPQRSSLNQPQSLSTSLPMTNTTFSTNQNTNQEINFAAKKPVEFTPILVSYADLLPYLLDNSMVAITPAKVHQPPFLREYDSNAMCACHGEAPGRSIEHFRALKRKVQGLIDAS

SEQ ID NO: 173657 - protein, 182 aa, Glycine max
  Coding DNA Sequence Number=SeqID_81972
MAPKKLSTKRSRRDAHGESSNAPMEFDSHRFRSAEHQQHFEAIKGWSFHMKRRVQLREDQYSDFQEEIARRHWKPLVTPMAKFDPEIVLEFYANAWPTEEGVRDMRSWVRGVTPTRHPLDPERSNRALRFSALITGLCQFYGVPVIPSKVILPPITRTFIEKYCNPRQAQGDAQQAADAPPP

SEQ ID NO: 173658 - protein, 75 aa, Glycine max
  Coding DNA Sequence Number=SeqID_81973
  Subcellular localization annotation: CTP_CleavageSite=33; ConfidenceScore=5.23e-01
MSQGNFNRGSPESAPDRQPKLLNPRSLVRLNIQASSVDPSYPSCKNRLNSSSLRKCSLIYPKLCPQIPHVRLGLN

SEQ ID NO: 173659 - protein, 63 aa, Glycine max
  Coding DNA Sequence Number=SeqID_81974
MDFYKVERNLKDRKSLGDWMLAQVVAEPITIQIFVLLCSNLESMSNLKLMLQTFTVDLLRGIL

SEQ ID NO: 173660 - protein, 126 aa, Glycine max
  Coding DNA Sequence Number=SeqID_81975
VIRSPISRAFIKKYCTPRQAQGDAPQAADAPPPPHQADSAGSLGTERYLRHLVHQQAANHRGQGQGFAPFACPTPDQFRAEIAWPGDWLEDQTEEAPAGAPDDAEDARMDEEMIDLLGFLGGSGAT

SEQ ID NO: 173661 - protein, 84 aa, Glycine max
  Coding DNA Sequence Number=SeqID_81976
PFVKVKRSFSIGANVVSSFGYLKERDGSWVKKDAPVQATEDRSPSPHSQRDDSSSLMHSILESFDGLQTYVSERFDALERQVDT

SEQ ID NO: 173662 - protein, 40 aa, Glycine max
  Coding DNA Sequence Number=SeqID_81977
CCGDRRIVPLASSTSKARTTVLPLRCVVALVGSSYDRSTP

SEQ ID NO: 173663 - protein, 162 aa, Glycine max
  Coding DNA Sequence Number=SeqID_81978
VQSKHSFPPYGLPPNYTSPNVVYAPGENVNNSTPILNENQQPQPNHALVSQPLGETHEAPQDHTLADFGSHPEYTIKGHAFPGAPVPNAPGGGPRYQSPPRPLHFAIRESPSTVLEKEGIKNMEERLRAIEGGGNYAFADTADLCLVPDVVIPPKFKVPNFN

SEQ ID NO: 173664 - protein, 212 aa, Glycine max
  Coding DNA Sequence Number=SeqID_81979
MVNELGMRTLLRLGGVDGDPVLRGTRRRATRAPGSQPIKEQKSTKKGGLCGGWPAIYLMLLFEKFLLIAMAAQLIHDRVVMECLEGVWETLEGNERCRFRGIVQLTTTSLVHPEKPARTLQQPVEWILPTPTPYRLVEPVQLIEVSPSEEDLEEDPEELPPEPAMDAPDLPEDDEDSLPDVDSPEDITSASEADSTEESGPGGTANSDDPSS

SEQ ID NO: 173665 - protein, 285 aa, Glycine max
  Coding DNA Sequence Number=SeqID_81980
  Homolog annotation: Hit_ID=A7UQU7; Match level="QueryCoverage=61%, HitCoverage=33%, E-value=1e-12, Identity=30%"; Hit description=IMP dehydrogenase/GMP reductase, putative
ARSKLKVVSHGAQVLPLPTAPTMRAYMLQLVVSRPNHGVRDEMTITLDDVSCLLHLPVTGKHIDHVPSIFDRDAVKILLMTHLGILTEEEAMTVTNAAARARVLATTVYLLHLVDNTIFANKSLTHIHVTYLFYLSNLDVCHEYTWGVTTLAYLYDHLSYASQYTNNQVGRYMTLLIEIMGYVHLPSVGYSEHGTGALDDPIANRWKPTKGFSFIKCGTNVWPYLLEKVVEHVIPLGNVVPPRNHWACTPNYLPWFYKEGFEAMCNLERQRKSLVKGGKKGDRGG

SEQ ID NO: 173666 - protein, 75 aa, Glycine max
  Coding DNA Sequence Number=SeqID_81981
MIATLHEPDDFNKAKEMFLLQGMNAIKARYLGENKVLISPENGSNLEEWFVNKEEWLGGFCESVEAWSPRNVTGN

SEQ ID NO: 173667 - protein, 361 aa, Glycine max
  Coding DNA Sequence Number=SeqID_81982
MASRKRKSIGTKPIAQYDTRRFHSFEAWNQYMDNVLGRHILPERKVEIYHTELDEFKAELERRNFHKCLTNLVDSSIDLALVKEFYANLYSSKDPSPKQVRVRGHLEKIDADSLNTFLEMPVILAEGFVLNSEGHPGKILRKDLTTLAQMDMNVGALISGQITSIAQSNSSRLGFPTLITALCKARGVNSDSLVFERLSPVINLAYIRKNCWNPYDLTISIRGARRARTRPAEPPSTSTAPIPACTSAAPSVPASADFQRSIPSVEQFTELVAWPGTQSSLRREDEGPTAQVSQHVEDDSSEATIPEPFVRGMEAEETQEAAATLERSLEVASESPAQGEDIPSPQPATDPSTLVLDLSED

SEQ ID NO: 173668 - protein, 291 aa, Glycine max
  Coding DNA Sequence Number=SeqID_81983
  Gene Ontology: Mol. function=transferase activity, transferring glycosyl groups; Biological process=metabolic process
  Homolog annotation: Hit_ID=Q8S3B9; Match level="QueryCoverage=100%, HitCoverage=71%, E-value=4e-83, Identity=53%"; Hit description =Putative glucosyltransferase
MASAAQDATNMPNVENYTFRSTCAFTTSVYFWELMGRPLVESLCVPEIPSLEGCSTTQFMDFLIAQSNFLKFNDGNIYNTIREIEGAYIDFMDRISGDENLGTGPFVVFGVRHASVSVSDTRPCQRPTPTQHPYYVLYFGHYRCPRVRIRVVSGVRVGVLRDADKGDIFDGNEAKWHELPNGFEERIEFLLREHNHGGATAAWPMHSDQPRKSVLITEVLKVGSLVKDWAQRNALVSASVGENAVRRLMETKESYEMRERAVRLKIAIHRSMDEGGVSCMEIDCFMAHITK

SEQ ID NO: 173669 - protein, 109 aa, Glycine max
  Coding DNA Sequence Number=SeqID_81984
  Pfam annotation: Domain name=zf-CCHC; Domain location=41-54; Score =10.8; E_value=0.035; Accession=PF00098.14; Description=Zinc knuckle
MELQRLNQNEETDKRKRSIALKAFSSMQEEEEDDEEDFSLFCNQPGHIKANCPSNESWPEKNEKKSYKERRSKKAYIPWDDNDSFDGSKKEINLLSKDYESDENISEEV

SEQ ID NO: 173670 - protein, 46 aa, Glycine max
  Coding DNA Sequence Number=SeqID_81985
MCILTYVMTAQTNRYICRGRLALWSSGRMLLNSNDKFFIARMRTVL

SEQ ID NO: 173671 - protein, 1384 aa, Glycine max
  Coding DNA Sequence Number=SeqID_81986
  Gene Ontology: Mol. function=magnesium chelatase activity; Cellular component=cytoplasm; Biological process=chlorophyll biosynthetic process
  Homolog annotation: Hit_ID=O65808; Match level="QueryCoverage=100%, HitCoverage=100%, E-value=0.0, Identity=90%"; Hit description =Magnesium chelatase subunit
  Pfam annotation: Domain name=CobN-Mg_chel; Domain location=327-1306; Score=1803.7; E_value=0; Accession=PF02514.7; Description =CobNMagnesium Chelatase
  Subcellular localization annotation: CTP_CleavageSite=52; ConfidenceScore=5.56e-01
MASLVSSPFTLPNSKVDQLSSLAQRHLFLHSFLPKKANGYASSSKASLRVKCAAMGNGLFTQTTPEVRRIVPEKNQGLPTVKIVYVVLEAQYQSSLSAAVRVLNSNKKDASFEVVGYLVEELRDESTYKTFCKDLEDANIFIGSLIFVEELALKVKAVVEKERDRLDAVLVFPSMPEVMRLNKLGSFSMSQLGQSKSPFFQLFKKKKQSSAGFADSMLKLVRTLPKVLKYLPSDKAQDARLYILSLQFWLGGSPDNLQNFLKMISGSYVPALKGTKMEYSEPVLYLDSGIWHPLAPCMYDDVKEYLNWYGTRRDANEKLKSPNAPVIGLILQRSHIVTGDDGHYVAVIMELEARGAKVIPIFAGGLDFSGPVERYLIDPITKKPFVNSVVSLTGFALVGGPARQDHPRAVEALMKLDVPYIVALPLVFQTTEEWLNSTLGLHPIQVALQVALPELDGGMEPIVFAGRDPKTGKSHALHKRVEQLCTRAIKWAELKRKTKEEKKLAITVFSFPPDKGNVGTAAYLNVFSSIFSVLKDLQRDGYNVEGLPETSEALIEEVIHDKEAQFSSPNLNVAYKMNVREYQSLTPYATALEENWGKPPGNLNSDGENLLVYGKQYGNVFIGVQPTFGYEGDPMRLLFSKSASPHHGFAAYYSFVEKIFKADAVLHFGTHGSLEFMPGKQVGMSDVCYPDSLIGNIPNIYYYAANNPSEATIAKRRSYANTISYLTPPAENAGLYKGLKQLSELISSYQSLKDTGRGPQIVSSIISTARQCNLDKDVELPEEGEEIPAKDRDLVVGKVYAKIMEIESRLLPCGLHVIGEPPSALEAVATLVNIAALDRPEDGISSLPSILAETVGRSIEEVYRGSDKGILKDVELLRQITEASRGAITSFVQRTTNKKGQVVDVADKLTSILGFGINEPWVEYLSNTKFYRADREKLRTLFDFLGECLKLVVADNELGSLKQALEGKYVEPGPGGDPIRNPKVLPTGKNIHALDPQAIPTTAAMQSAKIVVDRLIERQKAENGGKYPETVALVLWGTDNIKTYGESLAQVLWMIGVNPVADTFGRVNRVEPVSLEELGRPRIDVVVNCSGVFRDLFINQMNLLDRAVKMVAELDEPAEQNFVRKHALEQAQALGIDVREAATRVFSNASGSYSSNINLAVENSSWNDEKQLQDMYLSRKSFAFDCDAPGAGMTEKRKVFEMALSTADATFQNLDSSEISLTDVSHYFDSDPTNLVQSLRKDGKKPSAYVADTTTANAQVRTLAETVRLDARTKLLNPKWYEGMLSTGYEGVREIEKRLTNTVGWSATSGQVDNWVYEEANTTFIQDEEMLKKLMNTNPNSFRKLVQTFLEANGRGYWETSEDNIDKLRQLYSEVEDKIEGIDR

SEQ ID NO: 173672 - protein, 71 aa, Glycine max
  Coding DNA Sequence Number=SeqID_81987
MEVKLGRIDGDPVLRETRIWATWEYMSSVGGGLQGMSGTWRYVAGVRRPWGRQVGCHCPKPSLTNPDPTWA

SEQ ID NO: 173673 - protein, 102 aa, Glycine max
  Coding DNA Sequence Number=SeqID_81988
MGGLGVKNLKDFNEVLLGKWRWSLFLEEGSLWSEDLKKICGGNGRARWFDEGIEWKVDKDSQQSRVHTVEIPEGLFGNKRKSITQEYHHQSSGFSLLFMRTS

SEQ ID NO: 173674 - protein, 68 aa, Glycine max
  Coding DNA Sequence Number=SeqID_81989
  Subcellular localization annotation: CTP_CleavageSite=22; ConfidenceScore=5.53e-01
MTPCSLQPPTSTSALTMFQGTRVARFNNFNGGGSGGGMSELGGGSKVGGIRGRVEGVRKGEEERVLED

SEQ ID NO: 173675 - protein, 179 aa, Glycine max
  Coding DNA Sequence Number=SeqID_81990
  Subcellular localization annotation: CTP_CleavageSite=35; ConfidenceScore=5.07e-01
MKGVFLQHHHCWPPPPWNLRRPTSTSSSLSFISLVLQTGRQINWAHLVRYWMHKALWANAPLPYPHLVTLFLHHFNVPLDDEPYVKVKRSFSIGVGVVTSFGYRKDVDGQWVRKQDLPPLIPDERTPSPPPERDASSSLLIEVLTELRAIFKHWWVSILMRWILALMGWILVSLGLKMI

SEQ ID NO: 173676 - protein, 77 aa, Glycine max
  Coding DNA Sequence Number=SeqID_81991
MSASGTAVSDSLVSGKLEDDSEDQGSSRIGNVVLSCRNFLLCSMLFRLRVASISKSNGTKSPVEDFPHIQSTSKNNN

SEQ ID NO: 173677 - protein, 186 aa, Glycine max
  Coding DNA Sequence Number=SeqID_81992
  Gene Ontology: Mol. function=peptidase activity
  Homolog annotation: Hit_ID=Q8H6W2; Match level="QueryCoverage=39%, HitCoverage=78%, E-value=2e-10, Identity=46%"; Hit description=Gag -protease polyprotein-like protein
  Pfam annotation: Domain name=zf-CCHC; Domain location=114-131; Score =28.6; E_value=2.3e-05; Accession=PF00098.14; Description=Zinc knuckle
MASSNSLFPEGNSIHRPPIFNGESYHYWKTHMEIFIEAIDLNIWEAIEIGPYIPTIVDVSTSTTTQKPREEESEDAEDFSLFVKKFKKFVKKRRIERRQNFNNGRRSQEDSQILRCYKCNQLGHIKANCPLNEEWPEKSNKKRYEERRTKKAYIAWDDNDSSDGLEKEINLLTKDYESDESISKKD

SEQ ID NO: 173678 - protein, 71 aa, Glycine max
  Coding DNA Sequence Number=SeqID_81993
MSASRECRAEEYKTHDHPRDTNGTVATYPSTGGRRVTHGRRVPRMEYARSRHQCLFEENVGKTGKDVIYEF

SEQ ID NO: 173679 - protein, 140 aa, Glycine max
  Coding DNA Sequence Number=SeqID_81994
MTCEEPFGPAIFHLLSSEAAEAAGSMTCGDKFWSFRTPFRHSDTVVSDGTQRLTSSSAPFVIQSRVRWHAETNIVFCAFCHPEAAGPMTCGEPFGPALFHLLSSRGGEPDDMRGTIWSSESSDKHAETNYGHSAPFVIQG

SEQ ID NO: 173680 - protein, 67 aa, Glycine max
  Coding DNA Sequence Number=SeqID_81995
MHALLGSLNSGNWSDSKVLDSAGLSCRAFTRNQGVIILVEFSLTRGICKRCLIRIRLNYHEESKFGI

SEQ ID NO: 173681 - protein, 177 aa, Glycine max
  Coding DNA Sequence Number=SeqID_81996
MSCLVIIAPISLCRSVSWCMPPTRHPLDPDKSNRALGFPALITGFCQSFGVPVTPSKGDAPQDADAPSPPHQADPAGSLGMERYLQHLVRQQAANHRGQVQIHECLYRFSLSQQGQGFAPFACPTPEQFRAEVVWPGDWPEAQAGEAPVGSPGDAEKARMDEEMTDLLGFLGGSEAT

SEQ ID NO: 173682 - protein, 80 aa, Glycine max
  Coding DNA Sequence Number=SeqID_81997
SSKGIRPPTNRAFIKKYCVSRQAQGETPQQPGDGRQRATDAPPSPLEFTSAHPQKGLSIVYTIWPTNRRPSPKPKVVKIP

SEQ ID NO: 173683 - protein, 64 aa, Glycine max
  Coding DNA Sequence Number=SeqID_81998
MAFIILRFMHSFHKLEIHAKVITQCQSFLSQLRSHSHRMAVDHQELELEMTEEQALVMLPPPEH

SEQ ID NO: 173684 - protein, 38 aa, Glycine max
  Coding DNA Sequence Number=SeqID_81999
MAFFQSYLDCKAQNAQVTNALRNGNVAHTPEVFSNIPM

SEQ ID NO: 173685 - protein, 153 aa, Glycine max
  Coding DNA Sequence Number=SeqID_82000
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=33%, HitCoverage=50%, E-value=4e-24, Identity=100%"; Hit description=LacZ protein
MGPKSTLRLMRTLRLSRASLAQSSWSLLSNALAGPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 173686 - protein, 222 aa, Glycine max
  Coding DNA Sequence Number=SeqID_82001
MYTGAGFCPDCCREASANDMTTLTQIWMTLLLSNILPIDHNSDLPMPKCQLVYAILTWMSIHVAQLIADAIYIFAGMAPTRHPLDPDKSNRALGFPSLITGLCQSFGVPVAPTKVIRPPITRAFIEKYCTQRQAQGDAPQAAGAPPPPHPAGQAGAFDMEQYLRHLVRQQAANHRAHVAWPGDWPEAQAGEAPLEAPGDGEEAHEDEEMADLLDFLGGSGDT

SEQ ID NO: 173687 - protein, 65 aa, Glycine max
  Coding DNA Sequence Number=SeqID_82002
MLPKGERTWESTYGYCHHQKGGDCRQRIKLNVLMMPKDYMNHMLLKDLLKTKQLKIFKMDDQDNL

SEQ ID NO: 173688 - protein, 90 aa, Glycine max
  Coding DNA Sequence Number=SeqID_82003
ANGGVEGYGALAMQGVATIGLVQVCRHKSLIFLWCSAFILFSDFSQYKKKVEKHIKVAIFISKLHGFRFVEKVEKHIKVAIFISKTSWVQ

SEQ ID NO: 173689 - protein, 257 aa, Glycine max
  Coding DNA Sequence Number=SeqID_82004
  Gene Ontology: Mol. function=motor activity; Cellular component=cell projection
  Homolog annotation: Hit_ID=UPI00016621D1; Match level="QueryCoverage =97%, HitCoverage=40%, E-value=1e-23, Identity=35%"; Hit description =UPI00016621D1 related cluster
RIPVLVFRGLHVLALRGLHILAFKGLHTLAFRGLHVLTFRGLHVLAFRGLHVLTFRGLHVLAFRGFHILAFKGLHVLAFRGLHALAFRGLHALAFRGLHALTFRGLHVLAFKGLHVLTFKGLHVLTFRGLHVLAFRGLHVLAFRGLHILAFRGLPVLAFRGLHILTFRGLHILAFRGLHVLAFRGLHALTFKGFHVLAVRGLHVLAFRGLHVLAFRGLQVLAFKGLHVLTFRGLHIRAFRVLKVLLFISGKCTGSRK

SEQ ID NO: 173690 - protein, 115 aa, Glycine max
  Coding DNA Sequence Number=SeqID_82005
  Homolog annotation: Hit_ID=A5BP71; Match level="QueryCoverage=65%, HitCoverage=19%, E-value=2e-12, Identity=48%"; Hit description =Putative uncharacterized protein
  Pfam annotation: Domain name=zf-CCHC; Domain location=88-105; Score =16.2; E_value=0.0054; Accession=PF00098.14; Description=Zinc knuckle
MVIIVNAEACGYVSLNYYQYIDVVYTNEHILKAYSPQWWPLGNEAAIPPSNDAWTLIPDPTTIRAKGRPKSTRIRNEMDWVEPSDHRQKCSRCGAKGHNRRRCPMQSERASCSNH

SEQ ID NO: 173691 - protein, 99 aa, Glycine max
  Coding DNA Sequence Number=SeqID_82006
  Gene Ontology: Mol. function=catalytic activity; Biological process =cellular metabolic process
  Homolog annotation: Hit_ID=A5BH93; Match level="QueryCoverage=63%, HitCoverage=5%, E-value=3e-10, Identity=54%"; Hit description =Putative uncharacterized protein
SFNLRGDGPFQVLDKINDNAYKIDLPNGGALDLRTNHFQEGGSDEDITKGKDHEALEGPMTRGKLKQAQHSDEDTTKGKDHEALEGPMPEVDLSRPNTS

SEQ ID NO: 173692 - protein, 122 aa, Glycine max
  Coding DNA Sequence Number=SeqID_82007
  Homolog annotation: Hit_ID=A5BLU9; Match level="QueryCoverage=96%, HitCoverage=10%, E-value=8e-16, Identity=43%"; Hit description =Putative uncharacterized protein
  Pfam annotation: Domain name=zf-CCHC; Domain location=99-116; Score =23.5; E_value=0.00041; Accession=PF00098.14; Description=Zinc knuckle
VASISISANLNSVPVLNGANFKDWKENMQIGLVCMDLNLALRIEKSLSPTDSKERLKQERTKSAHVVSTSKDNGERKRTEDPKNEAAKGPAQKKQNQGDNCFFCSKPGHIKKKCTKCLARKE

SEQ ID NO: 173693 - protein, 71 aa, Glycine max
  Coding DNA Sequence Number=SeqID_82008
MTKVKLGEIDGDPVLRGMRIRATWEYVSSVEGGQLGMVGLCVICGCGELFCTIARSPPSTTCDGYPIMLQA

SEQ ID NO: 173694 - protein, 140 aa, Glycine max
  Coding DNA Sequence Number=SeqID_82009
MASRKRKSIASIPTTQYDSRYTDNILGRNILPERNVKIYHTEFDEFKVELERRNLHKRLTNLQDGSIDVVVVKELYANLYTLEDQAPKQARVRGHLIKIDADSLNEFLQTPVVLEEGESLPTYSRLCRLRSNPQEIEARL

SEQ ID NO: 173695 - protein, 104 aa, Glycine max
  Coding DNA Sequence Number=SeqID_82010
  Subcellular localization annotation: CTP_CleavageSite=41; ConfidenceScore=5.23e-01
MPRALENLALPLLFVTVKSLFSFSSRLKTAGNRSLDTHIVLAQTHRTPYTAGKPTFSSLEPTEPPTLFLEVWLKENPTYTVATRVLKQSWVLKAQSFLCELQYC

SEQ ID NO: 173696 - protein, 64 aa, Glycine max
  Coding DNA Sequence Number=SeqID_82011
MIWNVLPDYMKFMEFLAKSPFGKRKPHAKRIIVHALSRESQALSAQPLHLRLIWSAKLAKVELS

SEQ ID NO: 173697 - protein, 307 aa, Glycine max
  Coding DNA Sequence Number=SeqID_82012
MYHTELDAWNRFLYLPERKVELYHIELDDFKTELERHNFHKRLTNLVDGSIDLALVKEFYANLYSYEGPSPKKARVRGHLVKIDADSLNIFLEIPMVLAEGETLPTHSRYCRLPIEYREIEAALCIPGRGLTFERLSSVINLAYIRKKCWNPEDQTVSIRGARRVVAPPGSIPLVEQFWEMVAWHEAQPSLHREDEGPIAQVPQDVEDESSEATVPEPFIVGEEAGETQVRQVAAATPERSLKATSKTPAPTVDLSSPQHAANPFTSILEIHEDLTTPVLTLDTSPPATLVLHLIDEEDVQTLDTQD

SEQ ID NO: 173698 - protein, 104 aa, Glycine max
  Coding DNA Sequence Number=SeqID_82013
MTRGNPSDLQPFDPEIDRAFHRLVRHHLVPFEHLEHSDIGDFEHYNFVHSENMAQPPPRERTLREMVAPDFTYESLCIQYPDEDVQYVLKTGKIHLLPKFHGLA

SEQ ID NO: 173699 - protein, 100 aa, Glycine max
  Coding DNA Sequence Number=SeqID_82014
MASPMTCGGSVWLSAPFVNQGEQVRWYRDDVGLPPISWASSHEGTWFLTNKMSGATSIGKYGTNLLQKFVKSWKPQIFLIVGGVGHSGMNFFLLGFVGTP

SEQ ID NO: 173700 - protein, 78 aa, Glycine max
  Coding DNA Sequence Number=SeqID_82015
MDNRKVSPHATGFWVMIAKGGVVDKSEAFAPTYPQFVMRNSDLRADNRKVSPHATGFWVMIAKGGVVDKSEAFAPTYP

SEQ ID NO: 173701 - protein, 134 aa, Glycine max
  Coding DNA Sequence Number=SeqID_82016
MIIYNSLTNEITITHLGTKFLLHPQTPSQVAKDQVQIKLKWDEEKNIKRKKEQPLMVKEECKEVSVASKRLAKKESHFAIKTNIKEISVLRQPPHLLLCKRTLVRTIISLELEVIPQATEIWMTPLPVKEDKSG

SEQ ID NO: 173702 - protein, 91 aa, Glycine max
  Coding DNA Sequence Number=SeqID_82017
MSTTHLVVSMNEWPRIMEIFESSSMSTITKSTEKNSLNHSTRIPFYDNALIVDVLFFLREEVLQNLVYISICCRTSPKGMVISSFLKMSRK

SEQ ID NO: 173703 - protein, 291 aa, Glycine max
  Coding DNA Sequence Number=SeqID_82018
MACKPRQDFSVAKLGRIDRDPVLRETRIRATWEYVSPVEGGQQGMVGLYVICGCGELFCTIARPPPSTTCDGVVPGDMSRGSGDLGDVRRAPGSQQIKGTKTTKQGGLLKSEDRKLRWPLVIDYQGVLRNEGSMLWRPLVIDYQAVQSITPGNMPLVIDYQIVMAAQLIHDRVKMECLEGAWETLKGNTRCRFRGTIRFTATSLWILPTPTPYRLVEPVQVIKVTSSEEDPEEDLEELPPEPAVDALDFPEGDEDPLPKVDSPEDVMSASEADSTEDSGPGEMAISEGSSS

SEQ ID NO: 173704 - protein, 207 aa, Glycine max
  Coding DNA Sequence Number=SeqID_82019
MNLVYIISTQISMIAQHDFSRLGFPALITALCKAWGVTSDSLFFESLSPSINLAYVKKNCWNLDDPSGKRFEAPSSSPLPTYAPFTFAPASSTPAQASAPTPSGPSTVSSNTLPAMLQILHKGQASAAQEPVPEDEDESLPPEPFIYEPDTKIAQEEAPSPELIPQSSPSPALVLEDPEPSAPAPIPDQPLAQDPLAALMLDLNEHA

SEQ ID NO: 173705 - protein, 245 aa, Glycine max
  Coding DNA Sequence Number=SeqID_82020
MTAKETNKKAAEEATTFVVDGEPVPEEVIIDEDDVKRLEAIYEPLTYDNISNVQEGLEHRKVIQVTAEPIRLSPIFATLDRHLTRMLSFGMENMKQGLEKRIGYWDSGFPGIDPSFYPILDNLPEEEQPALSVYDVDGPAIHMLPPRQTATPNPNNIIYIYEPSTMSLPKPSFAQAFKGHAFAKNESHKWSLIGDFFYKKPSRWKPHRFHMTPGSPLTISSNFKDSGDEFLRKFDEEAAKQKGRK

SEQ ID NO: 173706 - protein, 473 aa, Glycine max
  Coding DNA Sequence Number=SeqID_82021
  Gene Ontology: Mol. function=transketolase activity; Cellular component=chloroplast; Biological process=metabolic process
  Homolog annotation: Hit_ID=Q42676; Match level="QueryCoverage=54%, HitCoverage=81%, E-value=5e-52, Identity=62%"; Hit description =Transketolase, chloroplast
  Pfam annotation: Domain name=Transket_pyr; Domain location=235-378; Score=-54.4; E_value=0.018; Accession=PF02779.15; Description =Transketolase, pyrimidine binding dom
  Pfam annotation: Domain name=Transketolase_N; Domain location=71-319; Score=-125.5; E_value=3.2e-07; Accession=PF00456.12; Description =Transketolase, thiamine diphosphate b
  Pfam module annotation: Pfam domain module=Transket_pyr::Transketolase _N; Domain location=235-378::71-319
VDKDALVEVDTRSGCHSGTKDIIECNDEHVGKSVSNDLVDDSQKTSALEDFCKKSELTEPQTRTSNEEDQSHFALSKRLRANNWFEASLCGHELKASMGLVAVAKVFEAHRIFAEEFGSSALSIIKNENLVLKFRERYLLWEKVALLVLGMTVFGLDLPIETKDTIPVGLDDTIDHTDSVSSEEVFVDSESDCQTSVVEPSPTCVMPISKFITISQVTTTIGFASPNKVNSYSVHGSALGAKEVDATRKNLGRPYELFHVLEDVKKHWSRHTPEGAKWNETFFIFHDLEAKWNAKFVEYEKKYSEEAAELKAIITGELPASWEKALSPIEHLASFRAMPNTLMLRPTDGNETVGSYKVVVVNRKRPSIVALCRQKLTQLPGTSIEGVEKGGYTISDNSSGRKGKAVTIASFVSWELFDEQSDEYNESLLPASVTARVSIETGSTFGCHNIVGSKGKEFGITKEAVIAAAKELP

SEQ ID NO: 173707 - protein, 142 aa, Glycine max
  Coding DNA Sequence Number=SeqID_82022
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=29%, HitCoverage=41%, E-value=5e-18, Identity=100%"; Hit description=LacZ protein
  Subcellular localization annotation: CTP_CleavageSite=54; ConfidenceScore=5.20e-01
MENISLKSLSFGPPCAKGGSFLLSLLFFGLLLVWKTPPLEPKFVFFSSIFTKLSFSSIESGRHRGGAPIRPIVSRITIHWPSFYNVVTGENPGVTQLNRLAAHPPFASWRNSEEARTDRPSQQLRSLNGEWDAPCSGALSAA

SEQ ID NO: 173708 - protein, 389 aa, Glycine max
  Coding DNA Sequence Number=SeqID_82023
MHALLGSFNSGNWSNSKVLDNARLSCRAFTRNWEEGGELPLYSRFCRLRPDPQELAARLCIPGRGFELNADGLPLKILRKNLTTLAQTWSVLSFSNLAPTSHTSDITLDRARLIYGIIQKMDMNLGYIISSQISMIAQHDSSRLDFPTLITALCKARGVTSDSLSFESLNPAINLAYVKKNCWNLDDPSVTFRGPCKAMGNRSETLLSSKIPPLAAPSTIVPASFAPSASAPLPAPIITPPTGPSSFTSETLYAMLQSLHKGQVIIMKHLQSSGLQPMMSVKEFLSQVAWPGVQPSPSGGDKASAAQEPVLEDDEPVPPEPFVYETDPTSAQEEVASPEPVPHPSPAPVLDDSQPFAPAPVPDQPLAQDPPAAPVLDLNEHAEDHLQND

SEQ ID NO: 173709 - protein, 341 aa, Glycine max
  Coding DNA Sequence Number=SeqID_82024
  Subcellular localization annotation: CTP_CleavageSite=24; ConfidenceScore=5.10e-01
MWFPGSFPFTSYPKFVNINQCTLRVRLIASEPNLRSCLMDEGLTAPAQPPPANNANLGMNSNMERNPLVKKLLEFTLIPMSYGDLLPTLIANQLAVVTLGRIYQSPFPKWYNPNAGWLTFQEDGPNVKTNLFANHEGSAMNAIEACSLQRPKHLKDITTSRRFIFEALQDVGMIPLGGHKGDPCLMHPVDKKSPKKPKPLVIHFTRDAAPQNHRGPSTLSGSKPVPFPYKNSKVVPWRYAPQKPSEKKEEATDIDSFSAKVTNITRLSGMTCSGCIFAVPNLPVRPANVKGKAKMVVEEANEANSTLDEDVPTGRFAKRGEGLDRKEVSLEEANEFLYLIQ

SEQ ID NO: 173710 - protein, 156 aa, Glycine max
  Coding DNA Sequence Number=SeqID_82025
VAGFVICDGAHESGCCIPQEETTHEVNYMGNQPRHNFNGHGRNHPGNPFNKVQGGPSTRPREQGPSLYDRTSKLEETLDQFMQVSMSNQKSTKSTIKNLEVQVGQLAKQLADRPLSIFGANTEKNPKDECKAVMTRSRLANNVDEEKTEKKIVEEK

SEQ ID NO: 173711 - protein, 66 aa, Glycine max
  Coding DNA Sequence Number=SeqID_82026
MPFFLETLFGFALFEDTDLVFLEKVVWKQSYNDDSPGCFDDAKAQRVVSRIKNQAFKIPFKYSRIK

SEQ ID NO: 173712 - protein, 64 aa, Glycine max
  Coding DNA Sequence Number=SeqID_82027
  Homolog annotation: Hit_ID=Q9LHM4; Match level="QueryCoverage=59%, HitCoverage=2%, E-value=9e-07, Identity=65%"; Hit description =Retroelement pol polyprotein
MRANALLAKKSKCYFGVTRVEYLGHFITREEVSTDPAKAIIEAKLAFQCLKDQLRQTPILAFDQ

SEQ ID NO: 173713 - protein, 182 aa, Glycine max
  Coding DNA Sequence Number=SeqID_82028
  Gene Ontology: Mol. function=nucleotide binding; Cellular component =intrinsic to membrane; Biological process=defense response
  Homolog annotation: Hit_ID=Q2YE87; Match level="QueryCoverage=97%, HitCoverage=14%, E-value=2e-70, Identity=75%"; Hit description=NBS -LRR type disease resistance protein Rps1-k-2
  Pfam annotation: Domain name=LRR_1; Domain location=109-132; Score =5.2; E_value=34; Accession=PF00560.24; Description=Leucine Rich Repeat
  Pfam annotation: Domain name=LRR_1; Domain location=133-155; Score =2.3; E_value=1.1e+02; Accession=PF00560.24; Description=Leucine Rich Repeat
  Pfam annotation: Domain name=LRR_1; Domain location=158-181; Score =14.1; E_value=0.54; Accession=PF00560.24; Description=Leucine Rich Repeat
  Pfam annotation: Domain name=LRR_1; Domain location=16-43; Score=4.4; E_value=48; Accession=PF00560.24; Description=Leucine Rich Repeat
  Pfam annotation: Domain name=LRR_1; Domain location=61-85; Score=4.1; E_value=54; Accession=PF00560.24; Description=Leucine Rich Repeat
  Pfam module annotation: Pfam domain module=LRR_1::LRR_1::LRR_1::LRR _1::LRR_1; Domain location=109-132::133-155::158-181::16-43::61-85
MVESMVEAISSIETTCLQHLKLRDCSSAISFPGGRLPASLKTLVISNLKNLEFPTQHKHQLLESLFLYNSCDSLKSLPLVTFPNLKSLPIENCEHMESLLVSGAESFKSLCSLRISQCPNFVSFWREGLPAPNLTDFEVLHCDKLKSLPDKMSTLLPKLEYLDISNCPEIESFPEGGNWSFT

SEQ ID NO: 173714 - protein, 48 aa, Glycine max
  Coding DNA Sequence Number=SeqID_82029
MVKYRAKSETEMSRGTWGGARMDARPMINSSLSRVQLRTIEKRYREVA

SEQ ID NO: 173715 - protein, 40 aa, Glycine max
  Coding DNA Sequence Number=SeqID_82030
MVGYTPSSFADLVFTDERIKTRTTLPLCSRIPYNKRPTVS

SEQ ID NO: 173716 - protein, 82 aa, Glycine max
  Coding DNA Sequence Number=SeqID_82031
MLLVEVLDTVFPTSMTRPSKVEMIPPPGIVPVAGEHKLQAIQLLQIAAHKGKGLCGGRQRSINHRVWRQVQIFYSWPVGLPG

SEQ ID NO: 173717 - protein, 68 aa, Glycine max
  Coding DNA Sequence Number=SeqID_82032
  Gene Ontology: Mol. function=nucleic acid binding
  Homolog annotation: Hit_ID=A5C306; Match level="QueryCoverage=83%, HitCoverage=4%, E-value=7e-11, Identity=54%"; Hit description =Putative uncharacterized protein
MGREREHANCSGYMDLDLALRIEKPPSPTDSSTSEQRKLHEKWDHSNRMNLMIIKRGIPEVFRGTVFK

SEQ ID NO: 173718 - protein, 99 aa, Glycine max
  Coding DNA Sequence Number=SeqID_82033
MANLTSSRINGELTLVSLTNHKSTESAIKNLEVQVGQLAKQLAEKSSSTFGANTEQNPKEECKAVMTQGRKLTMEEKKKEKMVEDDKQQLVIEPTPKPV

SEQ ID NO: 173719 - protein, 74 aa, Glycine max
  Coding DNA Sequence Number=SeqID_82034
PHQLDLAPYALGPYNAQWNAPRLLRDKRTLCSSRILGEMEVDEPWLGLSRCKIHFLVGVLVYAKGGVCHWKCGR

SEQ ID NO: 173720 - protein, 81 aa, Glycine max
  Coding DNA Sequence Number=SeqID_82035
MDEHFRVSNCNSAKDMWDTLQVTHEGTRNEHEMELSQPTLRREGDTRAHGASSKGGRRAESPPTIIRGKRRKNRKGVVYEL

SEQ ID NO: 173721 - protein, 72 aa, Glycine max
  Coding DNA Sequence Number=SeqID_82036
MTVKADQKHAQQCYAESLKVALYPPTREPAKLYPTADEAQSLLKNSSSYNSDPNSGSACSSTGTSPAMSTDA

SEQ ID NO: 173722 - protein, 71 aa, Glycine max
  Coding DNA Sequence Number=SeqID_82037
MDKSDKRNFKEKKAYITWEDNGMDSSSDSKNEIINLGLMAKDYESEEEAMSSNYDLSISFDELQDAFNDFA

SEQ ID NO: 173723 - protein, 115 aa, Glycine max
  Coding DNA Sequence Number=SeqID_82038
QLHVDDAVDMLVELLEVSVAEARAETIQCHGSYVRLLWLRDVYQTKIEACHWIGIAALVHMYDNLNEAPKSTERKLVGYITLLQRWIYEHFPFVGSALAVEDYVERRPRACLRDL

SEQ ID NO: 173724 - protein, 93 aa, Glycine max
  Coding DNA Sequence Number=SeqID_82039
MGTKTPQTISQHHIKIKGIKIIGFSSIREKEKGLEPQFHYLHTRSISLLTDDTSQIPMVGLYDIKFQRFGYIRKKIGFWERKKGERTWEKKRV

SEQ ID NO: 173725 - protein, 179 aa, Glycine max
  Coding DNA Sequence Number=SeqID_82040
MAPTRHPMDPDKSNRALGFPALITGLCQSFGVPVAPTKVIRPPITRAFIEKYCTQRQAQGDAPQAAGAPPPPHRAGPAGSFDMEQYLRHLVRQQAANHRAHVQTHDCLYQLSLSMQSQGFASFSCPTPDQFRAGVAWPGDWPEAQAGEAPPEVPDDGEEAHEDEEMADLLDFLGGSGAT

SEQ ID NO: 173726 - protein, 162 aa, Glycine max
  Coding DNA Sequence Number=SeqID_82041
GKIKLKTPKEATELIENMSASDYAILRDKVVPFVVRLMNQVIAFPLKNTLRKFITWEIDRGKDTTKEDFQGGPSNMPPQQRPNIFQRTAKLEETLAQFMQVTMSNHKSTESALKNLKIQVGQLAKQFAEKSSISFGENTEKNPKEECKVVITRSKKLVAAED

SEQ ID NO: 173727 - protein, 74 aa, Glycine max
  Coding DNA Sequence Number=SeqID_82042
MEREEKRELYRIRCSYKENNVGDDMEGGIWLVCALDAPWLRVPVTADEVETPFRFFDGRSAVIDYIDPIIDYQN

SEQ ID NO: 173728 - protein, 299 aa, Glycine max
  Coding DNA Sequence Number=SeqID_82043
  Homolog annotation: Hit_ID=Q6WAY6; Match level="QueryCoverage=62%, HitCoverage=30%, E-value=3e-16, Identity=32%"; Hit description =Putative uncharacterized protein
IPVVGIPRKHLEEKAKALADQGEWALFIDVLALLVFGAVVFPTVDGLVDLATIDTFHTYHHSKESLVMAVLANAYDTFNRRCEKSGARIVCCTPTLYVWMVSHLFHHESRPVYPLQGHHICPEKGKANWEHLLANMVEASVNWFPRWKEGRVGVLSSCEGFSNIPLMGMRGCINYNLILAIRQLGYPMRRASAMQRKDRELTGSSNGIIGNYHKWLKTKTQELDWLSKLKASIEEEAKTPKESEEVQALKVELERAQEVKEKFKTTAIKVQKECNKLRGVNVATVEALERETKRARKEE

SEQ ID NO: 173729 - protein, 104 aa, Glycine max
  Coding DNA Sequence Number=SeqID_82044
GMVVLYVICGCGELLCTIARSPPSTTCDGVVPGDMSRGSGDLGDVRRAPGSQQIKEQRPQSKEACVVASQLLRNGTGRLEAYGNRLPVCVIDYTEEWVTGNRLP

SEQ ID NO: 173730 - protein, 118 aa, Glycine max
  Coding DNA Sequence Number=SeqID_82045
MTETSMRVGNYDVYGFLEPQSIQRSGQSQFESESYMKNWMQNLKRDVYLEAYLNGPASMFVFNNSLKGLDDTPQPKSKAGARWIVVKYFNDVRPLKSERLKALRIQWVKYYLKVRSET

SEQ ID NO: 173731 - protein, 66 aa, Glycine max
  Coding DNA Sequence Number=SeqID_82046
MVVAFMDEIDGVQIHLSSLDYLTWRADPTGSYSTKSAYNLLMDDGSSDNEDKNSKCWSRHVLLHKK

SEQ ID NO: 173732 - protein, 138 aa, Glycine max
  Coding DNA Sequence Number=SeqID_82047
MKNHPSEEVVMESGLLRPTLERLSSPKTHPSLCGIRNRKIELPLIIKCTLKWYTITGKLQSNTLSSKKDKSTKLGSIMEREEKRELYRIRCSYKENNVGDDMEGGIWLVCALDAPWLRVPVTADEVETPFRFFNGSAI

SEQ ID NO: 173733 - protein, 472 aa, Glycine max
  Coding DNA Sequence Number=SeqID_82048
  Homolog annotation: Hit_ID=A5C7Z4; Match level="QueryCoverage=24%, HitCoverage=41%, E-value=6e-07, Identity=29%"; Hit description =Putative uncharacterized protein
MGLVLPDSQRPFLGAEKTKKKLEEAAQSGSIDGVIDPSSPVRRHVKWKMAHTKKTGEMTTEAAKEIAEKIGTQGSFIPHGRQDVLTAAIGRPEHLGRVCAAGAGVTIKQYFGSAPRTSRSSSFLPPEELQQLTQQIRDQLEESITEKVTRQLMALFSQMQSQMQSQGLALPPEPLVGPSGPRVSTKGSCIDLSGNDPKTGDSDRCGLYIEANPVRLVALGSVYEGSIVVHNTPLLPGQVKVGMEEVKDADAPVPVPIVEADTSGQVFITAAVSPEKPPQKLDPVVDDPLYLMTLTIPEFFLRPYQVTWDATVFGVFNPDFPLYIKHEDLSEIAHGGNLDIYGFLEPQSIKSEHWQMVAIVPKEHRVVWFSSLHIRLDSYLKEIINSALKGLDDAPQPKSKVPARWIIVKCNRQKGSTECGYCVMQWMSTIILGSFRNNWEAYFNDARPLEPERLKALRIQWVQYYLRVKDQS

SEQ ID NO: 173734 - protein, 175 aa, Glycine max
  Coding DNA Sequence Number=SeqID_82049
  Gene Ontology: Mol. function=magnesium chelatase activity; Biological process=chlorophyll biosynthetic process
  Homolog annotation: Hit_ID=O65808; Match level="QueryCoverage=87%, HitCoverage=11%, E-value=1e-64, Identity=84%"; Hit description =Magnesium chelatase subunit
MKCAAIGNGLFTQTTPEVCRIFLENDHNLPAVKIVYEDLQAQYQSSLTAAVIALNSKRKHASYEVLGYLVEELRDVVTYKTFYKDIEDANIFIGSLIFVEELALKIKVAVEKERERLDAVLVFPSMAEVMRLNKLGSFSMSQLRQSNNPFFQLIIHFYVKQQYSMWSFISSLYAH

SEQ ID NO: 173735 - protein, 301 aa, Glycine max
  Coding DNA Sequence Number=SeqID_82050
  Gene Ontology: Mol. function=motor activity; Cellular component=cell projection
  Homolog annotation: Hit_ID=UPI00016621D1; Match level="QueryCoverage =77%, HitCoverage=42%, E-value=2e-16, Identity=31%"; Hit description =UPI00016621D1 related cluster
THVLANRGLHVLAKRGLHALTFRGLHVLASRGLHVLAIKGLHALAIRGLHVLAKRVLHALTFRGLHALAFRGLHALSFRGLHVLAIRGLHVLAFKGLHVLPFIGLHVLAIRGLHILAKRGLHALTFRGLHAFAFSGLHVLTIRGLHVLTFKGLHVLPFKGLHVLAKRGLHALTFRGLHALTFRGLHALAFRGQHILTIRGLHVLTFKGLHVLTFRGLHALAFRGLRVLTFRASSFLLSVPFPGPLADLRGGPNVRAQPEGGYHAATVHTGARFDPCHCKETSVNHAHQHDHSYTDMDDVAT

SEQ ID NO: 173736 - protein, 157 aa, Glycine max
  Coding DNA Sequence Number=SeqID_82051
MSDIVDPAHSVKDITDLCVQYFRAGCQDIVSDIVDPAASILHLTFYLALCIVRAVMQVGSATFIIRVIKHSGIGNGDSKILQVASRFQDVKTSHVTSAFCSPCLHALAAASSISYSSFPGCQDISRDIRFLLPLSPCSSCSIFYQLLVVTVAYISHH

SEQ ID NO: 173737 - protein, 64 aa, Glycine max
  Coding DNA Sequence Number=SeqID_82052
MLFAMLDIITSNLGDPIWAISSDTLNSLVGLSLNFFLILPFINFGFIGFMYGVVGVVCPVEPGA

SEQ ID NO: 173738 - protein, 121 aa, Glycine max
  Coding DNA Sequence Number=SeqID_82053
MYPPLFSLNNLVDVTSTRTDPQEMYPLLFSVTITQVDVPSTCTTKDGTSFLVQVEGTSTWVAVTENKRGYISCGLVLVEGTSTRLIKENKGGYIPSGSLLVKEFTRLKRNLNDCRSLGDWM

SEQ ID NO: 173739 - protein, 39 aa, Glycine max
  Coding DNA Sequence Number=SeqID_82054
MAIDGTNKSEDLSLAACVTRVDSSTICCPNSVGIAFFLG

SEQ ID NO: 173740 - protein, 128 aa, Glycine max
  Coding DNA Sequence Number=SeqID_82055
MPSKIILMMPKNQESSKFQRIKIQASFKNQDQDSRLKIQESREDSIKIMYILCGTSRVYIYLGCYTKNKRGYISCGSVQVECTSTWLFKENKGGHIPCGSLLVKDFTRLLEIQKPVVAWGLDVGTGGG

SEQ ID NO: 173741 - protein, 235 aa, Glycine max
  Coding DNA Sequence Number=SeqID_82056
MIYGIILRMDMNVGYLISDQISMIAQHDSSRLGFPTLITALCKARRETFDSRTQESFRPAINLAYVKKNCWNLDDLTVTFRGPRKAKGKKSETLPSSQVPPTTSAPSTSTPTSSTPATSAPSPAQLPFLAPSSGPSDFCFTPKMLHAMMLSLHRGQVAWPGVQPSPSGGGGTSAAQEPEPTDEHTPAAEDELASPEPFSFASDYVVAQEEVPSPEPIPEPSPAPISEDTLPSVNA

SEQ ID NO: 173742 - protein, 192 aa, Glycine max
  Coding DNA Sequence Number=SeqID_82057
VAEDDVSLCVLSGFSSYRQQNVYTDNHSGISACQRGTEDDVSLYVLSGFSSYRQQKVYTDYHSSIFARQRDSKVKDDVSLCVLAGFLAYRKLNVYTNNHSGISAHQRVSKVSMTDLVSAEDNGTEDDVSLCVLSGFSSYRMQKVYTDNHSGISGRQRDSKVSMTDLVSTEDDVNLHVSTGLSAAIDEGRRTR

SEQ ID NO: 173743 - protein, 48 aa, Glycine max
  Coding DNA Sequence Number=SeqID_82058
MDTSNRPLVINYQSCVIDYTVYGAGFHVLKLCNSSLASVVMGRIVLLP

SEQ ID NO: 173744 - protein, 99 aa, Glycine max
  Coding DNA Sequence Number=SeqID_82059
MEASLFIPRKGFVLNAEGQPWKLLRKDLTTLAQTWSIFCYSNLAPTSQTSDLNMDRARLVYGLVTGMDMNIGDLISGQITIMAQSNSSRLGFPALITTL

SEQ ID NO: 173745 - protein, 194 aa, Glycine max
  Coding DNA Sequence Number=SeqID_82060
  Homolog annotation: Hit_ID=A5BSR3; Match level="QueryCoverage=39%, HitCoverage=24%, E-value=7e-10, Identity=43%"; Hit description =Putative uncharacterized protein
MGGYSADKDSVDDIVCERYDISKEKWAQFCQTCRDPSWDDVRKKAQAIQKQNTALHVLSRGGYEYLEQKLMAEKTKKKLEEAAQSGSTKGVIDPPSPIKRHMKWKMACTKKTGQMTSEVAKEIAEKIDSLEEQASRGSFVPHGRQDLLAAAIGRPEHPGHVRAVGADVAIKKYFGSASRTSRVLPPWLLKNSSS

SEQ ID NO: 173746 - protein, 180 aa, Glycine max
  Coding DNA Sequence Number=SeqID_82061
MTTLAQTCSVLSFSNLIPTSHTSDVTLYRARVIYGIIMKMDMNVRYLISYQISLTAQHDTSRLGFLAKGVQYDSRSLESLNPAINLAYIKKNFWNLDDPTVTFRGLRKAKGKRSEAPSTAPSEAPTPSSSTLPPSSSTEIPVIPPAPSQIPLPALVSTGPTDFIFTPQMLHSMLQSIHRG

SEQ ID NO: 173747 - protein, 145 aa, Glycine max
  Coding DNA Sequence Number=SeqID_82062
MSRFMASSNSLFPEGNSIHTPPIFNGIDEYFRVPNCSNAKEMWDTLQLTHEGTTDEHEMELQRLNQNEETDKRKRSIPLKVSSSMQEEEKEEESDDEEDFSLFVKKFHKFVKNRRMEKSHNFNNRKRSQEFSPTLKCYKCNQTVT

SEQ ID NO: 173748 - protein, 221 aa, Glycine max
  Coding DNA Sequence Number=SeqID_82063
METLQKVRKAWEVVQKKDKELRGSNNGPIGGYQRWLKAHVQGLDWLSSLRTAKREKVEAPEEDKEVQALRAELEQAQTVKERFKSAALKIRKENAELKDIATTKAFEQEAKRARREEHGRNKSKRNLSQRLCETETNMLAIVSKYQEELNLATTHEHRVEDEYAQVYVEKEARGRVIDSLHQEATMWMDRFALTLNGSQELPRLLARAKAMVDTFSAIVSI

SEQ ID NO: 173749 - protein, 43 aa, Glycine max
  Coding DNA Sequence Number=SeqID_82064
MGLLEAKLIIDSGCSKHMAGDASKFIHISPKNSGHETYGDNNK

SEQ ID NO: 173750 - protein, 73 aa, Glycine max
  Coding DNA Sequence Number=SeqID_82065
MDSFAFWKMNGSRMEKEERERKKEMNEGSGREEHEILCSKRALKSEIWFIPLIQDQVQDSPLSVLRCHEECKA

SEQ ID NO: 173751 - protein, 145 aa, Glycine max
  Coding DNA Sequence Number=SeqID_82066
  Gene Ontology: Mol. function=aspartic-type endopeptidase activity; Biological process=DNA integration
  Homolog annotation: Hit_ID=A5AS08; Match level="QueryCoverage=54%, HitCoverage=4%, E-value=4e-13, Identity=45%"; Hit description =Putative uncharacterized protein
MTDLHSNMHACHSSCIESEFVLDHMSELDAESESKFDIDYMSGDVLPLEIDFIKSDGTNHVSGSTHTSDFLYEVQAEKPSLSTTIQPATPKLKPLPSNLKYAYLDDNKSFPVIIFASLANEQEEKLLSVLKKHKKAINWTLADIP

SEQ ID NO: 173752 - protein, 289 aa, Glycine max
  Coding DNA Sequence Number=SeqID_82067
HAGVGSIVEEVGRISSYCHDTEACQSHQSSKTAEVETSLRWNSLRSEGWQAIYEQAMERNEYDDIVEERLGVVVESKGDGRVQQHKEGYEGRSMTHTTTSHSSQHSLAAALSYTSPSSISNTLSQQFQSSNKKGQREATLLTSFVYFLFILEVRVGPIALVSRYAKPGKLFVVQSQQQRGGTPSFEFMYYSDQTTGNNWHNGHPVVGKTESTKENRSARGTENTVGALLTLCPHLELPHTMDYYTIRMLGLIPQAEKRATSGAQLQPLIILYICASTTLERRPTASGTK

SEQ ID NO: 173753 - protein, 108 aa, Glycine max
  Coding DNA Sequence Number=SeqID_82068
LASLLKEVSIVIRGVCVAKLELLKEASQGVSSSSFLSKAIVGGEAPSSLADSLVDGATPLLFSFSFRCISMSTRASCVEGRSPEYEEPRDLRSNPLQDGEDDAILPPK

SEQ ID NO: 173754 - protein, 73 aa, Glycine max
  Coding DNA Sequence Number=SeqID_82069
VKGSGVVFLHGEGISTPLVCHKGRQPLINRQGVSLAPTYSSIVIRKSDLRSSLRTKRWKAGVAAHDVQRYVKE

SEQ ID NO: 173755 - protein, 56 aa, Glycine max
  Coding DNA Sequence Number=SeqID_82070
MSLSLEDKLIRQALENAIFHLLAKPICWLSEPPLSARKTLEEDELYRFAKHTASSH

SEQ ID NO: 173756 - protein, 169 aa, Glycine max
  Coding DNA Sequence Number=SeqID_82071
PRGKGDILTTCIFAIFHLVLLFVVKKASWYGKLNPLLDLPWSFNSENWSDSKVLDSAGLSCGAFTRNRAEQVLGAVAGELLFIWEVSSFLGNLVPLDLEIEATLRRNRAERRSKLLQDRTVASFLEEETHFSNLLSPDSPSSRESATQLPEAITMAEEHDQRITLEDYS

SEQ ID NO: 173757 - protein, 147 aa, Glycine max
  Coding DNA Sequence Number=SeqID_82072
  Homolog annotation: Hit_ID=Q9Z422; Match level="QueryCoverage=65%, HitCoverage=21%, E-value=2e-15, Identity=49%"; Hit description =Glucose-binding protein
MAGLHPLQRRQNSVTATAARQTHKALNADWQRRIDVQLLRHIANTQPRRAADAAAVWREQAEYRAHQRGLAGSVGTQQGENFARLQRQADACQHRTLAKLHRNVFECNNLATTFSAQSAVVASIKPLGFIAAAIADGITPVEVLLPD

SEQ ID NO: 173758 - protein, 235 aa, Glycine max
  Coding DNA Sequence Number=SeqID_82073
  Gene Ontology: Mol. function=four-way junction helicase activity; Biological process=response to DNA damage stimulus
  Homolog annotation: Hit_ID=Q6D4A2; Match level="QueryCoverage=100%, HitCoverage=70%, E-value=1e-115, Identity=88%"; Hit description =Holliday junction ATP-dependent DNA helicase ruvB
  Pfam annotation: Domain name=AAA; Domain location=1-141; Score=-6.9; E_value=7.6e-05; Accession=PF00004.20; Description=ATPase family associated with various cellular activities (AAA)
  Pfam annotation: Domain name=RuvB_C; Domain location=154-232; Score =198.5; E_value=1.7e-56; Accession=PF05491.4; Description=Holliday junction DNA helicase ruvB C-terminus
  Pfam module annotation: Pfam domain module=AAA::RuvB_C; Domain location=1-141::154-232
MLTNLEPHDVLLIDEIHRLSPVVEEVLYPAMEDYQLDIMIGDGPAARSIKLDLPPFTLIGATTRAGSLTSPLRDRFGIVQRLEFYNVPDLQHIVGRSAACLGLTLSEEGALEVARRARGTPRIANRLLRRVRDFAEVRASGNMSGEVAASALDMLNVDNQGFDYMDRKLLLAIIDKFMGGPVGLDNLAAAIGEERETIEDVIEPFLIQQGFIQRTPRGRMATQHAYKHFGISREE

SEQ ID NO: 173759 - protein, 329 aa, Glycine max
  Coding DNA Sequence Number=SeqID_82074
  Gene Ontology: Mol. function=aspartate-tRNA ligase activity; Cellular component=cytoplasm; Biological process=tRNA aminoacylation for protein translation
  Homolog annotation: Hit_ID=Q7MB41; Match level="QueryCoverage=97%, HitCoverage=54%, E-value=1e-155, Identity=83%"; Hit description =Aspartyl-tRNA synthetase
  Pfam annotation: Domain name=GAD; Domain location=221-320; Score =160.1; E_value=6e-45; Accession=PF02938.5; Description=GAD domain
  Pfam annotation: Domain name=tRNA-synt_2; Domain location=31-313; Score=291.4; E_value=1.8e-84; Accession=PF00152.11; Description=tRNA synthetases class II (D, K and N)
  Pfam annotation: Domain name=tRNA-synt_2b; Domain location=54-206; Score=-38.9; E_value=0.015; Accession=PF00587.16; Description=tRNA synthetase class II core domain (G, H, P, S and T)
  Pfam module annotation: Pfam domain module=GAD::tRNA-synt_2::tRNA -synt_2b; Domain location=221-320::31-313::54-206
MATGDIEVFAHELNIINRAEPLPLDSNQTNSEEARLTYRYLDLRRPEMAQRLKTRARITSFVRRFMDGEGFLDIETPMLTKATPEGARDYLVPSRVHKGKFYALPQSPQLFKQLLMMSGFDRYYQIVKCFRDEDLRADRQPEFTQIDVETSFMSAEQVRSVMERMIRELWLDIKGVDLGDFPQMTFAEAMNRYGSDKPDLRNPMELVDVADLLKNVEFQVFAGPANDPKGRVAALRVPGGAALTRKQIDEYGSFVGIYGAKGLAWMKINARASGFDGVQSPVAKFLTPEIVEAILQRTDAQDGDLIFFGADRAKVVADAAGCTAPESGP

SEQ ID NO: 173760 - protein, 111 aa, Glycine max
  Coding DNA Sequence Number=SeqID_82075
MYTRAGFCPDCCPGDGCGSCAPNMTTLTQIWMTLLLSNIQPSDHNSDLPLLKCMAPTKHPLDPDKSNRALGFPALITGLCHSFGVPIAPSKVIRPPITRAFIEKYCTQRQA

SEQ ID NO: 173761 - protein, 63 aa, Glycine max
  Coding DNA Sequence Number=SeqID_82076
MEKGYVAAVAEEPQLFVVSGAVAVAAFVVAAGWVEEHMVCLGQQHSKNKAVVVAAAVVKDSTI

SEQ ID NO: 173762 - protein, 360 aa, Glycine max
  Coding DNA Sequence Number=SeqID_82077
  Gene Ontology: Mol. function=acid phosphatase activity; Cellular component=integral to membrane
  Homolog annotation: Hit_ID=A7PIC9; Match level="QueryCoverage=83%, HitCoverage=98%, E-value=3e-68, Identity=44%"; Hit description =Chromosome chr13 scaffold_17, whole genome shotgun sequence
  Pfam annotation: Domain name=Acid_phosphat_B; Domain location=129 -352; Score=-12.9; E_value=2.2e-07; Accession=PF03767.5; Description =HAD superfamily, subfamily IIIB (Acid
MSLQQVSSSEGSSKMVRDGDSVRFHDDDNNNFDEKGIKSNPDTIASKERDGKKRLEAMSAYAHQMEQQYSAPSLSDDSETGSHYELESGFFMKSFTATIFVASLVTLGVLLITLVISLVIMLQSCQSKSAGVIELLNINDYYSYCRVYSLHAELNNLEGYNLPGICRHLAVHYIKVGQYARDLDLTMSVIDDYFKSVRPSEDGLDVVLMDIDDIFPRNSDSSNLFHRFYNDSTSNCIKEAKNVKLMFVTRLYMYLQTGGWSIILLSREPRTHRNVTINHLDSAGLRSWSALMMRAEDSDPTKGYEYFSRQRNLIRKKSFRIKSIISSHMDAVTVPETGVRNFLLPDPLCYKCEKQIEHRY

SEQ ID NO: 173763 - protein, 60 aa, Glycine max
  Coding DNA Sequence Number=SeqID_82078
MSWSHYSDCWVCVGVLEGDCDMLVSVDGVSVLGGDGDMLVDGVDAWLGCGGWLRDGYGWW

SEQ ID NO: 173764 - protein, 458 aa, Glycine max
  Coding DNA Sequence Number=SeqID_82079
  Gene Ontology: Cellular component=integral to membrane; Biological process=peroxisome organization and biogenesis
  Homolog annotation: Hit_ID=P92961; Match level="QueryCoverage=95%, HitCoverage=95%, E-value=0.0, Identity=72%"; Hit description=Proline transporter 1
  Pfam annotation: Domain name=Aa_trans; Domain location=34-444; Score =324.6; E_value=1.8e-94; Accession=PF01490.9; Description =Transmembrane amino acid transporter protein
MRKGNMELETNKVYDYEDARGNDAEVPDTAHQISTDSWFQVAFILTTGINSAFVLGYPGTVMVPLGWFGGVIGLILATAVSLYANALVAYLHELGGQRHIRYRDLAGFIYGKKAYNLTWVLQYINLFMINTGYIILAGSALKATYVLFKDDGLLKLPYCIAIAGLVCAMFAVCIPHLSALRIWLGFSTVFSLAYIVISFVLSLKDDIPCYCALTNRTLSGLRSPPRDYEIPGEGVSKIFTIIGASANLVFAFNTGMLPEIQATIKQPVVKNMMKALYFQFTVGVLPLYLVAFTGYWAYGSSTEVYLLNSVNGAVWVKALANITAFLQSVIALHIFASPMYEFLDTKYGIKGSAMNVKNMSFRMVVRGGYLAFNTFVAAFLPFLGDFMSLTGAISTFPLTFILANHMYLKAKKDKLNSSQKLWHWLNIGFFSIMSLAATISAIRLIAIDSKTFHVFADL

SEQ ID NO: 173765 - protein, 81 aa, Glycine max
  Coding DNA Sequence Number=SeqID_82080
  Gene Ontology: Mol. function=sedoheptulose-bisphosphatase activity; Cellular component=chloroplast; Biological process=reductive pentose- phosphate cycle
  Homolog annotation: Hit_ID=A8DUA7; Match level="QueryCoverage=95%, HitCoverage=53%, E-value=1e-11, Identity=83%"; Hit description =Chloroplast sedoheptulose-1,7-bisphosphatase
MGCPVEGGFIVAFDPLDGFSIVDTNFTVGTIFAPLRFLIEKAEGYNSDVHQSVLDKVITNIDEITQVAYGSKNEIIRLRNP

SEQ ID NO: 173766 - protein, 371 aa, Glycine max
  Coding DNA Sequence Number=SeqID_82081
  Gene Ontology: Mol. function=binding; Cellular component=integral to membrane; Biological process=transport
  Homolog annotation: Hit_ID=A7PIC4; Match level="QueryCoverage=91%, HitCoverage=91%, E-value=1e-105, Identity=60%"; Hit description =Chromosome chr13 scaffold_17, whole genome shotgun sequence
  Pfam annotation: Domain name=Mito_carr; Domain location=143-255; Score=68.2; E_value=2.8e-17; Accession=PF00153.18; Description =Mitochondrial carrier protein
  Pfam annotation: Domain name=Mito_carr; Domain location=266-361; Score=89.9; E_value=8e-24; Accession=PF00153.18; Description =Mitochondrial carrier protein
  Pfam annotation: Domain name=Mito_carr; Domain location=3-91; Score =32.4; E_value=1.6e-06; Accession=PF00153.18; Description =Mitochondrial carrier protein
  Pfam module annotation: Pfam domain module=Mito_carr::Mito_carr::Mito_ carr; Domain location=143-255::266-361::3-91
MSDALINGLAGAGGGIIAQLITYPLQTVNTRQQTERDPKKDTRSQGTLERMCQVVKEEGWERLYGGLMPSVVGTAASQETVIDRDFGHDIKIFGHSTITTVAISATFAAIPGVYYYLYQIFRNKAEAAALQQKKMGVGDGSVGMLSSLVVAVLSGSVTVLLTNPIWVVATRMQTHRKELNRTPADQGLLVSTEQPILSAVEHLPYGTSQVIQDIYSEAGILGFWKGVLPTLIMVSNPSIQFMLYEAMLVKLRKRRAWSKKGSNGVTALEIFLIGALAKLGATVVTYPILVVKARLQARQDKTGDKRHHYKGTWDAIIKMIRYEGFNGFYNGMGTKIVQSVLAAAVLFMMKEELVRGVRFLLANDAVKPKHP

SEQ ID NO: 173767 - protein, 22 aa, Glycine max
  Coding DNA Sequence Number=SeqID_82082
MTQKIIHEKEFGNTSIEKCMHK

SEQ ID NO: 173768 - protein, 173 aa, Glycine max
  Coding DNA Sequence Number=SeqID_82083
  Homolog annotation: Hit_ID=Q6UUU1; Match level="QueryCoverage=34%, HitCoverage=40%, E-value=1e-18, Identity=78%"; Hit description =Putative uncharacterized protein
GELELHRGGGRSRTSGSPGLQEFDPKIPSRNFQDVTEATKAIEVAQVQISLMHGDHIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 173769 - protein, 147 aa, Glycine max
  Coding DNA Sequence Number=SeqID_82084
  Gene Ontology: Mol. function=drug transporter activity; Cellular component=membrane; Biological process=multidrug transport
  Homolog annotation: Hit_ID=A7PL88; Match level="QueryCoverage=68%, HitCoverage=16%, E-value=2e-15, Identity=48%"; Hit description =Chromosome chr7 scaffold_20, whole genome shotgun sequence
ATSLIYNFPYALSLAVSTKVGNELGANRSDKAKASSFYALLCAFITTIVATILTVSMTYAYGQMSIEYEPLLSLTATTLPIVGRELLGAPSNYVNGQNCPCLKNVIFNCGRTFFRAISRKNFFRRKPRKKVLPQLKITTAEEPSSVS

SEQ ID NO: 173770 - protein, 138 aa, Glycine max
  Coding DNA Sequence Number=SeqID_82085
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=81%, HitCoverage=96%, E-value=2e-24, Identity=55%"; Hit description =Putative uncharacterized protein
  Subcellular localization annotation: CTP_CleavageSite=46; ConfidenceScore=5.48e-01
MTMITPSSKLTLTKGNKSWYRAPPRGRRSNSCSPGDPLVLERPPPRWSSNSPYSESYYNSLAVVLQRRDWENPGVTQLNRLAAHPPFASWRNSEEARTDRPSQQLRSLNGEWDAPCSGALSAGGCGGYAQRDRYTCQR

SEQ ID NO: 173771 - protein, 80 aa, Glycine max
  Coding DNA Sequence Number=SeqID_82086
MGLSWLTELMPLKSLSVKVPVLVEVVARATMTVVFVCLGLSLFFCLLPSSYVAPLDVLQVLVLLGDCLVSYQIGLSTQPV

SEQ ID NO: 173772 - protein, 179 aa, Glycine max
  Coding DNA Sequence Number=SeqID_82087
  Homolog annotation: Hit_ID=Q9KHC4; Match level="QueryCoverage=23%, HitCoverage=8%, E-value=3e-07, Identity=69%"; Hit description=SocE
DAGSRQARQGASAGVGGCRGWLNYAASEQIVLRVHHMRAIGAGLFAITPAGERGMCCKAIKLGNARVFPSLDQQHNDTLSGRFTEEEIREAVWGCGGEKSPGPDGINFKFIKALGTELELRNHGHSCFLRETCRASCINESANARGEAVCVLGALPLPRSLTRCARSFGCGERYQLTQR

SEQ ID NO: 173773 - protein, 27 aa, Glycine max
  Coding DNA Sequence Number=SeqID_82088
KTIEDKAMDNRLQYSLGKAEPGWCSPP

SEQ ID NO: 173774 - protein, 153 aa, Glycine max
  Coding DNA Sequence Number=SeqID_82089
  Subcellular localization annotation: CTP_CleavageSite=54; ConfidenceScore=5.55e-01
MHFHLGTQCPRDTHQESGSNTVSTTTKTSGYGMVQASGLAFGGLTGNKVVSTSRARMVGTGTTTSTTGTSSALEGPLPPGHAATRWTEQLTTQSDTRGTDGRLRRGAENNPTFDNIVKKPEKHLQPSFKYVLVHARAKKRSNSRVVCLFVRTP

SEQ ID NO: 173775 - protein, 205 aa, Glycine max
  Coding DNA Sequence Number=SeqID_82090
  Homolog annotation: Hit_ID=A9MNV3; Match level="QueryCoverage=91%, HitCoverage=30%, E-value=2e-18, Identity=27%"; Hit description =Putative uncharacterized protein
SCFAATSARFDNVDNIYSNKRKLDANKETTYTFAQTGVLALGCSHPQKQQNGEFIRLEVSGGGDSNLHILGQNTQGDWEQQKAGAGILGGAVLYDGKSNHFVPKKITDKTQEIINKSLGESLSIAALYEAVNGMDGTHEMFTASQGSLFLNYSKCCSAEYREGAVNVGFFADKTTRANAAHWGLWHELGHENEPQWEYNVFPEVQ

SEQ ID NO: 173776 - protein, 138 aa, Glycine max
  Coding DNA Sequence Number=SeqID_82091
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=71%, HitCoverage=75%, E-value=3e-25, Identity=66%"; Hit description=LacZ protein
  Subcellular localization annotation: CTP_CleavageSite=32; ConfidenceScore=5.05e-01
MTMITPSSKLTLTKGNKSCPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSGTATLASADVRRCFCRYAPPRQ

SEQ ID NO: 173777 - protein, 75 aa, Glycine max
  Coding DNA Sequence Number=SeqID_82092
EPVQVIEVSSSEEDLEEDPEELPPEPAMDALYLLEDDEDPLLDVDSPEDVVSASEADSTEESGPVGTANSDDSSS

SEQ ID NO: 173778 - protein, 144 aa, Glycine max
  Coding DNA Sequence Number=SeqID_82093
IDWDHLVQYRMHKALRANAPLPYPHLVTLFLHHFNVPLDDEPFVKVKRSFSFGAGAVTSFGYRKDVNGQWVHKQDLPPPIPDELTLSPPPQRVDSTSLLTEVLTELRDLRAFIGEHFDVMNTWITRLEDDMSFIRHCFNPSADS

SEQ ID NO: 173779 - protein, 208 aa, Glycine max
  Coding DNA Sequence Number=SeqID_82094
MKILGLQAPMELTSVIVSRVLGTKVVLSSNSIAKSIRCLHKESTYQEGWEKIYDSHVARALYKENVNKASDKKTIVYNLICERARIWANILNKSVLHKARLKTTQSDLHKFVLFHLMENLSFDLPHTIYINILRNLHSLGGLDDIYYVSLINKTRKQSHREEEEEELIAREHGTRKKHEQSSVSIPECPAKEKSIPQRFKDLSETNED

SEQ ID NO: 173780 - protein, 184 aa, Glycine max
  Coding DNA Sequence Number=SeqID_82095
MVLKEELIACLRSKRSLSQRLCETETNMLAIIAKYQEELGLATAHEHRIADEYAQVYTEKEARGRVIDSLHQEATMWMDRFALTLNGSQELPRLLAKAKAMADTYSTPEEIHGLLGYWKNTITKRAARDPYRTRSKSRTMGDQEETQEQMKADMSALKEQMASMMEAMLSMKQLIEKNAATAAA

SEQ ID NO: 173781 - protein, 63 aa, Glycine max
  Coding DNA Sequence Number=SeqID_82096
GPGLPGINRDTRIYLFCEVIFPSPAVPPVQLLTGWCVTAKAPPDISAGKCSGHAARNHHTRRA

SEQ ID NO: 173782 - protein, 162 aa, Glycine max
  Coding DNA Sequence Number=SeqID_82097
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=53%, HitCoverage=72%, E-value=4e-24, Identity=66%"; Hit description=LacZ protein
  Subcellular localization annotation: CTP_CleavageSite=35; ConfidenceScore=5.55e-01
PVYTPLAPNTQTASPPRVGRFINAAGTTGFPTGKRAVSATQLIPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 173783 - protein, 67 aa, Glycine max
  Coding DNA Sequence Number=SeqID_82098
MEKINSKLVVYVEKHGHGNWCSVPEKADQSKDAVNMKHIGQQESARFEAKARKSMQVGSNSFIPPVH

SEQ ID NO: 173784 - protein, 105 aa, Glycine max
  Coding DNA Sequence Number=SeqID_82099
MEVTTFTVTMHRVDVVMFENKKFGTMGKGGDIHNDNICNDDVCDNSEAELEEVEGSENVLRDLEEGCNIRIEKLRQMMDVMVVEKHVGGFVLPTSVQLLVPDPSG

SEQ ID NO: 173785 - protein, 576 aa, Glycine max
  Coding DNA Sequence Number=SeqID_82100
  Gene Ontology: Mol. function=transcription regulator activity; Cellular component=nucleus; Biological process=regulation of transcription
  Homolog annotation: Hit_ID=Q9LHQ4; Match level="QueryCoverage=46%, HitCoverage=78%, E-value=8e-84, Identity=61%"; Hit description =Genomic DNA, chromosome 3, BAC clone: F3H11
  Pfam annotation: Domain name=DUF1995; Domain location=311-547; Score =178.1; E_value=2.3e-50; Accession=PF09353.1; Description=Domain of unknown function (DUF1995)
MVSPENSNWLFDYPLIDDVIPVGDASFSVSASAFSWPPPPANVSVEIDASLGDSDGPKDTALKKRCLFLDEVIPYLLFIPVAGLDVIQVLLLALKRVGRSCGGIGLMTSKLLNHPHLPSVHNCSPCGPPKTDKAAILIDAARMVTQLRDEALKLKDSNTSLQEKIKELKAEKNELRDEKQRLKAEKEKLEMQVKSMNAQPAFLPPPPAIPAAFAPQGQAPGNKLMPFIRYPGVAMWQFMPPATMDTSQDHVLRPPLTSCLPPHSNAQITSIPFPTTHYLYNHCNSFIIPLSFTVPLKALSTSIHSSLSSPKPPITKEDAILQAKTSLSATLEKPLNNTKLIGKFKKLRQPKFRVEIPVIDDSPDSLSQLALDFFGDMPIKRKGSPIKILILWPDASLKESATIGFQSHSTFEHIDIPSVTKTDPRILNSADVAIFLAPESSQLALIRRVSDAFYPKPLVLFNPKWAFEEESNFGDLSGFVDSFEVVYSFMGLEVRGILSKRKGVIFKCVRDGVVSGERWNVFVEEGEELKVVSSFKARPTIVEVENVLYNLMAINSPITKSAKFIKGLVSNVTGKK

SEQ ID NO: 173786 - protein, 79 aa, Glycine max
  Coding DNA Sequence Number=SeqID_82101
MAARGECCFLHTAEAVSLQGTKKPGRLHQASMRPLEWSGRQDSNLRPLRPEPQRRFSFSIRFCSRAIKLIDTVDLEGGP

SEQ ID NO: 173787 - protein, 73 aa, Glycine max
  Coding DNA Sequence Number=SeqID_82102
  Gene Ontology: Biological process=transposition, DNA-mediated
  Homolog annotation: Hit_ID=Q1J7G7; Match level="QueryCoverage=43%, HitCoverage=45%, E-value=2e-11, Identity=100%"; Hit description =Transposase
  Subcellular localization annotation: CTP_CleavageSite=48; ConfidenceScore=5.20e-01
MVKVGTSYVPINVSFSPKSWPRASPVLQWLLFLSAVPPVQLLTGWCVTAKAPPDISAGKCSGHAARNHHTRRA

SEQ ID NO: 173788 - protein, 103 aa, Glycine max
  Coding DNA Sequence Number=SeqID_82103
MDRVTSLLRLLPNTFRTVDVLVTSSFTLTKMSWTIKEHVLRCPYRTCARAREIGEVEEVQEHMKVDMEAMKEQMDTMMEAMMIIKKIMEANVVAVAATSAVAK

SEQ ID NO: 173789 - protein, 225 aa, Glycine max
  Coding DNA Sequence Number=SeqID_82104
MPSPQRREFGTCAHALSQFLGDPLVLEEGQQCEFSQRRNRADNFDEEAITQLLCIPGQDFARTTAGKRVRIMRTCMTTLTQTWMTLLLSNVLPSDHNSDLPLPKFQLVYAILTRMSVHVAQVWCLIGTLWTQISPTGPWVSGADHGPLPVLWSSRHPHLSQQGQGSAPFVCPTPEQFGAEVAWPRDWPDAQAREELAGSPGEVDESHMDEDMTDLLGFLGGSRVA

SEQ ID NO: 173790 - protein, 182 aa, Glycine max
  Coding DNA Sequence Number=SeqID_82105
  Homolog annotation: Hit_ID=A5CA85; Match level="QueryCoverage=56%, HitCoverage=16%, E-value=3e-13, Identity=41%"; Hit description =Putative uncharacterized protein
MTRGNPGDLQPFDPKTDRTFHRLVRHSVHLDHSVHFEHSEHSVHSEHYVAGDSEHSNFEHSAANFHTENMAQSPPCERTLREMDAPDFSYESLCIQYPDEDVPYVLKTGLIHLLPKFHGLAGEDPHKHLKEFHIVYSTMKPPDVQEYHIFLKAFPHSLKGVAKDWLYYLAPRSITSWDDLKR

SEQ ID NO: 173791 - protein, 369 aa, Glycine max
  Coding DNA Sequence Number=SeqID_82106
  Gene Ontology: Mol. function=P-P-bond-hydrolysis-driven protein transmembrane transporter activity; Cellular component=type II protein secretion system complex; Biological process=intracellular protein transport across a membrane
  Homolog annotation: Hit_ID=Q1H405; Match level="QueryCoverage=34%, HitCoverage=21%, E-value=6e-37, Identity=58%"; Hit description =Protein-export membrane protein SecD
  Pfam annotation: Domain name=YajC; Domain location=168-250; Score =110.6; E_value=4.8e-30; Accession=PF02699.6; Description=Preprotein translocase subunit
ASYFLLLAPQKVTKEDGTQPSRPNGCLALLNKTVAPSTLILSPLLSVMGWDLSRQTHIAEIWTHALIKAVQHRLGGSSRPSAVRVPHQATFCVAWYSGSTKASRSAGAGHGLPLARPYAGQPSSHFTKLLPYTLESHHAIYSSPACARIARTNHMFISNAYAAAAPATDIMSFLPMVVIFVLFYFMLIRPQMKQAKQHKSMLETLKAGDEVATTGGIVGKVTKVSEHFVSIEIAANTVFLMNRYPIWKFVLIGTVIIIGLLYTIPNFFGESPAVQISPAKTSLKLDESLLQKVESTLKLANIPFDGLFMDASGVKVRFANTDTQLLAKDKLVANLGKDYTVALNLVPQTPGWLQSIGAKPMYLGLDLRG

SEQ ID NO: 173792 - protein, 149 aa, Glycine max
  Coding DNA Sequence Number=SeqID_82107
  Gene Ontology: Mol. function=aspartic-type endopeptidase activity; Biological process=RNA-dependent DNA replication
  Homolog annotation: Hit_ID=Q6WAY3; Match level="QueryCoverage=66%, HitCoverage=3%, E-value=7e-09, Identity=36%"; Hit description =Gag/pol polyprotein
METCLAVEDQLQQMIDRGRLEVDDEGSEEQHICMQSADERSFGRPKPLMSGVTRSGRVFAPPDLPTQLANVKGKAKIMEEQNDKTILTPSEDIPVKGLPEKKDGCGKKEVSLEEAGEFLRIIQQSEFKVIEQLNKTPARVSLLELLISS

SEQ ID NO: 173793 - protein, 150 aa, Glycine max
  Coding DNA Sequence Number=SeqID_82108
  Subcellular localization annotation: CTP_CleavageSite=41; ConfidenceScore=5.20e-01
MTLQAQGLSQSINFQLNMGARDKSFMNRVSSLAKWLYQSIKAFIIFKLMHSFSNQRFMQKSVLNASRSLIVKYHTTHRFVVNDYLHNFSVKPTNIFSHAPNSCFSLLITTYSFKAKEINPNPVMAHPVSLWAYPEVRKEHPGLAEEYPEL

SEQ ID NO: 173794 - protein, 208 aa, Glycine max
  Coding DNA Sequence Number=SeqID_82109
  Gene Ontology: Mol. function=transferase activity, transferring groups other than amino-acyl groups
  Homolog annotation: Hit_ID=Q0BZD5; Match level="QueryCoverage=91%, HitCoverage=26%, E-value=2e-09, Identity=23%"; Hit description =Acyltransferase family protein
MPPHWRPNVADYARRQQKPLFQLTKASCPFLLDATRAMPQKPQHAQQCLDFNQRVLPIILSDKIDEVVISAFWAAGLSEQPGSGFRSLRDPAQDNLQALKSGLDTVVAQLLAAGKKITLIDDVPTITLDPLRYSHNRNMPLRRSLNSWLSAQDGAALVAERTQQMQMPNASVANLLKDYQQHGVRVLSLQETLCNAQGCLVTHQGMPL

SEQ ID NO: 173795 - protein, 98 aa, Glycine max
  Coding DNA Sequence Number=SeqID_82110
  Homolog annotation: Hit_ID=A5B194; Match level="QueryCoverage=89%, HitCoverage=6%, E-value=5e-12, Identity=39%"; Hit description =Putative uncharacterized protein
MEHQKSASLLVAYVVQGKPRGRDISVVQCFYCKGHGYFASHCPKKFYNHCTKGKASLPHSHSYFDSGASNHMTNNVAALTNVTNYSGSTLKEDNHKKA

SEQ ID NO: 173796 - protein, 238 aa, Glycine max
  Coding DNA Sequence Number=SeqID_82111
MSLKLPYYPELVRVFYSNLKIQDGNLISEVYGIPIIIDESVFFLLTQLPSQGAPFEGTIVDDWKFDYSNHDARHMYIIVRILHPRSSNLAQASEEDLIIMWAFLIGHQIDWAHLIRYRMHKALQSSAPLPYPQLVTLFLRHFQVPLDNEPFVQVKRSYAIGVGAVISFDYRKEMDGQWLKKDAQSLQDERTHSPSSQRDDSSTLMHEVLSELRGLRTYVGEHFDSFDARFAGMDTHIT

SEQ ID NO: 173797 - protein, 124 aa, Glycine max
  Coding DNA Sequence Number=SeqID_82112
  Homolog annotation: Hit_ID=Q84VH5; Match level="QueryCoverage=78%, HitCoverage=14%, E-value=3e-33, Identity=74%"; Hit description =Envelope-like protein
MATSPKETSAPGSPSAPSNQERPEFNIQPIQMIPGQAPVPEKLVPKRQQGVKISENPSPATSPREVDPEMDKKIRSIMFQHLPPQMFKSSLPPAKRDQQRKMIKPQRRPLHHGHQNLLQVTSLT

SEQ ID NO: 173798 - protein, 100 aa, Glycine max
  Coding DNA Sequence Number=SeqID_82113
  Gene Ontology: Mol. function=ATP binding; Biological process=protein folding
  Homolog annotation: Hit_ID=A3C7F2; Match level="QueryCoverage=60%, HitCoverage=42%, E-value=2e-15, Identity=68%"; Hit description =Putative uncharacterized protein
  Pfam annotation: Domain name=Cpn10; Domain location=2-74; Score=-6.4; E_value=0.0034; Accession=PF00166.12; Description=Chaperonin 10 Kd subunit
MVKTVGGVLLPKSAVKFERYLVGEILTVGAEAGELKAGTKVLFTDMNAYEVRDFKYLFYRCYVSETWKDVPETLKVLVWDDILPHLPEISVTMTVIATVI

SEQ ID NO: 173799 - protein, 218 aa, Glycine max
  Coding DNA Sequence Number=SeqID_82114
  Homolog annotation: Hit_ID=A0ST23; Match level="QueryCoverage=11%, HitCoverage=51%, E-value=7e-07, Identity=100%"; Hit description =Putative reverse transcriptase
VPPVQLLTGWCVTAKAPPDISAGKCSGHAARRVPFAIQAAQLLGRAIGAGLFAITPAGERGMCCKAIKLGNARVFPVTTLNSISKPLNPPSASLAHLFIGKWALGAKTTHPGELELAQASEPEVGLGELGSRKTKEKTLLSPNQAYRYRRPRGGARYQLLFPLVRVNFELGVIMVIAVSFGKPVVPAALMNRPTRGERRFAYWALAECILAYYVGTDE

SEQ ID NO: 173800 - protein, 171 aa, Glycine max
  Coding DNA Sequence Number=SeqID_82115
  Homolog annotation: Hit_ID=A1FSG7; Match level="QueryCoverage=41%, HitCoverage=18%, E-value=6e-32, Identity=90%"; Hit description =Transcriptional regulator, AraC family
GVIHHRVAAQLQPRPQRAAFIGQYDLQCPPVLRMRLAADAAQRLQLVQQPGHRAGHLVDGLGQFVGADAQIFFSHGRVELADQAVAHLAQQQAEAGGSAGWISEGAYLNDLVRWPGSTIQPMDVTFQPADMMNKAEIPPPKRLLRDDALDWFERNDGPPDVAFRFDSPQGL

SEQ ID NO: 173801 - protein, 130 aa, Glycine max
  Coding DNA Sequence Number=SeqID_82116
MDHDDPYTYLSTFMELRSTMGASNKDVEAIYLRAFPFSLAAGGTMMSKSLEEAIVIIDSIAASDYQCHHDKALTQRKGIMELDTQSTILAQNKLLTQQIKALTKQISQLPQQYHQGGPQKAHQAHQVQQI

SEQ ID NO: 173802 - protein, 137 aa, Glycine max
  Coding DNA Sequence Number=SeqID_82117
  Gene Ontology: Biological process=transposition, DNA-mediated
  Homolog annotation: Hit_ID=Q1J7G7; Match level="QueryCoverage=21%, HitCoverage=42%, E-value=2e-10, Identity=100%"; Hit description =Transposase
GHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPEFDTLPLLFWYNSVNQAHSCHFFKASIKLIDTVDLEGGP

SEQ ID NO: 173803 - protein, 102 aa, Glycine max
  Coding DNA Sequence Number=SeqID_82118
MMCYPLALDRLTWLWHFGNVLEQHPRSSTTIDLAARRNEPQRSGPCSYPAPPDDRTEEPSTTLWPPGIVERIETPSTPCLPPPPFPRRVLLGEEVKRGCPGC

SEQ ID NO: 173804 - protein, 93 aa, Glycine max
  Coding DNA Sequence Number=SeqID_82119
MDGGVSYSCTRSMEPTIDDGGSTPRQSLCNRAFASCLILTTNPIFFSVSCTNHQVYLTTYLLDSNQLGRAAVSYSQENKKQVKTTATSSIFGV

SEQ ID NO: 173805 - protein, 247 aa, Glycine max
  Coding DNA Sequence Number=SeqID_82120
MGSKIAKVIVSLEMVVEVGKVVERMEVVLVSEPRVVVKVQERTTPRLENCVYGILQREAKLLILLPLAFGKGLHCLANHFLNLAMSVEGGLMREGEFLPMVRTLRAANKVSNGGEQLLLAEFTKGRTKAIEGSDDEVEIVTNTRSAFGGAGKMFLEKHHPSTRVIAIVLVYPCPSIGRRCCGSHDNLCIRVALANKSKEYVVVLPFLKTVGRVGSNSGTVANGCRTARFCAINTAIDRLHGRYGHEE

SEQ ID NO: 173806 - protein, 349 aa, Glycine max
  Coding DNA Sequence Number=SeqID_82121
MPLQDGGGEIHINLKHEPLMSKRAKQFREKLCELVTRGDVGDSELLFGNEIIHKMIIDGVENGVGTKMEAIVKSAFEASDEAFHSLHNLYWESLLTMARLMDIDMGKIINVYEEVSKGGVVLVDEEKGVRLGITEVIVGEGLLKRVKSSPRSLLEAIESFAELAEGFMIIYIKALVKPFLPLDHQNPSAISKDDIKHFRHGSLQLNMYHLLLELPWGEWRKGVVLPLKMRKGWLGIRLDWGSSMGRMRRKRKDIFKGDMTRGVKELRGNRRVLGVSHIRLMFEMINRETFIFGPDVLDIVSDIVDPAASMLLATPDVLDIVSDIVNPAASILHLTFHLALCIVQPDLIL

SEQ ID NO: 173807 - protein, 104 aa, Glycine max
  Coding DNA Sequence Number=SeqID_82122
  Subcellular localization annotation: CTP_CleavageSite=20; ConfidenceScore=5.18e-01
MNLKRSARPSRSTGRTRLALGSMASYALSVRLPPYLLSTAIALSVKITFNVFESMNQPKDEESCSWVDVLDEVVVDTRKKLHISCPFEKVLIDALEALNDEDEK

SEQ ID NO: 173808 - protein, 66 aa, Glycine max
  Coding DNA Sequence Number=SeqID_82123
MKKRKLKIRKYKCLEVQVVRLASFTLAQRTCTGLLLPGSSMRLATHAAPSKSWAQPEEDGSANCKN

SEQ ID NO: 173809 - protein, 117 aa, Glycine max
  Coding DNA Sequence Number=SeqID_82124
  Gene Ontology: Cellular component=nucleus; Biological process=cell division
  Homolog annotation: Hit_ID=Q39880; Match level="QueryCoverage=42%, HitCoverage=11%, E-value=4e-19, Identity=94%"; Hit description =Mitotic cyclin b1-type
MGGERRNRRVLQDIGNLVAKQGHGNGINVSKPVTRNFRTQLLANAQAATEVEFVLFYDDLWIMKQPSSPGQAGSGKHLLPFPINRGRREEQKCSAFLIFHRSSSFVVRSSSFFGLQP

SEQ ID NO: 173810 - protein, 192 aa, Glycine max
  Coding DNA Sequence Number=SeqID_82125
MEQYSCHPDFLVHLDHRNQIERSVDHPYQLSQHLKCACTLIMVGSLKNGVWATTMEVVGWEKSLKSFCEQEDDDKKPKRMISRLSQRFKNQEKLDFKIQEKMNSSSKRRNQEDFTREGTSFVVQVEGTSTWVVVTENKRGYISCGSVQVEGTSTWLFKENKGGYIPCGSLLVKDFTRLKRNFKDRRSLGDWM

SEQ ID NO: 173811 - protein, 125 aa, Glycine max
  Coding DNA Sequence Number=SeqID_82126
  Gene Ontology: Mol. function=protein transporter activity; Cellular component=clathrin adaptor complex; Biological process=intracellular protein transport
  Homolog annotation: Hit_ID=A7NT73; Match level="QueryCoverage=31%, HitCoverage=8%, E-value=4e-11, Identity=82%"; Hit description =Chromosome chr18 scaffold_1, whole genome shotgun sequence
MATSVENNTSKPYIEVKIYTYSCWCYYHRICYMYASAGIWIHFFLKNVMKLTIFGQQFETKSEIRAACKDCAKKQKGKDFGYVKTTSTEDLKSYVFNEPIVIDAARMPPLGPASILLVVMHDSID

SEQ ID NO: 173812 - protein, 136 aa, Glycine max
  Coding DNA Sequence Number=SeqID_82127
  Homolog annotation: Hit_ID=A5B9V6; Match level="QueryCoverage=44%, HitCoverage=48%, E-value=6e-07, Identity=42%"; Hit description =Putative uncharacterized protein
MLTSINETEWTKIQRRVVSTIRLALALEIKHNMLKETTLKALWEKLENIYASKLLTNHLCLKMELSFKALVQTLFVGRSTLELDEVTATIRENDRMMRTENVDDEHHALVVVESERGRNHSRRHGPRGRSKSQLCP

SEQ ID NO: 173813 - protein, 211 aa, Glycine max
  Coding DNA Sequence Number=SeqID_82128
MDGLTVNFRGARKVVAPPGSILSVEQFIEKVFWPGTVPSVVREGEGPSAPVPQQVQDASSEAAIPRAFDFSGVGVEMRLDEVVFPEPIVPVIHETVEAGESQLRQEAATPERTTQTPEDPPSPGMELSFAQQVADPPTPVHERPADPFTPILEIPKYPPSATPELQFSNEEGGRITTPPGTPSLVEVLILSHPLSQFSCLASHPLSAAVHG

SEQ ID NO: 173814 - protein, 103 aa, Glycine max
  Coding DNA Sequence Number=SeqID_82129
MRGTVHEPQYPRFERTTRPRLERTTRPHHQRAARPHLQRTTCPRLERSYTPSPWVLVTLTVERTTRPRLERTTRPHHQRAACPHLQRTTCPRLERATRPHLGY

SEQ ID NO: 173815 - protein, 157 aa, Glycine max
  Coding DNA Sequence Number=SeqID_82130
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=74%, HitCoverage=96%, E-value=2e-24, Identity=55%"; Hit description =Putative uncharacterized protein
  Subcellular localization annotation: CTP_CleavageSite=51; ConfidenceScore=5.34e-01
MTMITPSSKLTLTKGNKSWYRAPPRGRRKNYERSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 173816 - protein, 200 aa, Glycine max
  Coding DNA Sequence Number=SeqID_82131
VARCTICRGAHESGCCIPIEEHPTHEGQWRNHPGNQFNKDQGGPSTRPQQQGPSLYDRTTKLEETLAQFMQVSMSNQKSIESAIKNLKSSTLLMSLSILLFLLSAYYSSASFASSYSALHIQMASRKRKAPSTPTQVRFDRSKFISQEAWERYNDAIVPRNLLPERNVVVYYTEFDEFKEELERHHWDEELTDFGDNNID

SEQ ID NO: 173817 - protein, 64 aa, Glycine max
  Coding DNA Sequence Number=SeqID_82132
MWIVQMLLIRLRVVLYVFATRDDVLQWARTVAHENGFVVVIMRSDTKTGSRGRSSFALIGCERS

SEQ ID NO: 173818 - protein, 154 aa, Glycine max
  Coding DNA Sequence Number=SeqID_82133
RVPFAIQAAQLLGRAIGAGLFAITPAGERGMCCKAIKLGNARVFPGELELHRGGGRSRTSGSPGLQEFDVLLKMSFPNTIVEKLDDSNYLHWRHVEPVIKAHKLQRFIVNPVVSPHYLTEDDHIIDRVNPKYEAWEVWGKIIKLIDTVDLEGGP

SEQ ID NO: 173819 - protein, 141 aa, Glycine max
  Coding DNA Sequence Number=SeqID_82134
MEDVLTSRRFILEALREVDMIVLDGDKGEFCLIHPGASHDVEACPVAEELLQEMMDEGLIERCCHTKAPRFPAYPVEKLAPFSYKSDKAVPWRYTIQGPDGRKGASVVHAKDYLSSAKVTNISGMSGMTRNGRIFAAPEPP

SEQ ID NO: 173820 - protein, 138 aa, Glycine max
  Coding DNA Sequence Number=SeqID_82135
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=71%, HitCoverage=75%, E-value=5e-25, Identity=65%"; Hit description=LacZ protein
MTMITPSSKLTLTKGNKRCPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 173821 - protein, 74 aa, Glycine max
  Coding DNA Sequence Number=SeqID_82136
  Gene Ontology: Mol. function=structural constituent of ribosome; Cellular component=chloroplast; Biological process=translation
  Homolog annotation: Hit_ID=Q32703; Match level="QueryCoverage=56%, HitCoverage=100%, E-value=2e-13, Identity=85%"; Hit description =Putative uncharacterized protein
MSFLVYLFYPELGGKLYCGDDTVGEISSGDDGVGPVAQRIRARGYEPRCRGFESLLAHNRPKKGRIFPSGVGKS

SEQ ID NO: 173822 - protein, 433 aa, Glycine max
  Coding DNA Sequence Number=SeqID_82137
  Gene Ontology: Mol. function=aldehyde dehydrogenase (pyrroloquinoline- quinone) activity; Cellular component=membrane; Biological process =electron transport
  Homolog annotation: Hit_ID=A8GE76; Match level="QueryCoverage=60%, HitCoverage=22%, E-value=2e-86, Identity=62%"; Hit description =Aldehyde oxidase and xanthine dehydrogenase molybdopterin binding
  Pfam annotation: Domain name=Ald_Xan_dh_C2; Domain location=5-393; Score=-302.0; E_value=0.088; Accession=PF02738.9; Description =Aldehyde oxidase and xanthine dehydrogenase, molybdopterin binding domain
  Pfam annotation: Domain name=Fer2; Domain location=22-82; Score=26.6; E_value=9.3e-05; Accession=PF00111.18; Description=2Fe-2S iron-sulfur cluster binding domain
  Pfam annotation: Domain name=Fer2_2; Domain location=90-157; Score =68.3; E_value=2.6e-17; Accession=PF01799.11; Description=[2Fe-2S] binding domain
  Pfam module annotation: Pfam domain module=Ald_Xan_dh_C2::Fer2::Fer2 _2; Domain location=5-393::22-82::90-157
MKMLAHQTATPVSPASTCHYALEVNGATHPISSYRDTSLLLVLRNQLQLNGPKYGCGLGECGACTVLIDGVAARACVIPAYGVRQRAITTLEGLGNRDALHPVQQAFIEAQAAQCGYCLNGMIMTTAALLRAQPCPDDRQIRAALSGDPVRGEARHHLMPAAGGGGIMSAANVPTQQQLLAASDILLIVDEIQPPPGLVPKGQTPTLKAKERALFLAIDGSGRVWAFNGHVDLGTGVKTALTQIVAEELNLRMDQVHMVLGDTLRVPNQGATIASATLQISAVPLRKAAATARQWLLQQAAARWQLPVESITLDGGFLQHPSGVQLSFAELVQQQRSIVPIDHQVTLKPASEYRLVGTSSARVDIPAKATGELTWVHDLRVPGMLHGRVIRPPYAGYDTGSFVGTSLLSIDESSIAHLEGIVKVVQIADFVGV

SEQ ID NO: 173823 - protein, 320 aa, Glycine max
  Coding DNA Sequence Number=SeqID_82138
MERSMIDAASGGALGDMTPAEAGNLIEKMVSNSQQFSARNDVIVLRGFHEVATDSSSSAENKKLEGKLDALVNLVTQLAMNQKFAPVARVCGWRNHPNLRWTSPPQQQQPVPPFQNAAGPSKPYVPPPMQQQQQQSQQRQQATEAPPQPSLEELVRQMTIQNMQFQQETRASIQSLTNQMGQMATQMNQAQSQNFDKLPSQIVQNPKNVSAITLRSGNQIQVPPLVAAPAPEPVKLHSTLEKEDEIAAQKRKLPNKKFHASGPSSSNSDLQQHPIPLPFPPRAIPNKKKGRSGKGDPGDLQESRGKHTSVGCNKANSKIC

SEQ ID NO: 173824 - protein, 372 aa, Glycine max
  Coding DNA Sequence Number=SeqID_82139
  Gene Ontology: Mol. function=motor activity; Cellular component=cell projection
  Homolog annotation: Hit_ID=P15305; Match level="QueryCoverage=97%, HitCoverage=93%, E-value=2e-28, Identity=22%"; Hit description =Dynein heavy chain
DCTSSPSEGLHVLASEGLHLLDFRGLHVLTFTGLYLLAFRGLHVLAIRGLQVLAFRRLHVLAFRGLHVLAFRGLHFLAFRGLHPLDFRGLHVLTFTGLYLLAFRGLHVLTFRGLQVLAFRGLHVLAFRGLHVLDFRGLHVLAFIGGLHILAFRGLHFLSFKGLHVLAFRRLHVLAFRGMHVLTFRRLHVLAFRVLHVLTFRRLHVLAFRVLHALAFRGLHFLTFRRLHILAFRGLHVLAFRRLDVLAFTELYVLAIRGLHVLAFRGLHILAFRGLHVLAFRELHVLTFRGLHVLAFRGMHVLPFRGLHVLTFRGLYVLTFRGLHVLAFKGLYVFAFRGLDALAFRELHVLAFTGLHVLAFRGLQVLAFRGLH

SEQ ID NO: 173825 - protein, 54 aa, Glycine max
  Coding DNA Sequence Number=SeqID_82140
  Homolog annotation: Hit_ID=A5C786; Match level="QueryCoverage=100%, HitCoverage=15%, E-value=3e-10, Identity=46%"; Hit description =Putative uncharacterized protein
MAFVSQIEPRNVDEAFYDEKLLLAMHEENKARLVAKGYNQEEGIGYDETYAPVA

SEQ ID NO: 173826 - protein, 101 aa, Glycine max
  Coding DNA Sequence Number=SeqID_82141
MACNMFAPCPNFRDLHGRKLKGPLVIIPKVVISLLMVSRGIIPFEEHIAAVGTTSNNMLSKRKTLDEREGDARLTGASSKGRRCAESPPMFIRGKRQKNRK

SEQ ID NO: 173827 - protein, 110 aa, Glycine max
  Coding DNA Sequence Number=SeqID_82142
MEAMKDQMTTMMEAMMSIRKIMKVNMVTVTTTSAATEVDSTHPSGVNQAPPNVVHVPEENIDHSAPIPLESQQPQPGHAHVAQPMGETHEVPRHHTRADFDPYLRYATEV

SEQ ID NO: 173828 - protein, 66 aa, Glycine max
  Coding DNA Sequence Number=SeqID_82143
MKKQQWKRRCNGRQRRRGKRRCHPLGNKPWKKELHHQDEPWIRSLERMLHWRKRKRERKREGGAQN

SEQ ID NO: 173829 - protein, 154 aa, Glycine max
  Coding DNA Sequence Number=SeqID_82144
LCQSYGVPVTPSKVIRPPITRAFIEKYYTPRQAHSDAHQATDTPPPPRQADPAGPLDVERYLQHLVRQQAANHHGQVQIHECLYQFSLSQQGQGSTPFVCPTPEQFGGKVAWPRDWPDAQTGEEPAGSLGEADESHMDEEMIDLLDFLGGSRAT

SEQ ID NO: 173830 - protein, 47 aa, Glycine max
  Coding DNA Sequence Number=SeqID_82145
MEVMEGCAIWCGERIGGVCGGGGVRGACWRCYMGVLRGRGVEDELQH

SEQ ID NO: 173831 - protein, 111 aa, Glycine max
  Coding DNA Sequence Number=SeqID_82146
MSWNFTDCATMLPFDFQHVTKLHRLPNDGCQVPRSGQTRVASQQTDGPRTKLGDSWWFSAKVISNGVNPVLEWHEVLYDHSAHNRNRPHNAGLRWTKALKYCSTIRFATSV

SEQ ID NO: 173832 - protein, 86 aa, Glycine max
  Coding DNA Sequence Number=SeqID_82147
MKSENSDDMISGRETSVTEEGLQRARLMGALSKGGKMRGVATNEGISTSHVDKSGALAPTYPPSRRKSDLRSSFLSVNQAILFTGK

SEQ ID NO: 173833 - protein, 64 aa, Glycine max
  Coding DNA Sequence Number=SeqID_82148
MERYEQLRLSLHVDGLSKVSMDKWMDITDMGYVIASRYNVYLKDRCPLLSMALLWSSNSYLEAK

SEQ ID NO: 173834 - protein, 120 aa, Glycine max
  Coding DNA Sequence Number=SeqID_82149
MTQHISVTVVDSRSGQSQFESKSYIKTWIQSSKRDVYLGAYLNGGHWQMVVILPKEHLVVWFCSLHSRPDNYLKGIINSALKGLDDAPQPKSKAPTRWIVIKYFNDPRPLELERLKALQI

SEQ ID NO: 173835 - protein, 117 aa, Glycine max
  Coding DNA Sequence Number=SeqID_82150
MVPKDNTLLDRHYEAKKILCLMGMEYKKIHGIMLQIEGCDSSSDEMKENVMDVEAMPSKVILMMLKNQELIPKIQESSFNNQDSRIQESSFNNQDSRIIKIKIQDSRFKNQEKTQSR

SEQ ID NO: 173836 - protein, 72 aa, Glycine max
  Coding DNA Sequence Number=SeqID_82151
MDDSSSVPPSQGNTSNHYPSWLFLGNYQHGTFRVACTIDTAASHYGYQSAAHSPSDLTSHSGYHSVAHSASD

SEQ ID NO: 173837 - protein, 82 aa, Glycine max
  Coding DNA Sequence Number=SeqID_82152
MTLGRVRTVRVRVRDKVFGGSVAMEGFRSTCNDLIHVVTEKRECHRRGFDSRCHGERETPAMKIQKVLDFVEGENLKNNCKK

SEQ ID NO: 173838 - protein, 255 aa, Glycine max
  Coding DNA Sequence Number=SeqID_82153
  Gene Ontology: Mol. function=magnesium ion binding; Cellular component=nucleus; Biological process=metabolic process
  Homolog annotation: Hit_ID=A4ZGS2; Match level="QueryCoverage=39%, HitCoverage=70%, E-value=3e-24, Identity=42%"; Hit description =Transcription factor bZIP83
MTLEEYEKVLEERRKAFHALKTEERKVLERDEIMNKFYKVTAQLEQSLGGISYDKLDISDEVKEHVELVLAQFRRANGRVDELAVRLSYLYYNSGSFNKENLYKLQDENAEHMPIGFEVAFPSLLDHARSLNIEVPDESSILKNIFAMRDLKLKKIVAFEIEYGQWEEQESVLNHYSNLFIMKADVVKADVLYLLSGAWKPSVERIFLWIGGSRPSQLLNTLVHDMAVDPLGVGNLGLQMALTMEKFEALEGFVN

SEQ ID NO: 173839 - protein, 103 aa, Glycine max
  Coding DNA Sequence Number=SeqID_82154
  Gene Ontology: Mol. function=4 iron, 4 sulfur cluster binding; Cellular component=integral to membrane; Biological process=protein -chromophore linkage
  Homolog annotation: Hit_ID=Q2WGC4; Match level="QueryCoverage=55%, HitCoverage=7%, E-value=8e-15, Identity=64%"; Hit description =Photosystem I P700 chlorophyll A apoprotein
MWIGGFLIVGVAAHAAIFMAFIVVAVGGKVALLPIPLGTVDFLVHHIHAFTIHSDVWGSISDQGIVNHITGGNFAQSSITINGWLHDFLCTQASQAWLLARTY

SEQ ID NO: 173840 - protein, 77 aa, Glycine max
  Coding DNA Sequence Number=SeqID_82155
MALLGTRPTKAQQPNDPTHSKKIELKREEEEEEEEEEEEEEEEEEEEEEEEEEEEEEEEEKVLTHAYQQGGCTSNKK

SEQ ID NO: 173841 - protein, 61 aa, Glycine max
  Coding DNA Sequence Number=SeqID_82156
MALGQHWSLRTINVYLSQPGWGSIAPTTWLNMKHAPWPSRQKLTSMSSYSRFLYNKRPSVS

SEQ ID NO: 173842 - protein, 38 aa, Glycine max
  Coding DNA Sequence Number=SeqID_82157
MWTTTGEELATQLAQVRKVASSRSNSLLEEESGRPMWA

SEQ ID NO: 173843 - protein, 236 aa, Glycine max
  Coding DNA Sequence Number=SeqID_82158
  Gene Ontology: Mol. function=cyclic-nucleotide phosphodiesterase activity; Biological process=tRNA 3'-terminal CCA addition
  Homolog annotation: Hit_ID=A8GJU7; Match level="QueryCoverage=100%, HitCoverage=57%, E-value=1e-124, Identity=91%"; Hit description =Multifunctional CCA protein [Includes: CCA-adding enzyme (EC 2.7.7.25) (EC 2.7.7.21) ...
  Homolog annotation: Hit description=(tRNA nucleotidyltransferase) (tRNA adenylyl-/cytidylyl- transferase) (tRNA CCA-pyrophosphorylase) (tRNA-NT); 2'-nucleotidase (EC 3.1.3.-); 2',3'-cyclic phosphodiesteras e (EC ...
  Homolog annotation: Hit description=3.1.4.-); Phosphatase (EC 3.1.3. -)]
  Pfam annotation: Domain name=HD; Domain location=66-167; Score=55.2; E_value=2.3e-13; Accession=PF01966.13; Description=HD domain
MAHSGELAALTAERVWKETEKALQSQSPQVYFQVLRDCGALAVLFPEIDALFGVPAPAKWHPEIDTGVHTLMALAIAARLTPEVDVRFATLCHDLGKGLTPKEFWPHHHGHGPAGVRLVEALCQRLRVPNPVRDLSKLVAEYHDLIHTVNKLRPETLLKLFDAIDVWRKPQRLEQMILTSEADARGRTGFEENPYPQGDYLRQAYQVANAVSIKEVVASGLQGTAIRDELKRRRQQ

SEQ ID NO: 173844 - protein, 114 aa, Glycine max
  Coding DNA Sequence Number=SeqID_82159
  Subcellular localization annotation: CTP_CleavageSite=56; ConfidenceScore=5.30e-01
MGFRGFRDTRNASSVFWRKQPSSPGRAGRQPPPPFSYKKAEGGCSKDPSAPWLCISAILGEKNCFREENPSRGASVTLPRCFRKQIREGFRPFFTVLRSSTEQNLTDRSHYNLG

SEQ ID NO: 173845 - protein, 84 aa, Glycine max
  Coding DNA Sequence Number=SeqID_82160
LCQSFGVSVAPSKVIRLSITQAFIEKYCTPRQAQGDAPQAADAPPPPHQANPAGSFGMERYLQHLVHQQAANHRAHVQTHECLY

SEQ ID NO: 173846 - protein, 134 aa, Glycine max
  Coding DNA Sequence Number=SeqID_82161
DFLSVVSLVTIFQRNERGFEAFSPHGQDHLGLPSGVETKHERQKPIKVLKDERKWGWGHDRPIVALLCAKQAENVAARQPRSLPQRGPGRIRQPKELVPLRSMTVTALGALYTNSASRPSRDGRFSGSDASSSR

SEQ ID NO: 173847 - protein, 82 aa, Glycine max
  Coding DNA Sequence Number=SeqID_82162
MSNHKSTESTLKNLEVQVGQLAKHIADKSSNSFVANTEQNPKEECKAVMTRSKRFMEVEDEDNVVYKKKTADKKGTDDKKNE

SEQ ID NO: 173848 - protein, 99 aa, Glycine max
  Coding DNA Sequence Number=SeqID_82163
MYFSNLAILSSSPCLWMLSLLKSNNGGLSENCIPWVEGLAYAFIYSSSMVLSSTSCSSSPPTSHSMVEIITLQWPFGFSFMVVEKPIEEVCNCLANYPF

SEQ ID NO: 173849 - protein, 68 aa, Glycine max
  Coding DNA Sequence Number=SeqID_82164
MGAKYLEVIKQGSHPNNGWSPDKIRGFIGALSRILAKWPFHYPICCKRRWILILMINAKRLLIASSMW

SEQ ID NO: 173850 - protein, 212 aa, Glycine max
  Coding DNA Sequence Number=SeqID_82165
  Gene Ontology: Cellular component=mitochondrion
  Homolog annotation: Hit_ID=Q6R9L5; Match level="QueryCoverage=40%, HitCoverage=70%, E-value=3e-30, Identity=76%"; Hit description =Putative uncharacterized protein orf121-a-ct
STLEDPQFDLCYDLSFMDVDKILPSSSTLGWHSLKVKGEVQTKKGLWWIPRHPETRKGVVSDEMLRGVENKRRSGDSRYRSTFRTAAESTGRQETTCLNRENGVVGELYKCRAARRSSRECCTLDGESPGPPCKAKYSWVTDSESSTVREGETTGAVAKASLHRAIVTAYGPEPGSEPTDVEESADELWLGVKCHSNPELAGSPRNALRRSS

SEQ ID NO: 173851 - protein, 138 aa, Glycine max
  Coding DNA Sequence Number=SeqID_82166
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=71%, HitCoverage=75%, E-value=7e-25, Identity=65%"; Hit description=LacZ protein
  Subcellular localization annotation: CTP_CleavageSite=32; ConfidenceScore=5.04e-01
MTMITPSSKLTLTKGNKSCPGDPLVLERPPPRWSSNSPYSESYYNSLAVVLQRRDWENPGVTQLNRLAAHPPFASWRNNEEARTDRPSQQLRSLNGEWDAPCSGALSAAGVVVTRSVTATLASADVRRCFCRYAPPRQ

SEQ ID NO: 173852 - protein, 88 aa, Glycine max
  Coding DNA Sequence Number=SeqID_82167
  Homolog annotation: Hit_ID=A5AV98; Match level="QueryCoverage=89%, HitCoverage=16%, E-value=1e-09, Identity=32%"; Hit description =Putative uncharacterized protein
  Pfam annotation: Domain name=zf-CCHC; Domain location=28-45; Score =9.9; E_value=0.048; Accession=PF00098.14; Description=Zinc knuckle
MKKHDKGKGPLKINDGPMQIQKKASKSNNCHFSGKSRHFQKDCPKHGLYVETILTLHHNIGTKHSLVNERSAFLWHKHLGHSSRGGIL

SEQ ID NO: 173853 - protein, 93 aa, Glycine max
  Coding DNA Sequence Number=SeqID_82168
  Homolog annotation: Hit_ID=Q2HW90; Match level="QueryCoverage=67%, HitCoverage=12%, E-value=6e-07, Identity=44%"; Hit description =Putative uncharacterized protein
MANQEEWVPFMDVLALIIFGVVLFPNMDGLVDLAAIDAFLAYHHSKESPVVAILADLFDTFERRCEKSSARIICCLLCTFPPYVMQYSRGSFK

SEQ ID NO: 173854 - protein, 261 aa, Glycine max
  Coding DNA Sequence Number=SeqID_82169
RMKRILPMHWLNFKRYKSDVAKQAVPPHLNAAEFARHYADKPQADTEEYLSLSGEMCWDAVVLCAHRSGALSKAKYKQLWQTALPPAIKIFASAWGARSAGKISIWRAICAGSRKAVFYARATTKCCAFFTGLSPPEPTGGSDPRLMWVDIIVVLVDVAHHIGLYQALGFEIGEGIGEGVRAGGVLFPQFIGFFIQRAGVIGGQPGQDLIVERIVGHDAVLFIASDSLGKWRREMLKVISPMLKSAPSHRASITRMPMMME

SEQ ID NO: 173855 - protein, 134 aa, Glycine max
  Coding DNA Sequence Number=SeqID_82170
  Gene Ontology: Biological process=transposition, DNA-mediated
  Homolog annotation: Hit_ID=Q1J7G7; Match level="QueryCoverage=29%, HitCoverage=70%, E-value=9e-12, Identity=73%"; Hit description =Transposase
VLQWLLFLSAVPPVQLLTGWCVTAKAPPDISAGKCSGRVPFAIQAAQLLGRAIGAGLFAITPAGERGMCCKAIKLGNARVFPVTTLNSIPWPAGGARAGTGEGAYRGAPVGPVRPAAGERGDAELRAGPRAKAP

SEQ ID NO: 173856 - protein, 78 aa, Glycine max
  Coding DNA Sequence Number=SeqID_82171
MRDGKRSSYVFGIGVNSGIGHGGMFLITLELAPKWALPVGRVVVGVGAWGASFWMGAGALGCTGAQLEEFPARAEKLG

SEQ ID NO: 173857 - protein, 89 aa, Glycine max
  Coding DNA Sequence Number=SeqID_82172
MAIRLLNLYLRVGVVLGYINERKDRGGVGLGAKQSEGLRTVGEEGEGEFKIWRASFSFSSPSSNVNAPPNSPLKDIKPNSHSLYITENR

SEQ ID NO: 173858 - protein, 108 aa, Glycine max
  Coding DNA Sequence Number=SeqID_82173
SRLFRFFRRFPQINVGGDSARIPFVEHASRESRVALPPKGRLRQAGTGGPLEGATRSDPTQHGSDGGAREYNDGEVETTSEQTRGTHAIEKMPCVHGGFMRTNGTIMK

SEQ ID NO: 173859 - protein, 156 aa, Glycine max
  Coding DNA Sequence Number=SeqID_82174
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=55%, HitCoverage=73%, E-value=2e-24, Identity=67%"; Hit description=LacZ protein
MKHFTDTLISANILLRPLVQQDGDTRLQNVIGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 173860 - protein, 42 aa, Glycine max
  Coding DNA Sequence Number=SeqID_82175
MTTLTQTWMTLLLSNILPNDHNSDLPLPKYQLVQFVKFRDMS

SEQ ID NO: 173861 - protein, 137 aa, Glycine max
  Coding DNA Sequence Number=SeqID_82176
  Gene Ontology: Mol. function=protein serine/threonine kinase activity; Cellular component=plasma membrane; Biological process =protein amino acid phosphorylation
  Homolog annotation: Hit_ID=A7QWP1; Match level="QueryCoverage=33%, HitCoverage=15%, E-value=5e-12, Identity=72%"; Hit description =Chromosome chr4 scaffold_205, whole genome shotgun sequence
MQTELNMRRLSHPNLVNLLGYCWDDDEHLLVYEFMPKGSLDNYLFNQAYRYRRPRGGARYQLLFPLVRVNFELGVIMVIAVSFGKPVVPAALMNRPTRGERRFAYWALAECILAYYVGTDEGVSEVLHVAGEKRLHP

SEQ ID NO: 173862 - protein, 42 aa, Glycine max
  Coding DNA Sequence Number=SeqID_82177
VSVHVAQLISDAIYQFVGIAPTRGGDKAQEDEDMADMLDFLL

SEQ ID NO: 173863 - protein, 117 aa, Glycine max
  Coding DNA Sequence Number=SeqID_82178
MEAIKEQMATMMKAMMSMKKIMEANAVIVAAISAVAKWLKTLMTMAGMGKLDHLEERLRAIEGGEDYAFANLKELFLIPKHGHSQVQGARLWQVQGDYSLQEPSKDVLSEDGGIRKR

SEQ ID NO: 173864 - protein, 535 aa, Glycine max
  Coding DNA Sequence Number=SeqID_82179
  Gene Ontology: Mol. function=tRNA dihydrouridine synthase activity; Cellular component=nucleus; Biological process=metabolic process
  Homolog annotation: Hit_ID=A7P7Z5; Match level="QueryCoverage=88%, HitCoverage=65%, E-value=1e-157, Identity=62%"; Hit description =Chromosome chr3 scaffold_8, whole genome shotgun sequence
  Pfam annotation: Domain name=Dus; Domain location=375-534; Score= -127.7; E_value=0.089; Accession=PF01207.8; Description =Dihydrouridine synthase (Dus)
  Pfam annotation: Domain name=zf-CCCH; Domain location=107-136; Score =17.9; E_value=0.0059; Accession=PF00642.15; Description=Zinc finger C-x8-C-x5-C-x3-H type (and similar)
  Pfam annotation: Domain name=zf-CCCH; Domain location=146-174; Score =9.1; E_value=0.087; Accession=PF00642.15; Description=Zinc finger C -x8-C-x5-C-x3-H type (and similar)
  Pfam module annotation: Pfam domain module=Dus::zf-CCCH::zf-CCCH; Domain location=375-534::107-136::146-174
MTRDILLSFIKPYYLSSTKKHERNNMDEEEPRDEGQQGGSVEQSPEQLVARAIAPVKKDFLRPPPVRSSSPNDGVSIPNDNNKTSVLAKEKKSKRQLKRERRLEQKSARNLCPEIAKTGDVSSCPYKDKCRFSHDLEAFKAQKPADLEGQCPFFKSGGACPYGLGCRFSSTHEDGVPSANLNGLKNNSEVNGLSKHVQKLLWKNKMSFSKADAQLKSLGLVGTSKSKRNDLENKDEGDTGSNKCDHSDYSGSCVVTSDSCCKLECPEEVMKDDDNDIDGKSESDVLCPQKRRKIAENCGPMDAENEGHRFIFDSICVTWLHTAETGVSVTEQIVERSCTKSEPEAGTDALTPETDLSLKLHSREKKLIDFREKLYLAPLTTVGNLPFRRVCKVLGADVTCGEMAMCTNLLQGQASEWALLRRHSSEDLFGVQICGAYPDTVARTVELIEQECTIDFIDINMGCPIDIVVNKGAGSALLTKPMRMKSIVEVASGTAEKPITIKVFAVLNTTELDTMIYVTPINILIAYSLSSSVFW

SEQ ID NO: 173865 - protein, 77 aa, Glycine max
  Coding DNA Sequence Number=SeqID_82180
  Gene Ontology: Mol. function=catalytic activity; Biological process =auxin mediated signaling pathway
  Homolog annotation: Hit_ID=P33080; Match level="QueryCoverage=66%, HitCoverage=56%, E-value=8e-13, Identity=67%"; Hit description=Auxin- induced protein X10A
  Pfam annotation: Domain name=Auxin_inducible; Domain location=1-52; Score=23.8; E_value=1.1e-07; Accession=PF02519.5; Description=Auxin responsive protein
MKRLLIPVSFLNEPLFQELLREAEEFGYYHSMGGLTLPCMEDVFLDIASHLKRHRYIMPNFSETQTIMIVQLSTITD

SEQ ID NO: 173866 - protein, 630 aa, Glycine max
  Coding DNA Sequence Number=SeqID_82181
  Gene Ontology: Mol. function=hydrolase activity, acting on glycosyl bonds; Cellular component=anchored to membrane; Biological process =nucleoside metabolic process
  Homolog annotation: Hit_ID=A7P840; Match level="QueryCoverage=62%, HitCoverage=92%, E-value=1e-150, Identity=62%"; Hit description =Chromosome chr3 scaffold_8, whole genome shotgun sequence
  Pfam annotation: Domain name=PNP_UDP_1; Domain location=434-630; Score=-83.3; E_value=0.034; Accession=PF01048.11; Description =Phosphorylase family
  Pfam annotation: Domain name=Phytochel_synth; Domain location=47-210; Score=143.2; E_value=7.5e-40; Accession=PF04833.6; Description =Phytochelatin synthetase-like conserv
  Pfam module annotation: Pfam domain module=PNP_UDP_1::Phytochel _synth; Domain location=434-630::47-210
MTGQENMKGPFTKSGALASFDCYDPLDPNGNISVTFDIFQRTPDNGYLARVTLQNYYQYRHVDKPGWKLGWTWANNEVIWSMSGAIATDRGNCSSYSGSQMPHSCKKDPTIVDLSLDASQNRSEHCCRGGLLSPWSIDPFYAFSSFELEVRNVGDNPLGQAPINLTLMAPGPGYTCSPLLDTDLSVSSDFGGLRQVPVLRTWKSTCAYSSFLANTIPVCCVSLSSFYNPAITSCRNCSCGCREADKSTATCIRSSSLSRSNEDNTIDEMIECTDHMCPVRVHWHFKNNYMNQWRVKLTISNYNYNRNYSNWNVLVQHPGFTQKARTYSFNSTKLPTLGLQDYYNNELVHSDKDGVGLVTTEILLDKDPNSFTVSNGWAFPRRIYFNGENCEMPLPDTFPMLPNGGSILRATYCEDVEEKWTFAFHVSTLIEVSTYAQWCRFPQGVPLVRYHGTFKDLNMNWIWAGNDPTLGVDSIGTIPSALATYAAVLALQPYLIINAGTAGGFKIFDLYGIGLRKVFETPNLVKELNLKEFIVFVQNLNVKQYLCIFLVAKLSTGGSLDMTEQDESSIIANDATVIDMEGAAIAYVADILKVPAIFIKAVNSIVDGDKAIVEEFLQNLEALTAVLDLN

SEQ ID NO: 173867 - protein, 45 aa, Glycine max
  Coding DNA Sequence Number=SeqID_82182
MGHATLPPFPCYSCLNGQHVEFKISAQIKDLDLGIQAFGFKCKKA

SEQ ID NO: 173868 - protein, 140 aa, Glycine max; identical to SEQ ID NO: 99143
  Coding DNA Sequence Number=SeqID_82183
  Homolog annotation: Hit_ID=O52175; Match level="QueryCoverage=58%, HitCoverage=94%, E-value=1e-32, Identity=85%"; Hit description =Salmonella berta plasmid pBERT, complete plasmid sequence

SEQ ID NO: 173869 - protein, 416 aa, Glycine max
  Coding DNA Sequence Number=SeqID_82184
MAPKKLSAKRSRRDAAAEGTSVAPEFDSHHFRSVVHQQRFEAIKGWSFHRERRVQLRDDEYIDFQEEIARRHWTSLATPMAKFDLEVVLEFYANAWPIEEGVRDMRSWVRGQWIPFDADALSQFLGDPLVLEEGQECEFSQRRNRNDGFNEEAIAQLLCTPRQDFTRTAAGRWVRIMRTSMTTLTQMWMTLLLSNVLPSDHNSNLPLPKCQLVYAILTRMSVHVAQLIADAIYLFAGMPPTRHPLDPDKSNRALGFLALITGLCQSFRVPIASSKVIRLSITRAFIEKYCTPRQAQGDALQAVDAPPPPHQVDPARSLGMERYLQHLVRQQAANHRRQVQIHECLYRFSLSQQGQGFAPFACPTPVQFRAEVAWPGDWPEAQAGEALARSPGDAEEARMDEEMTDLLSFLGGSRAT

SEQ ID NO: 173870 - protein, 66 aa, Glycine max
  Coding DNA Sequence Number=SeqID_82185
MREARRSTLFQIYNMGSGNAMWLDSHVDLNESSFPRRCNSSYFGNGKIFGARTQEEGLIRIILTWF

SEQ ID NO: 173871 - protein, 158 aa, Glycine max
  Coding DNA Sequence Number=SeqID_82186
MVRFALSQGAPFEGTIVDDWKFDYSSHDARRMVYNDQDDMTGRLLAGSLTFDCHIMHYIIVRILLPRCSNMAQASEEDLILMWAFLIGRQIDWAHLVRYQIQKALRANAPLLYPQLVTLFLRHFQIPLDDEPFVQVKRSFAIGAGAVTSFGYRKDRDG

SEQ ID NO: 173872 - protein, 169 aa, Glycine max
  Coding DNA Sequence Number=SeqID_82187
  Subcellular localization annotation: CTP_CleavageSite=21; ConfidenceScore=5.46e-01
MDTPFAPPPPPPPPSPTPPFPADTTVSLSTLERIHKVTQLRSLATRPPGAERLVININLAIGKADGPHKKKLRTYLGIVARDKVDITYETWKEAEFEIPKTSNSRTKKKILQTVGERWRQFKSDLTRKWALAPNIDGVDNTVYEKYDISKEKWTQFCQTHRDPSWEKKA

SEQ ID NO: 173873 - protein, 59 aa, Glycine max
  Coding DNA Sequence Number=SeqID_82188
MAPKKLSAKRSRRDTTAEGTSAAPEFDSHHFRSAEHQQCFEAIKGWSFHRERRVQLRDD

SEQ ID NO: 173874 - protein, 178 aa, Glycine max
  Coding DNA Sequence Number=SeqID_82189
  Subcellular localization annotation: CTP_CleavageSite=21; ConfidenceScore=5.05e-01
IGNALSAGSGAKPESLTKALSAATALSPKCLLEVTISSRGTWVATLVPKPLHSLIPEHFCFCFVLIAPLHPSCFSALHIQLTDFGDGNIDVAIVKEFYAKLYDPEDKSPKQVRVRGHLIKFDEDMINTFNTFLKTPVIVEEGESLCAYSRFALLRPDPQELAAKLYILGKGFEFNADG

SEQ ID NO: 173875 - protein, 147 aa, Glycine max
  Coding DNA Sequence Number=SeqID_82190
GTKAGTGPPLEVDGIDKLDQPQPTDGPAPTFGLLAGRIDIHELPCWFHSYSTVLVLCCENREADTTTHQFNLASTIMFVQGHGVKAGTLRAERGRSSLLNSTNDRGPHGTNGQRIAYWVPGWWCSTSLLFLLTINYYEESTARGWRG

SEQ ID NO: 173876 - protein, 187 aa, Glycine max
  Coding DNA Sequence Number=SeqID_82191
  Homolog annotation: Hit_ID=UPI00006A2D9E; Match level="QueryCoverage =72%, HitCoverage=77%, E-value=3e-11, Identity=16%"; Hit description =UPI00006A2D9E related cluster
PLDESISCFLIRVDPWVLVPIAFRGLHTLAFKGLHALTFKGLHALAFRGLHVLTFRGIHTLNFRELHAFNFKGLHILAFRGLHILAFRGLHTLAFKGLHILAFRGLHVLAFRGLHILAFRGLHVHTFRGLHARTFRELKGGQLCEHNQRRGQVSDFDEETIAQLLYIPGQDFAQWLQGDECGSCAPT

SEQ ID NO: 173877 - protein, 86 aa, Glycine max
  Coding DNA Sequence Number=SeqID_82192
SHVQSGTYECGYYVMHWMWNIIVGQLKTNWTLQNPSGEDDVAADGNKENPTNEAEQKEPENKKFNLEFENSCDYSIVSHRRNSQLA

SEQ ID NO: 173878 - protein, 52 aa, Glycine max
  Coding DNA Sequence Number=SeqID_82193
MCVPMPKMARECFPNEYMMWNCPSRVGRWHEGFFSNARNGPEEACHKEVQEE

SEQ ID NO: 173879 - protein, 101 aa, Glycine max
  Coding DNA Sequence Number=SeqID_82194
MMMKDNYRLKDTLLSFKVFWTGLMDSKPMLVILMMPKNQELSKRFQAKIQESSFKNQDSSFKNQDYRFKNQVSRIKNQVSRIIKIKFQDTRFNNQEKTQSR

SEQ ID NO: 173880 - protein, 53 aa, Glycine max
  Coding DNA Sequence Number=SeqID_82195
MFCHQKIRGQDDRGDEREGGTGAGGSLEVPWRRWLAAVVVEEDPFHFLDDSAI

SEQ ID NO: 173881 - protein, 284 aa, Glycine max
  Coding DNA Sequence Number=SeqID_82196
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSISTHNDTTTASPYPLSIYQSNIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 173882 - protein, 252 aa, Glycine max
  Coding DNA Sequence Number=SeqID_82197
  Gene Ontology: Mol. function=isocitrate lyase activity; Cellular component=cytoplasm; Biological process=carboxylic acid metabolic process
  Homolog annotation: Hit_ID=A4TH33; Match level="QueryCoverage=100%, HitCoverage=57%, E-value=1e-126, Identity=88%"; Hit description =Isocitrate lyase
  Pfam annotation: Domain name=ICL; Domain location=1-252; Score=251.5; E_value=1.8e-72; Accession=PF00463.12; Description=Isocitrate lyase family
MITAGAAGVHFEDQLAAVKKCGHMGGKVLVPTQEAIQKLVAARLAADVLGVPTLVIARTDADAADLLTSDCDPYDSAFVTGERTAEGFFRTHAGVEQAISRGLAYAPYADMVWCETSTPDLDAAQRFADAIHAKYPGKLLAYNCSPSFNWKKNLDDQTIARFQQALSDMGYKYQFITLAGIHSMWFNMFDLAHAYAQGEGMKHYVEKVQQAEFAAVDRGYTFASHQQEVGTGYFDKVTTIIQGGASSVTALT

SEQ ID NO: 173883 - protein, 290 aa, Glycine max
  Coding DNA Sequence Number=SeqID_82198
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGYFENNCGVADVEEACHLGARAERACGGDDYAENQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 173884 - protein, 324 aa, Glycine max
  Coding DNA Sequence Number=SeqID_82199
  Homolog annotation: Hit_ID=Q9LEU1; Match level="QueryCoverage=62%, HitCoverage=48%, E-value=1e-22, Identity=31%"; Hit description =Putative uncharacterized protein T30N20_270
  Pfam annotation: Domain name=DUF868; Domain location=18-323; Score= -10.3; E_value=1.8e-11; Accession=PF05910.3; Description=Plant protein of unknown function (DUF868)
MTWKVADPQCNPAHEHTYYEGQKAFEALSKAQFKETNKLTLLSHSLTIYAPHTFSITIPLNPSTFSFFRTRPESKSIYLTRPHKRSQKIKLHWDFSETLFSTRNSAEPESCFYLAICCNGRVEFFLGDLVLGLPVQLSTHQPSDQTLVSRREHVFGSKSYVSRGEFMGSKHELEIELCSGEELRVKADGQVCLVVKRLAWKFRGNEKIFIDGVEVEFYWDVLNWVVNSEDGNGNNGHGVFVFQVGDGGAVWPEMVGPEKKLMKKRLVGPTMAPSIFRTSPSSSSVLQWAEESSDGGRSSCSSSTRSCGSSNGGFSLLLYAWWRD

SEQ ID NO: 173885 - protein, 127 aa, Glycine max
  Coding DNA Sequence Number=SeqID_82200
MSELTNEEHGQCCKMVKIMLKVAVPPYAILNTVNAKDEIYGEVSKSFAVRWKDIFDRLWHFIDKNGNFHTVVYNQNLDKPTIVAGWTTLRDFYHLIGDHQVSLTHYSNNVFFLTIFKSSSLPKSFPR

SEQ ID NO: 173886 - protein, 276 aa, Glycine max
  Coding DNA Sequence Number=SeqID_82201
  Gene Ontology: Mol. function=protein dimerization activity; Cellular component=nucleus; Biological process=regulation of transcription, DNA-dependent
  Homolog annotation: Hit_ID=Q0GPG9; Match level="QueryCoverage=82%, HitCoverage=56%, E-value=1e-104, Identity=85%"; Hit description=BZIP transcription factor bZIP89
  Subcellular localization annotation: CTP_CleavageSite=48; ConfidenceScore=5.40e-01
MDRVFSVDDISDHFWPPPPIPVSGANTSSQMSRSASEWAFQRFIQEASASAPSPPSSSSPADVVFVEIDDQPKPTPPPPSHGGVLPSDPGPVALDSEEYQAFLKSKLNLACAAVAMTRGSLAKSQDPSPFSDGGSQPTNPSLVGSQTTSKGSIPSGNDQSKLQDKDINAPVGIPSIPAIQKKPAVAIRPSTSGSSREQSDDEDIEGETSMNDNTDPADVKRVRSKLNKFYTGGKFNWGTNYASICLCPLWCVGRLVLPWKEVLMLSDILFYHRFLN

SEQ ID NO: 173887 - protein, 429 aa, Glycine max
  Coding DNA Sequence Number=SeqID_82202
  Gene Ontology: Mol. function=metal ion binding; Cellular component =prefoldin complex; Biological process=chaperonin-mediated tubulin folding
  Homolog annotation: Hit_ID=A7QVP5; Match level="QueryCoverage=69%, HitCoverage=77%, E-value=3e-61, Identity=42%"; Hit description =Chromosome chr14 scaffold_190, whole genome shotgun sequence
  Pfam annotation: Domain name=Prefoldin_2; Domain location=319-423; Score=86.0; E_value=1.2e-22; Accession=PF01920.11; Description =Prefoldin subunit
MNPTPVCRKCIYEKLSDEETDCCPVCNIDLGCLPVEKLSAPKVSMQPGFTGKRTKNSTRKAAALRGCSFLLDESIKKEQANGDDNMVCSILPDSSNMTSENESQVWAMGTTGLGDSSMPEPSKKHKPHEDTENNVEHTEGKVDLWTPLNCLVEAANRTKSSRSNSQATPLAKLESPTTPHGGQDTSETTTKTDLPASAKSELNIPKSKNKDTGHKTIFGDDKDANSLPSGPGKRRRLRPAGQKRVAASEMSASSPAPLDTTGGKCNRKNSPIWFSLVASEDQDGAVPVSFIQKYLVKKLNLACEAEGGGSETEVTWEDQQNINKFGRLNNRFHELEDEIKIAKETNDNLEDASNELILTDEEVIRFQIGEVFAHVPKDEVENRIEQIKEVTSQKLAKLEEEKESILAQMAELKKILYAKFNDSINLEED

SEQ ID NO: 173888 - protein, 190 aa, Glycine max
  Coding DNA Sequence Number=SeqID_82203
  Gene Ontology: Mol. function=protein serine/threonine kinase activity; Cellular component=plasma membrane; Biological process =protein amino acid phosphorylation
  Homolog annotation: Hit_ID=A7Q0P7; Match level="QueryCoverage=100%, HitCoverage=22%, E-value=6e-61, Identity=64%"; Hit description =Chromosome chr7 scaffold_42, whole genome shotgun sequence
MNQGHVSTVVKGSFGYLDPEYFRRQQLTEKSDVYSFGVVLFEALCSRPALNPSLAKEQVSLAEWALYNKRRGTLEDIIDPNIKGQINPESLKKFADAAEKCVSDLGFERPSMNDLLWNLEFALNVQQNPDGKTHEPRLDESEFEEVNLENNDMAAHYKNLSLGSEHDLSHESSSDNHASIFSQIANPKGR

SEQ ID NO: 173889 - protein, 50 aa, Glycine max
  Coding DNA Sequence Number=SeqID_82204
MGNARKGTGARKKKGKERRGRLGIRGVAEASLVRAEKGIQVWGYPQKEGI

SEQ ID NO: 173890 - protein, 132 aa, Glycine max
  Coding DNA Sequence Number=SeqID_82205
  Gene Ontology: Mol. function=nucleic acid binding
  Homolog annotation: Hit_ID=A7PF18; Match level="QueryCoverage=80%, HitCoverage=81%, E-value=4e-42, Identity=81%"; Hit description =Chromosome chr11 scaffold_13, whole genome shotgun sequence
  Pfam annotation: Domain name=Alba; Domain location=17-86; Score=69.9; E_value=8.6e-18; Accession=PF01918.12; Description=Alba
MATVAAVPALTANDSHKKNRIQVSNTKKPLFFYVNLAKRYIQQHNEVELSALGMAIATVVTIAEILKNNGLATEKKVLTSTVGMKDENKGRLVQKAKIEIVLGKSDKFDNLMSPPAPTESEEAAADDDDKKE

SEQ ID NO: 173891 - protein, 214 aa, Glycine max
  Coding DNA Sequence Number=SeqID_82206
  Gene Ontology: Mol. function=phosphoribosylaminoimidazole carboxylase activity; Cellular component=phosphoribosylaminoimidazole carboxylase complex; Biological process='de novo' IMP biosynthetic process
  Homolog annotation: Hit_ID=O80937; Match level="QueryCoverage=53%, HitCoverage=18%, E-value=3e-46, Identity=78%"; Hit description =Putative phosphoribosylaminoimidazole carboxylase
  Subcellular localization annotation: CTP_CleavageSite=55; ConfidenceScore=5.27e-01
MLHSARLVFSGHTSISAFAFRPSNPSIKTTSSLGFYMEQSPPLKLKQCDQPHLACQATTQDDAVSLRNDESPVHGLTEVVVGVLGGGQLGRMICQAASQMAIKVMVLDPQENCPASSLSYDHMVGSFDDSTTVEEFAKRCGVLTVEIEHVDVDTLEKLEKQGVDCQPKASTDKYQQKVHFSQHGIPLPEFMKYLKIENSSLGYELRISEYVLNR

SEQ ID NO: 173892 - protein, 602 aa, Glycine max
  Coding DNA Sequence Number=SeqID_82207
  Gene Ontology: Cellular component=cytosol
  Homolog annotation: Hit_ID=A7PTU0; Match level="QueryCoverage=93%, HitCoverage=99%, E-value=0.0, Identity=75%"; Hit description =Chromosome undetermined scaffold_30, whole genome shotgun sequence
  Pfam annotation: Domain name=TENA_THI-4; Domain location=60-284; Score=44.8; E_value=3.1e-10; Accession=PF03070.7; Description =TENATHI-4 family
  Subcellular localization annotation: CTP_CleavageSite=36; ConfidenceScore=5.60e-01
MRWFLRSPIIKTSLLNLSPPISFRPHWARRTFTSSRLSMAAIHNHSNSNSETGLARRFWIKFTRESIFAMYTPFAIALASGNLHIDSFHHYIAQDVHFLRAFAQAYELAEECADDDDAKLGICELRKAVLEELKMHNLLVQERELDLAKEHGINSATVKYTEFLLATASGKIEGLKGPGKLATPFEKTKIAAYTLGAMTPCMRLYAVMGKKFQELLDSNESTHPYNKWINNYSSDGFQATTLQTEDLLDKLSVSLTGEELDVIEKLYYQAMKLEIEFFSAQPLFQPTIVPLTKGHKPVEDHLIIFSDFDLTCTVVDSSAILAEIAIVTAPKSDQNQPEDQIVRMLSSDLRNTWGFLSKQYTEEYEQCIESIMPPDRLNNFDYKELSMALEQLSKFENTANNRVIESGVLKGISLEDIKRAGERLILQDGCPNFFQSIVKNENLNANVHVLSYCWCGDLIRSTFSSADLNELNVHANEFTYEGSVSTGEIVKKVESPIDKVEAFRNILKNCNDDKKKLTVYIGDSVGDLLCLLEADVGIVIGSSSSLRSVGTQFGISFVPLYSGLVKKQKEYVEGSTSDWKGLSGILYTVSSWAEVHAFILGC

SEQ ID NO: 173893 - protein, 69 aa, Glycine max
  Coding DNA Sequence Number=SeqID_82208
MDEDQWMYDSIMSEEVDMDDENEQECGMNEQHVDCSDAFDTYQVFATRDDVLQWARSVAHENGFVTVIM

SEQ ID NO: 173894 - protein, 105 aa, Glycine max
  Coding DNA Sequence Number=SeqID_82209
MYDHLNDACKSGNRQLAGYITLLQCWIHEHFSSVAESLSDPDYDEMSPRVCRWIATKASSKSLPASTYQSYTMRSRCRQTRTRGWCNNLDMFRPFLHRLGFNVII

SEQ ID NO: 173895 - protein, 41 aa, Glycine max
  Coding DNA Sequence Number=SeqID_82210
MTVFQVATKGFVVAMMGWVREVGVVADCEGKVPLMGGKQGA

SEQ ID NO: 173896 - protein, 384 aa, Glycine max
  Coding DNA Sequence Number=SeqID_82211
  Gene Ontology: Mol. function=nucleic acid binding; Cellular component= nucleus; Biological process=regulation of transcription, DNA-dependent
  Homolog annotation: Hit_ID=A7Q821; Match level="QueryCoverage=65%, HitCoverage=20%, E-value=2e-77, Identity=60%"; Hit description =Chromosome undetermined scaffold_62, whole genome shotgun sequence
  Pfam annotation: Domain name=PHD; Domain location=9-59; Score=-3.0; E_ value=0.03; Accession=PF00628.20; Description=PHD-finger
MGQDCSEGYCTWCGGSNELVSCKLCKGLFCTKCLKKNLGVELYAGMQDTSWHCCSCHPNLLQKLSLQLEKAVGSADIIVSSSGSDSDSSDDSDDSDDSDAKVNVTISSKRRHKKKIRRILDDAELGEETKRKIAIEKERQERLKSLRGQFSASSFEMSSDGCNGNLSESASVEVLGDALAGYIVNVVREKGEEAVRIPPSISAKLKAHQITGIRFMWENIIQSIRKVKSGDKGLGCILAHTMGLGKTFQICSLLLKSSFLPTAAIVIGELFQNVHTINFSEVACKELSSFGFNRWNLLFTVIILKATSLILKFLLNMLRLKIGIQIKSPAYLARASTHTSAAVQVQCAQPMQYVYAQPAHFQVTVQAEHIELAQEQVAQQQKYV

SEQ ID NO: 173897 - protein, 1171 aa, Glycine max
  Coding DNA Sequence Number=SeqID_82212
  Gene Ontology: Mol. function=nucleoside-triphosphatase activity; Cellular component=integral to membrane; Biological process =proteolysis
  Homolog annotation: Hit_ID=A7Q614; Match level="QueryCoverage=74%, HitCoverage=98%, E-value=0.0, Identity=68%"; Hit description =Chromosome chr14 scaffold_54, whole genome shotgun sequence
  Pfam annotation: Domain name=AAA; Domain location=759-949; Score =158.6; E_value=1.7e-44; Accession=PF00004.20; Description=ATPase family associated with various cellular activities (AAA)
  Pfam annotation: Domain name=Peptidase_M41; Domain location=1023 -1129; Score=-135.7; E_value=0.017; Accession=PF01434.9; Description =Peptidase family M41
  Pfam module annotation: Pfam domain module=AAA::Peptidase_M41; Domain location=759-949::1023-1129
  Subcellular localization annotation: CTP_CleavageSite=54; ConfidenceScore=5.64e-01
MTSSPLHSPLHFPQRPLFTSIRPIPNRTFISNNPRRTPRTPLLLAPITLTPPITFAAKSTPTPTPSPNDDVFSKHLVRALFCFAVGFSALGAFHAPPPAFAIAAPWTYWAKRGTEEKERAKSHQYSDCTDRLLETVSFLLKTVDEVRNGNGDVSEAEAALEAVKSKKEEMRKEINGRLYPALKRLRRERKALWKRSGEIVGEILNAMAEYDKLKAKVAANEKENENARMKELEESVGVMEDEYNGVWERVGEIEDRISREETVALSYGVREINFIERECEQLVESLPTGSVTRLSKSAIQKDLETVHRKQAEQIILPSILDVEDLGPFFHEDSINFAQCLTRSLKDSREKQRNLEAQIRKKMKKFGKEKRSIIYSPEEEVVKGFPEVELKWMFGNKEVVLPKAVGLHLYHGWKKWREEAKANLKQNLIKDAEFGRQYVAERQERILLDRDRVVSRTWYNEEKSRWEIDPVAVPYAVSKKLIEHVRIRHDWGAMYIALKGEDEEFYVDIKVVAEYEMLFEDLGGFDGLYMKMLACGIPTAVHLMWIPFSELNIRQQFLLILRVSHGILSGLWNSGVVTNARNWIFKNIKDTTDDIMVVIVFPTVELLVPYPVRIQLGMAWPEEIYQTVDSTWYLKWQSEAELNFRSRQTTTDDDEESSWVWAFAKRSEYAEVAASGISLFLHLVHKYYISQKLKKIKQRRKDGVDPIKTAFEQMKRVKKPPIPLKNFASIESMKEEINEVVTFLQNPKAFQEMGARAPRGVLIVGERGTGKTSLALAIAAEAKVPVVEIKAQQLEAGLWVGQSASNVRELFQTARDLAPVIIFVEDFDLFAGVRGTYIHTKNQDHETFINQLLVELDGFEKQDGVVLMATTRNLKQIDEALQRPGRMDRIFHLQRPTQAEREKILYLSAKETMDDQFIDYVDWKKVAEKTALLRPIELKIVPMALEGSAFRSKVLDTDELMDYCGLFATFSSMIPQWLRKTKIFNKFSKGLVNHLGLTLTKEDLQNVVDLMEPYGQISNGIEYLSPPLDWTRETKFPHAVWAAGRGLTALLLPNFDDVDNLWLEPLSWQVTALSMGDDHEYVMAAKVEKMFDLAYLKAREILQKNRLVLEKIVEELLEFEILTGKDLERITKDNGVIREQEPFTLGEVQASEPTSGSFLERGNASGSALLAS

SEQ ID NO: 173898 - protein, 647 aa, Glycine max
  Coding DNA Sequence Number=SeqID_82213
  Gene Ontology: Mol. function=nucleic acid binding; Cellular component= nuclear heterochromatin; Biological process=regulation of transcription, DNA-dependent
  Homolog annotation: Hit_ID=Q337N7; Match level="QueryCoverage=91%, HitCoverage=41%, E-value=1e-165, Identity=54%"; Hit description=SNF2 domain-containing protein, putative, expressed
  Pfam annotation: Domain name=Helicase_C; Domain location=336-416; Score=66.9; E_value=6.8e-17; Accession=PF00271.22; Description =Helicase conserved C-terminal domain
  Pfam annotation: Domain name=SNF2_N; Domain location=7-214; Score= -32.2; E_value=6.3e-07; Accession=PF00176.14; Description=SNF2 family N-terminal domain
  Pfam module annotation: Pfam domain module=Helicase_C::SNF2_N; Domain location=336-416::7-214
MVRNSGKMCHNFTRKLLDGLCREKTSRYGSHIREDKDTERRQPLKTNTGLKQRDGPDILVCDEAHMIKNTKADVTQALKQVKCQRRIALTGSPLQNNLMEYYCVFLEAAMNFETGKDFFSLIHTNSTLTDVKIMNQRSHILYEQLKGFVQRMDMNVVKKDLPPKTVFVITVKLSPLQRKLYKRFLDVHGFTTQVHPEMLRKRCFFAGYQALARLTKEVKDYVKHEDAVENFLVDDSSSDENSDYNVLAGEKMRYANDLLQRKDDNGFFLKGWWNDLLHGKIYKEIDHSGKMVLLMEILTMSSDVGDKVLVFSQSIPTLDLIELYLSRIPRRSKREKFWKKGKDWYRLDGRTESSERQKLVERFNEPLNKRVKCTLISTRAGSLGINLHAANRVVIVDGSWNPTYDLQAIYRSWRYGQKKPVFAYRLLAHGTMEEKIYKRQEGLAARVVDRQQVHRTISKEEMLHLFEFGDDDNPETLVDLSQDNEHQDNPILVGHSLKHTAPHSNGTSYSDKLMESLLSKHHPRWIANYHEHESLLQENEEEKLSKEEQDMAWEVYQKSLEWEEVQRVPLGESIMPEQKPEMPIAMPQNVSESCSILPTKLSRRFTIRKCTNLAHMLTLRSQGTKFGCSTVCGECAQEIRWEDLKKR

SEQ ID NO: 173899 - protein, 551 aa, Glycine max
  Coding DNA Sequence Number=SeqID_82214
  Homolog annotation: Hit_ID=A7Q847; Match level="QueryCoverage=92%, HitCoverage=99%, E-value=0.0, Identity=66%"; Hit description =Chromosome undetermined scaffold_62, whole genome shotgun sequence
MAGLMVILEKGEQEWTTMEEGFVERAYNKYVYMLTIKDDHVTRSDCQFKLKETERLEDSKSSREQNNDERVSLLYSAWSAVLNEPTSGGKEHLQKHGISGSSLPHAPHLENCKVKTQLYDYFDKRKGNEVFPPWTTWKGSLQTFPVAAINEQMQNLRHDAVSEGAYPPWIAGSDEENYPLTRKVQRDIWIHQHPLNCSSPDVKFLVTDWERLPGFGIGAQIAGMCGLLGIAINEGRVLVTNYYNRAEHGGCKGSSRSSWSCYFFPETSLECRRRAFELMKSEDAWSKGIVTTKENYTTKHIWAGPTPRKWGLQWNYLQPTTDINGTLLASHRKMDIRWWRAQAVRYLMRFPTEYTCNLMNEARHASFGKLAAEMVLQSLAGDWPKESSGRARSNDIDEYVWSNHKPWVPRPLLCMHVRMGDKACEMKVVGFEEYMQLADRTRRHFPHLNNIWLSTEMQDVIDKTREYSHWNFYYTKVRRQAKINMSMAAYEASLGRETSTNYPLVNFLMAADSDFYVGALGSSWSFLIDGMRNTGGKVMAGFLSVNKDRFW

SEQ ID NO: 173900 - protein, 174 aa, Glycine max
  Coding DNA Sequence Number=SeqID_82215
  Gene Ontology: Mol. function=DNA binding; Cellular component=nucleus; Biological process=regulation of transcription
  Homolog annotation: Hit_ID=Q0PJK0; Match level="QueryCoverage=67%, HitCoverage=55%, E-value=1e-15, Identity=44%"; Hit description=MYB transcription factor MYB88
MKLILVNPGLMLRWATIATRLPGRTDNEIKNFWHTHLKKRLERSKVINTYSNPLQEAQTASSARTLISVPRVAVEASGASSSRNPPIVGLGFYGVASSDILGQIIGNSSHSRQIDKELEFRSNVYMNSHHKGMKMKEKRGIGGKKREITVAKRQEHLKEVLQTAKAGGVLEPHD

SEQ ID NO: 173901 - protein, 273 aa, Glycine max
  Coding DNA Sequence Number=SeqID_82216
  Homolog annotation: Hit_ID=Q5XM22; Match level="QueryCoverage=17%, HitCoverage=26%, E-value=1e-12, Identity=72%"; Hit description =Resistance-like protein HAAS-2
MVWTRGLGRALGTVSCRGLGKGDHDNSDDAPQRRRPTASAHRQRVPMTFADEVDIPVTETDVPVVEVDVPGPDLASTKDTGANTAAEDDADTIAQAAEDEPEGFPGGPGDPSMLTEYADHVAGSVWMGEERPELKLSSHRRKVHSLGRHVPAIERLVTGTGLSPLIVCSIDTEVTITLDDVAFLLHLPVVGDLHAFQLMHVDDGIQMLVELLMVTAEATRAETGQYRGPYVRLQWVHDIYQRRCQAGHWTVAARAFLLHLLGCTLFANKSATH

SEQ ID NO: 173902 - protein, 72 aa, Glycine max
  Coding DNA Sequence Number=SeqID_82217
RVPFAIQAAQLLGRAIGAGLFAITPAGERGMCCKAIKLGIRFIFTSHGCDLPLTLNLAQVLVFVAVCGVSLP

SEQ ID NO: 173903 - protein, 297 aa, Glycine max
  Coding DNA Sequence Number=SeqID_82218
  Gene Ontology: Mol. function=nucleic acid binding; Cellular component= nucleus; Biological process=mRNA catabolic process, nonsense-mediated decay
  Homolog annotation: Hit_ID=A7PVJ9; Match level="QueryCoverage=74%, HitCoverage=89%, E-value=1e-80, Identity=66%"; Hit description =Chromosome chr9 scaffold_33, whole genome shotgun sequence
  Pfam annotation: Domain name=RRM_1; Domain location=142-213; Score =82.8; E_value=1.1e-21; Accession=PF00076.13; Description=RNA recognition motif. (a.k.a. RRM, RB
  Subcellular localization annotation: CTP_CleavageSite=71; ConfidenceScore=5.73e-01
MTTPPSSSSASQSQFAYSNPSSSSSYFPVPFHLQQPATTHYAAPYVAAPSVQIPAPPVVGPVAPAPVPGVYSAVPQYQAQQLFERDAQIITPEALENVKAAIASSDVEHKTDAKKKAVPRKAAGHAWEDPILAEWPEDDYRLFCGDLGNEVNDDVLSKAFSRFPSFNMARVVRDKRTGKTKGYGFVSFANPSDLAGALKEMNGKYVGNRPIKLRKSKWRERTDYEALEKQKNHIQKKPKMARKDCVLKLVLGGVAEIQSVDAIQYHPTPISLVINSINALPSFVCWICLWFSSALIR

SEQ ID NO: 173904 - protein, 437 aa, Glycine max
  Coding DNA Sequence Number=SeqID_82219
  Gene Ontology: Mol. function=calcium ion binding; Cellular component =mitochondrion; Biological process=protein amino acid dephosphorylatio n
  Homolog annotation: Hit_ID=A7QMW5; Match level="QueryCoverage=100%, HitCoverage=99%, E-value=1e-151, Identity=83%"; Hit description =Chromosome chr14 scaffold_128, whole genome shotgun sequence
  Pfam annotation: Domain name=efhand; Domain location=293-321; Score =20.9; E_value=0.0048; Accession=PF00036.23; Description=EF hand
MEVVTDAASLDLELLQLPEFSGLALKSNLNFIEKLFDQWLSLPESNRLVTSLLNEAKSGAPLTVPGNCSSPNASSNSLPSMFPAGTAPPLSPRSTSGSPRIVKHRVGPSNLGSPLKVVSEPVKEVIPQFYFQHGPPPPNELKEECLFKIDRLFHDHMDGMQVHAETVIYRIYYYINRSGNGRLTLRELKRGNIIDAMQHADEEEDINKVLRYFSYEHFYVIYCKFWELDTDHDFLIDKENLIRYGNHALTYRIVDRIFSQVTRKFTSKVEGKMGYEDFVYFILSEEDKSSEPSLEYWFKCIDLDGNGVLTRNELQFFYEEQLHRMECMAQEPVLFEDILCQIIDMIKPEDESVITLRDLKGGKLSGSVFNILFNLNKFMAFETRDPFLIRQERENPTLTEWDRFAHREYIRLSMEEDVEDASNGSAEVWDESLEAPF

SEQ ID NO: 173905 - protein, 767 aa, Glycine max
  Coding DNA Sequence Number=SeqID_82220
  Gene Ontology: Mol. function=two-component response regulator activity; Cellular component=endoplasmic reticulum membrane; Biological process=two-component signal transduction system (phosphorelay)
  Homolog annotation: Hit_ID=A7QMR7; Match level="QueryCoverage=96%, HitCoverage=97%, E-value=0.0, Identity=65%"; Hit description =Chromosome undetermined scaffold_127, whole genome shotgun sequence
  Pfam annotation: Domain name=GAF; Domain location=192-341; Score =54.4; E_value=3.8e-13; Accession=PF01590.17; Description=GAF domain
  Pfam annotation: Domain name=HATPase_c; Domain location=489-616; Score=0.4; E_value=0.078; Accession=PF02518.17; Description =Histidine kinase-, DNA gyrase B-, and HSP90-like ATPase
  Pfam annotation: Domain name=HisKA; Domain location=377-442; Score =34.0; E_value=5.5e-07; Accession=PF00512.16; Description=His Kinase A (phosphoacceptor) domain
  Pfam annotation: Domain name=Response_reg; Domain location=641-757; Score=77.3; E_value=5.2e-20; Accession=PF00072.15; Description =Response regulator receiver domain
  Pfam module annotation: Pfam domain module=GAF::HATPase _c::HisKA::Response_reg; Domain location=192-341::489-616::377 -442::641-757
MEITPPLLHHLWFLLLLLLLCYLVLCASATDVEFDNCNCDDGEGIWSIHSILVGQKVSDFFIAVAYFSIPIELLYFVSRSNVPFKLLFLQFIAFIVLCGMTHLLNAYSYHGPPSFQLLLSLTVAKFLTALVSCATALTLPPLIPLLLKVKVRELFLRQNVMELGQEVGMMKKQKEASWHVRMLTREIRKSLDKHNILYTTLVELSKALDLHNCAVWMPNEDRREMHLTHELKTNSAKNFQNSIPVNDPDVLEIRKTKGVKILGPESALGAASSGGSVELGAVAAIRMPLLHVSNFKGGTPELVETCYAILVLVLPSSSTRVWTYHEMEIVEVVADQVAVALSHASVLEESQLMRQKLEERNRALQQAKKNAMMASQARKSFQKVMSHGMRRPMHSVLGMLSLFQEDNLRSEQKIIGDTMLKVGHVLSSLINDVMEISENEKGGFRLEMKPFLLHSMVREAASIAKCLCVYEGFGFEIDVQKSLPETVMGDEARTFQVILHMIGYLLNMNDKGTLNFRVFLESDGGDRDDKNIGIWRSSNQNEYVHIKFDFQITESSQSDEAISTIHYTGRRQYYNNEPKGGLSFSMCKKLVQMMQGNIWISPNSLGLVHGMTLLLKFQIGPSLEKSIFAPKDYSSSQFRGLKVVLAEDDGVNRTVTKKLLEKLGCQVIAVSSGFECLSAVSGAGNSFRIILLDLHMPEMDGFELAKRIRKFHSRSWPLIIALITSAEEHVREKCLLAGMNGLIQKPIVLHQIADELRTVLQRAGEKL

SEQ ID NO: 173906 - protein, 169 aa, Glycine max
  Coding DNA Sequence Number=SeqID_82221
  Gene Ontology: Mol. function=NADPH:quinone reductase activity; Biological process=negative regulation of transcription
  Homolog annotation: Hit_ID=A9PDW4; Match level="QueryCoverage=26%, HitCoverage=22%, E-value=3e-10, Identity=68%"; Hit description =Putative uncharacterized protein
MLSHTASHPQLQHHRCRRRCCHLRWTSPCCRQRILRSHHPVLSGGRIGRLTDVVGFVVEGRRSVRVENHSPTNTGEEESERTAAVELAISQRQQSVGFSVWLSLDSVVRFRRDLVRVLLNVPQTLPPEELVRLRAPPKSDVPIINPFKLPAADGFVFGFPTRLGINPKW

SEQ ID NO: 173907 - protein, 80 aa, Glycine max
  Coding DNA Sequence Number=SeqID_82222
MVLAKPMWTRIHARFANGAGETGHMARVSSMVSAKPMLDEKCRHAMHGWTWCNMHARRCVDRNDDTRCFTTEMTKPFPKP

SEQ ID NO: 173908 - protein, 160 aa, Glycine max
  Coding DNA Sequence Number=SeqID_82223
MAARCFGIGVFEKDPEIMSRSWFETPGRPLHYRECGGVVSDGVGVEDVGVEIIAIKESFNLLFPIRIIVGKKFGDIGESDASKGFGWLMGVGNEGVVVGHGRQGTQTVIRVYDLKVPEVACFSETILGEVSRAHLDKGVLAVGPGIYHLSSPLHHRGVVG

SEQ ID NO: 173909 - protein, 77 aa, Glycine max
  Coding DNA Sequence Number=SeqID_82224
MTSSVILRRSSFVISRRSCLHRAASSQVPRRQRDYSNYEEVSGANSDEGLEIANLGMDTQIVDALAKKGIAKLFPIQ

SEQ ID NO: 173910 - protein, 68 aa, Glycine max
  Coding DNA Sequence Number=SeqID_82225
  Homolog annotation: Hit_ID=A5C1T4; Match level="QueryCoverage=83%, HitCoverage=14%, E-value=2e-22, Identity=78%"; Hit description =Putative uncharacterized protein
MLIALLEGEITSYFRNLQIVDTDNSLSSVQSISTLAENTNCYDIKSYYSNEWGTYFYYGGPGNNPQCP

SEQ ID NO: 173911 - protein, 392 aa, Glycine max
  Coding DNA Sequence Number=SeqID_82226
  Gene Ontology: Mol. function=hydrolase activity, acting on ester bonds; Cellular component=cellulose and pectin-containing cell wall; Biological process=lipid metabolic process
  Homolog annotation: Hit_ID=A7PZ15; Match level="QueryCoverage=97%, HitCoverage=96%, E-value=1e-153, Identity=71%"; Hit description =Chromosome chr4 scaffold_39, whole genome shotgun sequence
  Pfam annotation: Domain name=Lipase_GDSL; Domain location=29-369; Score=142.8; E_value=9.8e-40; Accession=PF00657.13; Description=GDSL- like LipaseAcylhydrolase
MASCLVCCIIVTSLFMSLSFASAQQGRAFFVFGDSLVDSGNNDFLATTARADAPPYGIDFPTHRPTGRFSNGLNIPDIISENLGLEPTLPYLSPLLVGERLLVGANFASAGIGILNDTGFQFVQYTGPKLNIIHIYKQLKLFAHYQQRLSAHIGKEGAWRHVNQALILITLGGNDFVNNYYLVPYSVRSRQFSLPDYVTYIISEYRLILRKGPTCLKLANECDHAGDIKNLRLYDLGGRRVLVTGTGPMGCVPAELALRSRNGECDVELQRAASLFNPQLVEMVKGLNQEIGAHVFIAVNAYEMHMDFVTNPQDFGFVTSKIACCGQGPFNGVGLCTPLSNLCPNRDLYAFWDPFHPSEKANRIIVQQMMTGSDQYMHPMNLSTIMALDSRV

SEQ ID NO: 173912 - protein, 275 aa, Glycine max
  Coding DNA Sequence Number=SeqID_82227
  Gene Ontology: Mol. function=nucleic acid binding; Cellular component= plastid chromosome; Biological process=photosynthesis
  Homolog annotation: Hit_ID=A7PZ38; Match level="QueryCoverage=84%, HitCoverage=29%, E-value=8e-93, Identity=70%"; Hit description =Chromosome chr4 scaffold_39, whole genome shotgun sequence
  Subcellular localization annotation: CTP_CleavageSite=32; ConfidenceScore=5.21e-01
MSSLILPYTYTYGYARFPFKLNRFSPRAVTVRAAVSAPDKRGRKKKQSKDDESAVENGLRFSFMEELMDRARNRDSNGVSEVMYDMIAAGLSPGPRSFHGLVVSHALNGDEEAAMESLRRELAAGLRPVHETFLALIRLFGSKGRATRGLEILAAMEKLNYDIRQAWLILIEELVRNMHLEDANEVFLKGAKGGLKATDEVYDLLIQEDCKVGDHSNALDIAYEMEAAGRMATTFHFNCLLSVQVTFLNLVFVVKMLCSWGQFGVAEKIGVETFR

SEQ ID NO: 173913 - protein, 169 aa, Glycine max
  Coding DNA Sequence Number=SeqID_82228
  Gene Ontology: Mol. function=nutrient reservoir activity; Cellular component=extracellular region; Biological process=cell wall organization and biogenesis
  Homolog annotation: Hit_ID=Q9SC38; Match level="QueryCoverage=92%, HitCoverage=94%, E-value=5e-55, Identity=61%"; Hit description =Germin-like protein
  Pfam annotation: Domain name=Cupin_1; Domain location=8-158; Score =87.7; E_value=3.8e-23; Accession=PF00190.13; Description=Cupin
  Pfam annotation: Domain name=Cupin_2; Domain location=35-120; Score =21.1; E_value=0.0024; Accession=PF07883.2; Description=Cupin domain
  Pfam module annotation: Pfam domain module=Cupin_1::Cupin_2; Domain location=8-158::35-120
MAYILMLLEAMSKGMLFVNGKLCQDPKLAKAEDFFFSGLGPGDTSNPLGSKILHLTHPRGTEILVVLEGTLYVGFVASNQNDNRLFTKVLNKGDVFVFPIGLIHFQQNIGYGNALAIAGLSSQNPGVISIANAVFGSKPPISDEVLAKAFQVDKNVIDYLQKQFWYNNS

SEQ ID NO: 173914 - protein, 976 aa, Glycine max
  Coding DNA Sequence Number=SeqID_82229
  Gene Ontology: Mol. function=transferase activity, transferring glycosyl groups; Cellular component=cytoplasm; Biological process =multicellular organismal development
  Homolog annotation: Hit_ID=A7PZ50; Match level="QueryCoverage=93%, HitCoverage=99%, E-value=0.0, Identity=80%"; Hit description =Chromosome chr4 scaffold_39, whole genome shotgun sequence
  Pfam annotation: Domain name=TPR_1; Domain location=132-165; Score =34.3; E_value=4.4e-07; Accession=PF00515.19; Description =Tetratricopeptide repeat
  Pfam annotation: Domain name=TPR_1; Domain location=166-199; Score =40.0; E_value=8.6e-09; Accession=PF00515.19; Description =Tetratricopeptide repeat
  Pfam annotation: Domain name=TPR_1; Domain location=200-233; Score =28.7; E_value=2.1e-05; Accession=PF00515.19; Description =Tetratricopeptide repeat
  Pfam annotation: Domain name=TPR_1; Domain location=234-267; Score =37.1; E_value=6.5e-08; Accession=PF00515.19; Description =Tetratricopeptide repeat
  Pfam annotation: Domain name=TPR_1; Domain location=268-301; Score =47.2; E_value=5.7e-11; Accession=PF00515.19; Description =Tetratricopeptide repeat
  Pfam annotation: Domain name=TPR_1; Domain location=326-359; Score =44.6; E_value=3.5e-10; Accession=PF00515.19; Description =Tetratricopeptide repeat
  Pfam annotation: Domain name=TPR_1; Domain location=360-393; Score =10.8; E_value=0.27; Accession=PF00515.19; Description=Tetratricopepti de repeat
  Pfam annotation: Domain name=TPR_1; Domain location=394-427; Score =33.1; E_value=9.8e-07; Accession=PF00515.19; Description =Tetratricopeptide repeat
  Pfam annotation: Domain name=TPR_1; Domain location=428-461; Score =30.0; E_value=8.7e-06; Accession=PF00515.19; Description =Tetratricopeptide repeat
  Pfam annotation: Domain name=TPR_1; Domain location=462-495; Score =34.6; E_value=3.6e-07; Accession=PF00515.19; Description =Tetratricopeptide repeat
  Pfam annotation: Domain name=TPR_1; Domain location=64-97; Score=4.9; E_value=1.4; Accession=PF00515.19; Description=Tetratricopeptide repeat
  Pfam annotation: Domain name=TPR_1; Domain location=98-131; Score =16.7; E_value=0.052; Accession=PF00515.19; Description =Tetratricopeptide repeat
  Pfam annotation: Domain name=TPR_2; Domain location=132-165; Score =26.6; E_value=9.4e-05; Accession=PF07719.8; Description =Tetratricopeptide repeat
  Pfam annotation: Domain name=TPR_2; Domain location=166-199; Score =36.1; E_value=1.3e-07; Accession=PF07719.8; Description =Tetratricopeptide repeat
  Pfam annotation: Domain name=TPR_2; Domain location=200-233; Score =27.4; E_value=5.3e-05; Accession=PF07719.8; Description =Tetratricopeptide repeat
  Pfam annotation: Domain name=TPR_2; Domain location=234-267; Score =32.6; E_value=1.4e-06; Accession=PF07719.8; Description =Tetratricopeptide repeat
  Pfam annotation: Domain name=TPR_2; Domain location=268-301; Score =37.2; E_value=6.1e-08; Accession=PF07719.8; Description =Tetratricopeptide repeat
  Pfam annotation: Domain name=TPR_2; Domain location=326-359; Score =36.6; E_value=9.2e-08; Accession=PF07719.8; Description =Tetratricopeptide repeat
  Pfam annotation: Domain name=TPR_2; Domain location=360-393; Score =8.5; E_value=2.7; Accession=PF07719.8; Description=Tetratricopeptide repeat
  Pfam annotation: Domain name=TPR_2; Domain location=394-427; Score =32.1; E_value=2.1e-06; Accession=PF07719.8; Description =Tetratricopeptide repeat
  Pfam annotation: Domain name=TPR_2; Domain location=428-461; Score =18.1; E_value=0.034; Accession=PF07719.8; Description=Tetratricopepti de repeat
  Pfam annotation: Domain name=TPR_2; Domain location=462-495; Score =31.7; E_value=2.7e-06; Accession=PF07719.8; Description =Tetratricopeptide repeat
  Pfam annotation: Domain name=TPR_2; Domain location=64-97; Score =11.2; E_value=1.2; Accession=PF07719.8; Description=Tetratricopeptide repeat
  Pfam annotation: Domain name=TPR_2; Domain location=98-131; Score =15.0; E_value=0.28; Accession=PF07719.8; Description=Tetratricopeptid e repeat
  Pfam annotation: Domain name=TPR_4; Domain location=166-191; Score =12.1; E_value=1.4; Accession=PF07721.5; Description=Tetratricopeptide repeat
  Pfam annotation: Domain name=TPR_4; Domain location=200-225; Score =1.5; E_value=26; Accession=PF07721.5; Description=Tetratricopeptide repeat
  Pfam annotation: Domain name=TPR_4; Domain location=268-293; Score =8.6; E_value=3.7; Accession=PF07721.5; Description=Tetratricopeptide repeat
  Pfam annotation: Domain name=TPR_4; Domain location=326-351; Score =6.0; E_value=7.6; Accession=PF07721.5; Description=Tetratricopeptide repeat
  Pfam annotation: Domain name=TPR_4; Domain location=394-419; Score =0.2; E_value=37; Accession=PF07721.5; Description=Tetratricopeptide repeat
  Pfam annotation: Domain name=TPR_4; Domain location=462-487; Score =5.4; E_value=8.8; Accession=PF07721.5; Description=Tetratricopeptide repeat
  Pfam module annotation: Pfam domain module=TPR_1::TPR_1::TPR_1::TPR _1::TPR_1::TPR_1::TPR_1::TPR_1::TPR_1::TPR_1::TPR_1::TPR_1::TPR _2::TPR_2::TPR_2::TPR_2::TPR_2::TPR_2::TPR_2::TPR_2::TPR_2::TPR _2::TPR_2::TPR_2::TPR_4::...
  Pfam module annotation: Pfam domain module=TPR_4::TPR_4::TPR_4::TPR _4::TPR_4; Domain location=132-165::166-199::200-233::234-267::268 -301::326-359::360-393::394-427::428-461::462-495::64-97::98-131::132- 165::166-199::...
  Pfam module annotation: Domain location=200-233::234-267::268 -301::326-359::360-393::394-427::428-461::462-495::64-97::98-131::166- 191::200-225::268-293::326-351::394-419::462-487
MISAQGDHHRHHHHYHHQPQLPGSADTSRQQFTADRVEPFSVKQEPASLTLLPLRGHDSSEVDEDVYLSLAHQMYKTGNYKQALEHSNTVYERNPLRTDNLLLLGAVYYQLHDFDMCVAKNEEALRIEPHFAECYGNMANAWKEKGNIDLAIRYYLIAIELRPNFADAWSNLASAYMRKGRLTEAAQCCRQALAINPLMVDAHSNLGNLMKAQGLVQEAYSCYLEALRIQPTFAIAWSNLAGLFMESGDFNRALQYYKEAVKLKPSFPDAYLNLGNVYKALGMPQEAIACYQHALQTRPNYGMAYGQLDMAILHYKQAVACDPRFLEAYNNLGNALKDVGRVEEAIQCYNQCLTLQPNHPQALTNLGNIYMEWNMVAAAAQYYKATLNVTTGLSAPYNNLAIIYKQQGNYVDAISCYNEVLRIDPLAADGLVNRGNTYKEIGRVSDAIQDYIRAIVVRPTMAEAHANLASAYKDSGHVEAAVKSYKQALILRPDFPEATCNLLHTLQGHACFARMLQPYGIDTGLKEHSNRVTPKAYTPKSPLGPLLPDSVIILSVFQMSVLPSVQPFHAIAYPLDPMLALEISRKYAAHCSVIASRFALPPFNHPSPIPIKREGGYERLRIGYVSSDFGNHPLSHLMGSVFGMHNRKNVEVFCYALSANDGTEWRQRIQSEAEHFVDVSAMSSDAIAKMINEDKIHILVNLNGYTKGARNEIFAMQPAPIQVSYMGFPGTTGATYIDYLVTDEKNQDVLDPNCPHKRSDYGLPEDKFIFACFNQLYKMDPEIFNTWCNILKRVPNSALWLLRFPAAGEMRLRAYAAAQGVQPDQIIFTDVATKNEHIRRSSLADLFLDSPLCNAHTTGTDILWAGLPMVTLPLEKMATRVAGSLCLATGLGDEMIVSSMKEYEDRAVSLALNRPKLKALTNKLKAVRLTCPLFDTARWVRNLERSYFKMWNLHCSGQRPQHFKVTENDLECPYDR

SEQ ID NO: 173915 - protein, 122 aa, Glycine max
  Coding DNA Sequence Number=SeqID_82230
MGFICVMLLNNWVRGAREIGDGTCRRLVEMPQRLRENEYREEGKIYLKAVTIFTLLLHARCRHQILKNDNQHTNTNTNSYLAHHSSVKRITTSNITYAYSSSREKGNSYGKKNTSQSSKVEG

SEQ ID NO: 173916 - protein, 452 aa, Glycine max
  Coding DNA Sequence Number=SeqID_82231
  Homolog annotation: Hit_ID=A7PVB4; Match level="QueryCoverage=85%, HitCoverage=91%, E-value=2e-09, Identity=23%"; Hit description =Chromosome chr4 scaffold_32, whole genome shotgun sequence
MEAEALRSSFFSVISESADGWVLKRGLCLGRKILVATFVASAAPVVVPPLVVACAIGMALSMPCVIFLASHVCNLSLMSKLLPRPTPQDTLLHEEMCFRPGNDVIHTYKEEQVLLVYEMKRGIEIVGVQCLENGENMTLGSECGPQEEDATNGMEGRSNGVQEQPISGDNGVLTMIEEFKTPFDVTNVVLEESEDQAMEGDIEEEQLQRETKGLLEKIRDEGRTDMAQERGEYVEGICGGKNESDKKFGSAVEDMEMEVAWEDTHSGIIEGNEEDLGKEEDPNVCEEMLHSKNDESKDTMLEGKESDNTNDSLVEPMAEPSELQIPAEPIRDLPIEALVYNISVDEDSSEVISENIGIPRSLRRIVLLHCPMRRMYPLDAEAREIANESALDLFDGNQIDHDEYAYTIDLNEGSSNVVRHTNSMQVLVSSVEEESRPSKCSSAENHVCPSQE

SEQ ID NO: 173917 - protein, 415 aa, Glycine max
  Coding DNA Sequence Number=SeqID_82232
  Gene Ontology: Mol. function=nucleic acid binding; Cellular component= nucleus; Biological process=RNA metabolic process
  Homolog annotation: Hit_ID=Q9SWF9; Match level="QueryCoverage=90%, HitCoverage=96%, E-value=0.0, Identity=78%"; Hit description=Zinc finger CCCH domain-containing protein ZFN-like
  Pfam annotation: Domain name=zf-CCCH; Domain location=124-150; Score =45.5; E_value=1.8e-10; Accession=PF00642.15; Description=Zinc finger C-x8-C-x5-C-x3-H type (and similar)
  Pfam annotation: Domain name=zf-CCCH; Domain location=276-302; Score =46.6; E_value=8.6e-11; Accession=PF00642.15; Description=Zinc finger C-x8-C-x5-C-x3-H type (and similar)
  Pfam annotation: Domain name=zf-CCCH; Domain location=322-348; Score =46.2; E_value=1.1e-10; Accession=PF00642.15; Description=Zinc finger C-x8-C-x5-C-x3-H type (and similar)
  Pfam annotation: Domain name=zf-CCCH; Domain location=54-80; Score =48.3; E_value=2.8e-11; Accession=PF00642.15; Description=Zinc finger C-x8-C-x5-C-x3-H type (and similar)
  Pfam annotation: Domain name=zf-CCCH; Domain location=85-104; Score =23.6; E_value=0.00072; Accession=PF00642.15; Description=Zinc finger C-x8-C-x5-C-x3-H type (and similar)
  Pfam module annotation: Pfam domain module=zf-CCCH::zf-CCCH::zf -CCCH::zf-CCCH::zf-CCCH; Domain location=124-150::276-302::322 -348::54-80::85-104
MARVGEKEKTRVVVRFVGRRSFSFEEWGGGEDSLWMMNLRTGETMDSGSYPERPGEPDCSYYMRTGLCRFGATCRFNHPPNRKLYYLKTGTCKFGATCKFHHPKDQAGIAGRVALNILGYPLRPNEPECTYYLRTGQCKFGNTCKFHHPQPSNMMLSLRGSPVYPTVHSPTTPGQQSYAGGTYIPSPRWQGPSSYAPLILPQGVVSVPGWSAYSGQMGSISTSDSPQQAMRNGQTYGTSRQGELAGSQGAYSQFRSGTVPVGFYTLQRENIFPERPGQPECQFYMKTGDCKFGAVCRFHHPQERLVPAPNCVLSPIGLPLRPGEPLCVFYSRYGICKFGPSCKFDHPMEIFSHNISASPSADAPSRHLLGSSSGTAALNLSSEGLVESSSAKPRRLSLSETRQIPSGDDDIDDDG

SEQ ID NO: 173918 - protein, 61 aa, Glycine max
  Coding DNA Sequence Number=SeqID_82233
MSAHPSWYGIEQEYTLLQKDVNWPLGWPLGGFPGPQSVNEKWYEKEKKKGLQKFSLLTIKV

SEQ ID NO: 173919 - protein, 362 aa, Glycine max
  Coding DNA Sequence Number=SeqID_82234
  Gene Ontology: Mol. function=sequence-specific DNA binding; Cellular component=nucleus; Biological process=regulation of transcription, DNA-dependent
  Homolog annotation: Hit_ID=A7PV85; Match level="QueryCoverage=76%, HitCoverage=62%, E-value=4e-29, Identity=35%"; Hit description =Chromosome chr4 scaffold_32, whole genome shotgun sequence
  Pfam annotation: Domain name=FAR1; Domain location=116-189; Score= -29.1; E_value=0.076; Accession=PF03101.6; Description=FAR1 family
  Pfam annotation: Domain name=WRKY; Domain location=128-187; Score =115.4; E_value=1.7e-31; Accession=PF03106.6; Description=WRKY DNA -binding domain
  Pfam module annotation: Pfam domain module=FAR1::WRKY; Domain location=116-189::128-187
MEGCQPLAEQMQSSNDVAKTVKLPLPFDLNTIPKEDEEARPATSDETWLPDSESDDNFRPLQQPSSTPDAPVDIDDVEDRASIVEGGSDSGNRKRKRSLEESDKGTAGRSFHGETELTVRIGSKKEIDDDGYRWRKYGQKIMKGCLYPRAYYKCASAGCFVRKHVERDSRNNKNVIITYDGRHNHEQPPSWITNKNKLVLDDEGDEDDGGEELAPTNNALMTRNFLMNTPNPAEPQVHTLQLRNDMNPEFANRFMRPNHFGSLNNNMNIGSSSNNPHMHYSFLNNTNSMPHRSYGVNLDHPYATPQPRGPSMFPQLPTSPPFNNINVPSFSRGFSSQAWPNNNKNGSSSVFPSRETGARDKH

SEQ ID NO: 173920 - protein, 243 aa, Glycine max
  Coding DNA Sequence Number=SeqID_82235
  Gene Ontology: Mol. function=sequence-specific DNA binding; Cellular component=nucleus; Biological process=regulation of transcription, DNA-dependent
  Homolog annotation: Hit_ID=Q6VR15; Match level="QueryCoverage=46%, HitCoverage=60%, E-value=1e-08, Identity=40%"; Hit description=WRKY 10
  Pfam annotation: Domain name=WRKY; Domain location=200-241; Score =11.5; E_value=2.9e-05; Accession=PF03106.6; Description=WRKY DNA -binding domain
MENNSQNHHHQHHGFSAKSSSTKERRGLDFDLNEPIIDTSFETSPLVPADNINNCLVEMEGCQPLAPPTQDVAEQVHSSNDAEKVKFRFDLNAKPDEEEEVSAKVGGGSETHAAVSESADNVGPDNGLELTLNNDVHPTHAADDSDYEEDRASIGEGGSDTENSRKRKRSLEEYKKGTGKSFHGETTVVVQFESKNETILDDGYNWRKYGQKVIKGHTYPRYTVRSLLTRCTCKFVYICVPHG

SEQ ID NO: 173921 - protein, 492 aa, Glycine max
  Coding DNA Sequence Number=SeqID_82236
  Gene Ontology: Mol. function=transcription factor activity; Cellular component=nucleus; Biological process=regulation of transcription, DNA-dependent
  Homolog annotation: Hit_ID=A5BRJ8; Match level="QueryCoverage=75%, HitCoverage=73%, E-value=2e-78, Identity=41%"; Hit description =Putative uncharacterized protein
  Pfam annotation: Domain name=AP2; Domain location=196-243; Score=8.7; E_value=0.19; Accession=PF00847.11; Description=AP2 domain
  Pfam annotation: Domain name=AP2; Domain location=244-287; Score =27.0; E_value=7.1e-05; Accession=PF00847.11; Description=AP2 domain
  Pfam module annotation: Pfam domain module=AP2::AP2; Domain location =196-243::244-287
MASMNWLDFSLSPQELPSQPLNDEEDHSQTVTPLLGFNSHEISVTECFDLSSFALVEAPNRNNTHHITPLDYWNTKGLGTSCSSNQNMDNNQQHPKLENFLLEKPATGGGGCPKNTNSIGLSMIKTWLRKQMSSQSDAANTSLSMSTTRVSESGTVALPLLTAGEESSSSKSKQSGILNVDTVSRKSADTFGKRTSIYRGVSRHRWTGRYEAHLWDNSSRREGKTSKGKQGGYDKEEKAARAHHQHGRWQARIGRVAVNKDLYLGTFNTQEEAAEAYDIAAIKFRGLKAVTNFDMNRYDVKSILESSTLPIGGAAKRLKDADEQVDLTIMDPQTPHVDSNINIFGASHHSLALHQPQPYSHLNYTYGQKFWIDSASVDNNNNSSGSNYVIYGGGDGYAIPMATPTFNIADDDDVVQNSRSNGLEHNDVKMLGYENVLSSSTDPYHARDLCYLSQPASGDTVKGIPMIFAPELHRSHCCMSSRKLERRVIKDA

SEQ ID NO: 173922 - protein, 62 aa, Glycine max
  Coding DNA Sequence Number=SeqID_82237
  Gene Ontology: Mol. function=nucleic acid binding
  Homolog annotation: Hit_ID=Q9FEL4; Match level="QueryCoverage=75%, HitCoverage=96%, E-value=4e-09, Identity=44%"; Hit description =Putative uncharacterized protein
MQADENLRLELEEDVKEECTKLGPLDSVKIHASEDDGSVNHALVRDLEEDAIRLEQFGAELE

SEQ ID NO: 173923 - protein, 321 aa, Glycine max
  Coding DNA Sequence Number=SeqID_82238
  Gene Ontology: Mol. function=oxidoreductase activity; Cellular component=cytosol; Biological process=auxin mediated signaling pathway
  Homolog annotation: Hit_ID=A7Q5Z9; Match level="QueryCoverage=99%, HitCoverage=97%, E-value=1e-118, Identity=61%"; Hit description =Chromosome chr14 scaffold_54, whole genome shotgun sequence
  Pfam annotation: Domain name=Aldo_ket_red; Domain location=7-293; Score=175.5; E_value=1.4e-49; Accession=PF00248.12; Description =Aldoketo reductase family
KMDIPRLKLGTQGLEVSKLGFGCAGLSGVFDGPVPDEVVISLIKYAFSNGITFFDTSDFYGPYTNEVLVGKELPRDQIQIASKFGIVKVESNDAIVRGDPEYVRSCCEASLRRLGVEYIDLYYPHRIDTTVPIEETMGELKKLVEEGKVKYIGLSEASPDTIRRAHAIHPITALQMEWSLWSREIEDQLLPLCRELGIGIVPFSPLGRGFFGGKGVIESIPADSYLAIQPRFQGQKLDKNKTFYFRMEKLAEKHGCTTPQLALAWLLHQGNDVVPIPVKLSNDDLREITEAIPISEVVGDRTVDTFMRCSWKFANTPPKHS

SEQ ID NO: 173924 - protein, 151 aa, Glycine max
  Coding DNA Sequence Number=SeqID_82239
MARIITNVQNKYSNPTTQVGQDLKDTSNLRESKIILTKYAWSATEAAIDDKILATSQEGVVCPKWEVNCPKAEPVCSILGAAELNNEDDCVLPNGEDVASAGAVLNRDKDCPKLGVEEELAPNGDGVQQKIDGSAADDEEPKAGELRAGAT

SEQ ID NO: 173925 - protein, 403 aa, Glycine max
  Coding DNA Sequence Number=SeqID_82240
  Homolog annotation: Hit_ID=A7QJ33; Match level="QueryCoverage=77%, HitCoverage=82%, E-value=1e-138, Identity=74%"; Hit description =Chromosome chr2 scaffold_105, whole genome shotgun sequence
  Pfam annotation: Domain name=START; Domain location=101-310; Score= -21.5; E_value=0.0044; Accession=PF01852.10; Description=START domain
MPPLFRIFQIPTSLMDIITDLAMFITPLWIAVIVGVVVGWAWKPKWAFHPKDALLKFRSPRPSNPQNDTAFTFSTTRLVSSDSSAREKDASASASASHLVTEYDLLHLWKLVEEKDGGPAWIQMMDRSTPTMRYQAWRRDPESGPPQYRSRTVFEDASPELVRDFFWDDDYRLKWDDMLIHASTIQECVLTGTMMVHWVRKFPFFCSDREYIIGRRIWDAGRIYYCVTKGVPCPSMPRHNKPKRVDLFYSSWCIRAVKSRKDDQLTSCEVLLFHHEDMGIPWEIAKLGVRQGMWGAVKKFDPGLRTYEKQRASGTALSPCARAAKINTKVTMDNVRSLENTISDLLETENQDSSDKPGGRNIPKLLIVGGAIALACTLDQGLLTKAVIFGVARRFAKMGGKRL

SEQ ID NO: 173926 - protein, 437 aa, Glycine max
  Coding DNA Sequence Number=SeqID_82241
  Gene Ontology: Mol. function=hydrolase activity, hydrolyzing O -glycosyl compounds; Cellular component=anchored to membrane; Biological process=cell wall organization and biogenesis
  Homolog annotation: Hit_ID=Q8L868; Match level="QueryCoverage=78%, HitCoverage=79%, E-value=1e-131, Identity=66%"; Hit description =Putative glucan endo-1,3-beta-glucosidase 11 precursor (EC 3.2.1.39) ((1->3)-beta-glucan ...
  Homolog annotation: Hit description=endohydrolase 11) ((1->3)-beta -glucanase 11)
  Pfam annotation: Domain name=Glyco_hydro_17; Domain location=55-378; Score=397.6; E_value=1.9e-116; Accession=PF00332.9; Description =Glycosyl hydrolases family 17
MKILSADIWSKGLDFWMIQKDMKDVSSVGLMNGKITMHPFENFEMAAAIGLVSSLGINYGQIANNLPSQDDAVALVKSIGATKVKLYDADPRVLKAFANTGVELMVGLGNEYLSRMKDPKQAQAWIKANLQPYLPATKITSIFVGNEVLTFNDTSLTSNLLPAMQSVHAALINLGLDKQITVTTTHSLAVLQTSYPPSAGAFRPDLAPCLAPILSFQAKTGSPFLINAYPYFAYKANPKQVPLEYVLFQPNEGMVDPSSNLHYDNMLFAQIDAVYSALDSLGYGKLPVHISETGWPSKGDQDEAGANLENAKKYNGNLIKMAMSSSSSAKKGTPCRPNEDLNIYVFALFNENMKPGPASERNYGLFKPDGTPAYPLGFSLASVPVVAGNNNTGVASTPPQPTSPTSSTGYLSISSASSLNPKKDTGAWQWGGRAKAE

SEQ ID NO: 173927 - protein, 38 aa, Glycine max
  Coding DNA Sequence Number=SeqID_82242
MVVVEMRDDIGVANLRERGTREPLRCSGVMMGLMGGVL

SEQ ID NO: 173928 - protein, 448 aa, Glycine max
  Coding DNA Sequence Number=SeqID_82243
  Gene Ontology: Mol. function=binding
  Homolog annotation: Hit_ID=A7QJ66; Match level="QueryCoverage=65%, HitCoverage=58%, E-value=1e-133, Identity=83%"; Hit description =Chromosome chr2 scaffold_105, whole genome shotgun sequence
MSQTRPTKDSEYQDKSFLITTQELPSCAAVQFTREPGDLITSRAVVMMLCFMAKNSETNRALEKHESAHIFVFDAGEVKVNFGLQWSGWLGHDASNNWKNGVGFFQLPVVSTYSFLWILEFPGHACFTKYKYPYLGGSSHLCYLAITAVLIANLSAFYNWAIAISDRAKMRGRTKEAEELWKQATSNYEKAVQLNWNSPQALNNWGLALQELSTIVPAREKQKIVRTAISKFRAAIQLQFDFHRAIYNLGTVLYGLAEDTLRTGGSVSAQEVSPNELYSQSAIYIAAAHALKPNYSVYSSALRLVRSMLPLPHLKVGYLTAPPVGASIAPHNDWKGSDFFLDHEKLQQIPRGEHKQVPPQNLSGRSLDAVSGDKKTIKVDIADITSVSACADLTLPPGAGLCIDTSYGSVYLVADSWESLDGWLDAIRLVYTIYVRGKSDVLAGIITG

SEQ ID NO: 173929 - protein, 421 aa, Glycine max
  Coding DNA Sequence Number=SeqID_82244
  Gene Ontology: Mol. function=protein binding; Cellular component =cytoplasm
  Homolog annotation: Hit_ID=A7QJ86; Match level="QueryCoverage=62%, HitCoverage=92%, E-value=7e-66, Identity=53%"; Hit description =Chromosome chr2 scaffold_105, whole genome shotgun sequence
MGDVADKLAYFQAITGLEDPDLCTEILAAHNWDLELAISTFTSSSNPSSTDTPLQPHPNDHVPSASNPQPQPQHQHPPPPPGLAWKLITLPVSVISGSLGLVSGAIGLGLWAAGGVLSYSLGLVGLGSPSGSGSGSSSAPLVSVTAAASEAMDFVAAFERDYGSFGPNFVGEGFMDALQRSRNSFKLLFVYLHSPDHPDTPSFCQRTLCSETIAAFVNENFVCWGGSIRASEGFKMSNSLKASRFPFCALVMAATNQRIALLQQLLVSAIVSLTAIAAAIGVVVAVSALAERPPSATDTSIAERFRFAVGAAAIAVALGGAAQFLEQFFAPLLRSLHLFLLLLLLCHSPSSSPSRASAHHSVEDVFSREEVGAVGEDDVVFEGSEGAMEGALEVVPWWRLLIMGRVMDLVGGFGTFRREKL

SEQ ID NO: 173930 - protein, 496 aa, Glycine max
  Coding DNA Sequence Number=SeqID_82245
  Gene Ontology: Mol. function=anion channel activity; Cellular component=membrane of vacuole with cell cycle-independent morphology; Biological process=malate transport
  Homolog annotation: Hit_ID=A7QWG9; Match level="QueryCoverage=100%, HitCoverage=100%, E-value=1e-131, Identity=49%"; Hit description =Chromosome undetermined scaffold_203, whole genome shotgun sequence
  Pfam annotation: Domain name=UPF0005; Domain location=51-457; Score =495.1; E_value=8.7e-146; Accession=PF01027.11; Description =Uncharacterised protein family UPF0005
MARGNDMAKEVEWRIKVEEDDDTLQKTIVGCMWAVTAGLALKLCKFVKKAWEVGVNDPRKFIHCLKVGIALSAVSLFYYWKPLYDGVGGNAMWAVMTVVVVFEYTAGATICKTVNRMCGTSLAGFLGIGVHWVASRAGEQWEPVIAGVSVFLLASAATFSRFIPSLKARFDYGILIFILTFSLVSISGYRVDELLVMAQYRVCTIIIGSIMCIIVSVIIRPIWAGFELFVLVTGNLDKLANSLRCCVVQYFGGSEASEAESDEVSDKKLLGYKCVLSSKATEETMANFARWEPAHGRFNFRHPWRQYVKIGASMRSCASCLDALIGCINSDNQASDDMKKNMSSISMKVGANCASVIRELATTIRKMKKSSKLDILVTQMNSAAQELRSLLNSCPYLVNPPHNSKRSTRTETASPDDLAPKIEIPLMEIIQVVTVASLLIEIVARVEDIVENVEELSDLANFQPEMNVKSKQHTSDSKVSPDQQNDGEPVRTLQMV

SEQ ID NO: 173931 - protein, 181 aa, Glycine max
  Coding DNA Sequence Number=SeqID_82246
  Homolog annotation: Hit_ID=A7PAY0; Match level="QueryCoverage=76%, HitCoverage=26%, E-value=2e-45, Identity=67%"; Hit description =Chromosome chr16 scaffold_10, whole genome shotgun sequence
MARILLVRIGQSSPLELPIESEEQVWKMPLAEASDVKGNTEKSHGMAVASLQAADEYFKESKKLCEAFNAVPPLSSSQENSTFGGNMLFHDPSNWQSWCRNPPLWGTMKYLYEKIPKDTSSKVRINRDLYSYERIMETAPTLPDFALALKPDEYQLPQMDPSWRTENVKDGQSGTTNHING

SEQ ID NO: 173932 - protein, 84 aa, Glycine max
  Coding DNA Sequence Number=SeqID_82247
MSSSFSSRERMIQNFLFFFFSMHRVSVEPALRCKIVVAVVVWVKKEGGKRGGGCDFTGAGAGAVGARCMPEIISGGGERWPVTK

SEQ ID NO: 173933 - protein, 57 aa, Glycine max
  Coding DNA Sequence Number=SeqID_82248
MKNRSNRSGSAPHMPDLSSILTPEHFDGVTNHKTYDRNMFTQFSSNGPLSAIINADG

SEQ ID NO: 173934 - protein, 282 aa, Glycine max
  Coding DNA Sequence Number=SeqID_82249
  Homolog annotation: Hit_ID=A7QQ27; Match level="QueryCoverage=83%, HitCoverage=72%, E-value=5e-60, Identity=52%"; Hit description =Chromosome chr2 scaffold_140, whole genome shotgun sequence
  Pfam annotation: Domain name=TIM21; Domain location=84-235; Score =17.9; E_value=1.6e-07; Accession=PF08294.2; Description=TIM21
  Subcellular localization annotation: CTP_CleavageSite=47; ConfidenceScore=5.72e-01
MFRRILSHHRALSACAHNATTRSLVTRRTPNVPPPPTFLITGSRPVSSKTSQSNETGETTNKAKKDVANVEDPFSAPTYNIPEKPVTFVEGASYGVVILAGLGIAAAAGYAVFKELIFQPKEYKIYNKALKRIQDDGQIRVRIGFPITGYGQESRNRAARQRIPHRVWTDEEGVEHVELNKKLQEKVVREETKMKKRERKEARDSERRWGDLIKFETFGLLESEGEVNFYIRGPHGHGKVFAEMFKGADNEWKFTYLIVEIRAPSTAQIILESYIPSYSATK

SEQ ID NO: 173935 - protein, 86 aa, Glycine max
  Coding DNA Sequence Number=SeqID_82250
MTVVPPLRLHYQPTPPIACRWCVGGLIGDGGLGCGWLVVGGGLVGDDGDMVGTQGFGTEKIKEMGIEGGYGRRKSTKYPLMNMAFR

SEQ ID NO: 173936 - protein, 447 aa, Glycine max
  Coding DNA Sequence Number=SeqID_82251
  Homolog annotation: Hit_ID=A7QR03; Match level="QueryCoverage=84%, HitCoverage=49%, E-value=1e-120, Identity=57%"; Hit description =Chromosome undetermined scaffold_147, whole genome shotgun sequence
MPILDPLWGDLHSHAPGPHSLGCEGFCLNIYRKNFFSLRLNGVWLGTTARPYPDSKLKESQYQLTPWRSDTNHANVATQSQPHSIGAPLATSNKNGLELVPQHMYSQVKPQVSVDAQAGTDWGLLGRNQNGLSGGVATSVDTDDLGRFSPLASRNSSAHDASTHLVVTQGDTRPAHYGDEVTNKQVTFRVPVSNNEVDDPDGDGTHSMRETSANWSSGNPPYTTTVDDPSSSYSPYLPAVLEEPSSSFSEAADEDPLPAIEGLQISGEAFPGRELKAGGYSINGTTSWAKQPIYLVNADDVGTLLAIEVQPLDNRKRKGEPVKVFANDNKKIACDPEMQNHIEKAFNSGHASYRVSLSTGYLDIWEPATLTIKREGYSIKCSGPNGFVITEKFSPSTTVMIPYGHTSEFIIIGSSGAEHLLKAENNTDFSGRFHHLACCASLSANEK

SEQ ID NO: 173937 - protein, 56 aa, Glycine max
  Coding DNA Sequence Number=SeqID_82252
  Gene Ontology: Mol. function=unfolded protein binding; Cellular component=cytoplasm; Biological process=cellular protein metabolic process
  Homolog annotation: Hit_ID=A7PD22; Match level="QueryCoverage=89%, HitCoverage=10%, E-value=2e-16, Identity=77%"; Hit description =Chromosome chr17 scaffold_12, whole genome shotgun sequence
MVIIIHSMIELSRTQDEEVGDGTTSVIILALIDKNYHPTVICRAYNKALEDAIIVL

SEQ ID NO: 173938 - protein, 116 aa, Glycine max
  Coding DNA Sequence Number=SeqID_82253
  Gene Ontology: Mol. function=translation initiation factor activity; Cellular component=cytoplasm; Biological process=mature ribosome assembly
  Homolog annotation: Hit_ID=A2YP54; Match level="QueryCoverage=68%, HitCoverage=32%, E-value=3e-37, Identity=93%"; Hit description =Putative uncharacterized protein
  Pfam annotation: Domain name=eIF-6; Domain location=21-116; Score= -25.8; E_value=3e-05; Accession=PF01912.9; Description=eIF-6 family
MLQILSWLLWSKISGISVMATRLQFENNCEVGVFSKLTNAYCLFAIGGSENFYSGFEAELADVIPVVKTSIGGTRIVGRLCVGNKNGLLLPHTTTDQGDSYYSAVYFYSQYCLMLC

SEQ ID NO: 173939 - protein, 677 aa, Glycine max
  Coding DNA Sequence Number=SeqID_82254
  Gene Ontology: Mol. function=nucleic acid binding
  Homolog annotation: Hit_ID=A7QR16; Match level="QueryCoverage=79%, HitCoverage=72%, E-value=1e-155, Identity=54%"; Hit description =Chromosome undetermined scaffold_147, whole genome shotgun sequence
  Pfam annotation: Domain name=Rxt3; Domain location=535-616; Score =81.7; E_value=2.4e-21; Accession=PF08642.1; Description=Histone deacetylation protein Rxt3
MLVMHLLYMLVIIVVAFGAPKRSHEESVHSSSKHPNEDLGTYSKLVSSSVSNEYHMPHDITQDSRVAKVPRTEFHDADRRSPLNPVYRMSSPLNDSRTDHPIGPENRIESRDSKDNRDLRFENRDTKTEKKELHGEARRDPPSAKSEKDVRVEGRGDDNKDVRHDRDSHNDPKGDTKTEKDGYNVVSSHLNWKDSKEYHRGKRYSDSPGGNWDTWHMSRGNTQGSVEVGKESSAAGERDHVEAHEAVCENKVDPKGDDRSKEKDRKRKDVKHREWGDREKERSDRRNSPQVTNSTGDCKESAKEDRDVERLEREKKDLPKEKENLTERERDQMKRESWNGMEKEVSNNEKESVDASDKLTEQEIVLPEQKKQKEVDSWKNVDREARERRKERDADLEGDRSDKRTKGLDKESNDGCADVEGVMEKEREIPSPRQRRVLSSFTFLCFLIVCKFDDPASKVEVSSVVYKVGESMQELIKLWKEHESSQSEMEKNGESSNNGPTLEIRIPSEHVTATNRQDALRHQYPYSANYLVPLDLFKSSASSIVPPVRGGQLWGTDVYTYDSDLVAVLMHTGYCRPTASPPHAAIQELRATVRVLPPQDCYISTLRNNIRSRAWGAAIGCSYRVERCCIVKKGGDTIDLEPCLTHTSTIEPTLAPVTVERTMTTRAAASAYFIYVG

SEQ ID NO: 173940 - protein, 167 aa, Glycine max
  Coding DNA Sequence Number=SeqID_82255
MVGLLSRSLGGAAMLWCRLQAQQEIASYGGDLLCSKFFFLPYKAMQEVVKFLFFFGLHLLVAFLSTYLRLDFLSMASSSSSSSSIQIKSGLIEGDVLWMQPKHVSEHVWNGEPDRKLHIRRAVPIYQGQEEIPEEIIPLLRQSGFYWIMKMGYLKINSSLITALIER

SEQ ID NO: 173941 - protein, 446 aa, Glycine max
  Coding DNA Sequence Number=SeqID_82256
  Gene Ontology: Mol. function=protein dimerization activity; Biological process=alkaloid metabolic process
  Homolog annotation: Hit_ID=Q06YR2; Match level="QueryCoverage=57%, HitCoverage=72%, E-value=3e-93, Identity=66%"; Hit description=IOMT 4
  Pfam annotation: Domain name=Dimerisation; Domain location=30-78; Score=93.9; E_value=5.1e-25; Accession=PF08100.2; Description =Dimerisation domain
  Pfam annotation: Domain name=Methyltransf_2; Domain location=87-312; Score=132.7; E_value=1.1e-36; Accession=PF00891.9; Description=O -methyltransferase
  Pfam module annotation: Pfam domain module=Dimerisation::Methyltransf_ 2; Domain location=30-78::87-312
MASMNNQKEIELFEGQTLLYMQLYGHLRPMCLKWAVQLGIPDIIHNHAKPITLSDLVSTLQIPPAKAGFVQRFMRFLAHNGIFEIHESQEEHELTYALTPASKLLVNSSDHCLSPMVLAFTDPLRNVKYHHLGEWIRGKDPSVFETAHGTSAWGLLEKNPEYFSLFNEAMASDSQILDLALKNCTSVFEGLDSMVDVGGGTGTTARIICDAFPELKCVVLDLPHVVANLTETNNVGFVGGDMFKSIPQADAVLLKTSTTQVYYAKPPPHKQIQHHHQSIAIAQPNPTTSINSPPPTNTQPNLITTIKPNLLISNSLSHDGWASGAKVYIHSSLSRIGVGVTCKADWTKGGCVHFLCGLGCHDGGGGGGQGGGVSCTMHRSDAKRSRAEEDQSGYAWSLVLVACVTKRAGVQVASSPGESGHRIQFYFSERGMLFQPFQIKEGTFFR

SEQ ID NO: 173942 - protein, 60 aa, Glycine max
  Coding DNA Sequence Number=SeqID_82257
MSPEFHALEEVVVVFWCKRERIGVWRIGCMAWKWREEGKGKGGGQATCRFVVGFGGEWKE

SEQ ID NO: 173943 - protein, 184 aa, Glycine max
  Coding DNA Sequence Number=SeqID_82258
  Gene Ontology: Mol. function=kinase activity; Cellular component =cytoplasm; Biological process=coenzyme A biosynthetic process
  Homolog annotation: Hit_ID=A7P8S6; Match level="QueryCoverage=81%, HitCoverage=40%, E-value=2e-58, Identity=79%"; Hit description =Chromosome chr3 scaffold_8, whole genome shotgun sequence
MEQEVLEEGKCRMANEIYNFMMDFMSSAVFFRGGILISFTLADIILGIILPFARELLRRGSQVILAANYLPSLNDVTYAELIKIISKLKDEEGRLVGVGTSNLLIANSGNDLPVIDLTRVSQELGNLANDLDLVILEGMGRGIETNLYAQFKCDSLKIAMVEHPEVTEFLGSRFYDCVIKYDEV

SEQ ID NO: 173944 - protein, 136 aa, Glycine max
  Coding DNA Sequence Number=SeqID_82259
  Pfam annotation: Domain name=AT_hook; Domain location=46-58; Score =16.7; E_value=0.032; Accession=PF02178.10; Description=AT hook motif
  Pfam annotation: Domain name=AT_hook; Domain location=88-100; Score =10.9; E_value=0.31; Accession=PF02178.10; Description=AT hook motif
  Pfam module annotation: Pfam domain module=AT_hook::AT_hook; Domain location=46-58::88-100
MEGRENFGVVVGDEAPESFHVAPRIENNLDFSRATVPAPAPPTEGKKKRGRPRKYGPDGKPALGAVTALSPMPISSSIPLTGEFSAWKRGRGRPVESIKKSSFKFEVESPGPGFTVTSVAKVLFLLLHSSMVALVI

SEQ ID NO: 173945 - protein, 565 aa, Glycine max
  Coding DNA Sequence Number=SeqID_82260
  Gene Ontology: Mol. function=pyruvate kinase activity; Cellular component=chloroplast; Biological process=glycolysis
  Homolog annotation: Hit_ID=Q43117; Match level="QueryCoverage=100%, HitCoverage=75%, E-value=1e-150, Identity=90%"; Hit description =Pyruvate kinase isozyme A, chloroplast precursor
  Pfam annotation: Domain name=HpcH_HpaI; Domain location=243-397; Score=-88.5; E_value=0.077; Accession=PF03328.5; Description =HpcHHpaI aldolase family
  Pfam annotation: Domain name=PK; Domain location=90-438; Score=23.9; E_value=5.3e-22; Accession=PF00224.12; Description=Pyruvate kinase, barrel domain
  Pfam annotation: Domain name=PK_C; Domain location=455-561; Score =38.1; E_value=2.5e-08; Accession=PF02887.7; Description=Pyruvate kinase, alphabeta domain
  Pfam module annotation: Pfam domain module=HpcH_HpaI::PK::PK_C; Domain location=243-397::90-438::455-561
EWHKEVIDRVRGLNHEKGFAVAIMMDTEGSEIHMGDLGGASSAKAEDGEIWTFSVRAFDSALPQHTINVNYEGFAEDVKVGDELLVDGGMVRFEVIQKIGPDVKCRCTDPGLLLPRANLTFWRNGSLVRERNAMLPTISSKALLYGEGKKRDLGYNKLACMATSVGRIVVKLDDGLDVREEASSGPGTVVLDSMMKKWKSIERLKFLKIIKSIWVWLIKVEEYFAATGTLEAERLPRAVKTLRSCAFNWWLRWKLCNPQATLFEFDWLDIDFGISEGVDFIAISFVKSAEVITHLKSYIAARSRDSDISVIAKIESIDSLKNIEEIILAADGAMVARGDLGAQIPLEQVPSAQQRIVEICRQLNKPVIVASQLLESMIEYPTPTRAEVADVSEAVRQRADALMLSGESAMGQYPEKALTVLRSVSLRIEKWWREEKRYEAMLLPSVGSYFSEKISEEICNSAAKMANNLEVDALFVYTKTGHMASLLSRCRPDCPIFAFTTTSSVRRRLNLQWGLIPFRLSFTDDMESNLNRTFSLLKARNLIKSGDLVVAVSDMLQSIQVMNVP

SEQ ID NO: 173946 - protein, 592 aa, Glycine max
  Coding DNA Sequence Number=SeqID_82261
  Gene Ontology: Mol. function=acyltransferase activity; Cellular component=integral to membrane; Biological process=metabolic process
  Homolog annotation: Hit_ID=A7NWY4; Match level="QueryCoverage=84%, HitCoverage=96%, E-value=0.0, Identity=87%"; Hit description =Chromosome chr5 scaffold_2, whole genome shotgun sequence
  Pfam annotation: Domain name=ACP_syn_III_C; Domain location=401-485; Score=6.2; E_value=3.4e-06; Accession=PF08541.1; Description=3 -Oxoacyl-[acyl-carrier-protein (ACP)
  Pfam annotation: Domain name=Chal_sti_synt_C; Domain location=344 -487; Score=15.3; E_value=9.7e-05; Accession=PF02797.6; Description =Chalcone and stilbene synthases, C-te
  Pfam annotation: Domain name=Chal_sti_synt_N; Domain location=92-304; Score=-83.5; E_value=0.035; Accession=PF00195.10; Description =Chalcone and stilbene synthases, N-te
  Pfam annotation: Domain name=FAE1_CUT1_RppA; Domain location=98-387; Score=790.2; E_value=1.2e-234; Accession=PF08392.3; Description =FAE1Type III polyketide synthase-lik
  Pfam module annotation: Pfam domain module=ACP_syn_III_C::Chal_sti _synt_C::Chal_sti_synt_N::FAE1_CUT1_RppA; Domain location=401 -485::344-487::92-304::98-387
MADHTPGSGTVSVEASSQERRKLPNFLLSVRLKYVKLGYHYLISNAMYLLLIPLLGVASAHLSTISYQDVVQLWENLKFNLVSVTLCSSLIVFLVTFYFMSRPRGVYLVDFACYKPEPDCTCTREIFMHRSVETGVFSEENLAFQKKILERSGLGQKTYLPPAILSIPPNPCMAEARKEAEQVMFGAIDQLLEKTGVKAKDIGILVVNCSLFNPTPSLSAMIVNHYKLRGNIQSYNLGGMGCSAGLISIDLAKQLLQVHPNSYALVVSMENITLNWYFGNNRSMLVSNCLFRMGGAAVLLSNKSSDRRRAKYQLIHTVRTHKGADDRSYGCVFQEEDEKKTIGVALSKDLMAVAGEALKTNITTLGPLVLPMSEQLLFFATLVARKVFKMKIKPYIPDFKLAFEHFCIHAGGRAVLDELEKNLELSDWHMEPSRMTLNRFGNTSSSSLWYELAYTEAKGRIRKGDRTWQIAFGSGFKCNSAVWRALRTINPAKEKNPWMDEIHEFPVHFNIDGCAFGNPREAGFGGGVREWSDVWIVSFFGSCGVASNTLAELQEYLERGTRLLILLLMMILKGYIIWLFFRHHPFTTPKAR

SEQ ID NO: 173947 - protein, 29 aa, Glycine max
  Coding DNA Sequence Number=SeqID_82262
MKAGNEKTENSLAVLVTPANDAEGRFVPS

SEQ ID NO: 173948 - protein, 160 aa, Glycine max
  Coding DNA Sequence Number=SeqID_82263
  Gene Ontology: Mol. function=protein dimerization activity; Cellular component=nucleus; Biological process=regulation of transcription, DNA-dependent
  Homolog annotation: Hit_ID=P32294; Match level="QueryCoverage=74%, HitCoverage=60%, E-value=6e-60, Identity=89%"; Hit description=Auxin- induced protein 22B
  Pfam annotation: Domain name=AUX_IAA; Domain location=1-121; Score =228.0; E_value=2.2e-65; Accession=PF02309.7; Description=AUXIAA family
AKIVGWPPIRSYRKNSLQENDGAGIYVKVSMDGAPYLRKIDLKVYGGYTQLLKALENMFKLTIGEYSEKEGYKGSDYAPTYEDKDGDWMLVGDVPWDMFVTSCKRLRIMKGSEARGLGCAEKMEDTVQFRSSSSLATFMVIILASVVGCYAYDVVSTDPF

SEQ ID NO: 173949 - protein, 122 aa, Glycine max
  Coding DNA Sequence Number=SeqID_82264
MRVYDNAVIYANAMHEYDARMICLLRCHEEMHDVIKEYARVILLCAPNSGILWKGSKIPLLVTTPKGGTISDNASLKEENCRQRIKLNVLMMPKDYMNHMLLKDLLKTKQLEIFKMDDQDSL

SEQ ID NO: 173950 - protein, 114 aa, Glycine max
  Coding DNA Sequence Number=SeqID_82265
  Subcellular localization annotation: CTP_CleavageSite=59; ConfidenceScore=5.53e-01
MTKEVIHGHNSTTPQLDFSSSPSSSAFSPCFLGCGTLFPPQPCMAIYRKQPLSAGKFAQASERVACLGLKLYLSPGELDVSLGEFRVRNLHEETILPFLVALFLDLTNNHHNPE

SEQ ID NO: 173951 - protein, 54 aa, Glycine max
  Coding DNA Sequence Number=SeqID_82266
  Subcellular localization annotation: CTP_CleavageSite=59; ConfidenceScore=5.08e-01
MPFCGRARARLTGALSKGGKVNKSGALAPTYPLSKRKSYLRSSFLCVNQVILFT

SEQ ID NO: 173952 - protein, 66 aa, Glycine max
  Coding DNA Sequence Number=SeqID_82267
MGRVPPAAMMKKGELDHIEERLRAIDGGEDHAFANMAELCLMSSSLQNSRCPISISTRVLLAPRII

SEQ ID NO: 173953 - protein, 155 aa, Glycine max
  Coding DNA Sequence Number=SeqID_82268
MDFFSDESFECIQAFENSNLIPFMPIKLPVYSDLVKAFYSNLEIKEGTLISEVYGIKMVIDQSLFYDLTQLPSEGVPFEGTLIDDWKFDFSMHDARRLVCTNQADMTGRLIAGSLAFESRILHYLIVRILLPRSSNLAQVSEEDLIVMWAFHKGL

SEQ ID NO: 173954 - protein, 70 aa, Glycine max
  Coding DNA Sequence Number=SeqID_82269
  Subcellular localization annotation: CTP_CleavageSite=31; ConfidenceScore=5.26e-01
MYKDKWTQPWSMGPKSTLRFMRTLGPSSTALAQSSWSLLLMALDQPIAITTNMNEAKLLEVFLETEDVSM

SEQ ID NO: 173955 - protein, 74 aa, Glycine max
  Coding DNA Sequence Number=SeqID_82270
MVIHTFRQPGANEPIDVQRLTSSSAPVVILTHGVGWQAEIPGGHPHLSSTEANESDDSAGRDIDRPNNVPHEQN

SEQ ID NO: 173956 - protein, 51 aa, Glycine max
  Coding DNA Sequence Number=SeqID_82271
MKKQQWSRRRRGERRRHSLGNKPWKEELHHKECALDKKLREEASMEENNER

SEQ ID NO: 173957 - protein, 221 aa, Glycine max
  Coding DNA Sequence Number=SeqID_82272
  Subcellular localization annotation: CTP_CleavageSite=41; ConfidenceScore=5.15e-01
MTEPSKKRKGSSSTAAVVVHRCHRPPEAPTAPIHPSLSSPRSSTLFSSDDQCLRYLSQFSFRIILDPKYLDVDFFNDERLIAINQGAPFEGTIVDDWKFDYSSHDARRMVCNDQAEMTGRLLAGSLSFDNRIMHYIIVRILLPRSSNLAQASEEDLILMWAFLTGRQIDWAHLVRYRMHKALRANAPLPYPHLITLFLRHFQIPLDDEPFVQVKRSFAIGA

SEQ ID NO: 173958 - protein, 297 aa, Glycine max
  Coding DNA Sequence Number=SeqID_82273
  Gene Ontology: Mol. function=receptor activity
  Homolog annotation: Hit_ID=A4WGE2; Match level="QueryCoverage=100%, HitCoverage=66%, E-value=1e-106, Identity=59%"; Hit description=von Willebrand factor, type A
MAISGQLAPILTDDDEAAAGRLWDLSKAPLQHGDYELIVQYGDFLAQQPELMKLAQQLGRSREAKSVPAQDAPLEAFHQLVREPDNVPEEVSGIHQSDDVLRLLPPELAALSISELELEFYRRLVEKRLLTYRLQGDAWHEKVTLRPASHQQHEAQPRGPFIVCVDTSGGAATSCCLLIEVIGYELTADNGIEQAIRFLSQRFRGGTDLAACLSAVVTRMEGSQWQEADAVIVSDFIAQRLPDDIVSTIKQRQRHHQQRFHAVAMSAHGKPGILRIFDHIWRFDTGLKSRLLRRWKR

SEQ ID NO: 173959 - protein, 53 aa, Glycine max
  Coding DNA Sequence Number=SeqID_82274
MVKARQKGGKRGRWLPPSWPRRAGLLPPEGTAFCWNPLEGPRGSGYYLHTPFY

SEQ ID NO: 173960 - protein, 211 aa, Glycine max
  Coding DNA Sequence Number=SeqID_82275
  Homolog annotation: Hit_ID=Q6UUU1; Match level="QueryCoverage=28%, HitCoverage=40%, E-value=5e-17, Identity=73%"; Hit description =Putative uncharacterized protein
SALDGEEHIGEWRNPSGKIRKITFPSQEGPLLTVKNTLENGGFNRENNKDHISQSRGSALDDEEHIGDWRNQAYRYRRPRGGARYQLLFPLVRVNFELGVIMVIAVSFGKPVVPAALMNRPTRGERRFAYWALAECILAYYVGTDEGVIELLHVAGEKRLHRCVSKICDTGYIPLPRSLTRYARSFDCGERKWLTNGVDISWKMPGRYLTG

SEQ ID NO: 173961 - protein, 111 aa, Glycine max
  Coding DNA Sequence Number=SeqID_82276
MATRCACRSKFIFFLNWLIVPVSVCMHRSSAGKLKQQFEAEVMAEEQPQRVTLEDYSSTSVLQYFSSVARPEVQAQNLTYPPSLIQLIQSNLFHGLPNEDPYSHLATYIEI

SEQ ID NO: 173962 - protein, 269 aa, Glycine max
  Coding DNA Sequence Number=SeqID_82277
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSIRRSAHGVPIRVPDPHVLVDEHGDPVRIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 173963 - protein, 166 aa, Glycine max
  Coding DNA Sequence Number=SeqID_82278
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=31%, HitCoverage=50%, E-value=5e-24, Identity=100%"; Hit description=LacZ protein
MTMITPSSKLTLTKGNKSWYRAPPRGHEDLVHEWEHHEHSAESNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 173964 - protein, 274 aa, Glycine max
  Coding DNA Sequence Number=SeqID_82279
  Gene Ontology: Mol. function=oxidoreductase activity; Cellular component=integral to membrane; Biological process=electron transport
  Homolog annotation: Hit_ID=A4WFT1; Match level="QueryCoverage=100%, HitCoverage=69%, E-value=1e-125, Identity=80%"; Hit description =HI0933 family protein precursor
  Pfam annotation: Domain name=HI0933_like; Domain location=1-274; Score=323.9; E_value=2.8e-94; Accession=PF03486.5; Description =HI0933-like protein
MSGGGRCNFTNLYTEPAAYLSHNPHFCKSALARYTQWDFIDLVNRHGIAWHEKTLGQLFCDDSAQQIVDLLLKECEAGQVTLRLRSEVLNVARDDDGYTLQLNGSAVRADKLVIASGGLSMPGLGATPFGYKVAEQFGLRVHPTRAALVPFTLHKPLLEQLNTLSGVALPTTITAQDGTLFKEAMLFTHRGLSGPAVLQISSYWQPGEFVTVNLSPETALDDFIDVQRAAHPNLSLKNSLAKILPKRLVEVLQELQQIPDVTLKQLNSKQQSEL

SEQ ID NO: 173965 - protein, 153 aa, Glycine max
  Coding DNA Sequence Number=SeqID_82280
MSAMSQSSAMPAEKLPAPLRRYGADADPGRLRAGDSAAGPARLAAGRRAAAVRLFRRHQCVADRQLCYRINRYRGAGHCASVGGAGTGAQPWQNRRHGDDRAAGRHSAVARGERRGGGVSGLAHHVHDGGGGGAAEQSGAVARAATLYAGHHG

SEQ ID NO: 173966 - protein, 148 aa, Glycine max
  Coding DNA Sequence Number=SeqID_82281
  Homolog annotation: Hit_ID=A2Q186; Match level="QueryCoverage=45%, HitCoverage=17%, E-value=3e-11, Identity=41%"; Hit description =Reverse transcriptase-beet retrotransposon, putative
MGNNTNGGWEWKLSWRRALFDSEIQMADNFLGELSQQQIQPNTEDRCSWKHDQTGYYSTKSGYDLIWEAQMGANQNLDFVDIWKLKIPNSTQFVLDRDFSDHCPILLRSTTVDWGPTPFKVMDWWLKDKDFQKMVSHRWGNYHPSGWG

SEQ ID NO: 173967 - protein, 80 aa, Glycine max
  Coding DNA Sequence Number=SeqID_82282
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=100%, HitCoverage=57%, E-value=4e-14, Identity=58%"; Hit description=LacZ protein
  Subcellular localization annotation: CTP_CleavageSite=32; ConfidenceScore=5.05e-01
MTMITPSSKLTLTKGNKSCPGDPLVLERPPPRWSSNSPYSESYYNSLAVVLQRRDWENPGVTQLNRLAAHPPFASWRNSE

SEQ ID NO: 173968 - protein, 116 aa, Glycine max
  Coding DNA Sequence Number=SeqID_82283
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=Q8GEG0; Match level="QueryCoverage=50%, HitCoverage=46%, E-value=6e-24, Identity=93%"; Hit description =Putative uncharacterized protein
MEESNRENNKDHISQSRGESYYNSLAVVLQRRDWENPGVTQLNRLAAHPPFASWRNSEEARTDGPSQQLRSLNGEWDAPCSGALSAAGVVVTRSVTATLASADVRRCFCRYAPPRQ

SEQ ID NO: 173969 - protein, 28 aa, Glycine max
  Coding DNA Sequence Number=SeqID_82284
EKLPGSYIIDRTSKRVKLRPQKETTPEI

SEQ ID NO: 173970 - protein, 260 aa, Glycine max
  Coding DNA Sequence Number=SeqID_82285
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTFMLMPGPRGYTVFLVNPHNWDIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 173971 - protein, 152 aa, Glycine max
  Coding DNA Sequence Number=SeqID_82286
MPYGYPHLVIQRPQVRLTSRDQCGHLHPFWRCQHLPVETFQSHKQLLLIPTREVRWQAEIPEWLSVQRQLLLISTREVRWQVEIPEVVIRTNTLLLILTREVRWQTKIPEWLSVQRKLLLILTRDVRWQAEIPEWLSVQTQLLLILTREVRW

SEQ ID NO: 173972 - protein, 97 aa, Glycine max
  Coding DNA Sequence Number=SeqID_82287
KFGIPNVESTLFLTYADVNEITTGDKWLNIAILKLWTMGHWQLIVLCPTNYQGVWFCSMRKRPNVHTKTAINNAFKALKTTHDGKHPQSTPVWIEVK

SEQ ID NO: 173973 - protein, 273 aa, Glycine max
  Coding DNA Sequence Number=SeqID_82288
  Gene Ontology: Biological process=transposition, DNA-mediated
  Homolog annotation: Hit_ID=Q1J7G7; Match level="QueryCoverage=11%, HitCoverage=45%, E-value=9e-11, Identity=100%"; Hit description =Transposase
VLQWLLFLSAVPPVQLLTGWCVTAKAPPDISAGKCSGHAARRVPFAIQAAQLLGRAIGAGLFAITPAGERGMCCKAIKLGNARVFPVTTLNSIHAQLGLRVHFMGTDLHFDGATFRADHGGMQRAIVVGLRACDVIIELAWYRRPQRVHHAQRGVAGGDVVDHHAHRTDVIQLVEGQPLLLHLPPDAVDVLRAAADLSSLSIPSTSRGGPVPAFVPFSEVGKPVVPAALMNRPTRGERRFAYWALAECILAYYVGTDEGVSEVLHVAGEKRLH

SEQ ID NO: 173974 - protein, 149 aa, Glycine max
  Coding DNA Sequence Number=SeqID_82289
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=34%, HitCoverage=50%, E-value=4e-23, Identity=98%"; Hit description=LacZ protein
IVRLLTRENPEYKGDVSQCVFRNCKSNSCSPGDPLVLERPPPRWSSNSPYSESYYNSLAVVLQRRDWENTGVTQLNRLAAHPPFASWRNSEEARTDRPSQQLRSLNGEWDAPCSGALSAAGVVVTRSVTATLASADVRRCFCRYAPPRQ

SEQ ID NO: 173975 - protein, 73 aa, Glycine max
  Coding DNA Sequence Number=SeqID_82290
  Subcellular localization annotation: CTP_CleavageSite=44; ConfidenceScore=5.15e-01
MCIYIGCSMKRKCHRGSSPQRDLGGTPQAKEPVSLLSLTAIVSRAQSTSSVSRPSKDGRSTERDASNSGTMST

SEQ ID NO: 173976 - protein, 90 aa, Glycine max
  Coding DNA Sequence Number=SeqID_82291
MGNFNNDSWEWDLRWRRNLFDHENDIAVQFMEEISSIPIQRHSKDSMVWLAEPHGHYTTKSAYKFYTKPSTTNSDGKIYSIIWKLKIPPR

SEQ ID NO: 173977 - protein, 291 aa, Glycine max
  Coding DNA Sequence Number=SeqID_82292
  Gene Ontology: Mol. function=hydrolase activity; Biological process =transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGIRSRPYLQLGVSSNVTYTYDESRKEGERITSVWDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 173978 - protein, 117 aa, Glycine max
  Coding DNA Sequence Number=SeqID_82293
GSRPQDAQWARRSPTGPWGFQLWLRASESHPQRHPVDPEKSNRALGFPALVTGLCNPIGCPFPPARSRHHDIGIAPARHPVDPKKSNRVLELSSSNYGSLSVLRSACHLQQGHQAPY

SEQ ID NO: 173979 - protein, 92 aa, Glycine max
  Coding DNA Sequence Number=SeqID_82294
MDLYVVGDQSTQLVALGKVYDSSSTIRNVPYVDDVVRVTVVKAYHGDIEDSQKHLPKLVGFAEMDNAVAGVDPWDGTKFGIPNVKMAFSSHM

SEQ ID NO: 173980 - protein, 346 aa, Glycine max
  Coding DNA Sequence Number=SeqID_82295
  Gene Ontology: Mol. function=ferrochelatase activity; Cellular component=cytoplasm; Biological process=porphyrin biosynthetic process
  Homolog annotation: Hit_ID=A4BYW6; Match level="QueryCoverage=89%, HitCoverage=92%, E-value=1e-97, Identity=55%"; Hit description =Ferrochelatase
  Pfam annotation: Domain name=Ferrochelatase; Domain location=36-346; Score=250.3; E_value=4.1e-72; Accession=PF00762.10; Description =Ferrochelatase
MLQLREKKHMKNFLLILRTLGAATESDHQLLIKGIKAVNDVKEYLDEFLMDERVIDYRWIFRALLVRGIILNTRPAKSAEAYKTVWTDEGSPLIVITEKIQKKLQKLVDVPVEIGMRYAQPSIEAGIQKLVDQGVSEIVLFPLYPQYAMSTTETVIEKAEEVRKKTFPTVKINYIQPFYDRDIYINCLAESIKEKLPENFDALQFSYHGVPERHIYKTDPSHTCKIDDSNCINSTIEAHNARCYRHQCYKTTETVIAKMGLPKEKTIVSFQSRLGKDKWIEPYTDETLETIPKKGVKNLAIVCPAFVSDCLETLEEISVEGKEQFLHGGGENFHYIPCLNDEDRWM

SEQ ID NO: 173981 - protein, 182 aa, Glycine max
  Coding DNA Sequence Number=SeqID_82296
  Gene Ontology: Mol. function=aminoacyl-tRNA ligase activity
  Homolog annotation: Hit_ID=A7QY95; Match level="QueryCoverage=73%, HitCoverage=57%, E-value=3e-58, Identity=80%"; Hit description =Chromosome chr2 scaffold_241, whole genome shotgun sequence
MAKLTIVEAGASDCRTPSANENGGSPCGTGASPNPAPATHIETGANGVPDFSFKRVPSDYYDWPLEARRDALSAASIHHLCKSIVLVNTQAPANVVDCSDRKNSKYYVVVVQYTARFNAEAVKNFLYSLNNGSIAKKKFNMRLAPEETSMELTGYGHNAVTCIGMKTDIPVRMDMLIGIRFL

SEQ ID NO: 173982 - protein, 118 aa, Glycine max
  Coding DNA Sequence Number=SeqID_82297
MVGVKMFLLQMNRILTPMPKGPFLWFLVEVYDVCRSKRAWGAPAKETSTLNLSGIIAKAHFHIDILKTKVSLYAWQFLAGFQNLILVSSHLRSLARQTSPLEGHPHQLWMMGLQVNVT

SEQ ID NO: 173983 - protein, 446 aa, Glycine max
  Coding DNA Sequence Number=SeqID_82298
  Gene Ontology: Mol. function=ATP-dependent helicase activity
  Homolog annotation: Hit_ID=A7QY89; Match level="QueryCoverage=100%, HitCoverage=100%, E-value=1e-139, Identity=56%"; Hit description =Chromosome chr2 scaffold_241, whole genome shotgun sequence
  Pfam annotation: Domain name=zf-CCHC; Domain location=257-274; Score =20.5; E_value=0.0012; Accession=PF00098.14; Description=Zinc knuckle
  Pfam annotation: Domain name=zf-HIT; Domain location=172-201; Score =29.5; E_value=1.3e-05; Accession=PF04438.7; Description=HIT zinc finger
  Pfam module annotation: Pfam domain module=zf-CCHC::zf-HIT; Domain location=257-274::172-201
  Subcellular localization annotation: CTP_CleavageSite=63; ConfidenceScore=5.08e-01
MGTRTNFYKNPSISYKKRLSISSVLQNLHAYNIAAGNVPPADPPQATSTANVPPGNPPHLTPSARLKRSRNPEPPEFLREYRDDAPSSMSHHDYIQNRRKEVVSSRNHDRVELTEEVLGNSNSTLPLVDYDASDEDTPSECEETHTLLNSGQQEEFDGVKKSRNEQRFPVSGEPVCLICGRYGEYICNETDDDVCSMECKSELLEILKLNEGSSHNQVRDISSSGISAAVPVPVFGDDTWDYNQHHWSKKTCSLSTYECWKCQRPGHLAEDCMVTDGSNRSSSIPKDLLQLYRRCHQIGKDLLAANCNVCRRSSNLATCLDCSIVLCDGAGHLIEHIRTHPSHQKYYSHKLKRLVKCCKSTCKVTDIKDLLVCHYCFDKAFEKFYDMYTATWKGAGLAIMWGSICCEDHFTWHRMNCLNANVEESAYILKPDGHKGKRTQLSDFIF

SEQ ID NO: 173984 - protein, 517 aa, Glycine max
  Coding DNA Sequence Number=SeqID_82299
  Gene Ontology: Mol. function=methyltransferase activity; Cellular component=cytoplasm; Biological process=peptidyl-arginine methylation
  Homolog annotation: Hit_ID=A7QY82; Match level="QueryCoverage=91%, HitCoverage=77%, E-value=1e-173, Identity=57%"; Hit description =Chromosome chr2 scaffold_241, whole genome shotgun sequence
MVLNAVCLAATSRYLTFCNCITTTIAAASAAFSHNVSEILDSELLGEGLIPTLQHAHDNLLVENALTVPYRATTYGQLVESTFLWQLHDLHSIEATVSDGIQLTPPGLDSVLSVKRQQYAMHCNPIQEEIKLLSEPFKIFEFDFWKRPESSGETELCVKATNDGRIHAVVSWWVLQLDREGTIYYSTAPRWISSPTITSPVGWCDHWKQCVWFVPGSGISIFKGEEIHLHATHTETSISYNLDTQVPTSEILNHRCMTGDLQLVLPPERVAIYGDKGWRLSMLKAVQSMGRDHPLCLVADDSVFLPLLVAQLSEASHVMSLLPGLKERGLQYLQAAAHANGLSRNCIEVLEKRVDLLIAEPFYVGHDGMLPWQNLRFWKDRTTLNDILSEDALIIPSKGILRACAISLPVLSETFDVMEFDFSKQICLCQGKSQVKFTKTGVCHGFVLWIDWVMDLQNSVVISTGPDRRYWKQGVKLLGTPRTVGPQRSRNVQACSAVLEACFNPLQGELKIILDFL

SEQ ID NO: 173985 - protein, 112 aa, Glycine max
  Coding DNA Sequence Number=SeqID_82300
  Subcellular localization annotation: CTP_CleavageSite=15; ConfidenceScore=5.11e-01
MFTLMQQRSDQDKVSQGAKRTGIFSFRYAGRMGKPTNNMTAISESVLFIMASMQIIYALIASRTDWGNRACYRVAFALSANTHNPATDRITDVRINSVTSQANSQTPSKVAK

SEQ ID NO: 173986 - protein, 129 aa, Glycine max
  Coding DNA Sequence Number=SeqID_82301
  Homolog annotation: Hit_ID=P03851; Match level="QueryCoverage=65%, HitCoverage=100%, E-value=4e-44, Identity=98%"; Hit description =Uncharacterized 9.4 kDa protein
  Subcellular localization annotation: CTP_CleavageSite=32; ConfidenceScore=5.26e-01
MPAGRLLEDPRSSASSLTDSLRSVVRLRRAVSAHSKAVVRSKLGCVHEPPVQPDRCALSGNYRLESNPVRHDLSPLAAATGNRISRARYVGGATEFLKWWPNYGYTRRTVFGICALLKPVTFGKRVGSS

SEQ ID NO: 173987 - protein, 152 aa, Glycine max
  Coding DNA Sequence Number=SeqID_82302
MLETKSKGKTQLEVTTSSMETWLPPLDLRKKKGKFPPCNKPMPHPSPKDNIALHPIPYNWRVKKLQESSLKESRFKNNQDQDSRLKIQDSREEIEKQQSRLHKGSIFQNSKYSTVEAKLHGESKMMTKEMTKSSKINQRTTQVNQEQLKSSR

SEQ ID NO: 173988 - protein, 256 aa, Glycine max
  Coding DNA Sequence Number=SeqID_82303
  Gene Ontology: Mol. function=transporter activity; Cellular component= integral to membrane; Biological process=sodium ion transport
  Homolog annotation: Hit_ID=P75683; Match level="QueryCoverage=91%, HitCoverage=50%, E-value=1e-110, Identity=85%"; Hit description =Uncharacterized symporter yagG
MTIAGHHVPAGLFLHRRLRPVGGHYGTLFLISRVLGCAVTDPLMGLLVDRTRTRHGQFRPFLLWGAIPFGIVCVLTFYTPDFSAQGKIIYACVTYILLTLVYTFVNVPYCAMPGVITADPKERHALQSWRFFLAAAGSLAISGIALPLVSIIGKGDEQVGYFGAMCVLGLSGVVLLYVCFFTTKERYTFEVQPGSSVAKDLKLLLGNGQWRIMCAFKMMATCSNVVRGGATLYFVKYVMDHPEMATQFLLYGSLAT

SEQ ID NO: 173989 - protein, 239 aa, Glycine max
  Coding DNA Sequence Number=SeqID_82304
MTTLTQIWMTLLLSNILPSDHNSDLPLPKCQLVYAILTRMSIHVAQLIADAIYIFAGMAPTRHPLDPDKSNRALGFPALITGLCQSFGVPVTPSKVIRPPITRAFIEKYCTQRQVQGDAPQATDMPPPHQAGPAELFDTEQYMRHLVRQQAANHRAHVQTHDCFYQMSLSLQSQGFTSFPCPTPDQFRAEVAWPGDWPEAQAGEAPAGAPAEAPVEADEAREDEEMTDLLDFLGGSGVT

SEQ ID NO: 173990 - protein, 166 aa, Glycine max
  Coding DNA Sequence Number=SeqID_82305
  Gene Ontology: Mol. function=transcription factor activity; Cellular component=cytoplasm; Biological process=regulation of transcription, DNA-dependent
  Homolog annotation: Hit_ID=A4WAB3; Match level="QueryCoverage=100%, HitCoverage=58%, E-value=2e-78, Identity=84%"; Hit description =Transcriptional regulator, LysR family
  Pfam annotation: Domain name=HTH_1; Domain location=8-67; Score=72.7; E_value=1.3e-18; Accession=PF00126.18; Description=Bacterial regulatory helix-turn-helix protein, lysR family
MSRRSLPLNAIDAFLVTARHLNLTHAAAELCLTQGAVSRKIASLETWFGFPLFERHARGLRLSPQGSALLPELQSAFEQLLAVADQARSQQTVIRLKAPTCAMRWLVPRLLEVEREQPDLQIALTTTTDHNVNFKTESYDAAIVFGTHMSAGDLLFEEALTPVISP

SEQ ID NO: 173991 - protein, 359 aa, Glycine max
  Coding DNA Sequence Number=SeqID_82306
  Gene Ontology: Mol. function=leucyl aminopeptidase activity; Cellular component=intracellular; Biological process=protein metabolic process
  Homolog annotation: Hit_ID=A6TCE3; Match level="QueryCoverage=71%, HitCoverage=100%, E-value=4e-84, Identity=62%"; Hit description =Enhanced serine sensitivity
  Pfam annotation: Domain name=Peptidase_M17; Domain location=1-100; Score=-168.0; E_value=4.7e-05; Accession=PF00883.12; Description =Cytosol aminopeptidase family, catalytic domain
  Pfam annotation: Domain name=SseB; Domain location=95-359; Score =439.0; E_value=6.7e-129; Accession=PF07179.3; Description=SseB protein
  Pfam module annotation: Pfam domain module=Peptidase_M17::SseB; Domain location=1-100::95-359
DDVLAESLLGSATSENEAFWRLPLAEFHRNHLPSNFADLNNIASAAHAAGASSAAAFLSWFVSNYQQGWLHIDCSATYRKNAVDQWSAGATGLGVRTIANLLSLMSNRLEEVLKLAATEPAHRPEFFQLLLEADVWVPGESPAEQFDATSPVELQHWEKEGGGSVIPFFTSEAAMSEAIQGEQPYLRLPTRTLFEMTLGETLFLNPKLPAGKEFSPGEIAHLLGEEGSALSQQTVLEGGHALLLSEVAEPPAQMIDSLTQLFAKYKQVRRAYVASIRERADEQANLLIGIEADSDIDAIIQAAGSVATDTLPDDAPIDICEVVSNEQGVSHFFTAHITPFYERRWGSFLRDFKGSQRII

SEQ ID NO: 173992 - protein, 268 aa, Glycine max
  Coding DNA Sequence Number=SeqID_82307
  Pfam annotation: Domain name=Transposase_23; Domain location=102-169; Score=-4.2; E_value=0.0034; Accession=PF03017.5; Description =TNP1ENSPM transposase
MRGSGSNTSSATMSADKLVEIIGSIKQELRKEVEDENKRTIDLLQKQLDAIKSELSQIQTQQSAPFRPSIPDVLVARVSTKESCAEAAANVVAKERSTLDASIVGLYIVCGDSTQVVAAGKMYGVGGIIHNVAYADDVVRVCVETIYDGDASVPFPTSEIQYVRDASSTFIAWPRHLVKPITDDSNHNARFPVGRLGEAEVAAEADPLGELMKTLFYVYKTPVEVPWEATQFGLPDVGAKFFITHVDLAEIISGDKCLNISILQLWTM

SEQ ID NO: 173993 - protein, 76 aa, Glycine max
  Coding DNA Sequence Number=SeqID_82308
MFVASFIIHTVDEEEAQIGADRSSANSNKSEIYKEEARNAAQKHKPKRVESVNADAEAFGDHWKIQIALCILKLKH

SEQ ID NO: 173994 - protein, 159 aa, Glycine max
  Coding DNA Sequence Number=SeqID_82309
MAPKKHSTKRSRRDAIGEGSNVASEFDSHRFRSAEHQQRFEAIKGWSFHRERRVQLREDEYTDFQEEIARRRWTPLVTPMAKFDPEIVLEFYANAWPTEEGVRNMRSWFWRKASSVRSARGGARPTISMRKPSPSCCAYRGRISPGTLQGGGCGSCAPA

SEQ ID NO: 173995 - protein, 59 aa, Glycine max
  Coding DNA Sequence Number=SeqID_82310
MTEFVCAEDDINLRVSTGLLAAIDKGVSMTEIVGAADKSEALAPMYPQGGTQTYVVLAN

SEQ ID NO: 173996 - protein, 272 aa, Glycine max
  Coding DNA Sequence Number=SeqID_82311
  Gene Ontology: Mol. function=argininosuccinate lyase activity; Cellular component=cytoplasm; Biological process=arginine biosynthetic process via ornithine
  Homolog annotation: Hit_ID=A7FD01; Match level="QueryCoverage=100%, HitCoverage=59%, E-value=1e-140, Identity=91%"; Hit description =Argininosuccinate lyase
  Pfam annotation: Domain name=Lyase_1; Domain location=1-223; Score =278.1; E_value=1.8e-80; Accession=PF00206.11; Description=Lyase
SDAEDIHSWVEQKLIEKVGDLGKKLHTGRSRNDQVATDLKLWCKQQVGDLHQAIVQLHQALVETAEANQDAVMPGYTHLQRAQPVTFAHWCLAYVEMLARDESRLQDTLKRLDVSPLGSGALAGTAYPIDREQLAGWLGFASATRNSLDSVSDRDHVLELLSNAAISMVHLSRFAEDLIFFNSGEAAFVELSDRVTSGSSLMPQKKNPDALELIRGKCGRVQGALTGMMMTLKGLPLAYNKDMQEDKEGLFDALDTWMDCLQMAALVLDGIQ

SEQ ID NO: 173997 - protein, 138 aa, Glycine max
  Coding DNA Sequence Number=SeqID_82312
  Homolog annotation: Hit_ID=Q6WAY4; Match level="QueryCoverage=84%, HitCoverage=21%, E-value=2e-10, Identity=33%"; Hit description =Putative uncharacterized protein
MGSSQTPSLKKRFYQVKVKSLGIASLKELGQLMGQLQRQAFRKAYGKIWDLTMAEVSMEAIASLAQYYDQPLRCFTFGDFQLTPTVEEFEEILGCPLGGRKPYLISRFYPSLARISKIVKISTQELDRGKQVENGVVG

SEQ ID NO: 173998 - protein, 128 aa, Glycine max
  Coding DNA Sequence Number=SeqID_82313
MAPRKLPAKRSRKDKAAEGTSAAPEYDSHRFRSAEHQQRFEAIKGWSFHRERRVQLRDDEYTDFQEEIARRRWTSLVTPMAMFDPDIVLEFYANAWPTQEGVRDMRSWVRVSGFLSMRMPSANSWDTL

SEQ ID NO: 173999 - protein, 94 aa, Glycine max
  Coding DNA Sequence Number=SeqID_82314
  Subcellular localization annotation: CTP_CleavageSite=16; ConfidenceScore=5.42e-01
RGVVRNGKSTPPTSARASVEVTLRVNTTPPALIVPLQGASLSPFWLRKCGEGRSVRASLLFRQLAKGGCVARRLSWVTPGFSHSRRCKTTATEL

SEQ ID NO: 174000 - protein, 114 aa, Glycine max
  Coding DNA Sequence Number=SeqID_82315
  Subcellular localization annotation: CTP_CleavageSite=68; ConfidenceScore=5.32e-01
MGWLQNHHLILSLLLHLPLPQQLLLLLRLLLLSSSGASSSSSVDCSSSMPLYESIVISRSSSILFYVVALMVASSTLHVSLSSAIRASLDTAPEAAAFPDVETMSGTCVPSNSL

SEQ ID NO: 174001 - protein, 75 aa, Glycine max
  Coding DNA Sequence Number=SeqID_82316
  Homolog annotation: Hit_ID=A6FJQ2; Match level="QueryCoverage=50%, HitCoverage=84%, E-value=3e-11, Identity=92%"; Hit description=50S ribosomal protein L5
MTVRPLTHAAPGDGHSLSMRKEKIPHQAPFAIQAAQLLGRAIGAGLFAITPAGERGMCCKAIKLGNARVFPVTTL

SEQ ID NO: 174002 - protein, 122 aa, Glycine max
  Coding DNA Sequence Number=SeqID_82317
  Subcellular localization annotation: CTP_CleavageSite=42; ConfidenceScore=5.08e-01
MVLILLIYHIFILSLSPHHSIKSNTYCSSSNHTAPKIKPNVRQGSRKYLQNIRLRQERGLRTIGRIELAYGRIEVKATRFLDLAQFLTKLHKISSTSSDMDNRSKEQLCACKVYVAGHLALG

SEQ ID NO: 174003 - protein, 33 aa, Glycine max
  Coding DNA Sequence Number=SeqID_82318
MQILQYSGWRKTWMQRIQIREIRGQRQEKKKLL

SEQ ID NO: 174004 - protein, 478 aa, Glycine max
  Coding DNA Sequence Number=SeqID_82319
  Gene Ontology: Biological process=intracellular signaling cascade
  Homolog annotation: Hit_ID=Q6H5G7; Match level="QueryCoverage=76%, HitCoverage=72%, E-value=3e-84, Identity=41%"; Hit description=Leaf senescence protein-like
  Pfam annotation: Domain name=DUF231; Domain location=281-469; Score =130.3; E_value=5.6e-36; Accession=PF03005.6; Description=Arabidopsis proteins of unknown function
MRRKRLTLKIRSKKRFSNKKLKLPYVSYALPPIVLFCFCVFFYCHFFTSSPANEPPHSISISNHSSLAISTELIPHSISITNHSSLSASPPPPPPPPVYEKPNDQKIVYEKPCDYTNGRWIRTKRNPLYNSTTCVNLKESRNCIANGRPDLGFLYWKWKPSECYLPRFEPNTFLQLISNKHVAFVGDSLSRNHLESLLCMLNTVTKPNGFSHQSFTRWLFPSHNATLSFYWSPFLVQGVERNNQGPRYNNYNKIHLDHANMRWEKDMDQMDMIVLSLGHWFLIPSVFYWDDKVIGCVNRPVSNCTTDIGFYGPIRRALRTALNSIIKKKVKKGNGIDVILRTYSPSHFEGAWDKGGICSKTEPYRAGERQLEGENAMIRRIQFEEVERAKARAKELVKAKPKAEKFKGFRLEVLDVTKLALLRPDGHPGAYMNPFPFAKGVSKHVQNDCVHWCLPGPIDTWNEIFLEMMKNMAQAAEE

SEQ ID NO: 174005 - protein, 476 aa, Glycine max
  Coding DNA Sequence Number=SeqID_82320
  Gene Ontology: Biological process=intracellular signaling cascade
  Homolog annotation: Hit_ID=Q67V91; Match level="QueryCoverage=73%, HitCoverage=76%, E-value=1e-118, Identity=55%"; Hit description=Leaf senescence protein-like
  Pfam annotation: Domain name=DUF231; Domain location=287-465; Score =185.7; E_value=1.2e-52; Accession=PF03005.6; Description=Arabidopsis proteins of unknown function
MGRNEDKVGIAMFYAKNTRKKENYKEKKNKKGKALKMGITNPFKDQSLSLIKRLLPWTLYALLPIVLLRLYFYPLPFPPSPETELPHSTPTTIISQSSLSDSTLPSSPEKEKTYEPPCDYFDGKWIRDRRGPLYNGTTCGTIKEGQNCITHGRPDSSYLYWRWKPSQCNLPRFEPQTFLQLISNKHIAFVGDSMARNQLESLLCMLSTASTPNLVYRNGEDNKFRKWHFPSHNVSVSLYWSPFLVQGVEKSNSGPNHNKLYLDHVDERWARDMDQMDLIVLSIGHWFLHPAVYYEGGSVLGCHYCPGLNYTEIGFYDVLRKGLRTTLNSIIDRRVGKGYGIDVIVTTFSPAHFEGEWDKAGACPKTKPYRNGEKQLEGMDADMRKIEIEEVEDAKTKANNFGGIIRLEALDVTKLALLRPDGHPGPYMYPFPFANGHQERVQNDCVHWCLPGPIDTWNEIFLEMMKKWGQHPRTEE

SEQ ID NO: 174006 - protein, 406 aa, Glycine max
  Coding DNA Sequence Number=SeqID_82321
  Gene Ontology: Biological process=intracellular signaling cascade
  Homolog annotation: Hit_ID=Q67V91; Match level="QueryCoverage=73%, HitCoverage=76%, E-value=1e-55, Identity=36%"; Hit description=Leaf senescence protein-like
  Pfam annotation: Domain name=DUF231; Domain location=216-397; Score =120.5; E_value=5e-33; Accession=PF03005.6; Description=Arabidopsis proteins of unknown function
MAMENGMVCSGVGIRQIDGERFSKKLLPSASYALPPIVLLCFSLYFYCLSFTSSPANEPPHSLSITNHSSLELHSISITNHSSLSSSPPPPVYEKPCDYTNGRWVRTKRGPLYNATNCPNMKEKQNCIANGRPDLGYLNWRWKPSECHLPRFDPNTFLQLISNKHVAFIGDSIQEPPTVPPLHVKHCYRTKWIKQRRWEKDIDQMDIIVLSLGHWFLVPSVIYWGDKVIGCLNRPVSNFSNCTTKIGFYGPIRRALRTSLNSIIKRKVKKGNGIDVIVRTYSPSHFEGAWDKGGICSKTKPYREGERQLEGEDAEIRRIQLEELERAKEKAKKFRRFRLEVLDVTKLALLRPDGHPGAYRNPFPFANGIPKSVQNDCVHWCLRGPIDTWNEVFLQMMKNMARTAKE

SEQ ID NO: 174007 - protein, 256 aa, Glycine max
  Coding DNA Sequence Number=SeqID_82322
  Gene Ontology: Mol. function=molecular_function; Cellular component =membrane; Biological process=auxin mediated signaling pathway
  Homolog annotation: Hit_ID=A7Q2G6; Match level="QueryCoverage=99%, HitCoverage=69%, E-value=5e-70, Identity=51%"; Hit description =Chromosome chr1 scaffold_46, whole genome shotgun sequence
  Pfam annotation: Domain name=DUF6; Domain location=101-230; Score =33.8; E_value=6.1e-07; Accession=PF00892.11; Description=Integral membrane protein DUF6
  Pfam annotation: Domain name=TPT; Domain location=92-230; Score= -37.0; E_value=0.085; Accession=PF03151.7; Description=Triose -phosphate Transporter family
  Pfam module annotation: Pfam domain module=DUF6::TPT; Domain location= 101-230::92-230
MAYVGIELSSPTLASAILNVIPAFTFVLALIFRMEEVHWRYFSSQAKVLGTIVSIGGAFVVILYKGPPIFRTHSSYTSNKLQFSAQPNWILGGIFLVADSFLSSMWYIYQASVAKKYPAVTVIVFFQFLFSTIQCGVFALIAVRDPTEWELKFDRGLSVILYQAIVATMLRYTLTTWCVHRAGPLFCAMFKPVGIIFTVSMSAIFLGENFGLGSLIGAVIIVIGFYAVLWGNSREENKIENLESSSHNAPLLQDRS

SEQ ID NO: 174008 - protein, 1290 aa, Glycine max
  Coding DNA Sequence Number=SeqID_82323
  Gene Ontology: Mol. function=nucleoside-triphosphatase activity; Cellular component=intrinsic to membrane; Biological process=innate immune response
  Homolog annotation: Hit_ID=A5B905; Match level="QueryCoverage=80%, HitCoverage=82%, E-value=0.0, Identity=39%"; Hit description =Putative uncharacterized protein
  Pfam annotation: Domain name=LRR_1; Domain location=624-645; Score =6.8; E_value=17; Accession=PF00560.24; Description=Leucine Rich Repeat
  Pfam annotation: Domain name=LRR_1; Domain location=671-692; Score =10.4; E_value=3.6; Accession=PF00560.24; Description=Leucine Rich Repeat
  Pfam annotation: Domain name=LRR_1; Domain location=694-716; Score =12.8; E_value=1.3; Accession=PF00560.24; Description=Leucine Rich Repeat
  Pfam annotation: Domain name=LRR_1; Domain location=718-740; Score =7.0; E_value=15; Accession=PF00560.24; Description=Leucine Rich Repeat
  Pfam annotation: Domain name=LRR_1; Domain location=741-763; Score =10.3; E_value=3.8; Accession=PF00560.24; Description=Leucine Rich Repeat
  Pfam annotation: Domain name=LRR_1; Domain location=765-786; Score =5.9; E_value=25; Accession=PF00560.24; Description=Leucine Rich Repeat
  Pfam annotation: Domain name=LRR_1; Domain location=788-810; Score =8.3; E_value=9.1; Accession=PF00560.24; Description=Leucine Rich Repeat
  Pfam annotation: Domain name=LRR_1; Domain location=811-833; Score =10.3; E_value=3.8; Accession=PF00560.24; Description=Leucine Rich Repeat
  Pfam annotation: Domain name=LRR_1; Domain location=835-856; Score =5.9; E_value=25; Accession=PF00560.24; Description=Leucine Rich Repeat
  Pfam annotation: Domain name=LRR_1; Domain location=858-880; Score =6.6; E_value=19; Accession=PF00560.24; Description=Leucine Rich Repeat
  Pfam annotation: Domain name=LRR_1; Domain location=881-903; Score =12.2; E_value=1.7; Accession=PF00560.24; Description=Leucine Rich Repeat
  Pfam annotation: Domain name=LRR_1; Domain location=905-926; Score =5.3; E_value=32; Accession=PF00560.24; Description=Leucine Rich Repeat
  Pfam annotation: Domain name=LRR_1; Domain location=928-950; Score =9.9; E_value=4.6; Accession=PF00560.24; Description=Leucine Rich Repeat
  Pfam annotation: Domain name=LRR_1; Domain location=952-974; Score =10.0; E_value=4.3; Accession=PF00560.24; Description=Leucine Rich Repeat
  Pfam annotation: Domain name=LRR_1; Domain location=976-997; Score =7.7; E_value=11; Accession=PF00560.24; Description=Leucine Rich Repeat
  Pfam annotation: Domain name=LRR_1; Domain location=999-1020; Score =12.9; E_value=1.2; Accession=PF00560.24; Description=Leucine Rich Repeat
  Pfam annotation: Domain name=LRR_3; Domain location=601-620; Score =17.6; E_value=0.048; Accession=PF07725.3; Description=Leucine Rich Repeat
  Pfam annotation: Domain name=NACHT; Domain location=215-358; Score= -28.1; E_value=0.0093; Accession=PF05729.3; Description=NACHT domain
  Pfam annotation: Domain name=NB-ARC; Domain location=177-454; Score =133.1; E_value=7.7e-37; Accession=PF00931.13; Description=NB-ARC domain
  Pfam annotation: Domain name=TIR; Domain location=20-152; Score =165.8; E_value=1.2e-46; Accession=PF01582.11; Description=TIR domain
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::LRR_3::NACHT::NB-ARC::TIR; Domain location =624-645::671-692::...
  Pfam module annotation: Domain location=694-716::718-740::741 -763::765-786::788-810::811-833::835-856::858-880::881-903::905 -926::928-950::952-974::976-997::999-1020::601-620::215-358::177 -454::20-152
MAGSSSSAAVSLLPVIRHDVFLNFRGEDTRDNFISHIYAELQRNKIETYIDYRLARGEEISPALHKAIEESMIYVVVFSQNYASSTWCLDELTKILNCKKRYGRVVIPVFYKVDPSIVRHQRETYAEEFVKYKHRFADNIDKVHAWKAALTEAAEIAGWDSQKTSPEATLVAEIVKDILTKLNSSSSCDHQEFVGIETHITQIKLLMKLETLDIRIIGIWGLGGIGKTTIAGQIYHQLASQFCSSSLVLNVPEEIERHGIQRTRSNYEKELVEGGISISSERLKRTKVLLFLDDVNDSGQLRDLIGGRGRFGQGSRIILTSRDMQVLKNAEADEIYEVKEMNDEESLKLFSIHAFHQNQPIETYKELSEKVLRYAKGIPLALQILGSLLYRKTEEVWKNQLQKLEKYPDSKIFNVLKLSYDGLDEEQKNIFLDIACFYRGYWEIFVAQQLESCGFSATIGMDVLKDKCLISILKGNVQMHDLIQEMGREIVRQECCLNPGKRSRLWKVEEIHQVLKNNEGTDAVQCILLDTYKINKVKLHSKTFEKMENLRMLHFFNSHVPWSESNVFLASSLKSLPDGLKILCWDGFPQRSLPQNYWPQNLVRLEMIRCHLEQLWEPDQKLPNLKWLDLRYSGKLIRIPDLYLSPDIEGILLTGCSKFEIFPEIKDTMENLAVLKLDGTAIKTLPSSLCRLVALEVLSLDSCASLETIPSSIGDLSKLCKLGLTYCESLETFPSSIFKLKLTKLDLSRCSKLRTFPEILEPAQTFAHVNLTGTAIKELPFSFGNLVHLQTLRLNMCTNLESLPNSIFKLKLTKLDLSRCSKLRTFPEILEPAQTFAHVNLTGTAIKELPFSFGNLVHLQTLRLNMCTDLESLPNSIVKLKLTELDLSGCSKLRTFPEILEPAQTFAHVYLTGTAIKELPFSFGNLVQLQTLHLNLCTDLESLPNSIVNLNLLSVLDCSGCAKLTEIPSDIGCLSLLRELSLGESRIVNLPESICNLSSLELLDLSECKKLECIPRLPAFLKQLLAFDCQSITTVMPLSNSLIQIPSNSQECNIFRFCFTNGQQLDPGARANIMDESRLRMTEDAYRSVFFCFPGSEVPHWLPFRCEGHSITIHRDSLDFCRNDRLIGFALCVVFQLPDTNDIKRKCGSFSYCLNYVSDHGKHILPNNDNLKSYFYWRDQERKLDQDQDHTFLWKYNLEFPEMSCMSRMLPRARSFTFEISPYYDDNILQPPSFLSIDRYFKSTVKVKKCGICPLYTKKKDDNNAGAGDYSGSVRFSKNGIEEPSGSNAA

SEQ ID NO: 174009 - protein, 61 aa, Glycine max
  Coding DNA Sequence Number=SeqID_82324
FYGVPSPQQGIRPPITGLHQEVLRPRKAQGETPEQPRDGRQRATDAPPPPLEFTSAHPQKG

SEQ ID NO: 174010 - protein, 186 aa, Glycine max
  Coding DNA Sequence Number=SeqID_82325
MSYADLLPSLLSNQMAMCVALKHKVQSLIDAGWLTFQEDSPNVRTNPISNHGGLAVNAVEEWESRGLSDNGDLCLMHPGASNDVVTCPIVEELLHCEERGRRCMHAVGPPPPLSKPKPLVIHFTRDITTQRPSGFQPSIAKAPVPFPYKSDKAVPWKYGVQGPNGRQDVSVIRVRNDIPFAKITKI

SEQ ID NO: 174011 - protein, 179 aa, Glycine max
  Coding DNA Sequence Number=SeqID_82326
MPHQPPGWKHEIKARLCIPCKGFILNAEGQPWKLLRKDLTTLAQTWSVFSYSNLVPTSHTSYLNMDRARLVYGLVTHMDMNIGALISGQISSIALSNSSLLGFPALITALCRARGVTSDSMTYQSLSLAINLAYIRKKCWNVDDLTVNFRGARKARARPADVPSSSTPPAPPGPSAQDF

SEQ ID NO: 174012 - protein, 63 aa, Glycine max
  Coding DNA Sequence Number=SeqID_82327
CNRQKGSIECGYYVVHWMSTIILGSFRNNWETYFNDVRPLEAERLKALRIQWAQYYLKVRNQT

SEQ ID NO: 174013 - protein, 103 aa, Glycine max
  Coding DNA Sequence Number=SeqID_82328
MTRGNPSDLQPFDTEIDRTFHRLVRHSVHPSHSVHSEHSVEGDSDFEHSTTNFYTENMAQPPPHERTLREIAAPDFTYESLCIQYPDEGVPYVLKTGLIHLLP

SEQ ID NO: 174014 - protein, 25 aa, Glycine max
  Coding DNA Sequence Number=SeqID_82329
MGLSSNFFRTLLKEASQGGELSYER

SEQ ID NO: 174015 - protein, 85 aa, Glycine max
  Coding DNA Sequence Number=SeqID_82330
GSIIDKIIQLKKGAKGIVIIQDGKTRESERATTSPYEESERSTAPPTGESGGSAASPAGESGGATVSLDGESEMIIRGGDGRTTF

SEQ ID NO: 174016 - protein, 116 aa, Glycine max
  Coding DNA Sequence Number=SeqID_82331
MGKAEKVQEKVKADMEAMKEKMATMMEAMMSMRKIMEANAVAVAATSTVAKVNPMPPSGLNQMNHPTSAMIWETHEIPHHNLADFEPCLGYATEGQAVGEMGKLDHLEERLRAIEG

SEQ ID NO: 174017 - protein, 42 aa, Glycine max
  Coding DNA Sequence Number=SeqID_82332
MEKKNKPEKIQAEGIILETAKMQIGTKTWKKENQRGATNNEV

SEQ ID NO: 174018 - protein, 63 aa, Glycine max
  Coding DNA Sequence Number=SeqID_82333
MTKARQKGVRKIPGGLNIFVLPSFPYLKGTEGEACHPARPGELGCFLQKAVPFGELLGRPKWA

SEQ ID NO: 174019 - protein, 152 aa, Glycine max
  Coding DNA Sequence Number=SeqID_82334
MAPKKHSTKRSRRDTAAEGSSAAPEFDSHRFRSVEHQQRFEAIKGWSFHRERRVQLKEDEYRDFQEEIARRHWTLLVIPMAKFNPEVVLEFYANAWPTEVGVRDMRSWVRGQWIPFDTDTLSQFLGDPLVLDEDQQCEFSQRRNRADGFDEE

SEQ ID NO: 174020 - protein, 153 aa, Glycine max
  Coding DNA Sequence Number=SeqID_82335
  Homolog annotation: Hit_ID=Q6WAY4; Match level="QueryCoverage=83%, HitCoverage=23%, E-value=4e-12, Identity=34%"; Hit description =Putative uncharacterized protein
MGSSQVPWLKNRFYRVTIKSLGVASLKELGQLMDQLQRQTFRKTYGKIWDLTMAEVSTEAIASLAQYYDQPLRCFTFGDFQLTPTVEEFEEILGCPLGGRKPYLFSGFYPSLARISKIVKISTQELDRGKQVENGVVGVPRKCLEAKARTLVR

SEQ ID NO: 174021 - protein, 109 aa, Glycine max
  Coding DNA Sequence Number=SeqID_82336
GLYALAFRGLLAFAFRGLHVLTFRGQHVLAFRGLYILTFRGLHAFTFRGLHVFALRTTRPHLQRATRPHLQRTTLPYHEDYTSSPSEDYTSSPSEDYTSSPLEDYMSSP

SEQ ID NO: 174022 - protein, 62 aa, Glycine max
  Coding DNA Sequence Number=SeqID_82337
MQHWMSGVALGETRHKRLMEACLWGFYGGWIFELQWGPLVVIFHHGDAAEDKGKEELMKHWA

SEQ ID NO: 174023 - protein, 209 aa, Glycine max
  Coding DNA Sequence Number=SeqID_82338
GEPLGTSTLVSRGLYILALRGLHVLTIRGLHTLTSRGLHVLALRGLHALTLGTSYPHRQRTTRPRLERTTHPHHQRAARPHLQRTTCPRLERATRPHLGYSVTLTVRGLHVLAFERTTRPHHQRAARPHLQRTIRPRLERATRPHLGLRSPHFHSWATPDIGGGPTVRAQPEREAITQLLCIPGQDFTRAAAKRRVRIMRTNMTTLTQI

SEQ ID NO: 174024 - protein, 143 aa, Glycine max
  Coding DNA Sequence Number=SeqID_82339
TLSSQSERPTGHYERKSSPWVKTRELQVHQGQQSTQAGSGQGQHVTEVLSLILPALYLGCAIWWDCLAQTPPSIPELQQLAEATQIGEPASSSAEVRQLVDHLSEQAREVASEASMERTPRALAMWMAGLTLAFAISIALAQK

SEQ ID NO: 174025 - protein, 416 aa, Glycine max
  Coding DNA Sequence Number=SeqID_82340
  Gene Ontology: Mol. function=transferase activity; Cellular component= membrane; Biological process=teichoic acid biosynthetic process
  Homolog annotation: Hit_ID=A8GFL8; Match level="QueryCoverage=71%, HitCoverage=89%, E-value=1e-141, Identity=83%"; Hit description =Glycosyl transferase family 2
  Pfam annotation: Domain name=Glycos_transf_2; Domain location=6-177; Score=137.7; E_value=3.2e-38; Accession=PF00535.17; Description =Glycosyl transferase
  Pfam annotation: Domain name=UPF0181; Domain location=336-387; Score =69.3; E_value=1.3e-17; Accession=PF03701.5; Description =Uncharacterised protein family (UPF0181)
  Pfam module annotation: Pfam domain module=Glycos_transf_2::UPF0181; Domain location=6-177::336-387
MSLMLSVIVPMHNAGELLEPFLASLLAQREQRLEVIIVNDGSTDGSGEIAHRYAAAHPHIRVIDQANAGVSNARNAGLAVARGKYVAFPDADDVLAPDMYSTLLEQAEQHQLDVMQCNGERYFTSQDELQPIFPEARLRTTDVITGVQWFERALKSRKFIHVVWLAIYRLDFIRQHRLYFEPGLHHQDIPWTTEVMFNAKRVKYLSTPLYRQRVHDKSISNRRRTGQANVDYQRHYMKIVEMLERLNRRYAGTVAIRPAFHWQITREALGICHSIRREPDPAAQSQITEEFYQRGIDRAIGAAITAARNRPEPQDVGIRRVSAYTPSPFCRRKRHMHAGMPLLSHAEQQEAADRIHQLMEQGMSSGEAIARVAQEIREKHQGAQVAVLFDDDDEDEQHEAVPEASRNDDAEEDEDY

SEQ ID NO: 174026 - protein, 84 aa, Glycine max
  Coding DNA Sequence Number=SeqID_82341
MGRWIWAFAAGQQQLWISHQGQSFEEKYQYAGRHLPFVWKCSGGCGPLIFQLYLDKRFVVGSYELDPGCRPPSNHTEVPFHSIL

SEQ ID NO: 174027 - protein, 223 aa, Glycine max
  Coding DNA Sequence Number=SeqID_82342
  Gene Ontology: Mol. function=methylcrotonoyl-CoA carboxylase activity; Cellular component=mitochondrial matrix; Biological process=metabolic process
  Homolog annotation: Hit_ID=Q42777; Match level="QueryCoverage=30%, HitCoverage=9%, E-value=2e-25, Identity=80%"; Hit description =Methylcrotonoyl-CoA carboxylase subunit alpha, mitochondrial precursor
MLGFPRALHAAPDAPNAFVHDVSALHDFLADTRRDDATVQVPVPKVLPPLPPPSDALPLGPNALDESASMKAKRIALQRKGAAAMIAAEESYCRICKCGENEGSEKAQKMLSCKSCGKLKKNILYTPGCSGGSSLLPIWYSTPPFRIHHQAKHRMEFEWDNEYGSGSSKIMKLTITYQPDGRYLIEVSNETNFSLFNYATNSPKTLTQDDIISFRQNIMDLLF

SEQ ID NO: 174028 - protein, 195 aa, Glycine max
  Coding DNA Sequence Number=SeqID_82343
  Homolog annotation: Hit_ID=A5AYU6; Match level="QueryCoverage=64%, HitCoverage=21%, E-value=2e-12, Identity=32%"; Hit description =Putative uncharacterized protein
  Pfam annotation: Domain name=zf-CCHC; Domain location=89-106; Score =24.7; E_value=0.00027; Accession=PF00098.14; Description=Zinc knuckle
MVAGNTTIEKPREEWSEEEKRLVQYNLKAKNIIASALGMDEYVRVSNCKSAKDMWDTLQVTHEGNGNPRNQRRSNFKPKKRAEDSSSTLRCYECNQPGHLRVNCPIFKKRIEKSEKKAFNEKNAKKAYITWDDNDMDLFEDSENEVVNLSLMAKSYESDEEVSLKKKWHIDSGCSKHMTGDASSSLISLPRKADM

SEQ ID NO: 174029 - protein, 120 aa, Glycine max
  Coding DNA Sequence Number=SeqID_82344
MAESSKKRKGSSSTTTAKELLETHPHQFLPPFHLLDHLHCFLQMINAKVFQNSALTEFMSLKLPDFPELVRVFYNNLKIQDGIIYSEVHSIPIIIDQSLFFPLTKLPSQGVHFEGTIVDD

SEQ ID NO: 174030 - protein, 169 aa, Glycine max
  Coding DNA Sequence Number=SeqID_82345
MVNVNLAIGGGSSLHKEKFHNYLGVVAREKIPIVRHSWKDVPKSQKNPIWVDNLDPSVKYGLDPQTREEFAANQKTPNWQKKGLTNSKNNDCPHLLSREGYDLLEKNLMEKTRKNKQQDAINIEDSTMIIDPPSPIARHVKWKMACTKRYGQMTSKATQEISNKFVSSC

SEQ ID NO: 174031 - protein, 216 aa, Glycine max
  Coding DNA Sequence Number=SeqID_82346
MDFEICPIMQKNAVELCNKFLMCAEKCLCIAGYGKGAERNEDKGYVGVQWYLEICRWGQETLGTSGLKNGHRKLKWPLVIDYQWGVINYTGEFGRPSKAMRGADSVAQFDSLLLHPEEPARTLQQSVEWILPTPTPYRLVEPVQVIKVSSSGAACGVRHWRQFGKHAATDPHGGRQGGGSRDREVPDAKKDVLYLTMLMRSYLVSWTARPRFLMIA

SEQ ID NO: 174032 - protein, 46 aa, Glycine max
  Coding DNA Sequence Number=SeqID_82347
MEASNFPYTWWSGPLRNDLYSLKAKGRSGEGRRPKWRRIKPPSGEG

SEQ ID NO: 174033 - protein, 36 aa, Glycine max
  Coding DNA Sequence Number=SeqID_82348
MDNSMKVGEDEWREREKRGTKFMPQIRTSFVFHLGL

SEQ ID NO: 174034 - protein, 222 aa, Glycine max
  Coding DNA Sequence Number=SeqID_82349
MSANDIIIDKQVFYVQDPCDERWSAVLHGKTIGVNLEDDDSTLNASHIPLSTHMPTINGEDEVDDIHGNRNAPSPSTSKRTRQATWLRSLFARPVGLVRPLVHVEPNTRKATGKDDDDETMCDKYGINKDKWNQLYESHRDPSWEGTSFVAQVEGTSTWVVVLRTREGTSLVDPFKWRVHPLGCSKRTREGTSLVDLWLVKDFTRLKEISRTVGCLGTGCRH

SEQ ID NO: 174035 - protein, 44 aa, Glycine max
  Coding DNA Sequence Number=SeqID_82350
MADGKLIEMKGRINLGLKGENDCGKAWAVQRRKMSDQSEGKSHF

SEQ ID NO: 174036 - protein, 142 aa, Glycine max
  Coding DNA Sequence Number=SeqID_82351
  Homolog annotation: Hit_ID=Q2HV31; Match level="QueryCoverage=44%, HitCoverage=10%, E-value=6e-15, Identity=68%"; Hit description =Prefoldin
MAQVQPINKRWNEVDNKVEANLKAIEEIKAATDMALRNTEMVDSAKVEVEGELRLIEEQCVKGGTYYPITVKRHLKKAELHIDLNPIFHERTKHIEFDCHFVQQKLLAKEISMGRSSSNHQPESDLNQAISIQDKELKPRWL

SEQ ID NO: 174037 - protein, 263 aa, Glycine max
  Coding DNA Sequence Number=SeqID_82352
  Gene Ontology: Mol. function=hydrolase activity, acting on carbon -nitrogen (but not peptide) bonds, in linear amidines; Biological process=metabolic process
  Homolog annotation: Hit_ID=A7NX19; Match level="QueryCoverage=67%, HitCoverage=46%, E-value=2e-65, Identity=68%"; Hit description =Chromosome chr5 scaffold_2, whole genome shotgun sequence
  Pfam annotation: Domain name=Peptidase_M20; Domain location=3-259; Score=-20.2; E_value=0.029; Accession=PF01546.19; Description =Peptidase family M20M25M40
MGFFNTHVDVTEIILGDKCLNISILQLWMMFMNDWRASLGYGSVYGFLEPQSIHHAKDKREECQQYIETWVKESHQQLYLGPYLNQNHVGLAPSELALAIERHVLDCGSIDNVGTAGILELHLGAINNIPNKCHLEIDTRDIDEERRNKVVDKIHQSAIKITKTRGVKFSHFRVINQDPLSLSNEAVMKAVETATKELNLTSKLMISRAYHDSLLMARLSPMGMIFIPWYKGYNHKPKEFATIEDMSNGVNVSALTLAKLSSQ

SEQ ID NO: 174038 - protein, 68 aa, Glycine max
  Coding DNA Sequence Number=SeqID_82353
MKLLRVQLKRNKIKGFLSYQKPIDSERWIFVGDGKSVELLMVNPLMQNCVVLSVELIILTQEHYGISA

SEQ ID NO: 174039 - protein, 48 aa, Glycine max
  Coding DNA Sequence Number=SeqID_82354
AKCKSLIGEKNAWDYVMQSYPARTLDRRLQVDWARDAREDPRVLMSLR

SEQ ID NO: 174040 - protein, 59 aa, Glycine max
  Coding DNA Sequence Number=SeqID_82355
IPVLDEGNTFSKNTLLRSSQLKIDLGARGLHGGTNNMELLKMFMRIFTCKTMKLGQQMY

SEQ ID NO: 174041 - protein, 108 aa, Glycine max
  Coding DNA Sequence Number=SeqID_82356
MKDKYIVQSLLKNFEKIKNKLVCTSFACMISTPQACGYVSMNYNQYIDVVYINEHILKAYSTQWWHLGNEATIPPSNDAWTLIPDPTTIRANGRPKSTRIRNEMDWVV

SEQ ID NO: 174042 - protein, 267 aa, Glycine max
  Coding DNA Sequence Number=SeqID_82357
VAVGIRPAAFILVVGDVDATGEGEAPIDDHQLAVGTQVQPRALERLQQLPWVEPDRFATGVEQRLQEAAGQGGRAYGIEQQAHLHAGLCTFHQRVTQGGSGMVRVEDVVLQMHVVACLCDGLKQRGVGRRGVHQPGHFGGAARRKPGRGLGDLGQLGACSMPDRARATAQTLPLHLLRAQQVVDEEAQVRQQRQRQDPAQRRHRLALLQHDPAGQREQVQQIGHRQDGTEVGNAVQPVAQGVEEGEHPPIIAAHATRWDPTSTRVPG

SEQ ID NO: 174043 - protein, 588 aa, Glycine max
  Coding DNA Sequence Number=SeqID_82358
  Gene Ontology: Mol. function=DNA topoisomerase (ATP-hydrolyzing) activity; Cellular component=chromosome; Biological process=DNA topological change
  Homolog annotation: Hit_ID=A1FVQ0; Match level="QueryCoverage=99%, HitCoverage=73%, E-value=0.0, Identity=82%"; Hit description=DNA gyrase, B subunit
  Pfam annotation: Domain name=DNA_gyraseB; Domain location=22-176; Score=148.9; E_value=1.4e-41; Accession=PF00204.16; Description=DNA gyrase B
  Pfam annotation: Domain name=DNA_gyraseB_C; Domain location=512-577; Score=156.5; E_value=7.1e-44; Accession=PF00986.12; Description=DNA gyrase B subunit, carboxyl terminus
  Pfam annotation: Domain name=Toprim; Domain location=203-315; Score =30.4; E_value=6.6e-06; Accession=PF01751.13; Description=Toprim domain
  Pfam module annotation: Pfam domain module=DNA_gyraseB::DNA_gyraseB _C::Toprim; Domain location=22-176::512-577::203-315
HQDRPADERGDGRRDDFHYEGGIRSFVEHLAQLKTPLHPNVISVTGEHNGFVVDVALQWTDSYQETMYCFTNNIPQKDGGTHLAGFRGALTRVLNKYIEQNGIAKQAKINLTGDDMREGMIAVLSVRCRTRASPARPRKSWSAPTCVRRWKMPSAIAGKIVDAARAREAARKARDLTRRKGALDIAGLPGKLADCQEKDPALSELFIVEGDSAGGSAKQGRNRKNQAVLPLRGKILNVERARFDRMLSSDQVGTLITALGTGIGRDEYNPDKLRYHKIIIMTDADVDGAHIRTLLLTFFYRQMPELIERGYVYIGLPPLYKIKQGKQELYLKDDPALDSYLASSAVENAALVPATGEPGIEGLALEKLLLAYAAALDSIERNAHRYDRNLLEALVDFVPMDLESLRAAGEGEGLDALAKRLNQGSLGSPRFTLELQEANDERPAAVLVTRRHMGEQHIQVLPMSAFESGELRAIHQASKLLHGLVREGATISRGAKSIEVDSFAKAQNWLLEEAKRGRQIQRFKGLGEMNPEQLWDTTVNPETRRLLQVRIEDAVAADQIFSTLMGDVVEPRRDFIEDNALKVANLDI

SEQ ID NO: 174044 - protein, 42 aa, Glycine max
  Coding DNA Sequence Number=SeqID_82359
MEEKPSTWEASLRSKEGRFLGKLEEESFHEKLERGYSHSSNS

SEQ ID NO: 174045 - protein, 50 aa, Glycine max
  Coding DNA Sequence Number=SeqID_82360
  Gene Ontology: Cellular component=integral to membrane
  Homolog annotation: Hit_ID=A8GII2; Match level="QueryCoverage=78%, HitCoverage=16%, E-value=2e-13, Identity=94%"; Hit description =Integral membrane protein TerC
MLALAFLILVGFTLMLESFQVHVPKGYIYFAMFFSMSIKTYLRRASPRVC

SEQ ID NO: 174046 - protein, 163 aa, Glycine max
  Coding DNA Sequence Number=SeqID_82361
GHVGAGDGGGAGATVGLQHVAVEGDGAFAQRVAVHARAQAAADQALDLQRAAALLATGRFTVTTGVGGARQHAVLGGDPAFALAAQEARHAVLDAGGAQHAGFTEAHQHRTFGVAGEAALDDDRAELVGLAAAGAGIGHGAGSVMAREYAATPAAFTGRARGL

SEQ ID NO: 174047 - protein, 160 aa, Glycine max
  Coding DNA Sequence Number=SeqID_82362
MPPTRHPLDPDKSNRALGFPALIMGLCQSFGVPVNPSKVIRPPITRAFIKKYCTPRQAQGDAHQVADTPPPPHHASPAGSLGMKRYLQHLVRHRSQQGQSSTPFVCPTPEQFAVEVAWPGDWPDAQAREEPAGSPGRMDEPRMDEDMTDLFDFLGGNGAT

SEQ ID NO: 174048 - protein, 29 aa, Glycine max
  Coding DNA Sequence Number=SeqID_82363
MDLLGETSFKAGDIEAHSSSMREISAQTC

SEQ ID NO: 174049 - protein, 164 aa, Glycine max
  Coding DNA Sequence Number=SeqID_82364
  Gene Ontology: Mol. function=motor activity; Cellular component=cell projection
  Homolog annotation: Hit_ID=UPI00016621D1; Match level="QueryCoverage =87%, HitCoverage=40%, E-value=2e-13, Identity=34%"; Hit description =UPI00016621D1 related cluster
MHDKGCMHLIPKYHDRPWGTSTHTIRGLHALTFTGLHVLAFGGLHVLAFRGLHALAFRGLHVLAFKGLRVLAFRGLHAFTFRGLHVLAYRGLHALAFRGLHVLAFRGLHVLAFRGLHVLAFKMLLALTIRGLHVLAFRRLHTLTFRGQHILTFRGLHALTFREL

SEQ ID NO: 174050 - protein, 56 aa, Glycine max
  Coding DNA Sequence Number=SeqID_82365
MVNSVLKGFNDNHRSKSKATAKWISIECNKQRGSIECGYYVMHWMSTIVLGSFKDN

SEQ ID NO: 174051 - protein, 173 aa, Glycine max
  Coding DNA Sequence Number=SeqID_82366
MMGTSKPYTGAIRGIVHEPQGGPLGNSTLTVKGLHVLAFRGLHTLTFRGLHILTFRGLHALTIRGLHVLPFRGLHALIFRGLYVLAFRGLHALAFRGLHVLTFRGLHLLAFRGLRALAFRGLHLLAFRGLHALAFRGLCVLALRGLQALALRGCKSSPSEDYTPSPLEHWGIL

SEQ ID NO: 174052 - protein, 166 aa, Glycine max
  Coding DNA Sequence Number=SeqID_82367
  Subcellular localization annotation: CTP_CleavageSite=38; ConfidenceScore=5.56e-01
MAESSKKRKGSSASASASRDHRSETNSASTAPIPPSLSSSTLFSSEEQQKWYSNLFSSRSIFDPKFIDMEFFSAETFHCVQAFQNLGLIPFMSLHLPVYPELVKAFYCNLEIQDSTLISEVFGIKMVIDQSLFHDLTQLSSDGVPFEGTLNDDWKFDFSAHDARQL

SEQ ID NO: 174053 - protein, 184 aa, Glycine max
  Coding DNA Sequence Number=SeqID_82368
MTAHCAMLQHSGVLAPVLASLALNVARIARALSRLASYNIPMNATNAIDQLAPQKWTETSPAERLRLLEEIRANMKKYGDDLALADSKMKNGILGAPLFSHPLSKVATVVPMASTVSAAILLYESILDGKMPQPLSVEKVSEDLYDIYVFPQERKDKLMYADQKSRIRVKGEPKQINPMEKPCP

SEQ ID NO: 174054 - protein, 76 aa, Glycine max
  Coding DNA Sequence Number=SeqID_82369
MVRGGDGQQQRWWRMIPFASSMILPFDEVLGNFNRWNRKRSENEEDWALRDVFWSSKPSGNRLQAVVIDYKLYVLV

SEQ ID NO: 174055 - protein, 50 aa, Glycine max
  Coding DNA Sequence Number=SeqID_82370
MADQQATKSKAKGRAPLKRIPVWPHKLTQALTNNDSRAGNINSVSRPSKD

SEQ ID NO: 174056 - protein, 95 aa, Glycine max
  Coding DNA Sequence Number=SeqID_82371
DCDVDITKGKDNEALEGPMTRGRLKQAQYVIETRLTYQGNPCGVYPDLSSFIGSGIYPDLSSFTGSGVYPDLSSFTGSGVIQTSVACIKRSAPTQ

SEQ ID NO: 174057 - protein, 125 aa, Glycine max
  Coding DNA Sequence Number=SeqID_82372
MDEIHYRRPLEDTVELLCTIGRTPNAILNLLEGPSIPTHDAVLYYNGRWNMPRQNNFVRYAFTGINPQYSKILKFEIIELKSDDDVLKVLVESFFWKQFVPIEILALFSKVVLENDDEVVTSLHV

SEQ ID NO: 174058 - protein, 20 aa, Glycine max
  Coding DNA Sequence Number=SeqID_82373
MAMVQTTGKRGFSLNPNPDN

SEQ ID NO: 174059 - protein, 159 aa, Glycine max
  Coding DNA Sequence Number=SeqID_82374
MEPKGMLSARIPLYSLSATIGLSAFSISIYLEEDNKRGDCGCERDNYNCGCGYQFVEGGTGLSLMQRLVVLWVAMHGWVWCLGDECGSLFMEVGVHVTATTNLVTLRRCYDSVCNLLNARGVDMDKAEVEINGKGTVDDAVDKPKVDDEVVGVEATRGR

SEQ ID NO: 174060 - protein, 161 aa, Glycine max
  Coding DNA Sequence Number=SeqID_82375
MEDGASKTKEEYIEESTCIELGLVNSLNRERHNVEQWRKVEFTKEEKKLGMAGREDSNSGIFQQQGFHDNNSANLEGRDTNEIDLDDLPYGTLMKASPVRANMVTGIRNEVKIGIFRRRIYYLDKGSITRKERENRRWKLNIAQVQKNFIDTTVEAVKQPY

SEQ ID NO: 174061 - protein, 131 aa, Glycine max
  Coding DNA Sequence Number=SeqID_82376
MKRTDATIKNLEVQIGQLAELVAEKPTKTFTVNIEMKPKEDCKEKRRKKEKEMRRKQESILQVNTPPHQLIVKEERHGKHEKALSVILSLISTTSLAIMWKVLPEYMSFMASLAKRRKCKEDVFYVTFMPP

SEQ ID NO: 174062 - protein, 307 aa, Glycine max
  Coding DNA Sequence Number=SeqID_82377
  Gene Ontology: Mol. function=nucleotide binding; Cellular component =intrinsic to membrane; Biological process=defense response
  Homolog annotation: Hit_ID=A2Q4E5; Match level="QueryCoverage=100%, HitCoverage=35%, E-value=1e-103, Identity=60%"; Hit description =Disease resistance protein
  Pfam annotation: Domain name=NB-ARC; Domain location=154-307; Score= -110.6; E_value=0.0032; Accession=PF00931.13; Description=NB-ARC domain
MAESFIFSIAESLITKLASHAFQEASRVVGLYDHLRDLKKTLSLVKAVLLDAEQKQEHNHELQEWLRQLKSVFYDAQDVLDEFECQTLRKQLLKAHGTIKDEVSHFFSSSNPLGFRSKMAQQIKDLSKRLDKVAADRHKFGLRIIDVDTRVVHRRDTSRMTHSRVSDSDVIGREHDKEKLIELLMQQNPNDDDKNLSVIPIVGIGGLGKTTLAKFVFNDERVDECFKLKMWVCVSDDFDIYQLFIKIINSANVADAPLPQQNLDMVDLEQLQNQLRNILAGQKFLLVLDDVWNDDRLKWVELRNLIK

SEQ ID NO: 174063 - protein, 613 aa, Glycine max
  Coding DNA Sequence Number=SeqID_82378
  Gene Ontology: Mol. function=nucleotide binding; Cellular component =intrinsic to membrane; Biological process=defense response
  Homolog annotation: Hit_ID=A2Q4E5; Match level="QueryCoverage=91%, HitCoverage=79%, E-value=1e-146, Identity=45%"; Hit description =Disease resistance protein
  Pfam annotation: Domain name=LRR_1; Domain location=444-466; Score =8.8; E_value=7.3; Accession=PF00560.24; Description=Leucine Rich Repeat
  Pfam annotation: Domain name=LRR_1; Domain location=522-544; Score =10.5; E_value=3.5; Accession=PF00560.24; Description=Leucine Rich Repeat
  Pfam annotation: Domain name=LRR_1; Domain location=546-568; Score =17.9; E_value=0.038; Accession=PF00560.24; Description=Leucine Rich Repeat
  Pfam annotation: Domain name=LRR_1; Domain location=570-596; Score =1.9; E_value=1.4e+02; Accession=PF00560.24; Description=Leucine Rich Repeat
  Pfam annotation: Domain name=NACHT; Domain location=70-229; Score= -28.0; E_value=0.0091; Accession=PF05729.3; Description=NACHT domain
  Pfam annotation: Domain name=NB-ARC; Domain location=27-348; Score =159.5; E_value=9.3e-45; Accession=PF00931.13; Description=NB-ARC domain
  Pfam module annotation: Pfam domain module=LRR_1::LRR_1::LRR_1::LRR _1::NACHT::NB-ARC; Domain location=444-466::522-544::546-568::570 -596::70-229::27-348
MAQLFLFSIAESLITNLLLMLSKKLLGRDTSRMTHSRVSDSDVIGREHDKEKIIELLMPQNPNDDDKSLSVNPIVGIGGLGKTTLAKFVFNDKRIDKCFTLKMWVCVSDDFDINQLIIKIINSANVADAPLPQQNLNMVDLELLQNQLRNILAGQKFLLVLDDVWNDDRVKWVELRNLIKVGGAAGSKILVTTRIDSIASMMGTVTSYKLRSLSPENSLSLFVKWAFKEGKEEKHPHLVNIGKEIVKKCRGVPLAVRTLGSLLFSKFEANEWEYDYEFSSVEVTRLWEALGVLAPPRKNETPEDVVKQYLDELLSRSFLQDFIDGGTICQFKIHDLVHDLALFVAEDECLVLNSHIQNIPENIRHLSFAEYNFLGNSFTSKSVAELEALPKGLRKLISLRHLYISTKQPVLPYSEIANLISLAQLSIGSSHNMESIFGGVKFPALKTLYVADCHSLKSLPLAVTNFPELETLIVKDCVNLDLDLWKDDHEEQNPKLKLKLVGFSRLPQLVALPQWLQETANSLQSLFIMNCDNLGMLPEWLSTMTNLKVLIISDCPKLTSLPDNIHHLTALEWLRIVGCPELCRKCQPHVAPLATPGRGSGMVKREKRGDHDV

SEQ ID NO: 174064 - protein, 175 aa, Glycine max
  Coding DNA Sequence Number=SeqID_82379
  Homolog annotation: Hit_ID=A7R0M2; Match level="QueryCoverage=26%, HitCoverage=3%, E-value=3e-07, Identity=63%"; Hit description =Chromosome chr10 scaffold_312, whole genome shotgun sequence
  Subcellular localization annotation: CTP_CleavageSite=64; ConfidenceScore=5.90e-01
MAPPPSIVAPTNHPPPPPRNSRPSNWSSSSPPARLKSRRNTPSNPSPSPSPSGSTSSSKTLPPPAATSQPPMSPLLLPPTASDMALHKPLLSALIPLGELPSARGRPAEVPDSSFSQLSDSLKGVCSFDDFKQRMGVYLSLPACKEIFHQINRVTKGCCAAEHVEADGGQVALGG

SEQ ID NO: 174065 - protein, 44 aa, Glycine max
  Coding DNA Sequence Number=SeqID_82380
MLKGQNCDEPLTTKGDNISDKVTLTMLEYLRSEQKTIEILEVRI

SEQ ID NO: 174066 - protein, 44 aa, Glycine max
  Coding DNA Sequence Number=SeqID_82381
ITPARQLYGPREVQQGLGVASSDYGPPSVLRGACRPQQGHQAPY

SEQ ID NO: 174067 - protein, 62 aa, Glycine max
  Coding DNA Sequence Number=SeqID_82382
MKVEILLPSINPEERKVPLATLSFQEYWQDLSVPFKEPEATFPPTMKGSLWTTSKAIEQGEV

SEQ ID NO: 174068 - protein, 108 aa, Glycine max
  Coding DNA Sequence Number=SeqID_82383
MWAIINQYKEKLNLASTHEQRSKDEYAKVSVLQAKREAREKVIDSLNREAIMWMDRFSFTLNGSQELPRLLAKAKAMMDMYSAPEEVHGLLDYCQHMIDLMAHIIRNH

SEQ ID NO: 174069 - protein, 271 aa, Glycine max
  Coding DNA Sequence Number=SeqID_82384
  Gene Ontology: Biological process=transposition, DNA-mediated
  Homolog annotation: Hit_ID=Q6UUU1; Match level="QueryCoverage=22%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDTVNNHGESIEENSAPVRDQFTQDKDEVDTDCMIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 174070 - protein, 57 aa, Glycine max
  Coding DNA Sequence Number=SeqID_82385
MKFFDMSGVERKHYCAIRKVQPTWTFQGVPTEGGAFWWKEPSSPQRARRQPPPSFPL

SEQ ID NO: 174071 - protein, 187 aa, Glycine max
  Coding DNA Sequence Number=SeqID_82386
MSLDLRAMNLRDHPDGMGKPALFKVHQFMVVFNPADLHVDGGELGFVPRCEGGFSTEDRADLKYLLHAAGNSHLLVELRRLREEGRGVEVFDGENFSSIEFLQPGGSTSSRAAATAVELQFALYWRNSEEARTDRPSQQLRSLNGEWDAPCSGALSAAGVVVTRSVTATLASADVRRCFCRYAPPRQ

SEQ ID NO: 174072 - protein, 137 aa, Glycine max
  Coding DNA Sequence Number=SeqID_82387
  Homolog annotation: Hit_ID=A0PAV3; Match level="QueryCoverage=27%, HitCoverage=17%, E-value=5e-07, Identity=76%"; Hit description =Restriction endonuclease
MVKVGTSYVPINVSFSPKVGPGLPGINRDTRIYLFCEVIFRHSCPSCSATDGVGFPSHDVVKRRPVNCNTTHYRANWSSTAVAAALELVDPPGCRNSIWMDHGNGRKLMDAFYANYNIKLIDTVDLEGGPGTSFCSL

SEQ ID NO: 174073 - protein, 113 aa, Glycine max
  Coding DNA Sequence Number=SeqID_82388
  Homolog annotation: Hit_ID=Q5CDC4; Match level="QueryCoverage=37%, HitCoverage=32%, E-value=8e-16, Identity=100%"; Hit description =LacOPZ-alpha peptide from pUC9
MSNLNLDEDDDHDDDDYLESNSYVEESLDEDDSVDGISDTDDEVTDIPQPVRIVHPVEAYRYRRPRGGARYQLLFPLVRVNFELGVIMVIAVSCVKLLSAHNSTQHTSRKHKV

SEQ ID NO: 174074 - protein, 94 aa, Glycine max
  Coding DNA Sequence Number=SeqID_82389
MATTEALERETKKARKEEHGMILKDQLKAYLRSKRNLSQQLSEAERNMWVIIDKYKEKLNLATAHEKRLKDKYTKISAEREARERIIYSFTERQ

SEQ ID NO: 174075 - protein, 305 aa, Glycine max
  Coding DNA Sequence Number=SeqID_82390
  Gene Ontology: Biological process=transposition, DNA-mediated
  Homolog annotation: Hit_ID=Q6UUU1; Match level="QueryCoverage=19%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSMWRHCTGDGTDLQCPTWGGGTTVGRVVPGSTPHLLDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 174076 - protein, 211 aa, Glycine max
  Coding DNA Sequence Number=SeqID_82391
  Homolog annotation: Hit_ID=UPI00006A2D9E; Match level="QueryCoverage =91%, HitCoverage=85%, E-value=6e-16, Identity=18%"; Hit description =UPI00006A2D9E related cluster
MSSPSKGYTPSPSEDYTSSPSEGYTPSPSEDYTPLPSSGLHVLGFRGLHVLTFRGLHALTFRGLHVLAFRGLHVCFTLGGLHVLALEGYTGLRALTFRGLHVLAFRGLHVLTFRELHVLPFRGLHALAFIGLHALTFRGLHVLAFKGLHALTFRGLHVLAFRGLHALTFRGLHALAFVGLHVLGFRGLHVLTFRGLHALTFRGPGLTRPRL

SEQ ID NO: 174077 - protein, 87 aa, Glycine max
  Coding DNA Sequence Number=SeqID_82392
MAYSSSCASSIQTRSGPIEGDVLWMQPKHVSEHVWNGEADRKLHIRRAVPTYQGEEQIPEAIVPLLRQCGFYWIIKMGYLKINAALI

SEQ ID NO: 174078 - protein, 97 aa, Glycine max
  Coding DNA Sequence Number=SeqID_82393
LSEYVSLSQSLCFCVVALSAPYALSECCYFHKNIHSRNILPERNFNLLVTEYNEFHWELIKRNWHKALTQFMDGHIDVALVKEFYSNLYDPEDKSPK

SEQ ID NO: 174079 - protein, 126 aa, Glycine max
  Coding DNA Sequence Number=SeqID_82394
MQSPPAKVSVGLCRPDVGIAPTKTPSGPEEVQQGPEVSSSGYGPLSALQGARSPQQGSCPQNTVDPEKSNGVLGLPALITGLCRFYGVPVAPSKVIRPPINQAFIKKYCAPRQAQGETPQQHWDGR

SEQ ID NO: 174080 - protein, 221 aa, Glycine max
  Coding DNA Sequence Number=SeqID_82395
  Homolog annotation: Hit_ID=A0ST23; Match level="QueryCoverage=11%, HitCoverage=51%, E-value=7e-07, Identity=100%"; Hit description =Putative reverse transcriptase
  Subcellular localization annotation: CTP_CleavageSite=42; ConfidenceScore=5.15e-01
GTSYVPINVSFSPKVGPGLPAVPPVQLLTGWCVTAKAPPDISAGKCSGHAARRVPFAIQAAQLLGRAIGAGLFAITPAGERGMCCKAIKLGNARVFPEFDFYEPAALYGSNSSDGITSCNIVDGGKCDSDHNGSCQKGYQNFLVSDQAYRYRRPRGGARYQLLFPLVRVNFELGVIMVIAVSFGKPVVPAALMNRPTRGERRFAYWALAECILAYYVGTDE

SEQ ID NO: 174081 - protein, 20 aa, Glycine max
  Coding DNA Sequence Number=SeqID_82396
MDEEKVKAIREWPALENANE

SEQ ID NO: 174082 - protein, 135 aa, Glycine max
  Coding DNA Sequence Number=SeqID_82397
  Subcellular localization annotation: CTP_CleavageSite=15; ConfidenceScore=5.03e-01
MATPPSSPPPPPPTEAASQSSSTLKPAGADRPAVHVDPATGKAEGPHNKKFRTYLGIVTHDKVDVAYENWKQIEFDIPKAFDIRKKKKILQTMRERWRQFKSNLTSKWALAADKDSVDDTVCEKYNISKEKWGIL

SEQ ID NO: 174083 - protein, 169 aa, Glycine max
  Coding DNA Sequence Number=SeqID_82398
MTLTYKNRRITRPFRLARFGDDADAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSTPVGGGGWGIISGPVEGRGGYEIWGRR

SEQ ID NO: 174084 - protein, 106 aa, Glycine max
  Coding DNA Sequence Number=SeqID_82399
MLVKKDMMEKIHLFFQRFWTGLMAFKPLLVKGLTLWNYKWICASMRWSQESPRSCHHQKGGDCRSKLHDESRLIQRSFDDNKGDDKKLKDQEQFMITKMMISRIKE

SEQ ID NO: 174085 - protein, 84 aa, Glycine max
  Coding DNA Sequence Number=SeqID_82400
MGIAPIKTPSGPEEVQQGPGVSSSGYGPLSALQGARSPQQGLCPECLSPPARSSGPPTNQAFIKKYCAPRQAQGETPQQHWDGR

SEQ ID NO: 174086 - protein, 162 aa, Glycine max
  Coding DNA Sequence Number=SeqID_82401
  Homolog annotation: Hit_ID=A5C8I0; Match level="QueryCoverage=40%, HitCoverage=14%, E-value=3e-09, Identity=46%"; Hit description =Putative uncharacterized protein
  Pfam annotation: Domain name=zf-CCHC; Domain location=138-155; Score =17.6; E_value=0.0033; Accession=PF00098.14; Description=Zinc knuckle
MASSNPLFPEGNSIHRPPIFNGEGYHYWKTRMQIFIEVIDLNIWEAIELGPHIPSIVDEHEMELQRLNQNEENDKKKIIIALKASSSIQEEKEEEDSDDEEYFSFFVKKFQKFIKKRRIDRRQNFNNGRKSQDDSQVLRCYKCNQIGYIKANCPSNEEWSEK

SEQ ID NO: 174087 - protein, 68 aa, Glycine max
  Coding DNA Sequence Number=SeqID_82402
MGTTKGTQNELKKFDFGNLPVEDQRTTKNDEEWWKIFATSLTEMSRKRYGNALAWIFFTETIFLTNFM

SEQ ID NO: 174088 - protein, 94 aa, Glycine max
  Coding DNA Sequence Number=SeqID_82403
  Subcellular localization annotation: CTP_CleavageSite=39; ConfidenceScore=5.19e-01
MSGRSSTRQFPSQKLGGHGHTKSNPLGESSSYIATTWPSCLSYPNFVRGPLFDGMHPLLDRFEKSKESIVARFVKFRNMPEIKRKHFYTIRKVS

SEQ ID NO: 174089 - protein, 89 aa, Glycine max
  Coding DNA Sequence Number=SeqID_82404
  Subcellular localization annotation: CTP_CleavageSite=47; ConfidenceScore=5.57e-01
MDINGQKRLKSWSAKRSNCSKQTLWAQCASTAKRSFSALNVTRESVRAQESRLCAKREISLLRETFVFSQTQRMTGAEPKSTISPLSAT

SEQ ID NO: 174090 - protein, 182 aa, Glycine max
  Coding DNA Sequence Number=SeqID_82405
MAKARQKGVRKELTGLRPKNDEERSRTVENLREIAHGNVTEAPRLGFSSRKQFFSLISSDSRITKRAEHFFPSLLPLFIGKWGRSLPPSSPIASFRSNRLLEEFSGRPKWVWLVFAPPFLLNTLPFSFLVIFFRNVTKLYEFRNDACFLSVMLRNLTDYVIIPFFAFRNVTELYRLRINTSV

SEQ ID NO: 174091 - protein, 156 aa, Glycine max
  Coding DNA Sequence Number=SeqID_82406
MEAMKEKMATMMEAMMSMKKMMEVNAAIVVAASIAIEVDPAPPSGLNQINHPTSDIVGQGSKELGSTCDPHFTHEAPHHNLVDFEPCHGHATKGQAVGGVPLPNTLEGPQFRPQPLYFAVRRIPPVIAEKGKLDHIEERLRAIENVLSEDGGVRER

SEQ ID NO: 174092 - protein, 126 aa, Glycine max
  Coding DNA Sequence Number=SeqID_82407
MPSKVILMMPKNQELSKFQRFKNLVSRIKIQDSRIIKIKIQESTEDSIKIRYILCGTSRGYIYLGIIILRTREGTSIVDQFKWRVHPLGYSKRTREGTSLVDLWLVKDSTMLNRNLKNRRLLGDWM

SEQ ID NO: 174093 - protein, 106 aa, Glycine max
  Coding DNA Sequence Number=SeqID_82408
MDSSSRHLKIPFRPCSSIPHKPLLCQNEGDLVWISKHKASNGALGQTPTSLHERAESISGFTKEHHLEIPTMPMCPGFSVGSIRHAMVVPKSEKMQRQDETNKKQA

SEQ ID NO: 174094 - protein, 45 aa, Glycine max
  Coding DNA Sequence Number=SeqID_82409
MAVVFEGGVLWLSEWRRKKDDWRHHFKEKMSQTQAHHHRKPWIRA

SEQ ID NO: 174095 - protein, 413 aa, Glycine max
  Coding DNA Sequence Number=SeqID_82410
MWCYEWKKSEALRVGRPNMDLVFMMFGMLNCLDVVEAWRDCWGPGVERNEDKGYVGVRELSEGGQLGMVGVCVICGCGELTSTIARPPPSTTLVPGDMSRGSGDLGDVRRAPGSQPIKEQRPQSKETCVVAGQLLRNGTGMLKGPLVIDYQCCVIDYTEEQATAQFIHDRVEMKCLEGAWETLEGNARCRFRGTIRFTTTSLVYPEEPARMLQRTVEWILPTPTPYRLVEPVQVIEVTSSEEDPEEDPEELPPEPAVDALDFLEGDEDPLPEVDSPEDVVSASEADSTEDSGPGEMATMDTVVELHSPKMGFINTVFESEVRSRSMEAEAENNDVKKEENNNDNNNNNNNNNNNESDNKIRNSSEGLSKPKRQMKMSFQLEMLEKAYVGQEGVVGIEAAKGSGVAGFSSRGAQ

SEQ ID NO: 174096 - protein, 332 aa, Glycine max
  Coding DNA Sequence Number=SeqID_82411
  Gene Ontology: Mol. function=protein serine/threonine kinase activity; Cellular component=Golgi apparatus; Biological process =protein amino acid phosphorylation
  Homolog annotation: Hit_ID=A2Z9D5; Match level="QueryCoverage=36%, HitCoverage=19%, E-value=5e-44, Identity=66%"; Hit description =Putative uncharacterized protein
  Pfam annotation: Domain name=Arf; Domain location=141-301; Score =93.2; E_value=8.4e-25; Accession=PF00025.12; Description=ADP -ribosylation factor family
  Pfam annotation: Domain name=MMR_HSR1; Domain location=158-243; Score= -12.6; E_value=0.015; Accession=PF01926.14; Description=GTPase of unknown function
  Pfam annotation: Domain name=Pkinase; Domain location=1-180; Score= -12.1; E_value=6.7e-08; Accession=PF00069.16; Description=Protein kinase domain
  Pfam annotation: Domain name=Pkinase_Tyr; Domain location=4-177; Score=-95.0; E_value=1.4e-06; Accession=PF07714.8; Description =Protein tyrosine kinase
  Pfam module annotation: Pfam domain module=Arf::MMR_HSR1::Pkinase::Pki nase_Tyr; Domain location=141-301::158-243::1-180::4-177
MSRTSDAMTEEAKEDQGNLDDIQREAQMMSLIEHPNVVRAYCSFMVKRSLWVVMAFMAQGSCLHLMKAAYPEGFKEASIGSILKETLKVLEYLHRHDHIHRDVKARNIHLDDNGKVKLADFGVSTCMIAPEVLQPGTEATMGLTVSPLLRLFYARKEIRILMVGLDVAGKPTILYKLKLGEIVTTTIPTIGFNVETVEYKNVSFTVWDVGGQDKNTQGLIFVVDSNDRERILEARDEAEMVKDSFEHDCGAEDWIAIGDGKGNMAIIGVVNDDCTPTIRLCFTWVAKIERQLLGTYWCKSLGCRAREPPQCERPAKKTLGTHGEEDTSSERT

SEQ ID NO: 174097 - protein, 76 aa, Glycine max
  Coding DNA Sequence Number=SeqID_82412
MEFFIQSIDPDAWNPIVKGTCIPIKEVNGGFVPIEWDEMKDDDKRKNLGTKDHNDQGIQGLGVNVDGSSLQKIACI

SEQ ID NO: 174098 - protein, 226 aa, Glycine max
  Coding DNA Sequence Number=SeqID_82413
  Gene Ontology: Mol. function=microtubule motor activity; Cellular component=microtubule associated complex; Biological process =microtubule-based movement
  Homolog annotation: Hit_ID=A7P7W1; Match level="QueryCoverage=69%, HitCoverage=16%, E-value=1e-42, Identity=60%"; Hit description =Chromosome chr3 scaffold_8, whole genome shotgun sequence
  Pfam annotation: Domain name=Kinesin; Domain location=61-203; Score= -198.9; E_value=0.042; Accession=PF00225.14; Description=Kinesin motor domain
MTSVYNSDGGGRSMTSSRGHSESVYYDYGNPSPVEFGMDKEVITEPVDSSRARDSISVTIQFRPLREYHRGDEIMWYADGDKIVRNEYNRATAYAFDRVFGPHTNSDEVYEVAAKPVVKAAMESFWYCLVILWLRGDQYSPGIIPLAIKDVFSIIQDVIIIGSFLCHDSDSTGTALHWAVRFGRNLYFILGRREYQCKEREQEGQIKPPIPTQLVKHYKLLAAFKE

SEQ ID NO: 174099 - protein, 152 aa, Glycine max
  Coding DNA Sequence Number=SeqID_82414
  Homolog annotation: Hit_ID=A5B6M9; Match level="QueryCoverage=76%, HitCoverage=29%, E-value=8e-08, Identity=32%"; Hit description =Putative uncharacterized protein
  Subcellular localization annotation: CTP_CleavageSite=69; ConfidenceScore=5.25e-01
MEDLLHISIQVERQLKAKSNSKFSSTSSWKSNWRNKKSLTKSKDEAMFKKSFSAPRGVGHIASQCPNKRAMIFLDNGDMESKSSSDDEMPPLEDCNDVDVAIPVNGDVLVTRCALNLLKDKLTNAPLLCLPNFVKAFEIECDASSVGIGVVQ

SEQ ID NO: 174100 - protein, 282 aa, Glycine max
  Coding DNA Sequence Number=SeqID_82415
  Gene Ontology: Mol. function=hydrolase activity, acting on ester bonds; Biological process=lipid metabolic process
  Homolog annotation: Hit_ID=A7QLH4; Match level="QueryCoverage=58%, HitCoverage=48%, E-value=1e-32, Identity=41%"; Hit description =Chromosome undetermined scaffold_119, whole genome shotgun sequence
MVAGNATIEKTREEWTEDERRLVHYNLKAKNIITFALGMDEYFRVSNCKSAKNMWDTLQVTHEESNDVEYGNFYISDDVGTDVVSCAFYIVLQKAMMLNMGTSTSVVTNDVEYENFYIGGDIGTDDLPGFMESLVKQMSVNLKRIHSLGIKKVAVGLLQPIGCFPVLNVIFCRTNCIGLLNVISKDHNKMLLKAVQEPNKEAAVKSVFITLDLYNSFLSAIETMQKKRAEKSTLMNPLQPCCEGNKLEDSCGSVDDEGSKKYSLCENPKLSFFWDTLHPSQN

SEQ ID NO: 174101 - protein, 247 aa, Glycine max
  Coding DNA Sequence Number=SeqID_82416
  Pfam annotation: Domain name=Transposase_23; Domain location=139-209; Score=-3.8; E_value=0.0031; Accession=PF03017.5; Description =TNP1ENSPM transposase
MEEASQSRSTDTIIDPPSPIKRHMKWKMASTKKTTQMTSQAAKEIADKIGSFVAHGRQDILTASIGRPEHPGRVRATGAGVTIEQYFGPAPRTSRMSSSMASEYLEQLTQQIRDQLEESITQKVTQQLITKENCVDPSGNDPDKCGLYIDENPPQLVALGRLYEGSTTIHNIPLLHDQVKVGVKEVRDTEAPIFVPTEEVKLVGQALNTFLAWPTHLIKCLSEQLFLKPLRVMWDATVFGVYNDNFP

SEQ ID NO: 174102 - protein, 67 aa, Glycine max
  Coding DNA Sequence Number=SeqID_82417
MKFSRNISLLCRNVPFCGRARARLTGALSKGGKMRGVATNIYLWKTSEKLKETGLNENSKFGSCIYV

SEQ ID NO: 174103 - protein, 48 aa, Glycine max
  Coding DNA Sequence Number=SeqID_82418
MRGTMHEPQVNLGADHKFSPGRLKTRKGSLGKIREEQCKQHMHEVGQQ

SEQ ID NO: 174104 - protein, 123 aa, Glycine max
  Coding DNA Sequence Number=SeqID_82419
MNEKVKVILWMNAHLEPKLLNARKTMNFWQPNPITSLESPSNSFSYFSYDSNAYALIFEKLDVVEAMLSKFILMMPKTQVKNQESSKFQESKSRSIKASFKNQRVIQSRIKIQVKNQEKTQLR

SEQ ID NO: 174105 - protein, 98 aa, Glycine max
  Coding DNA Sequence Number=SeqID_82420
MIEISPEKHPYSPILRFVNRWIVFKFCLDIPKIRFYSLTIGILKIINFGLPLSEKGALSAIPTEGNCAERPKAALSPTLAERKCAECPEGPLSESCRL

SEQ ID NO: 174106 - protein, 117 aa, Glycine max
  Coding DNA Sequence Number=SeqID_82421
MTPVNRKAGTGERTREPPGGNACPGDPLVQSGRHRGGAPIRRNSESYHNSADAPCSLFFCHMKHVHWNTLRYQCQHSKPVYTSSLAAPIRKAASIARALADSKQLARQVSRMAKRAA

SEQ ID NO: 174107 - protein, 194 aa, Glycine max
  Coding DNA Sequence Number=SeqID_82422
RAGRGPLEVHRRGDSGRIRVGRGRGLRRHGAVHGQRLRRAVAGAADTIGGAGVAPDHRLVGRGLVQLVGHHGRRVAGSGALHVARGEGGAGAGASAQAHRVGRGVGAGHVDRGGVVQRGIEHAVAAETEIIRADGAVRGDGQRHRHVGRGLGPRRFGPGRDRRQGESQSRRAQGQAFHESLPRNTAALSDLREE

SEQ ID NO: 174108 - protein, 123 aa, Glycine max
  Coding DNA Sequence Number=SeqID_82423
MPISPYGRVMPTRHPVDPEEPNRALGFPALVSGLCQSYRVPVPPARSCHRDIGIAPARHPVDPEKSNGVLGFPALVGAGQGITVVGNRRTATISRVHLSSSTKRLERCLRHMVDQQATKSKAK

SEQ ID NO: 174109 - protein, 191 aa, Glycine max
  Coding DNA Sequence Number=SeqID_82424
  Homolog annotation: Hit_ID=Q6UUU1; Match level="QueryCoverage=37%, HitCoverage=46%, E-value=8e-19, Identity=71%"; Hit description =Putative uncharacterized protein
  Subcellular localization annotation: CTP_CleavageSite=42; ConfidenceScore=5.14e-01
WNSYVPINVSFSPKVGPGLPAVPPVQLLTGWCVTAKAPPDISAGKCSGHAARRVPFAIQAAQLLGRAIGAGLFAITPAGERGMCCKAIKLVGKPVVPAALMNRPTRGERRFAYWALAECILAYYVGTDEGVSEVLHVAGEKRLHRCVSRICDTGYIPLPRSLTRYARSFDCGERKWLTNGRRFPGRCQEDT

SEQ ID NO: 174110 - protein, 56 aa, Glycine max
  Coding DNA Sequence Number=SeqID_82425
MEIYVVFRADYICQALTREHAETNVLFCPLCQPDASEPVDTRRFTSSSAQTTSVNH

SEQ ID NO: 174111 - protein, 276 aa, Glycine max
  Coding DNA Sequence Number=SeqID_82426
  Homolog annotation: Hit_ID=A6UKX4; Match level="QueryCoverage=87%, HitCoverage=34%, E-value=1e-120, Identity=83%"; Hit description =Putative uncharacterized protein
MLHRPNAISGAAVRSPDWFKSATRWTQLTFAEDDPAKYDPEFWIDVFKRTKSNAVCLSAGGYIAYYPSEIPLHYVSSFIGDTDPFGTIVEGARKLGMHVMARVDPHAIHEDAALAHPEWVAINQDGSPREHWAFPGIYVTDALGSYNRDFTTDVIREVVTKYDVDAVFANRWQGHGVSYSDDNRIRFRQETGFDLPMRPDATDPAWQAWAAWRRRILTELVVYWDETVKSIRPHASFIPNMSETLPNPVRGPPGATRCGGWLVCWTERQTHSWNVP

SEQ ID NO: 174112 - protein, 78 aa, Glycine max
  Coding DNA Sequence Number=SeqID_82427
MRDDKRSLYVIGIGVNYGVGLGGKFLITLELAPKWALPAGQVVVGARAWGASLWMGAGALGCTGAELEESPTRAEKLG

SEQ ID NO: 174113 - protein, 327 aa, Glycine max
  Coding DNA Sequence Number=SeqID_82428
  Homolog annotation: Hit_ID=Q6UUU1; Match level="QueryCoverage=18%, HitCoverage=40%, E-value=5e-18, Identity=78%"; Hit description =Putative uncharacterized protein
MVKSWNLLRADQRLIFAKKLAPGLSRYQQGHQDFILFLRSDLPSQWLLFLSAVPPVQLLTGWCVTAKAPPDISAGKCSGRVPFAIQAAQLLGRAIGAGLFAITPAGERGMCCKAIKLGNARVFPVTTLANWSSTRGGGRSRTSGSPGLQEFDLEPDLLDAFQSLQSEMCLKHELRDGMIRLCESFSDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 174114 - protein, 67 aa, Glycine max
  Coding DNA Sequence Number=SeqID_82429
  Subcellular localization annotation: CTP_CleavageSite=39; ConfidenceScore=5.44e-01
MSPPPLGPLNHSQTQLTLSGRFPFPTLVFADLHTTKSLKLSRIWTSLSLSRTEDMQEFLKKMAKLPL

SEQ ID NO: 174115 - protein, 189 aa, Glycine max
  Coding DNA Sequence Number=SeqID_82430
  Homolog annotation: Hit_ID=A0ST23; Match level="QueryCoverage=22%, HitCoverage=87%, E-value=2e-08, Identity=72%"; Hit description =Putative reverse transcriptase
VPPVQLLTGWCVTAKAPPDISAGKCSGHAARRVPFAIQAAQLLGRAIGAGLFAITPAGERGMCCKAIKLGNARVFPGELELHRGGGRSRTSGSPGLQEFDDVVPLGCDPMLQQQASNTPMNQIKLIDTVDLEGGPVGKPVVPAALMNRPTRGERRFAYWALAECILAYYVGTDEGVSEVLHVAGEKRLH

SEQ ID NO: 174116 - protein, 113 aa, Glycine max
  Coding DNA Sequence Number=SeqID_82431
  Homolog annotation: Hit_ID=A5BP71; Match level="QueryCoverage=66%, HitCoverage=19%, E-value=6e-10, Identity=44%"; Hit description =Putative uncharacterized protein
  Pfam annotation: Domain name=zf-CCHC; Domain location=86-103; Score =14.1; E_value=0.011; Accession=PF00098.14; Description=Zinc knuckle
MTSTPQACGYVSLNYYQYIDVVYTNEHILKAYSAHWWPLGNEAAIPPSNDAWTLIPDPTTIRAKGQPKSTRIRNQMDWVEPSEHRQKCSRCGAEGHNKRCCPMQSERGSCSNH

SEQ ID NO: 174117 - protein, 31 aa, Glycine max
  Coding DNA Sequence Number=SeqID_82432
FPVPMMYGTRRTISSVYHLTRLEYGIDQPEE

SEQ ID NO: 174118 - protein, 176 aa, Glycine max
  Coding DNA Sequence Number=SeqID_82433
  Homolog annotation: Hit_ID=Q8GEG1; Match level="QueryCoverage=57%, HitCoverage=75%, E-value=1e-51, Identity=92%"; Hit description =Putative uncharacterized protein
MTVKTSDTCSSRRRSQLVCKRMPGADKPVRARQRMRKEKIPHQAPFAIQAAQLLGRAIGAGLFAITPAGERGMCCKAIKLGSGPLTSITKIDAQVRGGETRQDYKDTRRFPLEAPSCALLFRPCRLPDTCPPFSLREAWRFLIAHAVGISVRCRSFAPSWAVCTKPPFSPTGAPYP

SEQ ID NO: 174119 - protein, 196 aa, Glycine max
  Coding DNA Sequence Number=SeqID_82434
MTLTYKNRRITRPFRLARFGDDADAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPLEGPHFVCFHLLGASMMRCCRTRFKTHTILKVLVSLVWLPTFLNFRWVPSSNS

SEQ ID NO: 174120 - protein, 114 aa, Glycine max
  Coding DNA Sequence Number=SeqID_82435
MAQQIPPTGAKYTEHSAEIYRGRHGYAPRTYRRKGQTNNGEGGRGKGCSVLLLGKIEPDNENDEVVVGIRDAVDVDDDVEELWKMDRARILLKTPWPVLIQHTVRVHIQGEVFT

SEQ ID NO: 174121 - protein, 42 aa, Glycine max
  Coding DNA Sequence Number=SeqID_82436
MAKTQATGLQMRLKMKGRKESLFPARATHKGSECPLIQPGCS

SEQ ID NO: 174122 - protein, 139 aa, Glycine max
  Coding DNA Sequence Number=SeqID_82437
MEWKRYFSKLEVEHFQWACPWYHSQDMVFSCGNFPNVSLMRPRGCVAYTPTVAFRQLKWTQGVPNVEELRDREIGNLKDECADAHESSTCAKKARKNAPSMMMELQDKVKAMEREMAKIKKEKEDPKIKIVFKRKDWSA

SEQ ID NO: 174123 - protein, 125 aa, Glycine max
  Coding DNA Sequence Number=SeqID_82438
  Subcellular localization annotation: CTP_CleavageSite=73; ConfidenceScore=5.03e-01
MANPNCQGFHHRGPSGYNQGGNFSQGQGWRSHHGNNFNKDQGGPSIRPSNQGPNMYERTTKLEDTLTQFMQVSLSNHKSTEFAIKNLEVQVDQLAKQLVERSTGSFVANTKKNPKEECKTILTRS

SEQ ID NO: 174124 - protein, 82 aa, Glycine max
  Coding DNA Sequence Number=SeqID_82439
MELWNENTDIVELGLTLLAQASLPLPIRIMLFSLCAFLGYSTAHKGYVSVGNDFGMHYNYDKPLQATEFWMTPIPVKEDKSE

SEQ ID NO: 174125 - protein, 44 aa, Glycine max
  Coding DNA Sequence Number=SeqID_82440
MGYEVLVSCAEEFDGNENKKRKEFCRKKMMVVKPLEMELCSKKS

SEQ ID NO: 174126 - protein, 133 aa, Glycine max
  Coding DNA Sequence Number=SeqID_82441
MTKSKGKDPLEGLGGPMTRAMMMMRIMKLAKYRLKAQVEKGEGPNEDTTKGKDHEALEGPMSRDILKRAQHSDEDTTKGVPVEPNSDLSRLIPCGVTVTYLPSLEVASLSVNNPVSNVPPRKIHVIWYQSFGS

SEQ ID NO: 174127 - protein, 166 aa, Glycine max
  Coding DNA Sequence Number=SeqID_82442
  Pfam annotation: Domain name=zf-CCHC; Domain location=57-74; Score =17.1; E_value=0.0039; Accession=PF00098.14; Description=Zinc knuckle
MKESDGLDNYDGSTDDEVALMPKKFKQIKKKKENFQHSSRREDFRFKKKNKEENNEIICFKCRKPGHMKDDLDNEKSNSSDNKQAKICLMANTDDKVYVKTSSKSDTSSSASSNDEEDMPYDVLLQSCHMISLQCKKFKEKFKAFASENTKLRKSNENLKKKRFRL

SEQ ID NO: 174128 - protein, 411 aa, Glycine max
  Coding DNA Sequence Number=SeqID_82443
  Gene Ontology: Mol. function=nucleotide binding; Cellular component =intracellular; Biological process=intein-mediated protein splicing
  Homolog annotation: Hit_ID=A7PWD3; Match level="QueryCoverage=100%, HitCoverage=65%, E-value=0.0, Identity=81%"; Hit description =Chromosome chr8 scaffold_34, whole genome shotgun sequence
  Pfam annotation: Domain name=EFG_C; Domain location=188-281; Score =88.4; E_value=2.2e-23; Accession=PF00679.15; Description=Elongation factor G C-terminus
  Pfam annotation: Domain name=GTP_EFTU_D2; Domain location=12-82; Score=52.9; E_value=1.1e-12; Accession=PF03144.16; Description =Elongation factor Tu domain 2
  Pfam module annotation: Pfam domain module=EFG_C::GTP_EFTU_D2; Domain location=188-281::12-82
MVTNIEYDEHKGRIAIGRVQAGVLEKGLDVRVCTSDDSCRYGRVTELYVYDKFNRVPANKVEAGDICAVCGITDIQIGETIADKVSGKPLPSIKVEEPTVKMSFSINTSPFVGREGKYVTSRNLRDRLYRELERNLAMKVEDGETADTFVVSGRGTLHITILIENMRREGYEFMVGPPKVINKKVDEKLLEPYEELLQIATVEVPEEHMGAVVELLGKRRGQMFDMQGVGLEGTTLLKYKIPTRGLLGLRNSILTASRGTAILNTVFDSYGPWAGEISTRDQGSLVAFEDGTSTSYAISSSQERGQMFIGPGVDVYKGQIVGIHQRPGDLSLNVCKKKAATNIRSNKEQTGFSEYVWFMYPRLTTLLILDTPLDYSLDDCIEYIQEDELVEVTPASIRMSKNPKITNKKTR

SEQ ID NO: 174129 - protein, 112 aa, Glycine max
  Coding DNA Sequence Number=SeqID_82444
MFSKKEGMMRIMKLAKYRLKAQVEKDEGPSGEGQSPRVEKDEGPNNPCGVYPDLSSFTGSGVYPDLSSFIGSGVYPDLSSFTGSGVYPDLSSFTGSGVIQISVTCIKRSAPT

SEQ ID NO: 174130 - protein, 398 aa, Glycine max
  Coding DNA Sequence Number=SeqID_82445
  Homolog annotation: Hit_ID=A2Q3D2; Match level="QueryCoverage=32%, HitCoverage=24%, E-value=3e-14, Identity=36%"; Hit description =Putative non-LTR retroelement reverse transcriptase, related
MADTFIGEISLQQVQPHREDNWIWKHDQSGHYSSKSGLVRDRLPTRMNLTRRQVMLNNTMCPFCGLKEEEAQHLFFNCSSTLPLWWESLFWANLSTAMPQNPRDHFLQHTIATAEVKNLTRWKCWWISLTWSIWNHRNKIVFQNHTFNGSRLLDDAVLLLWTWVKNMEKDFAAIAIAWFCVYTRTNYSATLTCIFLVPLNRHGKSSKAVTNDTEDIPEDSSAKRVVFSLLLSWPERKKPESSTQEKNSLKDNKRKREKKFETDKPGQKGSFKTTSNDGLRLPKRSRYSNDKNPNVGRPEESEKGKKSWNNSFSGGGGKRKTKVTSTAKDKAASHVPIGSSKIMKLAKYRLKAQVEKDEDPSGEGQSPQWRRMKAQVEKDEGPEAEALPRLLIVVEGPN

SEQ ID NO: 174131 - protein, 86 aa, Glycine max
  Coding DNA Sequence Number=SeqID_82446
MMLSDATKSDSDEDITKSKGKDPLEGLGGPMTRDKARKAKEALQQVLSILFEYKPKFQGEKSKGPIGNLGISLLGDQMVADLMAVG

SEQ ID NO: 174132 - protein, 44 aa, Glycine max
  Coding DNA Sequence Number=SeqID_82447
MAKTQATGLQMRIRLKMKGRKESLFSARATHKGCESPLIQPGCS

SEQ ID NO: 174133 - protein, 46 aa, Glycine max
  Coding DNA Sequence Number=SeqID_82448
MIEDDGKWIQKQEGTEGAERELEEGIWESEGVEAETGGDRSGLRQK

SEQ ID NO: 174134 - protein, 357 aa, Glycine max
  Coding DNA Sequence Number=SeqID_82449
  Homolog annotation: Hit_ID=A5AZT5; Match level="QueryCoverage=93%, HitCoverage=27%, E-value=1e-11, Identity=24%"; Hit description =Putative uncharacterized protein
MDNTSAVFEIKSILHDLRQGESSVTKILMKFVEESLEPSDEDKARNKGKEPLEELGGPMARARTKKAKEALQQVLTMLFEFRPKLQVEKLRIVNCIMFQEEIVAASWLTDEDMFKSKGKDPLEGLGGPMSRARARKAKEALQQVLSILFEYKPKFQGEKSKGPIGNLGISLLGDQMVADLLAVGGKKVGGNSCWEHPLRARQWQQEDTSLNHHKRKTGASVIIARGQATPRKHAGSFMENLQKPGSSKARKEEATQPLTINKLSYSPCPYNYTVWIADGTHSKVGKTIGNAEECVGLYLLQVEKPEELKNHSYVAATVPSSDNSIMLWHYRLGHPNFMCPRVHVHVVSGVRVGVGAS

SEQ ID NO: 174135 - protein, 112 aa, Glycine max
  Coding DNA Sequence Number=SeqID_82450
MAPTRHPLDPDKSNRALGFPALITGLFQSFGVPVAPSKYLRHLVRQQAANHRAHVQTHDCLYQLSLSLQSQGFTSFPCPAEAPAEAPDEADEAREDEEMTDLLDFLGGSGAT

SEQ ID NO: 174136 - protein, 186 aa, Glycine max
  Coding DNA Sequence Number=SeqID_82451
LYFNGRVYEDNDGVIFEGSKKAIQIKRGISFNALKRKLEIRFLVSGKYVALQICDDEDVETMIESFQQQQQMSVLELYVEKDVAGGSMFHAANSVTSCGRNVSHYESELPKNISNLHVDEDDDDDDDDYLASNSYVEESFDEDDSDDGISHTDDEVTDIVEPVSIVHPSEGVPEIQNPFWNDAMPL

SEQ ID NO: 174137 - protein, 98 aa, Glycine max
  Coding DNA Sequence Number=SeqID_82452
MHVCILVEKTPRLFQVSQVIQNYVGARASLLSTAPLFVIMTQELVARGDTLQLSAPRHSVTPSVIDEQRPMWSSAPFPEMSASSGGDFFKSHKLSRTT

SEQ ID NO: 174138 - protein, 147 aa, Glycine max
  Coding DNA Sequence Number=SeqID_82453
  Gene Ontology: Mol. function=metalloendopeptidase activity; Cellular component=membrane; Biological process=proteolysis
  Homolog annotation: Hit_ID=A8GIW0; Match level="QueryCoverage=100%, HitCoverage=58%, E-value=6e-72, Identity=91%"; Hit description =Peptidase M48 Ste24p precursor
  Pfam annotation: Domain name=Peptidase_M48; Domain location=1-144; Score=32.5; E_value=1.8e-08; Accession=PF01435.9; Description =Peptidase family M48
MANGCIRVYSGLMDMMNDNEVEGVLGHEMGHVALGHTRKAMQVAYGTVALRTAASSAGGVIGSLSQSQLADIGEKLVSAQFSQKQESEADDYSFDLLKKRGIDPNGLATSFEKLAQMEAGRQSSMFDDHPSSQARAQHIRDRIAAEK

SEQ ID NO: 174139 - protein, 246 aa, Glycine max
  Coding DNA Sequence Number=SeqID_82454
  Homolog annotation: Hit_ID=UPI0000ECBAF8; Match level="QueryCoverage =16%, HitCoverage=48%, E-value=4e-16, Identity=100%"; Hit description= UPI0000ECBAF8 related cluster
RELGESATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTRSVAHEKGSGQYKCKNKEFFRRDTGTRKCGCPFRLRGKPVRVGERWIVKLICGPIRWNRRPAGMQAWHWPSFYNVVTGKTLALPNLIALQHIPLSPAGVIAKRPAPIALPNSCAA

SEQ ID NO: 174140 - protein, 386 aa, Glycine max
  Coding DNA Sequence Number=SeqID_82455
  Gene Ontology: Mol. function=ATPase activity, coupled to transmembrane movement of substances; Cellular component=integral to membrane; Biological process=proteolysis
  Homolog annotation: Hit_ID=Q7WBM7; Match level="QueryCoverage=100%, HitCoverage=53%, E-value=0.0, Identity=87%"; Hit description =Probable ABC transporter
  Pfam annotation: Domain name=ABC_tran; Domain location=178-362; Score= 184.7; E_value=2.3e-52; Accession=PF00005.18; Description=ABC transporter
MASFQASSQRNATLVEALTGLEAVKTLNAQGAIQRNWERSTEFIAQTGGKLKLISSSTVGFVQAVQQLVSIAVVIIGVYLAQDSALSMGGIIAASMIAGRCLAPLGQVAGLLMQYQNARTSLGSIDNYMKLPIERPAEAEFLHRPVFHGGLEFRDVSFTYPGSTQPVLKKVSFKLKPGEKVGIIGRIGSGKTTLEKLALALFQPTEGAVLLDGVDVRQIDPADVRRAIGHVPQDPLLFYGSLKHNLAMGAPYADDASILAAANMAGVTEFANLHPNGFYMLIGERGESLSGGQRQSVAVARALINDPPILLLDEPSSNMDHQSEAQLRRRLGEASANKTILLVTHRTALLELVDRLIVIDNGHIVADGPKEQVVEALRQGRVGRGS

SEQ ID NO: 174141 - protein, 71 aa, Glycine max; identical to SEQ ID NO: 111537
  Coding DNA Sequence Number=SeqID_82456
  Subcellular localization annotation: CTP_CleavageSite=26; ConfidenceScore=5.14e-01

SEQ ID NO: 174142 - protein, 31 aa, Glycine max
  Coding DNA Sequence Number=SeqID_82457
MFAYSLFAKHKPHAKRISVHALSRESQALSA

SEQ ID NO: 174143 - protein, 89 aa, Glycine max
  Coding DNA Sequence Number=SeqID_82458
MVITFDEDMTKSKGKDPLEGLGGPMTRAIARKAKEALQQVLSILFEYKPKFQGEKSKVASAYLGDQMVADLLAVGGDFWLPTISVTLSH

SEQ ID NO: 174144 - protein, 148 aa, Glycine max
  Coding DNA Sequence Number=SeqID_82459
MPKSSPNMHVNQEVSTRVKPRLLCKQSIGQSTPNKINNDGSKSHQCVYTRESVRATTSPDDESERLAISPTGEAGGSAVSSAGVSGGAVASYDDASEMIIRGGDKGTTSSLGERGGFTTGVHGSADIGSTRAGAGFEGAASLVLTNGS

SEQ ID NO: 174145 - protein, 317 aa, Glycine max
  Coding DNA Sequence Number=SeqID_82460
  Gene Ontology: Mol. function=motor activity; Cellular component=cell projection
  Homolog annotation: Hit_ID=UPI00016621D1; Match level="QueryCoverage =80%, HitCoverage=39%, E-value=3e-18, Identity=32%"; Hit description =UPI00016621D1 related cluster
  Subcellular localization annotation: CTP_CleavageSite=37; ConfidenceScore=5.01e-01
GLHALTFRGLDVLAFRGLHVLAFKGLHNLAFRGLPVLAFRGLRILTLGTRTLTFRGLHVLTFRGRHTLTFKGLHALAFRGLHVLTFRGLHVLTFRGLHVLTLGTRTLTFTGLHILAFRGRHTLTFRGLHALAFRGLNILTFRGLHALAFVGLHVLAFGGLHALTFRGLHVLLFRGLNALAFRGLHALTFRGLHTLAFRGLHILLFRGLHVLAFRGLDVLTFRGLRALTFRGLYVLPLKGLHVLAFGGLHALTFRGLHVLPFRVLHVLAFRGLHAVAFRGLHVVVLKGRHVLDFGELHAPSRLEGYASSLSVGSTSAP

SEQ ID NO: 174146 - protein, 108 aa, Glycine max
  Coding DNA Sequence Number=SeqID_82461
MVCVGCIRVIPLWEKRLEDLSRRYHDHLVGDEGWHEVLLTPRWALPAGRGGVGAGAWGFPSGWAWERLVVRALSWKSPRREPRSSGDVAHIGGYRERSAAAWPMQALK

SEQ ID NO: 174147 - protein, 71 aa, Glycine max
  Coding DNA Sequence Number=SeqID_82462
  Homolog annotation: Hit_ID=Q8H6W2; Match level="QueryCoverage=74%, HitCoverage=56%, E-value=3e-08, Identity=54%"; Hit description=Gag -protease polyprotein-like protein
MASANFLFPEGNSINRPPIFNGEGYHYWKTRMQIFIEAIDLNIWEAIEIGPYVCTHHSRWKHINRHNNRKT

SEQ ID NO: 174148 - protein, 150 aa, Glycine max
  Coding DNA Sequence Number=SeqID_82463
MASNSQQFNARNGAIILRGVHEVAMDSSSSTENKKFEGKLDALVNLVTQLAMNQKSAPVARIFVLLYSNLESMSNLKLNAANIYNRPPQQQNQQQQNNYDISSNIYNPGWRNHPNLKWTSPPQQQQHVPPFQNAAGPSKPYVPPPIQQQQ

SEQ ID NO: 174149 - protein, 69 aa, Glycine max
  Coding DNA Sequence Number=SeqID_82464
MGVQIATRPTWALQKIPPEGCCFWRKQPGSPGKSKPRHFRNVFREEFREDFRPFFDVLHSFFIVLRSST

SEQ ID NO: 174150 - protein, 70 aa, Glycine max
  Coding DNA Sequence Number=SeqID_82465
  Subcellular localization annotation: CTP_CleavageSite=57; ConfidenceScore=5.10e-01
MGKWLRRNSPQRGPEETPQQKGPVPPPSLIVIFSGAPSTSSTSRPLEDGHSTKRGVSSSGRMSIRTFRKR

SEQ ID NO: 174151 - protein, 128 aa, Glycine max
  Coding DNA Sequence Number=SeqID_82466
MERSFLLDPHYHLPYILCDLGQSQVDLWPRKGRGKRSEAPTTSAPPETLAPSSSTAPLPPTQTPVIPPTSTSEEETSIDQILEPSSAPIPDDAIPSAPVTEPEQPIQESSVAPALDLNEDQPQDEQDI

SEQ ID NO: 174152 - protein, 151 aa, Glycine max
  Coding DNA Sequence Number=SeqID_82467
  Gene Ontology: Mol. function=chitin binding; Cellular component =extracellular region; Biological process=chitin metabolic process
  Homolog annotation: Hit_ID=UPI00006A17C9; Match level="QueryCoverage =59%, HitCoverage=100%, E-value=6e-10, Identity=32%"; Hit description= UPI00006A17C9 related cluster
  Subcellular localization annotation: CTP_CleavageSite=35; ConfidenceScore=5.06e-01
VMLVRMIRTRHFAAARVKSCPSMQSSWAIASLSVYARTVGCLPISGGQRTLNSLKIWIWSPLKVRTRSPLKARACSPLKFRTCRPLKARVCSPLKARACSPLKFRTCHPLKVRACSPLKVRTCRPLKARACSPLKVRACSPLKGRTCSPLK

SEQ ID NO: 174153 - protein, 158 aa, Glycine max
  Coding DNA Sequence Number=SeqID_82468
MTPSTEDVKKAMQGLFAVLQLSMWGWFHTFFSKKVGPSIRYKEGRIEILSSCEGCPNVPLMGTRVTTTRGYSKEFARHVMRREERTESLGESSNGIIGGYHKWLRVRTQGLDWLPNLKTVRDDEVKASEESDEVQALKAELERAWVVEEKFKSIAIKV

SEQ ID NO: 174154 - protein, 81 aa, Glycine max
  Coding DNA Sequence Number=SeqID_82469
MALIKFSAIAGEQCPKCITRGNPSDLQPFDPEIDRTFHKLVRHHLVPFEHPEHSVIGDFEHPDLEHYNFEHSDFEHSENMA

SEQ ID NO: 174155 - protein, 117 aa, Glycine max
  Coding DNA Sequence Number=SeqID_82470
MSHHSSSINGKGTSHQDPISRILDELSSLKLWKGKLERKEKEKEREGIGHILDLTPIREKQRKPQEDNINLPYFHGKDNLEATLDWEIRVEQQLKRKSTSNFMALTLIQRKTKVKAS

SEQ ID NO: 174156 - protein, 49 aa, Glycine max
  Coding DNA Sequence Number=SeqID_82471
MEDCLEGPLLGNHGTQLQTQKAIMEHSSRLKSGGHVNDNAIHSRGSGKG

SEQ ID NO: 174157 - protein, 391 aa, Glycine max
  Coding DNA Sequence Number=SeqID_82472
MSYFGVIEKIWELDYSQFRVPVFKCKIMGTLPRSPLHSDGHSEAMSRRSRQSTRLRWLTLRTLDHPIPTVNVDPTTGKGLGPHKEKFHNYIGVLAREKIPIVHSNWKDVPESLKDLAKFDIQEAPNAKKVMSTVAARWRQFKCSLTTKFVKKAQEIQKYNHCPYLLSRGGYDFLEKKLLDKKRKKRQQKAILTENTPLIDDPPSPIERHVKWKLARIKRYQQMTSQATQEISNKIELKEAIKIELSQRQSQYSPSIKANIQVLGARKSTKGSNAETAVNPSGEEHVAHVMLTMGFDAQVSLPMSEIQYVRPALDTFISWPTHVVNLVSHEISPKKLVEPIQRSDDVATDDPLDDLIKSLFMNEWSSSVGHGLVYGFLEPQSIHNATDRRVE

SEQ ID NO: 174158 - protein, 71 aa, Glycine max
  Coding DNA Sequence Number=SeqID_82473
MDSCCMRFVLSEDLGNVNPRVTSTLAACARQGDYDRVSYFLTNGTTLHFRVESSACIILSIIDLNYGKVDD

SEQ ID NO: 174159 - protein, 95 aa, Glycine max
  Coding DNA Sequence Number=SeqID_82474
MAVEWRRGRVERRRHFKEKMSLEEAHHHRRPWIRAWRKKEMNEGRGREEHEILCSKRDLKSEMKMLLIPHDVSSIGACRPRIFFINEFRFFLEDE

SEQ ID NO: 174160 - protein, 116 aa, Glycine max
  Coding DNA Sequence Number=SeqID_82475
  Homolog annotation: Hit_ID=A7QWW8; Match level="QueryCoverage=44%, HitCoverage=3%, E-value=6e-08, Identity=50%"; Hit description =Chromosome chr13 scaffold_210, whole genome shotgun sequence
MPSFITDFQLFGLEHSGQQSQRKHSKVQAQWKGKASLRKAQPLYASISSEVLWLDIQEFAMVKYKKLNSTSVPLAIADQTRSSASMNPKSALFFRPLLTQNRWYIFLNREVGLVIL

SEQ ID NO: 174161 - protein, 87 aa, Glycine max
  Coding DNA Sequence Number=SeqID_82476
MAPRKLPSKRSRKDATEEGYSAAPQVDTDFDEHRFRSIDHQQRFEEEIAHRCWAPLVTHMAKFDLEIVMELYANAWPTEEGVRDMRS

SEQ ID NO: 174162 - protein, 141 aa, Glycine max
  Coding DNA Sequence Number=SeqID_82477
  Homolog annotation: Hit_ID=A5AEB7; Match level="QueryCoverage=100%, HitCoverage=15%, E-value=4e-23, Identity=36%"; Hit description =Putative uncharacterized protein
  Pfam annotation: Domain name=zf-CCHC; Domain location=116-133; Score =22.5; E_value=0.00059; Accession=PF00098.14; Description=Zinc knuckle
MDIDYAIRKDEPPGITETSTPDAVDLYEKWERSNRLSVMFIKINIFTSIRSSIDQHEKLKGIRGVHDHIMSMRDIVAQLKALEGERVNLTVHGKKKGDQPKNKGKIPAQPVIKKESKCFLCKKKGHMKKNCLKIKSWTDKK

SEQ ID NO: 174163 - protein, 155 aa, Glycine max
  Coding DNA Sequence Number=SeqID_82478
  Gene Ontology: Mol. function=small conjugating protein ligase activity; Cellular component=cytosol; Biological process=regulation of protein metabolic process
  Homolog annotation: Hit_ID=P35132; Match level="QueryCoverage=87%, HitCoverage=84%, E-value=5e-66, Identity=88%"; Hit description=SUMO -conjugating enzyme UBC9
  Pfam annotation: Domain name=UQ_con; Domain location=10-149; Score =203.3; E_value=5.9e-58; Accession=PF00179.17; Description=Ubiquitin -conjugating enzyme
MTRGFYFPTLYVLEGKGREGPVHEDMFHWQATIMGPPDSPYAGGVFLVTIHFPPDYPFKPPKVAFRTKVFHPNINSNGSICLDILKEQWSPALTISKVTWCLDKLAQSVLLSICSLLTDPNPDDPLVPEIAHMYKTDRNKYESTARSWTQKYAMG

SEQ ID NO: 174164 - protein, 142 aa, Glycine max
  Coding DNA Sequence Number=SeqID_82479
MAAEWRRKKKRRRHFKEKMSLEEAHHHRRSWIRAWRKKEMNEGGGREEHEILYSKKALKSEIWFSPLIQDQVQDSPLSVLRCHEASHEPEIYPKAHENPMAISCIFGPIFLESSIQCHCGVGLHKIFCLIEEHARRCIQKLN

SEQ ID NO: 174165 - protein, 279 aa, Glycine max
  Coding DNA Sequence Number=SeqID_82480
MAPRKLPSKRSRKDATEEGYSAAPQVDTDFDEHRFRSIDHQQRFEGQQCEYSQRRRQVFGFDEEAIAQLLCILGQDFAWTAVGRHVWIMRTSMTILTQIWMTLLLSNILLGDHNSDLPLPKCQLVYAILTQFTGTTPTRHPMDPERSNNALGFPALITGLCQFYEAPVAPNKVGVGRDTTAAWRQLAAGSRCTTVTLGVHLDPLAKVRLNESFYQYALRQQGRDSNPYTWPTPEQFEATVAWPGDWPDFHAEAGPTETSGGGDEAQDDQDMTDLIDFLL

SEQ ID NO: 174166 - protein, 89 aa, Glycine max
  Coding DNA Sequence Number=SeqID_82481
  Homolog annotation: Hit_ID=Q6WAY3; Match level="QueryCoverage=79%, HitCoverage=3%, E-value=2e-07, Identity=44%"; Hit description =Gag/pol polyprotein
  Subcellular localization annotation: CTP_CleavageSite=39; ConfidenceScore=5.02e-01
MNFTVKKPVNSTNQNTNQFTPIPVSYANLLPYLLDNSMVAITPAKVHQPPFLREYGLNAMCAYHGGAPAHSIEHFRALKHKVKGLIDAG

SEQ ID NO: 174167 - protein, 203 aa, Glycine max
  Coding DNA Sequence Number=SeqID_82482
  Gene Ontology: Mol. function=structural constituent of ribosome; Cellular component=ribonucleoprotein complex; Biological process =ribosome biogenesis and assembly
  Homolog annotation: Hit_ID=Q2VCI3; Match level="QueryCoverage=35%, HitCoverage=34%, E-value=2e-18, Identity=58%"; Hit description=60S ribosomal protein L7A-like
  Pfam annotation: Domain name=Ribosomal_L7Ae; Domain location=88-177; Score=16.1; E_value=0.00087; Accession=PF01248.17; Description =Ribosomal protein L7AeL30eS12eGadd45 family
RGGDIIGGCSGASVLRDDRANEGGGSDAETWIFQGSASRSLFFGNSTPSSSSSLPYMILQLENDDSAESDSLALLRYTIAAAAAMAPKRGGKAPTLAAKKKPEKVSNPLFEKRPKQVVVIAHDVDPIELVVWLPALYRKMEIPYCIVKGKARLGTNEDKLELSRVLEATKELYMELHALDRFAQDYQHKREEDDNSGAAQSGN

SEQ ID NO: 174168 - protein, 285 aa, Glycine max
  Coding DNA Sequence Number=SeqID_82483
LGGIDGDPVLRRTRIRATWEYVSSVKGGQLGMVDLCVIVDVESRLAPSPDRHLVPHMKVVPGDMSRGSGDLGDVRRAPGSQPIKEQRPQSKEACVVAGQLWILSDIWIMASGNRLQRSNRSLVIDYQLCVIDYTMHIAGFHVLKLCNSSLASGNRLPMLCNRLPEMKSLEAHLLIACSGYVTHCVATEPARTLQRTMEWILPTPTPYRLVEPVQVINVTSSEEDPEEDPEELPLEPVVDALDFPEGDEDPLPEVDSSEDVMSASEADSTEESGPGGIATSGGSSL

SEQ ID NO: 174169 - protein, 222 aa, Glycine max
  Coding DNA Sequence Number=SeqID_82484
  Homolog annotation: Hit_ID=Q6UUU1; Match level="QueryCoverage=27%, HitCoverage=40%, E-value=2e-18, Identity=78%"; Hit description =Putative uncharacterized protein
  Subcellular localization annotation: CTP_CleavageSite=42; ConfidenceScore=5.16e-01
GTSYVPINVSFSPKVGPGLPAVPPVQLLTGWCVTAKAPPDISAGKCSGHAARRVPFAIQAAQLLGRAIGAGLFAITPAGERGMCCKAIKLGNARVFPVTTLGKGPIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 174170 - protein, 145 aa, Glycine max
  Coding DNA Sequence Number=SeqID_82485
  Homolog annotation: Hit_ID=Q2HTA0; Match level="QueryCoverage=58%, HitCoverage=14%, E-value=2e-09, Identity=41%"; Hit description=IMP dehydrogenase/GMP reductase, related
  Pfam annotation: Domain name=DUF1723; Domain location=58-107; Score =49.2; E_value=1.4e-11; Accession=PF08330.1; Description=Protein of unknown function (DUF1723)
SIVFARKQWAVAAVAKDVDHVDHAANVFHEQPQELITDHVDADTKGFPSGHYDTLVLTSYADHVAARVWRWHKETSSFHLPVGEVTITLDDVASLLHLPITSAFHTFDALDVHQVVELLVEMLEVSTQEAKDETEQCRGAYVRLA

SEQ ID NO: 174171 - protein, 55 aa, Glycine max
  Coding DNA Sequence Number=SeqID_82486
MVNKPFETSEGTQGTIVPKDNLLEFALGLYILVDVKLAQQVGALGKNSIHCFHQC

SEQ ID NO: 174172 - protein, 159 aa, Glycine max
  Coding DNA Sequence Number=SeqID_82487
MWVVHRRKFSRLVALGRVYEGSTAVQNIPLLHGQVKVGVHEVKDAEALVPVPTDEVILVGQTLNTFLVWLTLLMKRLSEQAVVSPAKPIDGPDPQVMWDATVFGVFNEHFPLYIKHEDLSEIAHGDQCLNISVIQLWILHLTETSMRSGNSDVYGFLEP

SEQ ID NO: 174173 - protein, 262 aa, Glycine max
  Coding DNA Sequence Number=SeqID_82488
MGSSQAPLLKKRFYQVKVKSLGVTSMKELGQLMGQLHQQAFHKAYAIRQVGYPMRGAPLKEDLTPIIARGFNSTNAEALQKVHKAWEMVQKKDKELRGSSNGPISGYHRWLKAYTQGLDWLPNLRTTKGVEVEALEENEEVQALRAELEKAQTVKKKFKSAAIRIRKENAELRDVNIATTKTLEQETKRVRREEHGQNKFRGALWGSNNELKLRREERDQSRVGSLILKDELRICLRSKRSLSQRLCETETNMLAIISKYQE

SEQ ID NO: 174174 - protein, 221 aa, Glycine max
  Coding DNA Sequence Number=SeqID_82489
  Gene Ontology: Mol. function=sequence-specific DNA binding
  Homolog annotation: Hit_ID=A2UEV2; Match level="QueryCoverage=49%, HitCoverage=86%, E-value=5e-18, Identity=45%"; Hit description =Putative uncharacterized protein
  Pfam annotation: Domain name=DUF1044; Domain location=3-125; Score =120.4; E_value=5.2e-33; Accession=PF06296.3; Description=Protein of unknown function (DUF1044)
  Pfam annotation: Domain name=HTH_3; Domain location=166-220; Score =46.6; E_value=8.9e-11; Accession=PF01381.13; Description=Helix-turn -helix
  Pfam module annotation: Pfam domain module=DUF1044::HTH_3; Domain location=3-125::166-220
MAIYVLKPFDRNFKGDMIADIKLCLAARELIAGQYEASLGGGVYKKRIPLGAGKSGGARAIVAFKSQKHLFFVNGYAKSTTKSGIREIKEDELNLYRQVASQLFAMTTEQERAAIKARKMREEIAHDFNPLGVVSDELTEKIDSRVRLRELRTSLPVLQLMSGEAIRELRERHGLSQAMLAAYIGLSPATVVKWEREEKKPNGAALRLLNIIDRKGLEVLR

SEQ ID NO: 174175 - protein, 43 aa, Glycine max
  Coding DNA Sequence Number=SeqID_82490
MSREFQGRGLPEIALDRQPKLLNLDPSSDRINPSFALRSLLLD

SEQ ID NO: 174176 - protein, 165 aa, Glycine max
  Coding DNA Sequence Number=SeqID_82491
MGHARSDGHRVGGRSDIGRVIVLVRGIIGTWGCEGFVGNLAMWVLWLRHGCLPPFSFPYLFQSSYCRHLLKWCNRICPFLGLLRFFRLQILDPQNLRACIPPSSHSRTRRASAKCNTQWLSTRKNPEEDELYRFVECTSPGHQAHCFSSSAKREKCAKPKFTDVR

SEQ ID NO: 174177 - protein, 43 aa, Glycine max
  Coding DNA Sequence Number=SeqID_82492
MREVLSKKGGEDEAEDTERIVSSAPMGDGAPARKSAALITDCF

SEQ ID NO: 174178 - protein, 149 aa, Glycine max
  Coding DNA Sequence Number=SeqID_82493
LGHHFKNSVAPPTYLALLILLPVAAASGDKSCLTGATLPEGRKADRYPVSGRVGTGERTRELPGGNACLWKNASNAALFTVPGTFAGTFAHMFFPALSPDSVDNRITAFEKRKSAQYANRLSPRVGRFINAAGTTGFPTGKRAVSATQL

SEQ ID NO: 174179 - protein, 199 aa, Glycine max
  Coding DNA Sequence Number=SeqID_82494
  Pfam annotation: Domain name=Transposase_23; Domain location=33-103; Score=8.7; E_value=0.00013; Accession=PF03017.5; Description =TNP1ENSPM transposase
GLALPLEPKVGPSTAHVSIKESCVNPSGNDPDTSDSDKCGLYIEENIPHLVALGRVYEGSITIHNIPLLHDQVKVSVEEVKDADAPVPVPTDEVNLMGHSLNTFLAWLRHLAKRLSEQGVVGPAKPIDRLHHEVMWDATVFGVFNEDFPLYIKHEDLFEIAHSRGFNNYLKGIINSALKGLDDTPQPKSKAGARWIVVK

SEQ ID NO: 174180 - protein, 23 aa, Glycine max
  Coding DNA Sequence Number=SeqID_82495
MAEYEACTLGIQAEIDFKVKLLK

SEQ ID NO: 174181 - protein, 167 aa, Glycine max
  Coding DNA Sequence Number=SeqID_82496
MSILTLGSKKGEGKFPIQEKAKRKEKKFPIKSGRKQKEKKEIPQSKVGESKNWKFYLFTEARSHFSEENTETISSLTSYPELRRSKFLIGGYVGAKASLLSTTPLFVTMTQELVARGDTLRLSAPRHLVSPSVIDEQRPMWSSVPFPEMSASSGGDFFKSHKLSRTT

SEQ ID NO: 174182 - protein, 82 aa, Glycine max
  Coding DNA Sequence Number=SeqID_82497
EREIEIQRLNQNEETNKRKRSIALKASSSMQEENEDEESEDEEDFSLFVKKFHKFVKNRRSERRQNFNHGKRSHEGSLTLRC

SEQ ID NO: 174183 - protein, 126 aa, Glycine max
  Coding DNA Sequence Number=SeqID_82498
  Homolog annotation: Hit_ID=A6FJQ2; Match level="QueryCoverage=30%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNAREACHAIAKRLESHLNLGLVTLGTSTHELIEESLRIARSVIED

SEQ ID NO: 174184 - protein, 209 aa, Glycine max
  Coding DNA Sequence Number=SeqID_82499
  Homolog annotation: Hit_ID=Q3EAH8; Match level="QueryCoverage=44%, HitCoverage=15%, E-value=3e-30, Identity=67%"; Hit description =Uncharacterized protein At3g59040.2
  Pfam annotation: Domain name=PPR; Domain location=120-154; Score =19.7; E_value=0.011; Accession=PF01535.11; Description=PPR repeat
  Pfam annotation: Domain name=PPR; Domain location=155-189; Score =29.6; E_value=1.2e-05; Accession=PF01535.11; Description=PPR repeat
  Pfam module annotation: Pfam domain module=PPR::PPR; Domain location =120-154::155-189
MGSQGQSQAMLVRKEEGDRVVVEEELGGVGEGLCEEKEEESDCFTLLNVFEACNTHPGEFGSPGRADPQLKISALFLFGDCALRLGFEMEAKNKVKIEDSTTESPTSVLEDENWWDFGKMDFFMLITTYGKLGDFNGAEKVLGLMNKNGYAPNVVSQTALMEAYGKGGRYNNAEAIFRRMQKWGLEPSAFTYPIILKTFGGGCGTSGFL

SEQ ID NO: 174185 - protein, 94 aa, Glycine max
  Coding DNA Sequence Number=SeqID_82500
MFLIFNTSALKGLDDTPQPKSKAAARWIVVKCNKQKGIIECGYYVMYWMSMIILGSFRNNWETYFNEVRPLEAERFKALRIQWAQYYLKVRNQT

SEQ ID NO: 174186 - protein, 50 aa, Glycine max
  Coding DNA Sequence Number=SeqID_82501
MEDAPVSLASLARKRAVGLVNQQGDHPQGEKGKKEKENGLVIMVVAIGGC

SEQ ID NO: 174187 - protein, 44 aa, Glycine max
  Coding DNA Sequence Number=SeqID_82502
MVIKPGTFDINLRVNSSQEGGCDRGLSKEEEFSLGGLNMDGPIT

SEQ ID NO: 174188 - protein, 124 aa, Glycine max
  Coding DNA Sequence Number=SeqID_82503
MAINIEHKGGYILCGSFQVEGTSTLLFKENKGGILQGYWKSQEPWVAWGLDVGTVIVHASVEAMPSKVILMMPKNQELSKFQRFKNLVSRIRIQDSRIKFQESRFKNNQDQDSRIKRRLNQDKY

SEQ ID NO: 174189 - protein, 65 aa, Glycine max
  Coding DNA Sequence Number=SeqID_82504
MSKRLQKDWARTAEEGPRVLMNLRASLCDAILPRKGPVTRAMSKRLQEDWARAAEEGPRVLMNLR

SEQ ID NO: 174190 - protein, 137 aa, Glycine max
  Coding DNA Sequence Number=SeqID_82505
  Subcellular localization annotation: CTP_CleavageSite=69; ConfidenceScore=5.60e-01
FSPCSCFLCTCSLYFSTTTSFCSFSNTSSLCSKVTVPMLQSIHRGLCLVMQSMHDSAQHRPFISMDEFMAQVAWPGVQPSPLGGGEASAAQEPQPEPEVAREATPETTPQVSHATSFVVEVSEGEKGAEDTNYAANL

SEQ ID NO: 174191 - protein, 84 aa, Glycine max
  Coding DNA Sequence Number=SeqID_82506
  Subcellular localization annotation: CTP_CleavageSite=69; ConfidenceScore=5.18e-01
MKKILGLQAPMELTSNRLNSFASFFSLTKDSKNSQVVSPLNLCKGDLIQQVVSKQKETPSIGHPSLMVRVTTIGKPECKSLLKP

SEQ ID NO: 174192 - protein, 98 aa, Glycine max
  Coding DNA Sequence Number=SeqID_82507
MKADDSSTQKEEQMKPMRNKQNALHHKVARSIKFNQMDIPVDLATVSVFACWRSTLATVVSMVLREYESGSESVRLGVGCARVREYESAREVQFWFLN

SEQ ID NO: 174193 - protein, 64 aa, Glycine max
  Coding DNA Sequence Number=SeqID_82508
LISGAKRSSIAKHSFSALCATEEYVRASILRSRAKREISVLSTAVLFSQAQHMIGAKLKSTHSH

SEQ ID NO: 174194 - protein, 151 aa, Glycine max
  Coding DNA Sequence Number=SeqID_82509
AQRGSSFFTLIMSFKCCINYCACQRERERGIRTVKAPEQPRATTSHHSVPLSSSVNHHSVPLSSSVNQHHQPQALCQTPNTTKPPQTTNTATANHQHSQHSHRKPPTQPPPTTVQTNHKKNQQNQNPKHIQTTNHTIRTPIIAQTTETEPA

SEQ ID NO: 174195 - protein, 173 aa, Glycine max
  Coding DNA Sequence Number=SeqID_82510
MPPRKLSTKRSRKDAAAEGISATPEFDSHRFRSAEHQQRFEAIKGWSLHRERRVQLRDDEYTDFQEEIARRRWTSLVTPRAKFDPDIVLEFYAKAWPTEEGMRDMWSWVKGQWIPFDADALRQFLGDPLVLEEGQECEFSQRRNRADGFDEEAISQLLCILGQDFAWTASGRQ

SEQ ID NO: 174196 - protein, 160 aa, Glycine max
  Coding DNA Sequence Number=SeqID_82511
ALGFPALITGLCQSFGVPVAPTKVIRPPITRAFIEKYCTQRQAQGDAPQAAGAPPPPHQAGPAGSFDMEQYLRHLVRQQAANHRAHVQTHDCLYQMSLSMQSQGFASFSCPTPDQFRAEVAWSGDWPEAQAGEVPPEVPGDGEEAHEDEEMADLLDFLGG

SEQ ID NO: 174197 - protein, 100 aa, Glycine max
  Coding DNA Sequence Number=SeqID_82512
  Subcellular localization annotation: CTP_CleavageSite=60; ConfidenceScore=5.63e-01
MHTQSFTIPVFPKIGLTHKNSPQRSRQLSQPTLLRASEARLTGASSKGGKCAEFPPTFICEKRRKNRRKPVMKNIPDSGVVFTFEEGISTFHVCPKGQQP

SEQ ID NO: 174198 - protein, 130 aa, Glycine max
  Coding DNA Sequence Number=SeqID_82513
MDEDDDNDVGNDLVFEDDDALNWTTVYEASGVGERRMYTRRKKRERKQPTSAGITPTAAAAHTSKKQAMIVGSSSRKQKAVQENDEDLEFEDIELESEEEEEIMINFEASDGEEGEGDAPLSYDNNEEDY

SEQ ID NO: 174199 - protein, 145 aa, Glycine max
  Coding DNA Sequence Number=SeqID_82514
MEGYLMVIRTFLLILTREVRWQAEIPEWLSVQRQLLLILTREVKWHAGRQASPLTRKDLRRLLHLLSSRDGESDDMRGYLMVMRTFLLILTHEVRWQAEIPEWLSVQRQLLLILTREVKWHAGVPYGYPHLFVNQRQASPLTRKD

SEQ ID NO: 174200 - protein, 56 aa, Glycine max
  Coding DNA Sequence Number=SeqID_82515
MSCTGSLSAPLHLTKRTASVYPLSEKYVLSQKSLTCAKRSINLQRPELEAGADLRA

SEQ ID NO: 174201 - protein, 126 aa, Glycine max
  Coding DNA Sequence Number=SeqID_82516
  Subcellular localization annotation: CTP_CleavageSite=48; ConfidenceScore=5.57e-01
MVKVGTSYVPINVSFSPKVGPGLPAVPPVQLLTGVVRNRQKHRRTSALASVAVTLRVTTTPAALNAPLQGASHSPFRLRNCWEGRSVRASSLLRQLAKGGCAARRLSWVTPGFSQSRRCKTTASEL

SEQ ID NO: 174202 - protein, 130 aa, Glycine max
  Coding DNA Sequence Number=SeqID_82517
  Homolog annotation: Hit_ID=A2Q6B4; Match level="QueryCoverage=92%, HitCoverage=48%, E-value=9e-12, Identity=30%"; Hit description =Ribosomal protein L33; Nucleic acid-binding, OB-fold
MARIPDKIRSIDGSKETLKLAVRITDLWFVGTPNKSEQAEMVFVDSEGDQIHAICKSDHLKSWKVDLKENCTYVMHNFKVVKNDGQFRVCEHEYKLFFIGVTVVREPDLHELPFKEFRFQTHQTLLIKIS

SEQ ID NO: 174203 - protein, 60 aa, Glycine max
  Coding DNA Sequence Number=SeqID_82518
  Gene Ontology: Biological process=transposition, DNA-mediated
  Homolog annotation: Hit_ID=Q1J7G7; Match level="QueryCoverage=50%, HitCoverage=42%, E-value=2e-10, Identity=100%"; Hit description =Transposase
GHQDLFILRSDLPSQWLLFLSAVPPVQLLTGWCVTAKAPPDISAGKCSGHAARNHHTRRA

SEQ ID NO: 174204 - protein, 329 aa, Glycine max
  Coding DNA Sequence Number=SeqID_82519
  Gene Ontology: Mol. function=glutamate dehydrogenase [NAD(P)+] activity; Cellular component=cytoplasm; Biological process=amino acid metabolic process
  Homolog annotation: Hit_ID=Q7WA25; Match level="QueryCoverage=99%, HitCoverage=72%, E-value=1e-154, Identity=82%"; Hit description =Glutamate dehydrogenase
  Pfam annotation: Domain name=ELFV_dehydrog; Domain location=204-329; Score=15.5; E_value=1.4e-11; Accession=PF00208.12; Description =GlutamateLeucinePhenylalanineValin
  Pfam annotation: Domain name=ELFV_dehydrog_N; Domain location=58-188; Score=240.8; E_value=3.1e-69; Accession=PF02812.9; Description =GluLeuPheVal dehydrogenase, dimeri
  Pfam module annotation: Pfam domain module=ELFV_dehydrog::ELFV _dehydrog_N; Domain location=204-329::58-188
MAQLCQESMFMSQTPTHALPSYLNADELGPWGNYLQQVDRVTPYLGSLARWVETLKRPKRSLIVDVPIELDNGSVAHFEGYRVQHNTSRGPGKGGVRFHQDVTLSEVMALAAWMSVKNAAVNLPYGGAKGGIRVDPRKLSQSEIERMTRRYTSEIGVIIGPSKDIPAPDVNTNAQTMAWMMDTYSMNEGSTATGVVTGKPIALGGSLGRVEATGRGVFVVGCEAARDLNIDVSKARVVVQGFGNVGGTAARLFHEAGAKVIAAQDHTGTVHNAAGLDVHKLLSHVSQHGGVGGFSGGQAMDKNEFWTLETEFLIPAALESQITADNAAQ

SEQ ID NO: 174205 - protein, 130 aa, Glycine max
  Coding DNA Sequence Number=SeqID_82520
  Gene Ontology: Mol. function=chitin binding; Cellular component =extracellular region; Biological process=chitin metabolic process
  Homolog annotation: Hit_ID=UPI00006A17C9; Match level="QueryCoverage =95%, HitCoverage=100%, E-value=6e-13, Identity=28%"; Hit description= UPI00006A17C9 related cluster
  Subcellular localization annotation: CTP_CleavageSite=40; ConfidenceScore=5.60e-01
ARTFSPLNARACSPLKVRTCRPLKARGCSPLKARACCPLKATTSSPLKARAFKPLKARTFSPLNARACSPLKVRTCSPLKVRTCSPLKARGCSPLKERACCPLKARTCSPLKARACRPLKDVYSSTGEDV

SEQ ID NO: 174206 - protein, 154 aa, Glycine max
  Coding DNA Sequence Number=SeqID_82521
LIIDCDPGNGIAGANTDDGLALALALASRALAVELITTVSGNTPSAVGARVAKASAAAARTNIPMLNVADRIRRWANVRGSASARRRNEGQAIGCIRALSVAEIVTWPACAARCRAGVFQRYRAVGLSCAHAHHRAPAAARNGTQRHRHAEKRS

SEQ ID NO: 174207 - protein, 497 aa, Glycine max
  Coding DNA Sequence Number=SeqID_82522
  Gene Ontology: Mol. function=glucuronate isomerase activity; Biological process=glucuronate catabolic process
  Homolog annotation: Hit_ID=Q26DK1; Match level="QueryCoverage=88%, HitCoverage=94%, E-value=1e-127, Identity=49%"; Hit description =Glucouronate isomerase
  Pfam annotation: Domain name=UxaC; Domain location=1-441; Score =467.5; E_value=1.7e-137; Accession=PF02614.5; Description =Glucuronate isomerase
MPVIDYHNHLEPDVISTNQNFRSSTAIWLDGDHYKWRAMRNFGIDEQLISGNASDQEKFRKWAEVVPYTLRNPLFHWTHLELKNPFGISEYLSSNNADAVYHQMNESLQTPGFLPQSIIENFKVEALCTTDDPADDLVHHKALKNSGFKTAVLPAFRPDTYINMINPEQYLSGIKKLEKVCGFSIASISDVLNALQSRINYFVEAGAKVADHGFEYFPDTTKWNHSLEKEFSEFLKGNLSTFSDPDALCGYLLKELCKMYAEKGWVQQFHVGATRNNNSEMFRKMGANAGYDAIGEPYYAQRLSVLLDALNSEGKLAKTIIYNLNPAFNEVLATLAGNFNEGGIKSKVQFGAAWWFLDQLDGMTKQMNTLSNIGLISTFVGMLTDSRSLLSFSRHDYFRRLLCNLFGSEMERGLLPDDEKWDSSKILCFGELLLHFAPDSEGNWLNEQSLKIYVGGAEYNVAAALSQWKNAVKLLSALPENFVANQLESQLNNKGIE

SEQ ID NO: 174208 - protein, 138 aa, Glycine max
  Coding DNA Sequence Number=SeqID_82523
PPTYLALLILLPVAAASGDKSCLTGATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQL

SEQ ID NO: 174209 - protein, 141 aa, Glycine max
  Coding DNA Sequence Number=SeqID_82524
MKLEETLAQFMQVFMSNQKSIESTIKNLEVQVGQLALQLADRSSSNFTTNTEKNPKEDYKVVMSRSRMAIHVDESEAEKKMEEHKQHLAPKPALEPISDFVELEDINEEAQDDKEEETPIKEKEKRKNKRSRSRKIKKVEK

SEQ ID NO: 174210 - protein, 231 aa, Glycine max
  Coding DNA Sequence Number=SeqID_82525
  Gene Ontology: Mol. function=catalytic activity; Cellular component =cytoplasm; Biological process=thiamin biosynthetic process
  Homolog annotation: Hit_ID=A6TGP7; Match level="QueryCoverage=100%, HitCoverage=90%, E-value=1e-121, Identity=97%"; Hit description =Thiazole biosynthesis protein thiG
  Pfam annotation: Domain name=ThiG; Domain location=1-222; Score =473.1; E_value=3.6e-139; Accession=PF05690.5; Description=Thiazole biosynthesis protein ThiG
MVEAIRASGSQLVTLAMKRVDLRQHNDAILAPLLAAGVNLLPNTSGAKTAEEAVFAARLAREALGTHWLKLEIHPDARWLLPDPIETLKAAELLVREGFVVLPYCGADPVLCKRLEEAGCAAVMPLGAPIGSNQGLETRAMLEIIIEQATVPVVVDAGIGVPSHAAQALEMGADAVLVNTAIAVADDPVAMARAFRMAVDAGLLARQAGPGARSTQAQATSPLTGFLEALA

SEQ ID NO: 174211 - protein, 120 aa, Glycine max
  Coding DNA Sequence Number=SeqID_82526
  Gene Ontology: Mol. function=protein dimerization activity
  Homolog annotation: Hit_ID=A7PKN6; Match level="QueryCoverage=91%, HitCoverage=19%, E-value=1e-22, Identity=42%"; Hit description =Chromosome chr7 scaffold_20, whole genome shotgun sequence
MKARTEISPAHWCERNWSTFEHIHSKKRSRIEHQKLQDLVYVKYNQALLDRFECHDVIDPIALNDIDDSNKWLLGELEGEEADVAEATGAGEPLKNTMSQTQINKAAAAPAPTNEKGKKK

SEQ ID NO: 174212 - protein, 58 aa, Glycine max
  Coding DNA Sequence Number=SeqID_82527
MERESVNVLKHQLSRGVMVGRNDRAIADALQALAQAIGNPNRGEAGGAVEYQGLDRFQ

SEQ ID NO: 174213 - protein, 35 aa, Glycine max
  Coding DNA Sequence Number=SeqID_82528
MTRLKPDAATAREENRALYWIGKSEITCMYGSLKS

SEQ ID NO: 174214 - protein, 114 aa, Glycine max
  Coding DNA Sequence Number=SeqID_82529
MVTRPNTLCWESIRENESGEKEKHNKSGHVNSNEPIRPIVMLDNAYETSQDDGSSAGTEEGYEKAPITKHNAPNDNIRRCNNNFYIRKEEEEATKLLVFRKHMGMTQAKGEKEV

SEQ ID NO: 174215 - protein, 257 aa, Glycine max
  Coding DNA Sequence Number=SeqID_82530
  Gene Ontology: Mol. function=ubiquitin thiolesterase activity; Cellular component=nucleus; Biological process=ubiquitin-dependent protein catabolic process
  Homolog annotation: Hit_ID=A7PGA4; Match level="QueryCoverage=75%, HitCoverage=16%, E-value=7e-77, Identity=73%"; Hit description =Chromosome chr6 scaffold_15, whole genome shotgun sequence
MQNNSLLLGIQCDHRLFYNLQTSLCLLGRNSGRYKFDDERVTKEDNKRALEEQYGGEEELPQTNPGFNNTPFKFTKYSNAYMLVYIRESDKDKIICNVDEKDIAAHLRERLKKEQEEKEHKKKEKAEAHLYTIIKVARDEELKEQIGKDIYFDLVDHDKVRSFRVQKQTSFNLFKKLELGMCAIELEEVAKEYGIPVQFQRYWLWAKRQNHTYRPNRPLTHIEEAQSVNSHPCFEIFNLFSAFLFDSFLDSIWRCSV

SEQ ID NO: 174216 - protein, 247 aa, Glycine max
  Coding DNA Sequence Number=SeqID_82531
MATSAWSKYASSEAKIRLENRQPDDDGGNQTGRDSERQKTNGQRNMCGPKDNNLQILSTVTYSTTDSKKNAIGAAMSQSQTSSQQTTYVERLSKDRIGGSQEMEAGTGMVEMGNTAGIREEERNNTVKSGRNELEVGPSASANIELKGRGSHVAPHAEERDRSAMGFANDTNVESHIKQNNDIGPKTNGLVWKVYSRHTWCRKQKDNSNVVAPEYGKEDGINSVKISQPIDESGQFETSPLYRRAVD

SEQ ID NO: 174217 - protein, 113 aa, Glycine max
  Coding DNA Sequence Number=SeqID_82532
  Gene Ontology: Mol. function=ubiquitin thiolesterase activity; Cellular component=nucleus; Biological process=ubiquitin-dependent protein catabolic process
  Homolog annotation: Hit_ID=A7Q028; Match level="QueryCoverage=81%, HitCoverage=8%, E-value=3e-37, Identity=82%"; Hit description =Chromosome chr8 scaffold_41, whole genome shotgun sequence
MVLRFCCGYIADALQHFVGQLREVSNKVHNAELKLFLEVELGMDSRPIAPPDKTKDDILLFFKLYDPEKEELRYVGRLFVKCTGKPLEILTRLNEMAGYDPEEDIALYECFCN

SEQ ID NO: 174218 - protein, 405 aa, Glycine max
  Coding DNA Sequence Number=SeqID_82533
  Gene Ontology: Mol. function=ubiquitin thiolesterase activity; Cellular component=nucleus; Biological process=ubiquitin-dependent protein catabolic process
  Homolog annotation: Hit_ID=A7QNS3; Match level="QueryCoverage=94%, HitCoverage=32%, E-value=0.0, Identity=82%"; Hit description =Chromosome undetermined scaffold_134, whole genome shotgun sequence
  Pfam annotation: Domain name=MATH; Domain location=59-200; Score =43.9; E_value=5.7e-10; Accession=PF00917.17; Description=MATH domain
  Pfam annotation: Domain name=UCH; Domain location=215-384; Score =25.2; E_value=6e-09; Accession=PF00443.20; Description=Ubiquitin carboxyl-terminal hydrolase
  Pfam module annotation: Pfam domain module=MATH::UCH; Domain location= 59-200::215-384
ERFAISSAQQEDEEVLVPHADLPANNHQPMEVVAQPENANTVESQPVEDPPSSRFTWRIDNFSRLNTKKLYSEIFVVVFISVKLGFMLGRRVLIFPKGNNVDYLSMYLDVADSATLPYGWSRYAQFSLAVVHQTHNKYSVRKGGLGSGWGLGWGIDTQHQFNARESDWGFTSFMPLGELYDPSRGYLVNDTLIVEAEVLVRRIVDYWTYDSKKETGYVGLKNQGATCYMNSLLQTLYHIPYFRKAVYHMPTTENDMPTGSIPLALQSLFYKLQYSDTSVATKELTKSFGWDTYDSFMQHDVQELNRVLCEKLEDKMKETVVEGTIQKLFEGHHMNYIECINVDYKSTRKESFYDLQLDVKGCRDVYASFDKYVEVESLEGDNKYHAEQYGLQSYSSTRGTAADNT

SEQ ID NO: 174219 - protein, 268 aa, Glycine max
  Coding DNA Sequence Number=SeqID_82534
MDSDIATDDSRQFFSYEYKNMHLFRSRQQLNGRHGYHWKNMIPGRKNKGLEKRLDAIEDTNKSILKVIYNLVRQEACSSPKNTRDHVPISRSQITLPLEKRVDLVSAKCYGRHQEPKMSSGSLGRASLAYLKNIETIVIPKDEDAHDLKKCSTFFRGEFMRDHKKRVVKPPTPFNLWEPCDNNTTSDEFCKDGPFMTNYNRGVNFKGKIPMEIALPPQKLTYNVSTSVGRTLKKPKIETQQREETCRLLPERFDVVLCMPKSYMHTNL

SEQ ID NO: 174220 - protein, 204 aa, Glycine max
  Coding DNA Sequence Number=SeqID_82535
  Gene Ontology: Mol. function=DNA binding; Cellular component=nucleus; Biological process=regulation of transcription
  Homolog annotation: Hit_ID=Q0PJK5; Match level="QueryCoverage=43%, HitCoverage=29%, E-value=4e-16, Identity=60%"; Hit description=MYB transcription factor MYB82
MEKIFNEGHERKQKHRGHYYKSHQLHRFKWKVYVGLSTDVASGVVVFRQRLQRSYDTQDEQHADFMPMFNLSSQSPSMHAMVLNSIIDRLPMLQQGLNMPCSGGFFNSTGPCFSSSQSGVDNKGIYLENGGVFGSLNIGAEEDVGTTSYLDEQLQVATPLKGARLRQRGGGGTNTTFGGRTGAVGFVNVREMEECDGKGTMSGW

SEQ ID NO: 174221 - protein, 19 aa, Glycine max
  Coding DNA Sequence Number=SeqID_82536
MDKWKNITDMGYVIASRYF

SEQ ID NO: 174222 - protein, 68 aa, Glycine max
  Coding DNA Sequence Number=SeqID_82537
MPKPPADELADVDMPRHALACHEIVERLEGLINLRVVTKGTEAYTVTEECLRIARGVTAQGNVYVRSR

SEQ ID NO: 174223 - protein, 60 aa, Glycine max
  Coding DNA Sequence Number=SeqID_82538
MCYQIIISISAYDVLEDTSDTILPRKGQVTRAMSKRLQEDWARAAKEGPRVHMNLKGSIK

SEQ ID NO: 174224 - protein, 64 aa, Glycine max
  Coding DNA Sequence Number=SeqID_82539
  Subcellular localization annotation: CTP_CleavageSite=47; ConfidenceScore=5.04e-01
MEKFNRHATTLGSVHGGNADGTSDANGLAGQTVGRRGGGVRLSGRRRAVAVAGRLVEIAGHDEI

SEQ ID NO: 174225 - protein, 93 aa, Glycine max
  Coding DNA Sequence Number=SeqID_82540
MPCHHSCIAFVFVIIVTGSRKGVEVLVIKIFILANMGSNQAPSFKKRFYHVKVKSLDLASLRELGQRMDQVRCQAFHKAYGKIWGFGPDRSVR

SEQ ID NO: 174226 - protein, 82 aa, Glycine max
  Coding DNA Sequence Number=SeqID_82541
MAGLKKARPTIVIIRTAFVFPVSVVVVFFVGISFCDRAAVGVDYPSQVDGGVAASACRHWRGKHRCTEFIGVVSSSGSYGST

SEQ ID NO: 174227 - protein, 128 aa, Glycine max
  Coding DNA Sequence Number=SeqID_82542
MAKIQVPKEGKTYSNIYKEEWTKPWPMGSEIYPEVHENPRAFFSSSSPILLESSIQYPWGVRCGEGEGALRWSAAANEMDEDEWMYEIMSEQVDMDYENEEACGVNEPHVDCSNAFNTSQVFECREDV

SEQ ID NO: 174228 - protein, 117 aa, Glycine max
  Coding DNA Sequence Number=SeqID_82543
  Gene Ontology: Mol. function=aspartic-type endopeptidase activity; Biological process=DNA integration
  Homolog annotation: Hit_ID=Q5MG92; Match level="QueryCoverage=35%, HitCoverage=3%, E-value=1e-07, Identity=54%"; Hit description =Putative retrotransposon polyprotein
MIMKADGEITNEFEINEEEKVEEELEEEAMQGDMQMPHPRPNKLQWLSEDEEVKMTQQVEMCLTIGRYNDRVLCDVVPMGEFKDVFPKEILMQSYPRRALDRRLQEDCQRYKALGFS

SEQ ID NO: 174229 - protein, 78 aa, Glycine max
  Coding DNA Sequence Number=SeqID_82544
MSVKNLIKRLGVHDKTNHTLGDQSGSHYFVIMLQPCRISIGLKEHSNPVHLPPRPRPRRDYQGLSLLIQVQPKKYFNT

SEQ ID NO: 174230 - protein, 96 aa, Glycine max
  Coding DNA Sequence Number=SeqID_82545
MSGFTRNSPQISASPYQLDFTLYASGSYNAQWNAPGLFHDKHTLRLSRILGEMEVVFVIGSAVDRLCGRFRDGLCGYLGGGPTSILSLAKTKSAKL

SEQ ID NO: 174231 - protein, 249 aa, Glycine max
  Coding DNA Sequence Number=SeqID_82546
  Gene Ontology: Mol. function=motor activity; Cellular component=cell projection
  Homolog annotation: Hit_ID=UPI00016621D1; Match level="QueryCoverage =70%, HitCoverage=40%, E-value=2e-15, Identity=30%"; Hit description =UPI00016621D1 related cluster
MPSLLEDYTSSPSKDYTWATCPCLQRTTHRRLRGLHAHTFKGQHILAFRGLHILAFRGLHALTFRGLHALAFRELHALTFRGLHALAFSGLHALAFRGLHVLAFRGLRTLAFRGLHVLALRGLHVLAIRGIHALAFRGLHVLTFRGIHTLAFGGLHVLAFRRLHVFTIRGLHVVAFKGLHALAFRGLHVLAFRGLHALTFRGLHVLPFKGLHVGYMPLPSEDNTSSPLEGYTPTPSKDNTSSPSEDYTS

SEQ ID NO: 174232 - protein, 20 aa, Glycine max
  Coding DNA Sequence Number=SeqID_82547
STLEDPPTKKLPASYIEFSD

SEQ ID NO: 174233 - protein, 54 aa, Glycine max
  Coding DNA Sequence Number=SeqID_82548
MGQNTPKDYDDGWLKFSQRCLNGRGGSQCSFEAMKGLFAFIIKVKLHLLLQQVG

SEQ ID NO: 174234 - protein, 42 aa, Glycine max
  Coding DNA Sequence Number=SeqID_82549
MMTRSKRFVEVKDHDSIVHKKKNTGKKSTDDMKNEVKGEREL

SEQ ID NO: 174235 - protein, 263 aa, Glycine max
  Coding DNA Sequence Number=SeqID_82550
  Homolog annotation: Hit_ID=Q84VH5; Match level="QueryCoverage=100%, HitCoverage=35%, E-value=3e-82, Identity=66%"; Hit description =Envelope-like protein
  Subcellular localization annotation: CTP_CleavageSite=43; ConfidenceScore=5.35e-01
MATSPKETSAPGSPSVPSSPSSTKAPSNQEQPEFNIQPIQMIPSSAPGPEKLVPKRQQGVKTSENPSLATSPREVDTEMDKKIRSIVSNILKNASVPDADEDVPTSSTPNVSVPDADKDVPTSSTPNVSVPDADKDVPTSFTPNAEDPSSSSKEESTEEEDQATEETPAPRAPEPAPGDLIDLEEVESDEEPIANKLAPGIAERLQSRKGKTPITRSGRIKTMAQKKSTPITPTTSRWSKVAIPSKKRKEISSSDSDDDVELD

SEQ ID NO: 174236 - protein, 91 aa, Glycine max
  Coding DNA Sequence Number=SeqID_82551
MGETPEVPRDHTLVDFEPHLGYTIEGLPPAMVEKDKFDHIEERLRAIEGSGDYPFIDMAICEVPRHAESQKKSVVAQSVKFRDMPKIKRKC

SEQ ID NO: 174237 - protein, 168 aa, Glycine max
  Coding DNA Sequence Number=SeqID_82552
  Homolog annotation: Hit_ID=UPI0000ECBAF8; Match level="QueryCoverage =19%, HitCoverage=38%, E-value=5e-10, Identity=96%"; Hit description =UPI0000ECBAF8 related cluster
GETPGIFIVLSGFATTDLSVRFRDACQGGGAYGKTALPRPSQRSVENWYFHGISLLERQFGSNSCSPGDPLVLERPPPRWSSNSPYSESYYNSLAVVLQRLTGKTLALPNLIALQHIPLSPAGVIAKRPAPIALPNSCAGFPEWRMGRALVTATLASADVRRCFCRYG

SEQ ID NO: 174238 - protein, 127 aa, Glycine max
  Coding DNA Sequence Number=SeqID_82553
MVCNDHAHMTDRLLAGSFTFECRIMHYVLCQVLLPRYRMHKALRANAPLSYPHLVTLFLHHFNVPLEDEPFVKVKRSFAIGAGAVTSFGYQKDMDGQWVRKQDLPPPIPDERVGQVASDILRRGGGG

SEQ ID NO: 174239 - protein, 117 aa, Glycine max
  Coding DNA Sequence Number=SeqID_82554
MMDTLEPYTGAMKGTMLEPQANLGEVSKSNRTYTLREFPKRFAKDRMRLHELSPLSKIKSNQNHKIGKECHEHCTTFHGIALLHTFGDHCLSACDFRLTTSKCLTPIAMESVKFRDV

SEQ ID NO: 174240 - protein, 95 aa, Glycine max
  Coding DNA Sequence Number=SeqID_82555
VDYFIESDPTLDTQHDVSFIGACRPRIFFINGLFCFLEYEWQRNGEKKRERRRHFKDKMILEEVHHHRRPWIRAWRKKEMNEGKGREEHEILCSK

SEQ ID NO: 174241 - protein, 513 aa, Glycine max
  Coding DNA Sequence Number=SeqID_82556
  Gene Ontology: Mol. function=transporter activity; Cellular component= integral to membrane; Biological process=transport
  Homolog annotation: Hit_ID=A6XFC1; Match level="QueryCoverage=100%, HitCoverage=48%, E-value=0.0, Identity=95%"; Hit description=AcrB
  Pfam annotation: Domain name=ACR_tran; Domain location=1-513; Score =346.3; E_value=5.4e-101; Accession=PF00873.10; Description =AcrBAcrDAcrF family
  Pfam annotation: Domain name=FtsX; Domain location=258-420; Score= -34.5; E_value=0.05; Accession=PF02687.12; Description=Predicted permease
  Pfam annotation: Domain name=SecD_SecF; Domain location=164-351; Score=-95.7; E_value=0.026; Accession=PF02355.7; Description=Protein export membrane protein
  Pfam module annotation: Pfam domain module=ACR_tran::FtsX::SecD_SecF; Domain location=1-513::258-420::164-351
MTQEDISDYVGANMKDAISRTSGVGDVQLFGSQYAMRIWMDPNKLNNFQLTPVDVINAIKAQNAQVAAGQLGGTPPVKGQQLNASIIAQTRLTSADEFSKILLKVNQDGSQVRLRDVAKVELGGENYDIIAKFNGKPASGLGIKLATGANALDTATAIRAELKKMEPFFPSGLKIVYPYDTTPFVKISIHEVVKTLAEAIILVFLVMYLFLQNFRATLIPTIAVPVVLLGTFAILAAFGFSINTLTMFGMVLAIGLLVDDAIVVVENVERVMAEEGLPPKEATRKSMGQIQGALVGIAMVLSAVFIPMAFFGGSTGAIYRQFSITIVSAMALSVLVALILTPALCATMLKPIQKGGHGEHKGFFGWFNRMFDKSTHHYTDSVGNILRSTGRYLVLYLIIVVGMAYLFVRLPSSFLPDEDQGVFLSMAQLPAGASQERTQKVLDEMTDYYLTKEKNNVESVFAVNGFGFAGRGQNTGIAFVSLKDWSERPGSENKVEAITGRAMARFSQIKDAM

SEQ ID NO: 174242 - protein, 152 aa, Glycine max
  Coding DNA Sequence Number=SeqID_82557
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=Q37953; Match level="QueryCoverage=55%, HitCoverage=73%, E-value=3e-25, Identity=72%"; Hit description=LacZ protein
  Subcellular localization annotation: CTP_CleavageSite=51; ConfidenceScore=5.39e-01
MAMLLAYQHLFKWKQARYNPSSMAATQNHHVPWKPPLPSFPNPVVSFVRLQANLVSNSCSPGDPLVLERPPPRWSSIPYSESYYNSLAVVLQRRDWENPGVTQLNRLAAHPPFASWRNSEEARTDRPSQQLRSLNGEWDAPCSGALSAAGVV

SEQ ID NO: 174243 - protein, 110 aa, Glycine max
  Coding DNA Sequence Number=SeqID_82558
MAYERGGDFLEDARKILNREDYKRYQAFPPGGSLVRSPVPAFRFTGVIPLLWPRLSHSTPDTQFRVGSSLQAGLYARTPRSVRPLRPYPVTIVLSPPGKDMQKHHWQQPL

SEQ ID NO: 174244 - protein, 117 aa, Glycine max
  Coding DNA Sequence Number=SeqID_82559
  Homolog annotation: Hit_ID=Q6WAY4; Match level="QueryCoverage=85%, HitCoverage=18%, E-value=1e-07, Identity=32%"; Hit description =Putative uncharacterized protein
MAEVSTEAIASLAQYYDQSLRCFTFGVFQLSLMVEEFEEILGCPLGGRKPYLFSGFYPSLARISKIVQISMQELDHRKQVQNGVDGVPRKYLEAKARILAGKGEWASFIDILAPFDL

SEQ ID NO: 174245 - protein, 145 aa, Glycine max
  Coding DNA Sequence Number=SeqID_82560
  Gene Ontology: Mol. function=nucleic acid binding
  Homolog annotation: Hit_ID=A5B9V6; Match level="QueryCoverage=52%, HitCoverage=59%, E-value=5e-09, Identity=39%"; Hit description =Putative uncharacterized protein
GIKALIYQQRYQSYDREHTKQGLDQALEDERLASINETKWTKIQRRTVSTIQLVLAPEIKHNVLKETSPKALWEKLKNIYASKLLTNHLCLKMELSFKALVQMLFMGRSTLNLDEVTVALRENKRMISTENVDDEHNAIDVVESE

SEQ ID NO: 174246 - protein, 189 aa, Glycine max
  Coding DNA Sequence Number=SeqID_82561
  Gene Ontology: Mol. function=transferase activity, transferring glycosyl groups; Cellular component=integral to membrane; Biological process=protein amino acid glycosylation
  Homolog annotation: Hit_ID=Q9ST51; Match level="QueryCoverage=43%, HitCoverage=16%, E-value=3e-35, Identity=90%"; Hit description=Fuct c3 protein
MVFYNTENPKFSTSLSLSSYLHRCGDPHKAGEDIEAQVFVAHEIELDSSPSEAILFLVRTWHLHPPYQVEQLVFYNRWNHHNTMLRTILPWQDDGRGYNIVMTTILSSDVLVGYFSWAEYDIMAPVQRKTEVALAAAFISNCGARNMRLQDLEALEKSNIKIDSYGGCHRNRDGRVSPFVLDLVKCVSV

SEQ ID NO: 174247 - protein, 266 aa, Glycine max
  Coding DNA Sequence Number=SeqID_82562
MVGCGGFIRDLRGSRSCGFAKRIGYANSFLAKLWGFDVDSEVVVKCIIGGREGCATDALANIACHLKDSYVMYEQPPPIIRSLLLVDVNGGFNFPSHSDNHQELAQLNHPTIPQRKLSHTHVLESRKPQDHKVMIIGLNFLLTLDNSEKMLGPIKMFKFNFPKISQTLKARQKRLLLAEPVPVYSPLTQILSSSSTQFGCDECVEHKGREVTNRSKKRMGNGNKCCKRKLKSMFKRLPSFGFDVYGLFLLVPVLLVEFLKPDIVVH

SEQ ID NO: 174248 - protein, 108 aa, Glycine max
  Coding DNA Sequence Number=SeqID_82563
  Homolog annotation: Hit_ID=A7Q790; Match level="QueryCoverage=56%, HitCoverage=13%, E-value=2e-08, Identity=52%"; Hit description =Chromosome chr18 scaffold_59, whole genome shotgun sequence
MAKDELFDMLDVKSHLSQSHETWKQEIARSQSQVDVLVQIQHVPSAVITKFVMLCTKNQVLVQMQHVPSSVNALKFYANVQPNIRCKWLVYFYLLRVYMIASTVVFII

SEQ ID NO: 174249 - protein, 219 aa, Glycine max
  Coding DNA Sequence Number=SeqID_82564
MDNPDAGNLSATRMCKSIEGKGKYVFMLSQKEKGDMIDKDKSVIILCLGNKSLTKVAREKTTTEIWDAILYGKDQTISLDDVHKSVQIKELQKLQDLKIEDNGEGLNEDCHEKKAKESRNLVDSLDVVVALDGCESVRDYFETLELKEGGMVLLGNNKSCAEQAYSTKIEHGMINVSNGSSIVSKGTKRNGLYILDGSANISYASITSQTPHDRPSYDI

SEQ ID NO: 174250 - protein, 201 aa, Glycine max
  Coding DNA Sequence Number=SeqID_82565
  Subcellular localization annotation: CTP_CleavageSite=30; ConfidenceScore=5.44e-01
MVEPSKKRKGSTPTTTATRQHRHDTSGDPPAPTRPSLSSPRSLTLFSSDEQRQNQGVPFEGTLIDDWKHIYSTHDAHKMVCNEHADMIARLLAGSFTFECRVMHYLCRIVVASEEDLILLWALQTSRQIDWAHLVRYRMHKALQVNAPLPYPHLVTLFLHHFNVPLDDEPFVKVKRSFAIGAGVVASFGYRKDVDGQWVRK

SEQ ID NO: 174251 - protein, 57 aa, Glycine max
  Coding DNA Sequence Number=SeqID_82566
MGDSAKVVIKQDMKGRRHKYGFNNNEREKAQKKRVHQERLRKKFALEEGRIFAANEQ

SEQ ID NO: 174252 - protein, 127 aa, Glycine max
  Coding DNA Sequence Number=SeqID_82567
  Homolog annotation: Hit_ID=A5AGG9; Match level="QueryCoverage=66%, HitCoverage=13%, E-value=7e-12, Identity=42%"; Hit description =Putative uncharacterized protein
MSAVVYKDWVFTDEALPNDLVKRINFKNFYNILRVQNRKYLLVLKIVSGLKVVDFRQLEVLLVNKVDEFEVRRPLEALADMGLNGEYNLKELMRLIVTILDGNDKLIMGENMDSSEDWRQTNACFSY

SEQ ID NO: 174253 - protein, 162 aa, Glycine max
  Coding DNA Sequence Number=SeqID_82568
  Homolog annotation: Hit_ID=A7R5Q5; Match level="QueryCoverage=74%, HitCoverage=25%, E-value=2e-10, Identity=33%"; Hit description =Chromosome undetermined scaffold_1022, whole genome shotgun sequence
MTRGNPGDLQPFDPEIDRTFHRLVRHCVHLGHSVHCEHSVEGDPEYSDFEHSTTNFYTENMAQPPPRERTLREMAAPDLTYESLCIQYPDEGVLYVLKTGLIHLQPKFHGLAGEDPHKHLKEFHIVCSTIKPQDVQEDHIFLKAFPHSLEGVAKDWLYYLAP

SEQ ID NO: 174254 - protein, 285 aa, Glycine max
  Coding DNA Sequence Number=SeqID_82569
MVFVVLMICSEARFGNVFFNHQNLMETLTKVQLGEPGSLAKVEEGLWGEKDGGKFGNELLDFGYGVGWFLARVWSGGGLEGQMEKGGGGSIVDHLSDLFCRSIERPKHNAQKFGNLRLYEAMGTPIINEDSESSLMNKTMDTKGCRCGQTREGIKANMWKVLKWLSVKGGICPFSQRRAISSGVQRTKPVRQLAHDSISHKVVDAASEEHDPLPQQQPHHVALRASRRHRRCLGRRELEGEAQVPKLGPKVWVFGGDWQGREDAPLRGFWRVWGEEGGGNKELRV

SEQ ID NO: 174255 - protein, 582 aa, Glycine max
  Coding DNA Sequence Number=SeqID_82570
  Gene Ontology: Mol. function=oxidoreductase activity, acting on other nitrogenous compounds as donors, with NAD or NADP as acceptor; Cellular component=integral to membrane; Biological process=nitrate assimilation
  Homolog annotation: Hit_ID=P39866; Match level="QueryCoverage=100%, HitCoverage=65%, E-value=0.0, Identity=82%"; Hit description=Nitrate reductase [NADH] 2
  Pfam annotation: Domain name=Cyt-b5; Domain location=210-283; Score =94.0; E_value=4.8e-25; Accession=PF00173.19; Description=Cytochrome b5-like HemeSteroid binding
  Pfam annotation: Domain name=FAD_binding_6; Domain location=330-437; Score=226.7; E_value=5.2e-65; Accession=PF00970.15; Description =Oxidoreductase FAD-binding domain
  Pfam annotation: Domain name=Mo-co_dimer; Domain location=21-154; Score=261.8; E_value=1.4e-75; Accession=PF03404.7; Description=Mo-co oxidoreductase dimerisation domain
  Pfam annotation: Domain name=NAD_binding_1; Domain location=456-565; Score=160.2; E_value=5.5e-45; Accession=PF00175.12; Description =Oxidoreductase NAD-binding domain
  Pfam module annotation: Pfam domain module=Cyt-b5::FAD_binding_6::Mo -co_dimer::NAD_binding_1; Domain location=210-283::330-437::21 -154::456-565
MLPSHVDADLANEEGWWYKQEYKINELSINSVITTPSHEEILSINSYTTQRPYELRGYAYSGAGRKVTRVEVTFDGGETWHVCTLDHTEKPNKYGKYWCWCFWSLEVEVIDLLGTNEIAVRAWDEGLNTQPEHLNWNLMGMMNNCWYRVKTNVGKPAKGEIGILFEHPAQPGNQPGGWMGKERHLEKSLEKLPSIKRSGSTPSMNITSKRFSISEVKKHCTSDSTWIIVHGHVYDCTRFLKDHPGGVDSILINAGTDCTEEFDAIHSDKARRLLEDFRIGELMTTDYTSDSEPDNSMHGDSESTHLAPIKEITTPRPQRKVALNSREKISCKLVSKTYISHNTRLFRFALPSEDQLLGLPVGKHIFLYATIGDKLCIRAYTPTSSVDEVGFFDLLIKVYFKGVHPKYPNGGLMSQHLDSLSIGSMLDVKGPLGHIEYTGRGNFMVHGKQKFAKRLAMLAGGTGITPIYQVAQAILKDPEDHTEMHLVYANHAEDDILLREELDAWAKTHCDRFKVWYVVGIAKEGWQYSVGRITESIMREHLPKSSSDALALTCGPPPMIEFAVQPNLEKMGYDIKNDLLVF

SEQ ID NO: 174256 - protein, 221 aa, Glycine max
  Coding DNA Sequence Number=SeqID_82571
MEENPNPKAQRFFDMLATAQAPLWEGCKDHSKLSASLGRVETSPPPPCLSSLNVWNRVAHLPLYLELQEEKDFPGYGVEHVGRGKFFKPKEAYAMTKSQRLVVLKWVKELNLPAGYTSNLGPNYKGNVYRLGTLSKRFSCSKSGPSNSIAPMEDQIEEMCETINKLNVELLSKANKEKTLEEKMLQLMENHDHQTPTPSTTIADGTEHYVDDAQVDHSHDM

SEQ ID NO: 174257 - protein, 146 aa, Glycine max
  Coding DNA Sequence Number=SeqID_82572
MQFSNYIAPVGKLCAVSGHCLPDYMDWFYMILHPFMSLAQPGDPPRVPSVQQYNTFVEPDVYQQSMAVAAPDEAVDVHHLRHAVIIYFFAIADKLERLLNLRILTEGTEAYTIAEECMGITRSYISQPNIRTVIEVVLFLPFICHL

SEQ ID NO: 174258 - protein, 741 aa, Glycine max
  Coding DNA Sequence Number=SeqID_82573
  Gene Ontology: Mol. function=1-phosphatidylinositol-4-phosphate 5 -kinase activity; Cellular component=plasma membrane; Biological process=phosphatidylinositol metabolic process
  Homolog annotation: Hit_ID=A7NV71; Match level="QueryCoverage=91%, HitCoverage=93%, E-value=0.0, Identity=76%"; Hit description =Chromosome chr18 scaffold_1, whole genome shotgun sequence
  Pfam annotation: Domain name=MORN; Domain location=101-123; Score =34.4; E_value=4e-07; Accession=PF02493.11; Description=MORN repeat
  Pfam annotation: Domain name=MORN; Domain location=124-146; Score =28.6; E_value=2.3e-05; Accession=PF02493.11; Description=MORN repeat
  Pfam annotation: Domain name=MORN; Domain location=147-169; Score =26.4; E_value=0.00011; Accession=PF02493.11; Description=MORN repeat
  Pfam annotation: Domain name=MORN; Domain location=170-192; Score =36.5; E_value=9.5e-08; Accession=PF02493.11; Description=MORN repeat
  Pfam annotation: Domain name=MORN; Domain location=193-213; Score =13.0; E_value=0.26; Accession=PF02493.11; Description=MORN repeat
  Pfam annotation: Domain name=MORN; Domain location=55-77; Score=30.7; E_value=5.3e-06; Accession=PF02493.11; Description=MORN repeat
  Pfam annotation: Domain name=MORN; Domain location=78-100; Score =38.2; E_value=2.9e-08; Accession=PF02493.11; Description=MORN repeat
  Pfam annotation: Domain name=PIP5K; Domain location=386-701; Score =549.3; E_value=4.1e-162; Accession=PF01504.9; Description =Phosphatidylinositol-4-phosphate 5-Kinase
  Pfam module annotation: Pfam domain module=MORN::MORN::MORN::MORN::MOR N::MORN::MORN::PIP5K; Domain location=101-123::124-146::147-169::170 -192::193-213::55-77::78-100::386-701
  Subcellular localization annotation: CTP_CleavageSite=35; ConfidenceScore=5.60e-01
MREGDVAPALASPSPPVVVAGRSRSQGFTTRRVTPATAVDGSSAVERVLPNGDFYAGRFSGNVPHGSGKYLWTDGCMYEGEWKRGKASGKGKFSWPSGATYEGEFKSGRMEGFGTFVGSDGDTYRGSWSSDRKHGFGQKRYANGDLYEGWWKRNVQDGHGRYVWKNGNEYVGEWKNGVINGKGALLWANGNRYEGLWENGVPKGHGVMKIHHRLLWGENFNVKRFSVDGRGSVNNDKSFPRICIWESEGEAGDITCDIIDNVEASMFYRDGTTSDCEEKETRRNPCFSSEVKRPGETVSKGHKNYELMLNLQLGIRYTVGKEASTLRELKQSDFDPKEKFWTRFPAEGSKLTPPHQSAEFRWKDYCPVVFRHLRKLFQVDPADYMLAICGNDALRELSSPGKSGSIFYLTQDDRFMIKTVKKSEVKVLIRMLRSYYQHVSRYENSLVTKFYGVHCVKPIGGQKIRFIVMGNLFCSEYPIHRRFDLKGSSHGRTTDKPDEDIDETTTLKDLDLNFVFRVQRNWFQELIKQIERDCEFLEAEKIMDYSLLVGIHFRDDNTCDKMGLSPFLLRTGNRDSYQNEKLMRGYRFLEAELQDRDRVKSGRKSLIRLGANMPARAERVARRSDFDQYTTAGISHLTPYCSGETYDVILYFGIIDILQDYDISKKLEHAYKSLQVDSTSISAVDPKLYSKRFRDFVGRIFIEERKKCFKFETLGKGLGVKMPRHGQVADRSSLDFGFFMA

SEQ ID NO: 174259 - protein, 71 aa, Glycine max
  Coding DNA Sequence Number=SeqID_82574
MSRHDTIIIVIQHNTNTKRKEALRYAKVWGRDVVRSLTLAYEVVSGFEPMTNKSPRHNFTAAPGLALFKLS

SEQ ID NO: 174260 - protein, 107 aa, Glycine max
  Coding DNA Sequence Number=SeqID_82575
MAALFLDFVVVEAVPALVTVSALRRSRHGGIEALDDFNDTIDLEEFNNETNQMMLAMAKGLAVKTSLKEQRACQGAKEVKRVVGVANAKGEREKGSDALCAFFSFDL

SEQ ID NO: 174261 - protein, 159 aa, Glycine max
  Coding DNA Sequence Number=SeqID_82576
  Gene Ontology: Mol. function=nucleoside-triphosphatase activity; Cellular component=integral to membrane; Biological process=lipid transport
  Homolog annotation: Hit_ID=A7QT46; Match level="QueryCoverage=54%, HitCoverage=13%, E-value=1e-21, Identity=54%"; Hit description =Chromosome undetermined scaffold_165, whole genome shotgun sequence
  Pfam annotation: Domain name=DUF1336; Domain location=2-115; Score= -58.5; E_value=4.2e-06; Accession=PF07059.3; Description=Protein of unknown function (DUF1336)
MGQRFVRDKQKCPAPESCPYIPIGVDLFACPKKISHIAKHLELPLVKENESLPSLFIVNIQDISSLDIKRGNVGFLNQCLVLSKRSFINMYHDLGYYWLRVVIYIALAITLATIFYDLSASYDSIKDRDSLVAFINGFITFMIISGFPSFVEVMKALNS

SEQ ID NO: 174262 - protein, 73 aa, Glycine max
  Coding DNA Sequence Number=SeqID_82577
MAAEWRRKRERRRHFKEKMSLEEAHHHRRPWIRAWRKKEMNEGRGREEHEILCSKRALKSEPTKFKIKFKILY

SEQ ID NO: 174263 - protein, 644 aa, Glycine max
  Coding DNA Sequence Number=SeqID_82578
  Gene Ontology: Mol. function=secondary active sulfate transmembrane transporter activity; Cellular component=integral to membrane; Biological process=sulfate transport
  Homolog annotation: Hit_ID=P53393; Match level="QueryCoverage=99%, HitCoverage=98%, E-value=0.0, Identity=68%"; Hit description=Low affinity sulfate transporter 3
  Pfam annotation: Domain name=STAS; Domain location=505-632; Score =106.5; E_value=7.9e-29; Accession=PF01740.12; Description=STAS domain
  Pfam annotation: Domain name=Sulfate_transp; Domain location=187-482; Score=469.9; E_value=3.2e-138; Accession=PF00916.11; Description =Sulfate transporter family
  Pfam module annotation: Pfam domain module=STAS::Sulfate_transp; Domain location=505-632::187-482
EHGQTERSQWVLDSPNPPPLWKKLFSSVKETILPHGNKFCFSSKRKTINGHALSCLQNLFPIISWLRDYKVSKFKDDLLAGLTLASLCIPQSIGYATLAKVAPEYGLCKYVASVYTATDWFDTSVVPPLIYAMMGSSREIAIGPVAVVSMLLASLVPKVEDPVTNPNAYRNLVFTVTFFTGIFQTAFGVFRLGFLVDFLSHAALVGFMAGAAIIIGLQQLKGLLGLSHFTSKTDVVSVLASVYKSLHNQIAPGQKGRRNRKLFWLPAISPLLSVILSTLIVYLSRADKHGVNIIKHVKGGLNPSSLHQLQLHGPHVGQAAKIGLICSVIALTEAIAVGRSFASIKGYHLDGNKEMLSMGIMNIAGSLTSCYVATGSFSRTAVNFSAGCQTAVSNIVMAVTVFLSLELFTRLLYYTPVAILASIVLSALPGLIDLSEACYIWKVDKLDFLACIGAFLGVLFATVEIGLLVAVIISFAKILIQSIRPGIEVLGRVPRTEAFCDVTQYPMAISTPGIIVIRISSGSLCFANANFVRERQASNLQMIFRGWVSQDEDDLKETTKGRVQAVILDMTNLMNVDTSGILALEELHKRLLSRGVELAMVNPRWLVIHKLKLAHFVDKIGKEWVFLTVGEAVDACLATKIARA

SEQ ID NO: 174264 - protein, 121 aa, Glycine max
  Coding DNA Sequence Number=SeqID_82579
  Gene Ontology: Mol. function=protein dimerization activity
  Homolog annotation: Hit_ID=Q5UDR1; Match level="QueryCoverage=42%, HitCoverage=7%, E-value=8e-10, Identity=62%"; Hit description =Transposase
  Pfam annotation: Domain name=hATC; Domain location=1-48; Score=-1.1; E_value=0.043; Accession=PF05699.5; Description=hAT family dimerisation domain
MARDMLAILIFTLASESVFSTKGRVLDPNCCSLTPQMMETLVCTQDWIKRTPSPLPSNENEEFLEFEIIEEANLVIPSCRPVKVWQKLQVYARGNDVNLTDYKGKVLLVVNVASQWYVLIN

SEQ ID NO: 174265 - protein, 127 aa, Glycine max
  Coding DNA Sequence Number=SeqID_82580
  Homolog annotation: Hit_ID=Q8S6T7; Match level="QueryCoverage=63%, HitCoverage=10%, E-value=3e-08, Identity=39%"; Hit description =Putative activator-like transposable element
MAPTYNDWEFVHSIFPFLEIFYDATLCISGSSHATSTMYMFEAFGIGMKIKEMSTSRGVNMSVRTMVVRMKERYDKYWGNPNRINSFDGEGGELTYKLRDKVESSLRSLLEEYSRGGDEFEVNSQEA

SEQ ID NO: 174266 - protein, 30 aa, Glycine max
  Coding DNA Sequence Number=SeqID_82581
MGARDSSFMNKAHHEVRKEHPGLAKVSIML

SEQ ID NO: 174267 - protein, 166 aa, Glycine max
  Coding DNA Sequence Number=SeqID_82582
  Gene Ontology: Mol. function=hydrolase activity, acting on ester bonds; Cellular component=cellular_component; Biological process =lipid metabolic process
  Homolog annotation: Hit_ID=A7NVD4; Match level="QueryCoverage=85%, HitCoverage=36%, E-value=3e-58, Identity=71%"; Hit description =Chromosome chr18 scaffold_1, whole genome shotgun sequence
  Pfam annotation: Domain name=Lipase_GDSL; Domain location=1-147; Score=0.1; E_value=0.006; Accession=PF00657.13; Description=GDSL -like LipaseAcylhydrolase
MVIKRGRIQNKSRMKGTFKMLRFTETDAYDFAKPYNEVAQYFNHKLKEVVVLLRKDLPLAAIIYVNIYSVKYSLFSNPRKYGFRDPLVACCGFGGKYNYNNDVGCAETIEVNGSRIFVGSSTRPSVRVVWDGIHYTEAANKFIFSQISTGAFSDPPLPLNMACHKS

SEQ ID NO: 174268 - protein, 207 aa, Glycine max
  Coding DNA Sequence Number=SeqID_82583
MDESTKKRKGSSSTTATAGHCRHRPSEAPTAPGTIFYDWKFDYSSRDARRMVCNDQADMTGSLLAGSLTFDCRIMHYIIVHILLPRSSNLAQASEGGLDFDMGFPYRFLLMMNLLFKSRDLFAIGAGAITSFGYRKDYDGQWLRKQDLPHEPFIGDHFDAMDGCLNAMDARFAGMDTRITQLEDDMGFIHRCFDPLADSYLDYALFY

SEQ ID NO: 174269 - protein, 90 aa, Glycine max
  Coding DNA Sequence Number=SeqID_82584
  Subcellular localization annotation: CTP_CleavageSite=22; ConfidenceScore=5.52e-01
MAESSRKRKGSSTSTTATRTPRLGATGASPTQIPPSLSSSTLFSSDEQRICQGAPFEGTIVDDWKFDYSRLDARHMVYNDQADMSDRLLA

SEQ ID NO: 174270 - protein, 89 aa, Glycine max
  Coding DNA Sequence Number=SeqID_82585
MFVFNSALKGLDDTPQSKSNVGTRWIVVKKKGSTEYEYYVIHWMSTIIFGSFKNNWETYFNDATPLEQERLKALCIQWAKYYLKVRNET

SEQ ID NO: 174271 - protein, 126 aa, Glycine max
  Coding DNA Sequence Number=SeqID_82586
MVASTNKHCFKINSRSSFCLKTKCFQEIKALEQMKADMSALKEQMASMMEVMLGMRQLMEKNVATAVAVSSAAEANPTLLATVHHPPSIFVEPSVSSKWSFRNEMLTSKISFMVMSISHQHTPFPW

SEQ ID NO: 174272 - protein, 83 aa, Glycine max
  Coding DNA Sequence Number=SeqID_82587
MELQRLNQNEETNKRKRSIALKASSSMQEEEEEEEEETDDEEDFSLFVKKFHKFVKNRRMERSHNFNNGKRSPEVSPTLKCYK

SEQ ID NO: 174273 - protein, 131 aa, Glycine max
  Coding DNA Sequence Number=SeqID_82588
EGTSTQDSLYTATSVNDNEIYLNVVGAPNYKGNMYGLGTLSKRFSCSKSAPSTSIAPVEDQIKEMCETINKLNAELLAKANKEKTLEEKMLQLMENHDHQTPSLSTTITDGTEHHINDAQVDRPHDMGNDH

SEQ ID NO: 174274 - protein, 91 aa, Glycine max
  Coding DNA Sequence Number=SeqID_82589
MFQMQGEQTRDLYEEGFMPNYYWWTNHSEELPQFPPIVFQGSYYESGGQRKELNPYEQMIIDHVGPSIGQYIEQECVIETKCMEENPNPEA

SEQ ID NO: 174275 - protein, 193 aa, Glycine max
  Coding DNA Sequence Number=SeqID_82590
  Subcellular localization annotation: CTP_CleavageSite=7; ConfidenceScore=5.03e-01
AAIGPAVTSHEQSLLSPPIPQPQLAVPTFFAPIPPAPKAGLPTGTHYTAIGTGGSPFPPVPPAAPTGVGMGVGAVRVGDGGGLIGGGNDGGSDGVSGGGSGVVGIGAAGGGDCERKEDGEELVSRWSSSSKVKVTWSGLEGSLAMASSMHSILVLGGGASAMVGGFNESTNCYDPRVRGLGDLQKKRIEEKEC

SEQ ID NO: 174276 - protein, 371 aa, Glycine max
  Coding DNA Sequence Number=SeqID_82591
  Subcellular localization annotation: CTP_CleavageSite=21; ConfidenceScore=5.37e-01
MDGVISTWRGSSKSKSPFEQVASSLTGRTKTVGVISLFGMPDAEALALSRMHSLGVESSMMYFFCGLSVFQLMKLKIWVGIVAGGMFRFILILIRTILAAQLKKEEQEQHVEVFTYSLISLLFLQGGKRIHVHELVREGCVPEFGKCSWFKILVEQHRASSLGGHAYACGACLCHCHNGWKGTCKTKNSDAQIRICVRRLKQGLFVSLVDNSRLIDNNRELKDNYISLPSSESVCGQKRLSGAEKVSSCVEGRVTSLSSPPSVDECCPVSGVVALTNVRVTSRCGLSSPRAWSCVVRAASAKLFVMDVCQVSSDSRGSIEQSIRDREVIPIGGSSSEHTRRGASDSKSSSLEKVRTSCRTSGSTSHPCGRA

SEQ ID NO: 174277 - protein, 200 aa, Glycine max
  Coding DNA Sequence Number=SeqID_82592
  Subcellular localization annotation: CTP_CleavageSite=96; ConfidenceScore=5.06e-01
MWTTTGEELARRAQLAQASKVASSRSNSLLEEGSGRPKTPSISKRLTKGCVSSSNNSRTKLGYDTTPVTVGNAGVCGGGFVMAVGARLQSLKFRITAMTIGDVEIRGGGFIVAARCTVWLEMPRPSSVEMTMLCGCLCSADTVVVRLKEREEKDAEGVVIRGEGKDVNLRMSSLEGVTADGVAVNGVDIASVFLEGAYGV

SEQ ID NO: 174278 - protein, 96 aa, Glycine max
  Coding DNA Sequence Number=SeqID_82593
MNNVQNILREGRIRRGLRIVEHSMEYGKIGGVRERDQKRMGMGNGERSENEDGMTMGKEEMGKPGRTRGGRGKIMGRGKEIKASTSITLGLKREKS

SEQ ID NO: 174279 - protein, 152 aa, Glycine max
  Coding DNA Sequence Number=SeqID_82594
  Gene Ontology: Mol. function=oxidoreductase activity; Cellular component=cytoplasm; Biological process=flavonoid biosynthetic process
  Homolog annotation: Hit_ID=Q0EDG6; Match level="QueryCoverage=90%, HitCoverage=46%, E-value=4e-62, Identity=75%"; Hit description =Flavonol synthase
  Pfam annotation: Domain name=2OG-FeII_Oxy; Domain location=32-113; Score=62.0; E_value=2e-15; Accession=PF03171.11; Description=2OG -Fe(II) oxygenase superfamily
MNWRGAVAVLVYVIALCLEENQLKKVTNGDEMHYLLKINYYPPCPCPNLVLGVPTLTDMSYLTILVPNEVQGLQVCRDGHCMIRSNGKYKAVFHRTTVNKYETRMSWPVFIKPKKEHEVGPHPKLVNQDNPSKYKTKIYKDYAYCKLNKIPH

SEQ ID NO: 174280 - protein, 165 aa, Glycine max
  Coding DNA Sequence Number=SeqID_82595
  Gene Ontology: Mol. function=oxidoreductase activity; Cellular component=cytoplasm; Biological process=flavonoid biosynthetic process
  Homolog annotation: Hit_ID=Q0EDG6; Match level="QueryCoverage=66%, HitCoverage=47%, E-value=2e-44, Identity=59%"; Hit description =Flavonol synthase
MKVLRVQTIASKSKDAAIPVMFVRGETEQPGITTVQGVNLEVPIIDFSDPDEGKVMHEILEARYGTKLQKEVNGKKGWVDHLFHTVWPPSSIDYRYWPKNPPSYRPADQPVWPVGSAGRGRTNLFGLCKKRDGLTRSAANADLCGRALRGTGRPAYPPLLFPSRS

SEQ ID NO: 174281 - protein, 113 aa, Glycine max
  Coding DNA Sequence Number=SeqID_82596
MEMELVLADVMRYQRNLGNKGDRGWLEKLHKSAKLFRFEVLQDWDDIVNLCAKDRATGHGAETAMDADEVIKKIDGRVDDEDIQEVLSEALILDLNRQQWTKDIKWLTDDQSS

SEQ ID NO: 174282 - protein, 51 aa, Glycine max
  Coding DNA Sequence Number=SeqID_82597
MARRLREDWARDPGEGPRVLMNLRVDFGFMGADRLIQVTEFWVVATSREGR

SEQ ID NO: 174283 - protein, 127 aa, Glycine max
  Coding DNA Sequence Number=SeqID_82598
MPVGLRYPDPNQCSCSTTYLGRHLPVCRYCTSETPSGPREVQQGTGISSIDHRPLPVLRGTGHAHKADPDPQLTALGPHTPKQFKAIVAWPGDRPNFQGGTGPTEAQGDEDEADEDGDMANVMDFFL

SEQ ID NO: 174284 - protein, 63 aa, Glycine max
  Coding DNA Sequence Number=SeqID_82599
MVEVLQRAYSDHNPLYANDVLTSLDNVKEETLVFNKEVLESIFCCKERALGKDQRPREVLGER

SEQ ID NO: 174285 - protein, 114 aa, Glycine max
  Coding DNA Sequence Number=SeqID_82600
  Gene Ontology: Mol. function=nucleic acid binding
  Homolog annotation: Hit_ID=Q2QYQ5; Match level="QueryCoverage=80%, HitCoverage=6%, E-value=1e-09, Identity=34%"; Hit description =Retrotransposon protein, putative, unclassified, expressed
MDPVGFIFGGYCGVDCRLEDLGFKGPLFTWEGRGVKEMLDYAVGNELWRFGFLDSTVIHLLFLKSNHKVILLRTTQDNFVGGVKPFKFHACWLVNNSFHDVVRGTWNGAQHYLA

SEQ ID NO: 174286 - protein, 117 aa, Glycine max
  Coding DNA Sequence Number=SeqID_82601
  Subcellular localization annotation: CTP_CleavageSite=47; ConfidenceScore=5.68e-01
MAIPPSSPPPPTDSTSHSPSIMKRTIKATRLRSLATRPVGAERPLVRVDPFKSDLTSKWALVADKDSVYCDLPFSGRARRDGKGVALAPMYPQAFERFILNNKQKEAVKALNLERSR

SEQ ID NO: 174287 - protein, 70 aa, Glycine max
  Coding DNA Sequence Number=SeqID_82602
MESPTVATYPSAAGRGEMENKGSRVVYAQGSFLLFTIDKGVALDPKYPQETRALGGLAAHPGKLELTQAS

SEQ ID NO: 174288 - protein, 182 aa, Glycine max
  Coding DNA Sequence Number=SeqID_82603
MKARAKAVADTYSTPDEVHSLFNYCQHMFLHYSLHSFFNSHRCRQNIIIVIKKNKCTLRNPYQTRAKARIMSEIEEVQEQMKVDMEAMKDQITTMMEAMMSMRKMMEVNTAAVTATSAATRWTRLTRLGGEALGSTGSPHFVQVQSKHPFPPYGLPPNNAPPNVVHVPNENVDHSAPILIEI

SEQ ID NO: 174289 - protein, 201 aa, Glycine max
  Coding DNA Sequence Number=SeqID_82604
MDPLADLEAKAVQSANWGSILLARDLFCGVKPTSKANKIYVEPHDPQFVARQFGLTQHLHMAFLTMTSPKSRLLLSTKKMPILKRLPFYLLQANDHVQLDPISQTPSQPNHFLLVQLLFWLKRRKVHQLESPLTIHQLCNQKFDQAKQTLFAPPIPSTSAAPSTTIPQVEIMDYIVEVSAGISSAQVVVVAPNIAIGASKH

SEQ ID NO: 174290 - protein, 29 aa, Glycine max
  Coding DNA Sequence Number=SeqID_82605
MAMWIKENIQHLFSILMNERGFEDSNQRV

SEQ ID NO: 174291 - protein, 78 aa, Glycine max
  Coding DNA Sequence Number=SeqID_82606
MGSEIAPSRLAPLSCLTRRADLALSALLQFRCSSRFLLHAKRAEAALSDGYALSELSGLSATVTLALQEISSFLPKIV

SEQ ID NO: 174292 - protein, 34 aa, Glycine max
  Coding DNA Sequence Number=SeqID_82607
AYCKIDGMSTDVFIGGIPAQNRAGHLLICLLGIH

SEQ ID NO: 174293 - protein, 76 aa, Glycine max
  Coding DNA Sequence Number=SeqID_82608
MAEEEKRNKKELIQHLQPELDQQIQEGGRQLVQPINTVSTWKADDILLLTVQPVNLKSMKKRWKKSFRRKLCKMIC

SEQ ID NO: 174294 - protein, 170 aa, Glycine max
  Coding DNA Sequence Number=SeqID_82609
  Homolog annotation: Hit_ID=A7PC42; Match level="QueryCoverage=34%, HitCoverage=68%, E-value=8e-23, Identity=93%"; Hit description =Chromosome chr2 scaffold_11, whole genome shotgun sequence
MGGEENVKHLEDCSVSNKYNYNAADSECLTIHEGVGTLEHRIIRMLSRLYAPINFRVNPPVDHPKGLLKLLYCIGIQIGAYHDVHDHGYSSVVNWGKFGVLLNGALLAIPVGIKRKSLAPLVFFGTTGTMLDIIMGISACEREHAERQMKLLEAQNAAAETSLGETEIDS

SEQ ID NO: 174295 - protein, 211 aa, Glycine max
  Coding DNA Sequence Number=SeqID_82610
  Gene Ontology: Mol. function=aspartic-type endopeptidase activity; Cellular component=small subunit processome; Biological process=DNA integration
  Homolog annotation: Hit_ID=A5CB76; Match level="QueryCoverage=92%, HitCoverage=77%, E-value=5e-31, Identity=36%"; Hit description =Putative uncharacterized protein
  Pfam annotation: Domain name=GRP; Domain location=134-185; Score= -26.6; E_value=0.041; Accession=PF07172.2; Description=Glycine rich protein family
  Pfam annotation: Domain name=zf-CCHC; Domain location=185-202; Score =8.1; E_value=0.091; Accession=PF00098.14; Description=Zinc knuckle
  Pfam module annotation: Pfam domain module=GRP::zf-CCHC; Domain location=134-185::185-202
MASADPSASVELWFLGQGYHDHLEKRASAVPNDKKSEWEKLDFQLCAVLWQSVELDVLETLRSFKTCSFWKKAQEIFANDIQSKARAAVEELKRFLVADSLEEVNRKLDKFYMVLILRSLHSDFDHVRDQVPSMDSLITRLLRVPHVLKDENLAEVEETSAMVAPLGRGGGRNNRGGRGGRSGRPQCTYCRKMGHTQENCYFTPYMAFLTR

SEQ ID NO: 174296 - protein, 96 aa, Glycine max
  Coding DNA Sequence Number=SeqID_82611
MEKEKETQGLERASCQYRKTRTETAACGPHAPELAWVGGGVWRRVAGILATRLPQVSRTLQGAPNPGFARRYDGRRWWRPAADSDQSQNNYPLIPT

SEQ ID NO: 174297 - protein, 148 aa, Glycine max
  Coding DNA Sequence Number=SeqID_82612
MATQLIRDRVVMECLEGVWVTLEGNERCQFRGTVRLIATSLVHPEQPAHTLQQPVEWILPTPTPCRLVEPVQLIEVSSSEEDPEGDPEELSPEPAMDAPDLPEDDDDPLLDVDSPEDIMPAPEADSTEESGLGGMANNDDSSSQQTTP

SEQ ID NO: 174298 - protein, 115 aa, Glycine max
  Coding DNA Sequence Number=SeqID_82613
DDKGDDKKLKGQSKNEFKIFKIESRTLQDSRGKLISRIKNQDSRDQDFKNQDSRDQDSRLKIQESREGLIKIRYILCGTSRGYIYLGLTENKRGYISCGSVLVEGTSTRFKENKG

SEQ ID NO: 174299 - protein, 82 aa, Glycine max
  Coding DNA Sequence Number=SeqID_82614
MIIQKGGFRKYYWAYGKPTPEETSASRIGHENRSGKLVQEICPNVTHCDLPSMESWRTRGIPVLEPLAWRVGRRLELEKNSW

SEQ ID NO: 174300 - protein, 89 aa, Glycine max
  Coding DNA Sequence Number=SeqID_82615
  Gene Ontology: Cellular component=nucleolus
  Homolog annotation: Hit_ID=A7PHE5; Match level="QueryCoverage=51%, HitCoverage=9%, E-value=4e-14, Identity=84%"; Hit description =Chromosome chr17 scaffold_16, whole genome shotgun sequence
  Pfam annotation: Domain name=NOP5NT; Domain location=11-76; Score =43.8; E_value=6.1e-10; Accession=PF08156.4; Description=NOP5NT (NUC127) domain
MAQCIKVAIALFLLYKSASGYALLEAHGLDEIGHNTEAVRNSVSDLNRFGKVVKCRSFNPFNSFNRFATPFRTSTGCHSKELVFLKAFI

SEQ ID NO: 174301 - protein, 60 aa, Glycine max
  Coding DNA Sequence Number=SeqID_82616
MERENRIAQRQYIWRLQSLFRLSDVWELYQNSRRKNWKNLRKPLEMPLSLSEDMVLLSML

SEQ ID NO: 174302 - protein, 102 aa, Glycine max
  Coding DNA Sequence Number=SeqID_82617
MGEEEKKPEENKVEEKKAEEEEKKEEEKKPKESKDDKESKEEFVPPEIMQGTTFAMHGHFKHDFCHLLSYGLFCNTYAKDRNYFEFFIKLGTNMQQEYKVRD

SEQ ID NO: 174303 - protein, 434 aa, Glycine max
  Coding DNA Sequence Number=SeqID_82618
  Gene Ontology: Mol. function=aspartic-type endopeptidase activity; Cellular component=anchored to membrane; Biological process =proteolysis
  Homolog annotation: Hit_ID=A7NV28; Match level="QueryCoverage=92%, HitCoverage=76%, E-value=1e-143, Identity=58%"; Hit description =Chromosome chr18 scaffold_1, whole genome shotgun sequence
  Pfam annotation: Domain name=Asp; Domain location=12-359; Score= -85.4; E_value=1.5e-08; Accession=PF00026.14; Description=Eukaryotic aspartyl protease
MLKKVGDGVLHYTWIDIGTPNVSFLVALDAGSDMLWVPCDCIECASLSAGNYNVLDRDLNQYRPSLSNTSRHLPCGHKLCDVHSVCKGSKDPCPYAVQYSSANTSSSGYVFEDKLHLTSNGKHAEQNSVQASIILGCGRKQTGEYLRGAGPDGVLGLGPGNISVPSLLAKAGLIQNSFSICFEENESGRIIFGDQGHVTQHSTPFLPIDGKFNAYIVGVESFCVGSLCLKETRFQALIDSGSSFTFLPNEVYQKVVIEFDKQVNATSIVLQNSWEYCYNASSQELISIPPLNLAFSRNQTYLIQNPIFIDPASQEQEYTIFCLPVSPSDDDYAAIGQNFLMGYRMVFDRENLRFSWSRWNCQDRASFSSPYSVGSPNPLPVDQQQSFPNAHGIPPAIAGHTSPKPSAATPELITSRHSLVSLLLICHLWLWLFC

SEQ ID NO: 174304 - protein, 630 aa, Glycine max
  Coding DNA Sequence Number=SeqID_82619
  Gene Ontology: Mol. function=nucleotide binding; Cellular component =mitochondrion; Biological process=defense response
  Homolog annotation: Hit_ID=Q19PN1; Match level="QueryCoverage=45%, HitCoverage=20%, E-value=1e-37, Identity=36%"; Hit description=NBS -LRR type disease resistance protein
  Pfam annotation: Domain name=NB-ARC; Domain location=342-619; Score =111.8; E_value=2e-30; Accession=PF00931.13; Description=NB-ARC domain
MSRYDVKSIANSTLPIGGLSGKNKNSTDSASESKSHEPSQSDGDPSSASSQDPSDYWSILGYHNTPLDNSGIRNTTSTVTTTTFPSSNNGTASSLTPFNMEFSSAPSSTGSDNNAAFFSGGGIFVQQQTSHGHGNGSSGSSSSSLSCSIPFATPIFSLNSNTSYESSAGYGNWIGPTLHTFQSHAKPKARKNWNHKDMIAKEILQKNWNDKDMIGWSFSRRIGQLCIFQQVEMSGGTHNQNNETGDVKDHTNGGSNGDDALTINQLLSRLTRAEDNIDKKLQWLEFQGNKRKRQDDDWLDKLKDLKKRAIDVKNSLHQSGSTNEFPEPYELGDEFDELLLMKPWMLLDERDENMEKMWDLLEHEEVLIIGIDGMGGVGKTFMATHFKNEIKRKGTFKDVFWVTVFDDFTTFKLQHDIAATIQVKLYGDEMTRATILTLELEKRGKTLLILDDVWEYIDLQKVGIPLKVNGIKLIITTRLKHVCLQMDCLPNNIIRMHPLSGEEAWELFLLKLGHRGTPARLPPHVLEIARSVVMKCDGLQLGISVMARTMKGKNEIYWWRHALNILDRLEMGEEVLSVLKRSYDNLIEKDIQKCFLRSALFPNETRKEEWVMMVVESGGTVSLFVIFQQA

SEQ ID NO: 174305 - protein, 107 aa, Glycine max
  Coding DNA Sequence Number=SeqID_82620
MSMRDLQSSNPSRRNINGSNDNKIGFSVDRSQRFEKHTYGYIEFVVPRRTYIHHRRLFGGGDSVATGVWVFLGLGFFAVSLEERGMGVKDECGVGGGGGTREKVEKV

SEQ ID NO: 174306 - protein, 471 aa, Glycine max
  Coding DNA Sequence Number=SeqID_82621
  Gene Ontology: Mol. function=protein binding; Cellular component =cytoskeleton; Biological process=red or far red light signaling pathway
  Homolog annotation: Hit_ID=A7NV34; Match level="QueryCoverage=100%, HitCoverage=98%, E-value=0.0, Identity=70%"; Hit description =Chromosome chr18 scaffold_1, whole genome shotgun sequence
  Pfam annotation: Domain name=F-box; Domain location=35-82; Score =38.0; E_value=3.4e-08; Accession=PF00646.24; Description=F-box domain
  Pfam annotation: Domain name=Kelch_1; Domain location=164-209; Score =53.0; E_value=1e-12; Accession=PF01344.16; Description=Kelch motif
  Pfam annotation: Domain name=Kelch_1; Domain location=211-260; Score =52.0; E_value=2.1e-12; Accession=PF01344.16; Description=Kelch motif
  Pfam annotation: Domain name=Kelch_2; Domain location=164-209; Score =29.3; E_value=1.4e-05; Accession=PF07646.6; Description=Kelch motif
  Pfam annotation: Domain name=Kelch_2; Domain location=211-260; Score =18.0; E_value=0.036; Accession=PF07646.6; Description=Kelch motif
  Pfam annotation: Domain name=Kelch_2; Domain location=331-376; Score =3.1; E_value=19; Accession=PF07646.6; Description=Kelch motif
  Pfam module annotation: Pfam domain module=F-box::Kelch_1::Kelch _1::Kelch_2::Kelch_2::Kelch_2; Domain location=35-82::164-209::211 -260::164-209::211-260::331-376
MANTKANQSESSATSPNETSKRQRMSPASVEECPRLIPNIPDELSLQIIARLPRICYYHVRLVSRRWKTTITSLELYKVRKELGTTEEWLYLLVRIGQNKLLWHALDPRSRIWQRLPIMPRVVDEEDSQKVSSRLWMWNMVEGIRIAEIIRGLLGQKDVLDDMPFCGCAFGAVDGCLYILGGFSKASTMKCVWRFDPIQNSWKKVNSMSTGRAYCKTGVLNNMLYVVGGVSQGQAGLIPLQSAEVFDPFKDTWSDVPSMPFSRAGVLPTAFLADMLKPIATGLSSYKGRLYVPQSLYSWPFFVDVGGEIYDPETNSWMEMPNGMGEGWPIKQAGTKLSVVVNGELYAFDPSNSVDSGRIKVYDQGEDAWKVVIGKVPVYDFTELEYPYLLAGFHGKLHFITKDANHDISVLQADLCSNLDSSQSTSTPQSPKSMEDELLQESTETDEVIWKLVASKGFGQAELINCQVIDI

SEQ ID NO: 174307 - protein, 46 aa, Glycine max
  Coding DNA Sequence Number=SeqID_82622
MDTRLRVIGDPMNGVQRGWGHNPLFEDPPSECGGGAATVRYELISK

SEQ ID NO: 174308 - protein, 79 aa, Glycine max
  Coding DNA Sequence Number=SeqID_82623
MFNPTQFQAKEEKVKVVDDSLSEADPLSEMHPLSEASSSLSGWETLEEDKPEIYMLNAQPARPARTLSLLALSAPMLAK

SEQ ID NO: 174309 - protein, 31 aa, Glycine max
  Coding DNA Sequence Number=SeqID_82624
MTPLMKKIQGLQAPHGATSIGVPQVVDLGPV

SEQ ID NO: 174310 - protein, 394 aa, Glycine max
  Coding DNA Sequence Number=SeqID_82625
  Homolog annotation: Hit_ID=Q5NRP4; Match level="QueryCoverage=24%, HitCoverage=6%, E-value=2e-08, Identity=34%"; Hit description =Putative gag-pol polyprotein, identical
MSYHSSSIDVKGTSHKDPLSRILDELSSLKLWKENLERKEKGKERVEINQDEIKQIREEERRKILKEVRKEKHASYSSHDPCKSLSEELRDYYEGRHRSHLRHHSHGREKERKPQEANINLSYFHGKDNAETYLDWEIKVEQQLKRKSTSKSYCPHSYPKKDQGQGILGAAPSKPKDDKGKTIEKQPLKASMQEKTSSIKYFKCLGRGHITSQCPTKKTMIMRGQEIYSSQDEATTSPYSSERQPLMVKEECKEVSVSSKRLAKKECHFAIKTNIKETFLLRKPPHLPLYKKTLVSNTIPLGLEIIPQLKELLDEGLVCKSLNPCALLVPFRGMSEVEREHCRAIRKVPQHSRGQKRDYCIIRKGVPTEGVAFWWKQPSSPGQAGQQPPPSFSL

SEQ ID NO: 174311 - protein, 76 aa, Glycine max
  Coding DNA Sequence Number=SeqID_82626
MTPKKSEHVKMITKDDDKGDDFKMFKIESRTLQDSRGKLNSRIKNQDSRDQGSRLKIQESRKGYSRIKKKLNQDKY

SEQ ID NO: 174312 - protein, 75 aa, Glycine max
  Coding DNA Sequence Number=SeqID_82627
ETSLSTTIPLELEVIPQVKELLDEGLLRKSLNPCALLVPKIGLLMNPKRIKVIPEWPTPPSVEERINEFQEPLDL

SEQ ID NO: 174313 - protein, 168 aa, Glycine max
  Coding DNA Sequence Number=SeqID_82628
MVRWRTYNFKVDGEQREQESLDGEEDREKEKTTRRRRNIPSATKTMLECDEHDAQMQIGTLKLLLDAVVEVHDGIILVVDVVHVVVDSVLVERVVLFRGRREVDVEFGNLDEAMDESEECWPLGPMMAKRCVGIWRMEELEARVFFDAKVSWVESGFGLWMLGYGYLT

SEQ ID NO: 174314 - protein, 276 aa, Glycine max
  Coding DNA Sequence Number=SeqID_82629
MTVLTPLDPEIENTFQKLKGEASRAKKQLFEEGSSSSSSIEATEIDNKGMVEVDQTMTKLATDQGIDASQPIRPPNTKDNQINFPAWVHKNLNHNQFMGVSTEDSHAHLTRSIQLCISVRLSGITNDYKRMINASARGNYLNKTTTQVNTIIEDLTASEKTIETNLSNPPTEEAIKDQNALRYQPRRLTTWEDNNDRTITSNKEGVTWELKKKKGGRKHHAKGRDESTSQPLNPSMLRIHKQRDDERMAKFKKYMEMLQGKKKEPPIEKLTWDVLH

SEQ ID NO: 174315 - protein, 79 aa, Glycine max
  Coding DNA Sequence Number=SeqID_82630
  Pfam annotation: Domain name=zf-CCHC; Domain location=38-55; Score =16.4; E_value=0.0051; Accession=PF00098.14; Description=Zinc knuckle
MLPPNNKKGAERPKLRKKDPDESSTRNKTKLRKTNVHMTCSRCGQKGHNRKTCKSTPKGQQPNTQAIQLNKVKILEPQS

SEQ ID NO: 174316 - protein, 99 aa, Glycine max
  Coding DNA Sequence Number=SeqID_82631
MISNANFFALYAVDEDVASDAEEIHVDCPIIGEGGDEANVDEELAESSNPPSHNPKHMPPNKEVFDRKDDRVNQDMKIVSNLWADKAEEDDNSLHLSAL

SEQ ID NO: 174317 - protein, 203 aa, Glycine max
  Coding DNA Sequence Number=SeqID_82632
  Subcellular localization annotation: CTP_CleavageSite=38; ConfidenceScore=5.10e-01
MAFGVVAIAFLSSVSLYHMVASPSRSLTMVALTYLVIVANMLYYLALSHSPPFHDHRTRCLISTSNKYNGVGGGSMDIEISCIENLLGSILAAMTRPAGGSHGVLMITKDDDKGDDKKLKDQSKNNSSESRTIQEFKIRIKKNSRVQDKNQEEFKTQEESLESRIKIQGSRSQESRSRFKTQDSRIKRRLNQDKYGKFFSKIE

SEQ ID NO: 174318 - protein, 367 aa, Glycine max
  Coding DNA Sequence Number=SeqID_82633
  Homolog annotation: Hit_ID=A7NV42; Match level="QueryCoverage=56%, HitCoverage=47%, E-value=8e-79, Identity=67%"; Hit description =Chromosome chr18 scaffold_1, whole genome shotgun sequence
MANGSHGKEVSHRVVGDTIGLKDGIRNTCCIGLESCMGDEKKGVSSKKKTETTELLKPNFTVKQLLYMHGKPDTLSKQQRNDDLKIETRPEEADDPDCVVAPEFWVSDFETFWAGPCLVRHTRSSDHWKKWRWLAAVMLAGDNGRQHTAGRARSTRFDTNNEYPLFIPRQNYCSTDGENSWSERSSSNFGVASVESERRHRLDSSGSTSFNYSLASSHSVQTHKDLQKGISLLKKSVVCITAYCYNSLCLDVPSEASTFEAFAKLLATLASSKEVRSVFSLKMARSSIDISISYNNKSLIPLAERIENYLPSSTGSFLYAADLSDGKNECLIEGWDIVEHPTFPPPPSQSEDVEHWTRAMFIDAKGK

SEQ ID NO: 174319 - protein, 368 aa, Glycine max
  Coding DNA Sequence Number=SeqID_82634
  Gene Ontology: Mol. function=protein dimerization activity; Cellular component=nucleus; Biological process=regulation of transcription, DNA-dependent
  Homolog annotation: Hit_ID=A4ZGS2; Match level="QueryCoverage=63%, HitCoverage=100%, E-value=1e-126, Identity=97%"; Hit description =Transcription factor bZIP83
  Pfam annotation: Domain name=bZIP_1; Domain location=61-124; Score =25.5; E_value=0.0002; Accession=PF00170.12; Description=bZIP transcription factor
  Pfam annotation: Domain name=bZIP_2; Domain location=61-122; Score =9.6; E_value=0.045; Accession=PF07716.6; Description=Basic region leucine zipper
  Pfam module annotation: Pfam domain module=bZIP_1::bZIP_2; Domain location=61-124::61-122
MGIYDPFHQVNMWGDSFKIDGSLNSIAPQMLMIKPSMRNKSECTPHESREPSGDDQETNDKADTKALRRQAQNREAARKCRLRKKVVKTEFIGRWPAYVQQLETSRVKLMQLELEIEKARKQGMYIRRALDVSYMGSSATVNPARITLFELEYGQWIEEQDRQNQELRNALQTQASEMQLHLLVESCLSHYSNLFRMKAEAAKADVFYLISGAWKASVERLFLWIGGSRPSQLLNIIAPQLEPLTDQQIVSISNLRLSSQQAEDALSLGLDKLQQSLVHNIPSDPLVVGHYGFEMAAAMDKGEALEGFVNQADHLRQQTLIHMSRILTTGQAAKGLLAMGEYFHRLRTLSSLWTARSCDPSFPTQLSN

SEQ ID NO: 174320 - protein, 27 aa, Glycine max
  Coding DNA Sequence Number=SeqID_82635
MAGAAVLREGVETAEAATAACDEGAAE

SEQ ID NO: 174321 - protein, 205 aa, Glycine max
  Coding DNA Sequence Number=SeqID_82636
  Gene Ontology: Mol. function=RNA-directed DNA polymerase activity; Biological process=RNA-dependent DNA replication
  Homolog annotation: Hit_ID=Q2R6I2; Match level="QueryCoverage=65%, HitCoverage=13%, E-value=2e-09, Identity=24%"; Hit description =Retrotransposon protein, putative, Ty3-gypsy subclass
MEECEAAFRQFKETLSTPLTLTKLDPGETMYSFGDSNRHESPSAKVFNNFKLMVNQLNRAFHVKEPIFQKYAIKIGVIKERFKKMEFIYIPREKNLKADLLSKLSNIEENVGMENVVHQTIHTLRLNIKERFTSLEHPQSNGQAKATNWIILTIPRSVARETPFKMVYGTEVIILVEIRDPTFRIANLNLNQYEGNIKIKLDLIE

SEQ ID NO: 174322 - protein, 128 aa, Glycine max
  Coding DNA Sequence Number=SeqID_82637
  Homolog annotation: Hit_ID=Q6WAY6; Match level="QueryCoverage=91%, HitCoverage=20%, E-value=1e-13, Identity=35%"; Hit description =Putative uncharacterized protein
MIEFSVEAITSLTQYYDQPLRCFTFGDFQLVPTVEEFEKILGCPLGGRKPYHFSGFYPSMARVAKVIKISVQEVDRVKKNRNGVVRIPRKHLEGKAKALADQREWASFIDIFALLIFGVVLFPNMERL

SEQ ID NO: 174323 - protein, 101 aa, Glycine max
  Coding DNA Sequence Number=SeqID_82638
  Gene Ontology: Mol. function=secondary active sulfate transmembrane transporter activity; Cellular component=integral to membrane; Biological process=sulfate transport
  Homolog annotation: Hit_ID=A7YGI3; Match level="QueryCoverage=99%, HitCoverage=14%, E-value=1e-32, Identity=73%"; Hit description =Sulfate transporter
  Pfam annotation: Domain name=STAS; Domain location=1-89; Score=25.2; E_value=0.00018; Accession=PF01740.12; Description=STAS domain
MDEEELVKGDYQTRIQFLMVEMSPVTDIDTSGIHALEELFRSLQKRDVQHLFDQLVLANPGPIVIDKLHTSNFATLLGEDKIFLTVAEAVAYCSTKLAEEP

SEQ ID NO: 174324 - protein, 130 aa, Glycine max
  Coding DNA Sequence Number=SeqID_82639
  Pfam annotation: Domain name=zf-CCHC; Domain location=61-78; Score =30.9; E_value=4.6e-06; Accession=PF00098.14; Description=Zinc knuckle
MKHSTKASSSMQDENEDEESEDEEDFSIFVKKFHKFVKKRRIEKHQNFNHGKRFQEDSPTLRCYKCNQFGHIKANCPSNEQWPEKNEKKSHEERRSKKAYIVWDDNDSSDGSEKEINHLSKDYESDENIS

SEQ ID NO: 174325 - protein, 188 aa, Glycine max
  Coding DNA Sequence Number=SeqID_82640
MVSISYIVGGGSSMDYLVVLTLNFVSEIFIGLLISVGTERMLEVMESPSQTLSQLTSSSEKYSYLVIGIMKHIIDNEDWCYTLCLCNKSVYLDEKQWFCDKCNRHVKKVVPDYLDNTEIEVLTWKVPPVALAILADVEGAAFSIGETRHIESRLSHWRDTFTLQLHCCPGSDLHVTGYSLPKVSHSSV

SEQ ID NO: 174326 - protein, 40 aa, Glycine max
  Coding DNA Sequence Number=SeqID_82641
MGLHHLWISSSGAYIHLVVQREQGRVIGNLKNRGLLGDWM

SEQ ID NO: 174327 - protein, 58 aa, Glycine max
  Coding DNA Sequence Number=SeqID_82642
MATSRRSTQAVESSTSVIRGLTNLKASPGATVKLCLDDQFGHGFKFGNNFYAYARQQR

SEQ ID NO: 174328 - protein, 42 aa, Glycine max
  Coding DNA Sequence Number=SeqID_82643
MKANLELAMVLLLVSPKNAIVLRLKFVKLYEHFVPLMCIGIS

SEQ ID NO: 174329 - protein, 131 aa, Glycine max
  Coding DNA Sequence Number=SeqID_82644
  Homolog annotation: Hit_ID=A7QZ76; Match level="QueryCoverage=52%, HitCoverage=6%, E-value=6e-11, Identity=45%"; Hit description =Chromosome undetermined scaffold_265, whole genome shotgun sequence
MGNWVHLMYLIMLADLDRVRWYSWGFAFLARPYREICRATDPDAKTMGGCASLLQSWAWYRMPFIAERVNRTPSHILVTRWSGGGLSFTVLVKSISPLFGCFGVNIFRRLLHMDSPHPSNLFLDSRMAPSG

SEQ ID NO: 174330 - protein, 564 aa, Glycine max
  Coding DNA Sequence Number=SeqID_82645
  Gene Ontology: Mol. function=secondary active sulfate transmembrane transporter activity; Cellular component=integral to membrane; Biological process=sulfate transport
  Homolog annotation: Hit_ID=Q9AT47; Match level="QueryCoverage=96%, HitCoverage=83%, E-value=0.0, Identity=81%"; Hit description=Sulfate transporter 2
  Pfam annotation: Domain name=Sulfate_transp; Domain location=191-502; Score=537.0; E_value=2.1e-158; Accession=PF00916.11; Description =Sulfate transporter family
  Pfam annotation: Domain name=Voltage_CLC; Domain location=111-452; Score=-183.8; E_value=0.083; Accession=PF00654.11; Description =Voltage gated chloride channel
  Pfam module annotation: Pfam domain module=Sulfate_transp::Voltage _CLC; Domain location=191-502::111-452
MGDPADENLETKEMDARSLSFSHGQEPYVHKVGIPPRQNLFKEFQSTVKETLFADDPLRSFKDQSKSRKLVLGIEAIFPIIGWGRTYNLTKLRGDLIAGLTIASLCIPQDIGYAKLANLDPQYGLYSSFIPPLIYAVMGSSRDIAIGPVAVVSLLLGTLLQSEIDPIANPVDYRRLAFTATFFAGITQATLGILRLGFLIDFLSHAAIVGFMGGAAITITLQQLKGFLGIEMFTKKTDVISVIHSVLSSAHHGWNWQTIVIGASFLAFLLYAKYIGKKNPKFFWVPAIAPLISVILSTLFVFLIRADKHGVAIVKHIDKGLNPSSVKEIYFTGDYLGKGFRIGIVAGMIALTEATAIGRTFASMKDYQLDGNKEMVALGAMNVVGSMTSCYVATGSFSRSAVNFMSGCETAVSNIVMSVVVFLTLQFLTPLFKYTPNVILATIIISAVINLVDYKAAILIWKIDKFDFVACMGAFFGVVFASVEIGLLIAVSISFAKILLQVTRPRTAILGKIPRTTVYRNIQQYPEATRVPGVLIIRVDSAIYFSNSNYVKERINPVSIKYLM

SEQ ID NO: 174331 - protein, 105 aa, Glycine max
  Coding DNA Sequence Number=SeqID_82646
  Homolog annotation: Hit_ID=A5BP71; Match level="QueryCoverage=71%, HitCoverage=19%, E-value=4e-10, Identity=44%"; Hit description =Putative uncharacterized protein
  Pfam annotation: Domain name=zf-CCHC; Domain location=81-98; Score =18.9; E_value=0.0021; Accession=PF00098.14; Description=Zinc knuckle
MQKVFCASLSMFTHYCSLWLQHILKAYSAQWWPLGNEVAIPPSNDAWTLIPDPTTIRAKGQPKSTRIRNEMDWVESSEHRQKCSRCGAEGHNRRRCPMQSERGSC

SEQ ID NO: 174332 - protein, 144 aa, Glycine max
  Coding DNA Sequence Number=SeqID_82647
MFVDPKNANTVTLAEVAETLQYMVSPQGRNTWTVDDLVPYVEKITILLEEQERITEPMYQYPFKGHHTDMSASEHSFGAPHWNVPGAIPDMGDLLGVDLSQEFFAEAEEVQAGRHRGRRNPDRQARRWDRPCGTSSRHHGHDNE

SEQ ID NO: 174333 - protein, 400 aa, Glycine max
  Coding DNA Sequence Number=SeqID_82648
  Gene Ontology: Mol. function=transferase activity, transferring glycosyl groups; Cellular component=integral to membrane; Biological process=protein amino acid glycosylation
  Homolog annotation: Hit_ID=Q9ZS49; Match level="QueryCoverage=99%, HitCoverage=99%, E-value=0.0, Identity=78%"; Hit description=Avr9 elicitor response protein
  Pfam annotation: Domain name=Galactosyl_T; Domain location=145-343; Score=216.7; E_value=5.5e-62; Accession=PF01762.12; Description =Galactosyltransferase
MKTRTSKKISAKWVPIFSVSSFLIGMLITTRMWEPPESNGVLLSNHRHEQELQVVSGDCATKKPVQDEDVMSKVYKTHEAIQGVRSLDKQVSMLQMELAAARSTREPEISDGSNNTLASGVTTEGPPRKKVFVVIGINTAFSSRKRRDSVRETWMPQGEQLLQLEREKGIVIRFMIGHSATSNSILDRAIDSEEAQHKDFLRLEHAEGYHELSAKTKTFFSTAVAKWDAEFYVKVDDDVHVNLGVLATTLARHRSKPRVYVGCMKSGPVLSRKDVKYHEPEFWKFGEEGNKYFRHATGQIYAISKDLATYISINQPILHKYANEDVSLGAWFIGLEVEHIDDRSMCCGTPPDCEWKAQAGNICVASFDWSCSGICKSVEKIKYVHSKCGEGDGAVWSALV

SEQ ID NO: 174334 - protein, 143 aa, Glycine max
  Coding DNA Sequence Number=SeqID_82649
MRSFSKLIYERILEEFEARLSQARSNATSSVGESQVTPLDPTEEQRLRSWCWVAAVGPKHKGRLYGIGDLVDTYKCRNDSFMQHTQGSSSCAEDATEINRPREELHQSKEDMRVFQSVVLQLLPLEAQNIIHYQQQSHQQHQH

SEQ ID NO: 174335 - protein, 102 aa, Glycine max
  Coding DNA Sequence Number=SeqID_82650
  Homolog annotation: Hit_ID=A5BKY7; Match level="QueryCoverage=97%, HitCoverage=18%, E-value=9e-17, Identity=50%"; Hit description =Putative uncharacterized protein
  Pfam annotation: Domain name=zf-CCHC; Domain location=66-83; Score =23.5; E_value=0.00042; Accession=PF00098.14; Description=Zinc knuckle
MALASILIIKFSSLRLTGVKEETLVIEMGESALLTIACGKNKATKFQANQKGNGKIPSQTDIKKVEKCFFCKKKGHIKKNCPRFQKWLEKKGYAKPKETSGK

SEQ ID NO: 174336 - protein, 82 aa, Glycine max
  Coding DNA Sequence Number=SeqID_82651
MIEMLTLAADANDARRWTLVRGSWLLLTATRLPSRWFVAEEEEEDGSARKKDGCKENARKKKKNARKKNGFVGGRRRMRGRR

SEQ ID NO: 174337 - protein, 227 aa, Glycine max
  Coding DNA Sequence Number=SeqID_82652
  Homolog annotation: Hit_ID=A5B5G7; Match level="QueryCoverage=89%, HitCoverage=13%, E-value=1e-06, Identity=25%"; Hit description =Putative uncharacterized protein
MLFKLSECVSLSQNVFLCCHAKHALCTKKRKATASRPREPYDTTQFISEGAWERYSQNVHSRNILPERNVVLYVNEYDEFRRELERRCWHKALTRQLDGHIDVALVKVFYANLYDPEDKSLKQVRVRGKLIKLDAESLNTFLETLAILEPGEQYTTYTRFCHSRPDPQELAARLCIPGCKFVLNAEGALWKLLRKDLTTLAQTWSVLSYSNLAPTSHTSDLNIERRG

SEQ ID NO: 174338 - protein, 95 aa, Glycine max
  Coding DNA Sequence Number=SeqID_82653
MSDGFCGTHLQIMVRTRGLGRALGQVTGRVIPASDVQDDPVEAPAAVEDIPADILVDAGVEAAEDQPQGFPGGPSDPSVLTAYADHVACSVWTGE

SEQ ID NO: 174339 - protein, 142 aa, Glycine max
  Coding DNA Sequence Number=SeqID_82654
  Homolog annotation: Hit_ID=A2Q523; Match level="QueryCoverage=65%, HitCoverage=27%, E-value=6e-08, Identity=30%"; Hit description =Polynucleotidyl transferase, Ribonuclease H fold
MQLAFGQKYSLLFINLKEYITELIFKIIDSLHHDDYQRWAIWQWRNEKIWENFETPAMIFVSLAYQNLIEWKPVRTPSSKPVQHQQRIESWHPPPTGRLKCNIDALLYIQQLDEWLSQPSRTRSLELIACSYVDKGAESSEH

SEQ ID NO: 174340 - protein, 127 aa, Glycine max
  Coding DNA Sequence Number=SeqID_82655
MCSLSLNSGLYDREVQLSRERQLFGLCAPTFGTFSTRTRGPWITFCCATLGHRKCLGDVLNVRELTIAHHHVVHSYCSRLHSIHSLWGQRIWNNLKIMKGGETMLTLLRVCFFATIQHYIFTAGEDE

SEQ ID NO: 174341 - protein, 426 aa, Glycine max
  Coding DNA Sequence Number=SeqID_82656
  Gene Ontology: Mol. function=protein serine/threonine kinase activity; Biological process=protein amino acid phosphorylation
  Homolog annotation: Hit_ID=Q7XTK4; Match level="QueryCoverage=89%, HitCoverage=82%, E-value=1e-46, Identity=54%"; Hit description =Putative mitogen-activated protein kinase 1
MNHLPRIFGNRKKQASDMDPTKKKKKSKGKKHQQPKLERRNAAKHFEYDAGSLCSSRDEYDASTSSSSSLHCTRSMELFDRKSFRIEGVEGEFDQICRSLGLSGPEDFSIPAAAWEAMKLRCSSDLLPRRPKHGGEEEEFDEEPKEKEKEEVEIAVLESEDRARVLDECVVPAESSGCCGGIKGFRPPMLKPPPGVRVSVVDDATCSTWDLMRDFAPKGEGGGKDSYVELNSSDDEDDHEREEKEEEEEEEEEEGEVGGVRVESVEEENAAAIAEIVGDFSGFSTSNEDDSSSTSTGPRSNNISPNGRIKRVITAGNWQKGELLGRGSFGSVYEGISEDIKCANILVDANGSVKLADFGLAKATKFNDVKSCKGTAFWMAPEGGSYRGEVWKESRPLGILVAFLFWLRLQAESFFSMEHLLCEGRL

SEQ ID NO: 174342 - protein, 243 aa, Glycine max
  Coding DNA Sequence Number=SeqID_82657
  Gene Ontology: Mol. function=protein serine/threonine kinase activity; Biological process=protein amino acid phosphorylation
  Homolog annotation: Hit_ID=Q39008; Match level="QueryCoverage=18%, HitCoverage=7%, E-value=1e-12, Identity=80%"; Hit description =Mitogen-activated protein kinase kinase kinase 1
MGYKLCYFKRASPGAVAAYNIPPPYLRIAKSLWAMGDIRCANILVDANGSVKFADFGLAKEPKFNDVKSWKGTAFFWMAPEVCLQSPPLKKAKEESTQKNFDEGETAQLGLSKVVVTKGATPNQHEMAPNLGNVRAEPVWHGEIGHVRMRERGSLKVAGGWRQLLKNELEKLKMLLEIKQLVEGSTGMWKAKERSLPEKGGSYRGEVWKESRPLGILIAFLFWLRLQAESFFSMEHLLCEGRL

SEQ ID NO: 174343 - protein, 209 aa, Glycine max
  Coding DNA Sequence Number=SeqID_82658
MGASTVDKYSDVSLMNEAINLEGQGLLWEMIRVWVRVNWCVSRFCDEEEYPGRRQSWILSSCNLASVVAWGNDMRCMANTSRRMSGERPEMKQLRRNGGGKPIIRSWQSGILVPVEIPAMSGGGGIGIGEGWLRQSRSNSTLVARVVAITTGEKRGAEGLAITTGEKLFKNAKIISYEYFPIKAIGMHHLSSLVHIPGSNNIECVFHLC

SEQ ID NO: 174344 - protein, 181 aa, Glycine max
  Coding DNA Sequence Number=SeqID_82659
MSRQSWIFSVDPFAYVLWQRESNGYGQDNSNARAEDIGREGCFSQFKLISIFLPWSWTAIFLFALIFFLFLVCYQSLSSTSGQVDPVNNNLRTGMSEVGIVHNMVVIATQRQIALMGLLFESICFKTIYNMGLLFYVKYMQTVSVTGKKPLRATRGENATATSGIVSGLAACAGDIAMHGM

SEQ ID NO: 174345 - protein, 307 aa, Glycine max
  Coding DNA Sequence Number=SeqID_82660
  Gene Ontology: Mol. function=nucleotide binding; Cellular component =myosin complex; Biological process=signal transduction
  Homolog annotation: Hit_ID=A5AK37; Match level="QueryCoverage=18%, HitCoverage=3%, E-value=5e-11, Identity=58%"; Hit description =Putative uncharacterized protein
MIEEDIQVLVTRVSTKGSCAEQRGGYTSITPSGEEHVTNVRPIMGLHVEHDHSTLVALGKKTLHTFIALLRHLVKLVSHEIRPKKHDEPVHRLTVVSGTDPLLDLIQNMSDLYEKPLEMLWNGTQFGIPNLWMMFMKESSSRLGCGQLYGFLKPQSIHNAKDRCDEAQNYIETWVKESQREVYLGPYLNHLLLCVLGTMLLSGSVHCGVMEAIWISCARYPTRKNFDEFVQWFTILEPNVVKACPNEMIACKRLLDRANLKEYQLSAIELQKVARGLLQRLFNSYLFPKTNEINNYCTMFLEDNIGT

SEQ ID NO: 174346 - protein, 112 aa, Glycine max
  Coding DNA Sequence Number=SeqID_82661
MELIYLSLMDQRLKNTRSKIGRRRKTGPVSLNVELCEKHDFFHSPPLQMPTQTLTPSSPPPTTIGGHHKPPLLAAKPPQQEEHFNWSRIHLKDSVEKNSYCILVFKKNNVFD

SEQ ID NO: 174347 - protein, 135 aa, Glycine max
  Coding DNA Sequence Number=SeqID_82662
MEYCLKGVYGTYGSGRGGGVGPHHMLRVASTSRQQEKVQNKNMKQQAGETKVKTQSTISRQNKMQKIKTEATNKQHIIHRENIIKQQMRHRVIIDPVWRSSKPCECDQQEPVMRKKMKWLRPEVGHTMHMERGKC

SEQ ID NO: 174348 - protein, 93 aa, Glycine max
  Coding DNA Sequence Number=SeqID_82663
  Gene Ontology: Mol. function=aspartic-type endopeptidase activity; Cellular component=chromatin; Biological process=chromatin assembly or disassembly
  Homolog annotation: Hit_ID=B0B0G2; Match level="QueryCoverage=47%, HitCoverage=33%, E-value=3e-10, Identity=68%"; Hit description =Putative integrase
QPKSKGKDTILVVVDKLTKYVHFIPLGHPFNAIEVAIVFLQEIVHSLSSVQHIIPKLTDKLMQSYPARALVRRLQVDWARDPRKGPKVLMSLR

SEQ ID NO: 174349 - protein, 141 aa, Glycine max
  Coding DNA Sequence Number=SeqID_82664
MAIVQNLGMDNKKRRTIICKTKPDLNKTFKEATKRWLRGPQQQQAPPDRMSKMEDTLTHFMQVSISNQKNTDAFIKNLEVQVGQLAKQLSEHGSGSFSANTHVNPKEHCNLITKRWGTMVGLKDNGEKKNKEGVEKEKMMK

SEQ ID NO: 174350 - protein, 58 aa, Glycine max
  Coding DNA Sequence Number=SeqID_82665
MAVEWRRRRVERRHHFKEKMSQEEAHHHRKPWIRAWSPLIQDQVPDSPLSMLRHVKHE

SEQ ID NO: 174351 - protein, 80 aa, Glycine max
  Coding DNA Sequence Number=SeqID_82666
  Homolog annotation: Hit_ID=A5C6J6; Match level="QueryCoverage=96%, HitCoverage=12%, E-value=4e-07, Identity=40%"; Hit description =Putative uncharacterized protein
MVNTIKIEKFIGKNSFRLWCIKMQSLLKERGIWAPPSSQSSKIDKSMLELQEEKSHSLILLSLSDEVLYEVSKKLTIVGL

SEQ ID NO: 174352 - protein, 114 aa, Glycine max
  Coding DNA Sequence Number=SeqID_82667
MDKRSWVQGQWIPYNEDAINQFLGHPLVLKEGQRCEYIKRRSQVLGFDEETIGQLLCFPRQDFAPSVMGRHHTSKTPSGPRKVQQRTGISSFDHRLPPQSSSDRHSSRGRNVTP

SEQ ID NO: 174353 - protein, 490 aa, Glycine max
  Coding DNA Sequence Number=SeqID_82668
  Homolog annotation: Hit_ID=Q6WAY6; Match level="QueryCoverage=85%, HitCoverage=88%, E-value=2e-11, Identity=24%"; Hit description =Putative uncharacterized protein
KNLELASLREQGQWMDQVQRQAFSKAYGKIWDLTMVEVSVEAITSFVQYYNQSLRCFTFGDFQLTPTIEEFDEILRCPSGGRKSYLFAGFYPFMARIEKVIKILKQELDRVKQNRNGVVGIPRKRLEEKAEALANQGDWFPRWKEGGAEVLCSCEGFPNVPLMGMRVCINYNPMLAIRQLGYPMRGASSEEIIVPFVARGFIEANAKILQRVRKAWSTVERKDKELRGSSNGIIGGYQKWLKSRMQGITWLPKLKGLSRKQAEVPEENEEVQALKAKLKKTRVVKEKLKTAVTRVRKECDELREVNMTIVEALERETKRARKEEWSENKFRGALWGSSNKLKLRKAKREESRMESMMLEDKLKVCQRSKRSLTEQLSITEENMLTIIDQYKEKVNLAASHGQRLEDEHAKVSTLQIEREARERVIESLHREAMKWMDRFTLTLNGSQELPRLLARAKAMVDTYLAPDEVHGLFDYCQHMIKLMTRIIKNH

SEQ ID NO: 174354 - protein, 64 aa, Glycine max
  Coding DNA Sequence Number=SeqID_82669
MDEFGSGGHKFNVDFNLPTRFCQSYQQLNLALQDNLHGHRLYGWWWFDVVNSSCWWLLMSPAGP

SEQ ID NO: 174355 - protein, 71 aa, Glycine max
  Coding DNA Sequence Number=SeqID_82670
MEELINKRQLSLKIISMSLRWLGGSTKESHSSSSTVVILLPRTRIRDHHSMMHVSDLNPQLQCGNIPKEIA

SEQ ID NO: 174356 - protein, 99 aa, Glycine max
  Coding DNA Sequence Number=SeqID_82671
  Homolog annotation: Hit_ID=A5B4I5; Match level="QueryCoverage=46%, HitCoverage=2%, E-value=4e-09, Identity=56%"; Hit description =Putative uncharacterized protein
MSKKPVEYSMLKVFGCPTYYHISESKLEPKTKKGFFTGYGDGIKGFRGKVEDVTKQVEFKSSTISSISDQKQIEAPNEADQDLQMHHQHKNLALVEGTN

SEQ ID NO: 174357 - protein, 134 aa, Glycine max
  Coding DNA Sequence Number=SeqID_82672
MHKALRANAPLPYPHLVTLFLHHFNVPLDDEPFVKVKRSFSFGAGAVTSFGYRKDVNGQWVHKQDLPPPIPDELTLSPPPQRVDSTSLLTEVLTELRDLRAFIGEHFDVMNTWITRLEDDMSFIRHCFNPSADS

SEQ ID NO: 174358 - protein, 153 aa, Glycine max
  Coding DNA Sequence Number=SeqID_82673
MASYDEVKDSIDEEDQGLQALHGAPLLGSVQDAFVCKEVKALLGRKVSSGRKTLKDFQDLEERVKSLKALKDSEEQCKEMFKQKLLLQKECTLANDELDKLKMKNSDLWMKLGHEIHKCNYLPEKGNPSKGLSNAYQHPLANKEKGPKKIWGT

SEQ ID NO: 174359 - protein, 148 aa, Glycine max
  Coding DNA Sequence Number=SeqID_82674
MSDSQETEPNPNNQAKLDFKNNPPSASFEEGEVVQIVRSTRMSIVTVEVSLKDKEPKVHIQHFFDIESLETIGCIIKAHLMLCNIHRFFENLKVVVPKFIREFWRTAKVYHYEVISNFFVGQVLGIIVKLSVKTIAQPLVVSVKAPSS

SEQ ID NO: 174360 - protein, 90 aa, Glycine max
  Coding DNA Sequence Number=SeqID_82675
MMIWPLCRLCSIANNVSEVNEDGPVGGVGVGTGASRRRREILRKIIMLREYINWILPRHNYLEFDLLPRMHEVVSDFNMLSPLMMDLILG

SEQ ID NO: 174361 - protein, 153 aa, Glycine max
  Coding DNA Sequence Number=SeqID_82676
MMIWPLCRPYSITNNVSKVNEDDPVGGVGAGTGAKGVGAEAGNCGKCGVNVDGAEGSGKVDEEGEEVSDAVEVGGASDLLPLSFLGLLNVTVGSSRFQQFFFIYAKLMAGLRLSKDLESDVVPLALHKVVIKTRNPSLEESCWAMIEIWWEMR

SEQ ID NO: 174362 - protein, 98 aa, Glycine max; identical to SEQ ID NO: 115196
  Coding DNA Sequence Number=SeqID_82677
  Homolog annotation: Hit_ID=O52175; Match level="QueryCoverage=83%, HitCoverage=94%, E-value=1e-32, Identity=85%"; Hit description =Salmonella berta plasmid pBERT, complete plasmid sequence

SEQ ID NO: 174363 - protein, 195 aa, Glycine max
  Coding DNA Sequence Number=SeqID_82678
  Gene Ontology: Mol. function=oxidoreductase activity, acting on single donors with incorporation of molecular oxygen, incorporation of two atoms of oxygen
  Homolog annotation: Hit_ID=Q6D2W4; Match level="QueryCoverage=45%, HitCoverage=79%, E-value=6e-28, Identity=68%"; Hit description =Putative uncharacterized protein
  Pfam annotation: Domain name=Glyoxalase; Domain location=70-179; Score=11.7; E_value=0.0081; Accession=PF00903.16; Description =GlyoxalaseBleomycin resistance proteinDioxygenase superfamily
MAITRSTRELSKRRATSQRKAVFTGRLLPLSLFVRYCLFLTTLRPRPAYGHCGYRGSGLHCWEAAVKITKIDHIHVYVENIKLAERWYHEVPGFSRDDSLYFWFEQGGPLVIRNHGASLSLFPRKNQHPGHTVAFVVEAAEFLSFVPALNAKNIPFTVCDHDVSLSVYFNDLSDNKIELTSYEYLQAKQLLESVV

SEQ ID NO: 174364 - protein, 69 aa, Glycine max
  Coding DNA Sequence Number=SeqID_82679
LSLSQHGQGFAPFACPTLDQFRAEVAWPGDWPEAHAGEAPAGAPSDAEEARMDEEMTNLLDFLGGSGAT

SEQ ID NO: 174365 - protein, 178 aa, Glycine max
  Coding DNA Sequence Number=SeqID_82680
  Homolog annotation: Hit_ID=Q6WAY6; Match level="QueryCoverage=91%, HitCoverage=25%, E-value=3e-09, Identity=26%"; Hit description =Putative uncharacterized protein
MARVAKVVKISTQELDRAKQNRNGVVGKPRKRLQEKEKTLADQGEWTSFIDVLALLVFGIILFPNVDGLVYLAAIDVFLAYHHSKESPVVAVLVDAYDAFDRRCEKNSMRIVYCTPTLYVWLVSPIFHHENRPICPLQGHRMCAEKGKANWEELLAGMVGASVNWFPRWKEGGAEVLC

SEQ ID NO: 174366 - protein, 260 aa, Glycine max
  Coding DNA Sequence Number=SeqID_82681
  Subcellular localization annotation: CTP_CleavageSite=39; ConfidenceScore=5.12e-01
MAPRPAPPQRGPGRIKRPKEPVPLPSMTATALGVLNTSSASRPSGFAGGGHHWLPPMAKFDPDIVLEFYANAWPTEEGGQECEYGQRRNRSDGFDEEAIAQLLCIPRKDFARTATGRRVWIMRTNMTTLTQIWMTLLLSNILPSDHNSDLPLPKCQLVYAILTRMSVHVAQLIADAIYLFAGMAPTRHPLDPDKSNRALGFPALITGLCLSFGVPVAPTKVIRPPITRAFIEKYCTQRQAQGDAPQAAGAPPPPHQAGPA

SEQ ID NO: 174367 - protein, 154 aa, Glycine max
  Coding DNA Sequence Number=SeqID_82682
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=74%, HitCoverage=96%, E-value=4e-26, Identity=56%"; Hit description =Putative uncharacterized protein
MTMITPSSKLTLTKGNKSCLSQNICHFIKESNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 174368 - protein, 151 aa, Glycine max
  Coding DNA Sequence Number=SeqID_82683
SFGVPVTPSKVIRPPITRAFIEKYCTPRQAQGDAPQAADVPPPPHQADPTGSFDTEQYLRHSIRQHAANHRGLGQVHECHYQLSLSMQSQGFAPFACPTPDQFRAEVAWPGDWLEAQAGEAPAEAPDDEEEASMDEEMSDLLGFLGGSGAT

SEQ ID NO: 174369 - protein, 135 aa, Glycine max
  Coding DNA Sequence Number=SeqID_82684
MVLDLEVLAQFLHHLVIQIGGIVCDNILGQSIPADYFLFNEFDYHDSRDTGVQGGFNPFGELVDRNQDEVMPVRSLGLNGPDHIYSPHGEGPRCCQNVQRHGRSIDIVRECPALMAFPNMDATIALHEEPVISRP

SEQ ID NO: 174370 - protein, 142 aa, Glycine max
  Coding DNA Sequence Number=SeqID_82685
SLATYELKNGVWLLVIVLNRVKGGREGPGPGWNARFFKDCWNIVEKDVTRSKTSFGTGSKGEDVKPKDLNFYWRAYHTGVEREGKSLSSLSPSIYEIARSAFERVRAKATSSTASPTSSAAQVKADTACREGHSRIRIKEKG

SEQ ID NO: 174371 - protein, 535 aa, Glycine max
  Coding DNA Sequence Number=SeqID_82686
  Gene Ontology: Mol. function=ATP-dependent helicase activity; Cellular component=phycobilisome; Biological process=regulation of transcription, DNA-dependent
  Homolog annotation: Hit_ID=Q1H0H1; Match level="QueryCoverage=99%, HitCoverage=47%, E-value=0.0, Identity=68%"; Hit description =Transcription-repair coupling factor
  Pfam annotation: Domain name=CarD_TRCF; Domain location=464-535; Score=45.8; E_value=1.5e-10; Accession=PF02559.7; Description=CarD -likeTRCF domain
MAVSLPVIGHPQRFSFHSQGLDSQALAELACGLKATQTPLVVLTASAFEAQRLMDEIPYFGKDIQVHLLPDWETLPYDVFSPHPDLTSERLATLYQLSQNQSNVVIVPMATALLRLPPVSYLAAHTFMLKKGQKLDVDALRNQCAQAGYHHVSQVMGPGEFSVRGGLVDLYPMGSAFPYRIDLFDDEIETIRTFDIDTQRSVYPVPEIRMLPAREFPMDEAAITRFRSQFREYFEGDPQRAKIYKDVSKGTPSGGVEWYLPLFFEQTATLFDYLPAQTVLCLHGDLDKAAQTFWADANSRYKLMAYDAEKPILRAESLLQKADEFFKQTHAFALVYQQLELQKLLPAVDVDRRAEHPLHKLQGFISQFDGRVLIAAESLGRRETIAQLFTEHGVTFSLAEDWAGFAQSNFPVMLGVAPLHQGLVDGDKAVITEAELYASTVRQQRRRNQEKARNAEGMLKDLSELRLDDPVVHEQHGVGRYKGLVNIDFGEGETELLLIEYFGDDKLYVPVSQLFLISRYSGGPSESAPFASFGQ

SEQ ID NO: 174372 - protein, 558 aa, Glycine max
  Coding DNA Sequence Number=SeqID_82687
  Gene Ontology: Mol. function=calcium ion binding; Cellular component =extracellular region; Biological process=pathogenesis
  Homolog annotation: Hit_ID=A4XQ73; Match level="QueryCoverage=99%, HitCoverage=46%, E-value=1e-105, Identity=37%"; Hit description =Hemolysin-type calcium-binding region
  Pfam annotation: Domain name=HemolysinCabind; Domain location=116 -133; Score=9.2; E_value=4.3; Accession=PF00353.10; Description =Hemolysin-type calcium-binding repeat
  Pfam annotation: Domain name=HemolysinCabind; Domain location=134 -151; Score=23.6; E_value=0.00072; Accession=PF00353.10; Description =Hemolysin-type calcium-binding repeat
  Pfam annotation: Domain name=HemolysinCabind; Domain location=233 -250; Score=15.2; E_value=0.25; Accession=PF00353.10; Description =Hemolysin-type calcium-binding repeat
  Pfam annotation: Domain name=HemolysinCabind; Domain location=25-42; Score=19.4; E_value=0.013; Accession=PF00353.10; Description =Hemolysin-type calcium-binding repeat
  Pfam annotation: Domain name=HemolysinCabind; Domain location=251 -268; Score=20.5; E_value=0.0064; Accession=PF00353.10; Description =Hemolysin-type calcium-binding repeat
  Pfam annotation: Domain name=HemolysinCabind; Domain location=314 -331; Score=14.1; E_value=0.54; Accession=PF00353.10; Description =Hemolysin-type calcium-binding repeat
  Pfam annotation: Domain name=HemolysinCabind; Domain location=332 -349; Score=21.9; E_value=0.0024; Accession=PF00353.10; Description =Hemolysin-type calcium-binding repeat
  Pfam annotation: Domain name=HemolysinCabind; Domain location=397 -414; Score=13.8; E_value=0.68; Accession=PF00353.10; Description =Hemolysin-type calcium-binding repeat
  Pfam annotation: Domain name=HemolysinCabind; Domain location=415 -432; Score=16.3; E_value=0.12; Accession=PF00353.10; Description =Hemolysin-type calcium-binding repeat
  Pfam annotation: Domain name=HemolysinCabind; Domain location=506 -523; Score=11.9; E_value=2; Accession=PF00353.10; Description =Hemolysin-type calcium-binding repeat
  Pfam annotation: Domain name=HemolysinCabind; Domain location=524 -541; Score=23.6; E_value=0.00072; Accession=PF00353.10; Description =Hemolysin-type calcium-binding repeat
  Pfam annotation: Domain name=HemolysinCabind; Domain location=7-24; Score=12.5; E_value=1.6; Accession=PF00353.10; Description=Hemolysin- type calcium-binding repeat
  Pfam module annotation: Pfam domain module=HemolysinCabind::HemolysinC abind::HemolysinCabind::HemolysinCabind::HemolysinCabind::HemolysinCab ind::HemolysinCabind::HemolysinCabind::HemolysinCabind::HemolysinCabin d::...
  Pfam module annotation: Pfam domain module=HemolysinCabind::HemolysinC abind; Domain location=116-133::134-151::233-250::25-42::251-268::314- 331::332-349::397-414::415-432::506-523::524-541::7-24
TDHINGTGNALANTITGNAGDNILDGGDGVDKLIGGAGNDTYIVDLVRTGTTAANYKVTLQDTITEAANAGNDTVQLRLLGSTDYSAMASATTLILGANLENLDASDTGSTKLNLTGNALANTLTGNDADNILDGGAGVDTLVGGSGNDTYMLDLKLQGTGAGATVVIEDSVTELNGTTEGIDTVKLRGTANLTTATTLTLDNDWANIEILDASATGSTKLNLTGNNLGNTLIGNAAANILIGGTGDDTLNGGAGADIMTGGDGDDIYIVDNVGDQVIENDGEGTDEVRASISYTLSDNLENLTLTGTAAINGTGNELDNTITGNAGNNILNGGTGADTLIGGKGNDTYIVDDVNDVVVESLNEGTDQINASISYSLALAANVENLLLTGTDHINGTGNALANTITGNSGNNTLDGGDGVDKLAGGLGNDTYIVDLVRTGTTTANYKVALQDTITEAANAGNDTVQLRLLGSTDYSAMASATTLILGANLENLDASDTGSTKLNLTGNALANTLTGNDADDILDGGAGVDTLVGGSGNDTYMLDLKLQGTGAGAYCSD

SEQ ID NO: 174373 - protein, 146 aa, Glycine max
  Coding DNA Sequence Number=SeqID_82688
  Homolog annotation: Hit_ID=A0ST23; Match level="QueryCoverage=30%, HitCoverage=91%, E-value=1e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPVTTLIPGKMGFDVGTELEFVIMVIAVSFGKPVVPAALMNRPTRGERRFAYWALFRFLAH

SEQ ID NO: 174374 - protein, 132 aa, Glycine max
  Coding DNA Sequence Number=SeqID_82689
MGGYSAFDSRTKKKILQIVGERWRQFKSDLTRKWALAADKDGVDDIFCEKYGISKEKWAQCQTRRDPSWEDVRKKAQASQKQNTAPYILSHGGYEYLKEKLMAEKTKKRLEEAAQSGSTEGIIDPQSPIRRH

SEQ ID NO: 174375 - protein, 277 aa, Glycine max
  Coding DNA Sequence Number=SeqID_82690
  Homolog annotation: Hit_ID=A1G2C6; Match level="QueryCoverage=99%, HitCoverage=96%, E-value=1e-135, Identity=85%"; Hit description =Putative uncharacterized protein precursor
MMKHRECVLGLVLAGLLAPSAQASGDDGETLRFQVAAHVQAHADPQQDGSIAVQLSPSGKRQTLAGAADADGNSRWGLEDVDFDGYPELVARASVGMVNEAVTVYRFDPASASYRVLQADTHGKDSCGDLMGLSVDVATRTLTSSCRSGPMWYADQYRFAGAKLYLYRAESVLMLGDTLNAALQWEQTEEQGPLAVWRTYDPAGGVLESAIADGLGAPPDGPLRGQQATVVPARLFLFDRPGASSTKRYLVQGDRVEMLDEQAGWVKLRYRNPKQGA

SEQ ID NO: 174376 - protein, 325 aa, Glycine max
  Coding DNA Sequence Number=SeqID_82691
  Homolog annotation: Hit_ID=B0KIK2; Match level="QueryCoverage=25%, HitCoverage=32%, E-value=4e-07, Identity=38%"; Hit description =Transcriptional regulator, LysR family
MVPTDESHQRLLPFYGAGAAAANAGSYALALDLAEAGFGVTIAPAPLVAARHRLAWRALPGQPLMRRVGICYAVQAQANPAVERIRYTAGRTGSKRISAAPRMVALQQQFAALDRAIFQHLQNLRDIVVQRHGAGIAELLITGGKTGQRQEGQRGTGCHQRGLRLTAQQRQKRGGDANHTEDVGYHDLLSNITGPFVCRHRFRLRDTGVGDQHVDMRELRVNRRGTAGEGGGVINVQSKTGNGRTLGDDLIEQRLASAGDNDAVSAIVKNLGQAAANAAGCAGDEQGVVGQFHSVPCQSENERPRARPIPVQGALDDGNAYGKSE

SEQ ID NO: 174377 - protein, 275 aa, Glycine max
  Coding DNA Sequence Number=SeqID_82692
  Gene Ontology: Mol. function=UDP-N-acetylmuramate-L-alanine ligase activity; Cellular component=cytoplasm; Biological process =peptidoglycan-based cell wall biogenesis
  Homolog annotation: Hit_ID=A8G9S8; Match level="QueryCoverage=99%, HitCoverage=55%, E-value=1e-126, Identity=82%"; Hit description=UDP -N-acetylmuramate--L-alanine ligase
  Pfam annotation: Domain name=Mur_ligase; Domain location=21-120; Score=170.1; E_value=5.6e-48; Accession=PF01225.16; Description=Mur ligase family, catalytic domain
  Pfam annotation: Domain name=Mur_ligase_M; Domain location=122-274; Score=56.1; E_value=1.2e-13; Accession=PF08245.3; Description=Mur ligase middle domain
  Pfam module annotation: Pfam domain module=Mur_ligase::Mur_ligase_M; Domain location=21-120::122-274
MNTQQLAKLRSIVPEMRRVRHIHFVGIGGAGMGGIAEVLANEGYHISGSDLAPNPVTQHLASLGATIYFNHRPENVTDASVVVVSTAVAQDNPELVAAREQRIPVIRRAEMLAELMRFRHGIAIAGTHGKTTTTAMVTSIYAEGGLDPTFVNGGLVKAAGTHARLGSSRYLIAEADESDASFLHLQPMVAIVTNIEADHMDTYQGDFENLKQTFINFLHNLPFYGRAVMCVDDVVIRDLIPRVGRQVTTYGFSDDADVRVENYEQRGAQGHFTLI

SEQ ID NO: 174378 - protein, 134 aa, Glycine max
  Coding DNA Sequence Number=SeqID_82693
  Homolog annotation: Hit_ID=UPI0000ECBAF8; Match level="QueryCoverage =30%, HitCoverage=48%, E-value=1e-16, Identity=100%"; Hit description= UPI0000ECBAF8 related cluster
RKRKSAQYANRLSPRVGRFINAAGTTGFPTGKRAMTEVGTEYVVKSILTTHKSGAPILPKGEFGTGINPDMEFVRMCFAQFGMQAWHWPSFYNVVTGKTLALPNLIALQHIPLSPAGVIAKRPAPIALPNSCAA

SEQ ID NO: 174379 - protein, 197 aa, Glycine max
  Coding DNA Sequence Number=SeqID_82694
MLAIIAKYQEELGLATAHEHRVADEYAQVYAEKEARGRVIDSLHQEATMWMDRFALTLNGSQELPRLLAKAKAMADTYSAPEEIHGLLGYWKNTITKCATRHPYRTRSKSRTMGDQEETQEQMKADMSALEEQMASMMEAMLGIRQLMEKNVATTAAVSSAAEADPTLLATAHHPPSNIVGRGRDTLGHDGNPSPGI

SEQ ID NO: 174380 - protein, 170 aa, Glycine max
  Coding DNA Sequence Number=SeqID_82695
MTTLTQTWMTLLLSNILPSDHNSELPLPKCQLVYAILTQMSVHVAQLITDAIYLFARMPPTRHPLDPDKSNRALGFPALITGLCQSFGVPVAPSKVIRSPITRAFIEKYCTQRQAQGGDPQAPDAPPPPPQADPAGSFDTERYLRHLVRQQAANHRAHLTSNFSLKKFFH

SEQ ID NO: 174381 - protein, 79 aa, Glycine max
  Coding DNA Sequence Number=SeqID_82696
MKQKGKRKKDREGRHVIVKKYKSFVKSKPMTNFARCFQIVIVTRALWSDMGVRPETDTLTPKFVLPQISRLGSHDKRPH

SEQ ID NO: 174382 - protein, 152 aa, Glycine max
  Coding DNA Sequence Number=SeqID_82697
MDEKARENEENEKEGRTHAATSIPTWPNFPPAQQCHYSANISPSHYPSPNQPQRPSLNQPQGSLTTHPMPNTTLNTNQNTNQEGNFPAKKPVEFTPILVSYANLLPYLLDNSMVAITPTKVTQPPFSEGTTRMYHVLIMEECRGIPLSIVGP

SEQ ID NO: 174383 - protein, 212 aa, Glycine max
  Coding DNA Sequence Number=SeqID_82698
  Homolog annotation: Hit_ID=Q6WAY6; Match level="QueryCoverage=91%, HitCoverage=30%, E-value=4e-10, Identity=25%"; Hit description =Putative uncharacterized protein
MGMRDCINYNPMLAIRQLGYPMRGAPSEETITPFISRGFNETNTKKLQKIHKAWNKVGRKDKELRGRSNGVIGGYHKWLKSRMQGIAWLKKLKDLNGEEAKVLEESEKVQALKAELEKTKVAKEKLKVVVTRVRKEYDKLKDINMTTTEALDWEMKKARKEEWSRNKFRGALLGSSNELKLRKAERDKSRMENMMLEDKLRNFQRSKGCLKE

SEQ ID NO: 174384 - protein, 231 aa, Glycine max
  Coding DNA Sequence Number=SeqID_82699
  Homolog annotation: Hit_ID=Q2HW90; Match level="QueryCoverage=87%, HitCoverage=40%, E-value=2e-22, Identity=36%"; Hit description =Putative uncharacterized protein
MGTNQTGKRFYQVKVKGLDTTSIKELGRLMEPLQMQAFRKTYGKILELTIAEVSIEAIASLTQYYDQPLRCFTFEDFQLVPTIEEFEEILGCPVGGRKPYLFSGCLPSLSRIATVVKDSARGLDCVKQTRNGIVGLPRKYLEDKARDMENQEDWVPFMDVLALLIFGVVLFPNVDGLVDLAAIDAFLAYRHSKESPAIAVLADLFDTFDRSKARGIHVRSKAIARVLKREE

SEQ ID NO: 174385 - protein, 111 aa, Glycine max
  Coding DNA Sequence Number=SeqID_82700
  Subcellular localization annotation: CTP_CleavageSite=20; ConfidenceScore=5.18e-01
MMTKVMTKSSKINQRTTQVNQEQFKSSKIRIKKNSRLKKKVKSQESRFKVQDLKNQDQDSRLKKKVKSQESRFKVQDLKNQDQDSRLKIQESREGLIKISIKSFSQKLSST

SEQ ID NO: 174386 - protein, 58 aa, Glycine max
  Coding DNA Sequence Number=SeqID_82701
MVKKRLSHEVLKVTVELSSSVGLSTNSSLSAASARLVRQKNLTEHQYQGRALSARSVR

SEQ ID NO: 174387 - protein, 109 aa, Glycine max
  Coding DNA Sequence Number=SeqID_82702
MTRDKSKFMSLKARKGGFVTYVDNNKGTILCVYVDDIIFGSTNKSLYEDFVHKMQGEFEMKFDMDKSKEAATLMATIATLGWMKKGNLLIKRSTEQTEVLKNERELKGN

SEQ ID NO: 174388 - protein, 134 aa, Glycine max
  Coding DNA Sequence Number=SeqID_82703
MRGTVHEPQTNLGADQKFSPIDVGPLKGCTSSPEEGYTSSPSGGYTSSPSEGYTSSPPEGCTSFAFKGLHILAFKGFYVLAFEGLHVVTFKGLHVLAFKGLHVLASKGLYVLTFRGLHVLAFIGLYVLASRGIH

SEQ ID NO: 174389 - protein, 133 aa, Glycine max
  Coding DNA Sequence Number=SeqID_82704
  Homolog annotation: Hit_ID=A5AWL4; Match level="QueryCoverage=65%, HitCoverage=13%, E-value=2e-07, Identity=33%"; Hit description =Putative uncharacterized protein
MFENDDELNIKILNCLTRTWEPKITIIKEWEDLASMSMEALFKKLLAYEHEFIQQSHIEEIEKKRKGIALKVGSSKEDYKDNSSDDEDVENISLMLKKFGKFLKRSKDKKFSKPSKKIQSNNNTFTYLVTHAI

SEQ ID NO: 174390 - protein, 297 aa, Glycine max
  Coding DNA Sequence Number=SeqID_82705
MKPLDSVYFDFPWQGKPRGGSTHLRVKLKTPKEATELIENMLARDHAILRDKIHQPTKKSLLELSSHDALLAHNNLQVVPSVVRLMKQANVFTLKKTLKNFTIWEINRDKDILKEDSQASSRGGPSNRPIQQGPNIFQRITKLEETLTQFIQVQVGQLAKKIADKSSNSFVANTEKNPKEECKAVMTKSKRFVEAEEEDSVLSKKKATEKKGTDKKKDEVIGESNQEKEKQIMVKKKELNDQEKEKEVEKEKENEKNGKNEKDEKKNKNEERSRSEQAREKKREKVVNKGAEVPYPV

SEQ ID NO: 174391 - protein, 332 aa, Glycine max
  Coding DNA Sequence Number=SeqID_82706
MAPRKLPSKSAEHQQRFETIKGWSFLRERRVQLRDDEFPDFQEEIGRKRWAPLVRGQWIPFDLDALSQFLGHPLVLEEGQQCEFSQRRNQVSGFDEEAIAQLLCIPRQDFTQTAAGRQVRIMCTSMTTLTQIWMTLLLSNILPSDHNFDLPLPKCQQVYAILTQVSIHVAQLIADAIYQFVGTVPARHPMDPKRSNRALGLPALITGLFQFYGVPVAPSKAGAGPGTAATRGRSVARGRCTTAATRGGTISEAANHKGQGRLNETLYRYHLHQQSQDPSPFPWPTPEQFEATVAWPRDETEFETQAGPARTSGGGDEAQDDQDMADMLDFLL

SEQ ID NO: 174392 - protein, 76 aa, Glycine max
  Coding DNA Sequence Number=SeqID_82707
MAAEWRRKRERRRHFKEKISLEEAHHHRRPWIRAWRKKEMNEGRGREEHEILCSKRALKSEPTNPRSIPRFSTKCA

SEQ ID NO: 174393 - protein, 242 aa, Glycine max
  Coding DNA Sequence Number=SeqID_82708
MAPKKLLSKRARKDAARKGSSATPQADIEFDGHRFRRPMTKYYSKIVMEFYTNAWPQRKESGISASGCGANGSPLMKMPLISSWGIHWSWKRGFDEEAIGQLLCIPGQDFPRSVTGRRVSINVAQLISNAIYQFVGIAPPRHPVGPEKSNRALRFPALIMGLCQFYRVPGQDHQQQLAIDATIPRVHICSYAKDGTLHFGATVASPGDRPSFQVGAGPAGAPGDEDGAQEDDDMAVVMNFFL

SEQ ID NO: 174394 - protein, 109 aa, Glycine max
  Coding DNA Sequence Number=SeqID_82709
QNRGGACHPARPGEPGCFLQKQPPSGGRIWKAQVGLLSECYGNSRIAQQHFLLISGTLRNFTDCVAMLPFDFWHVSELHVLCNKGCQVPRSGQLKVACHQTIVPDEIRV

SEQ ID NO: 174395 - protein, 47 aa, Glycine max
  Coding DNA Sequence Number=SeqID_82710
MAGVEAWLKEIENIFQVMDVEASFMMMNQVDSSSFDDDKDDDKKPKE

SEQ ID NO: 174396 - protein, 110 aa, Glycine max
  Coding DNA Sequence Number=SeqID_82711
MWLDMYLKKTLYKRLLGMVSSIPLDSIHMFWRRLSFLDQVLCEAEVTIKEEIETISKRSEELDAGGKVTLKSKLREISYPDQNSVSSSDKGQHQRSIEEIDEQKPKIHKA

SEQ ID NO: 174397 - protein, 338 aa, Glycine max
  Coding DNA Sequence Number=SeqID_82712
  Homolog annotation: Hit_ID=Q5XM22; Match level="QueryCoverage=20%, HitCoverage=38%, E-value=1e-20, Identity=72%"; Hit description =Resistance-like protein HAAS-2
MEEAVILLMELLEVSGQEARAETAQARRAYVRLLWVWDIYLSRCEARWWIIAARAYLLHLVGCTLFTNKSATHVHVVHLEAFRDLGESGRYAWGVAVLHFPSVHDCVTDDPYDETSPRAYRWLTTKAYIKGLRAPGQVRWGPIVVTVRPDRVVRQFEYVQTIPPSSVSASLSYEDIDDRWMHYEDHIADAGEIFVVLGQVSADYMEWFFQISHSFVTPTQAGDEPRHPPAPQHEEYVESSIPEVLVGADVGPSQAPAMDGCEAIAERLERVLNLRMVTEDTELHEIVEDCLRIARGLTTQMEMLGRNEDNAQIIDRSFYVLYLTIFLYLLHYFGYNFY

SEQ ID NO: 174398 - protein, 125 aa, Glycine max
  Coding DNA Sequence Number=SeqID_82713
MESGDMRGYRMVTRTFCQPGANEPVDTQRLTSSSAPFAIQGQRVRWQAEIPYGHPHLSSTKRNEFDGFYPRRPKTFKLDEARDSSLLGGDDRVQWRREVSWLSNFVTFKTLKFVDASDAFSFISE

SEQ ID NO: 174399 - protein, 117 aa, Glycine max
  Coding DNA Sequence Number=SeqID_82714
TNTGDPAVDFEQEASWTKDEEDEDVGLPPELERIFTHKDQEIRPIKKRQNSSFDDNKDDDKKLKSQDHFMITKMMTFKNEFKIESRTLQGSRGNLISRIKNQDSRLKTQRFKNQEKN

SEQ ID NO: 174400 - protein, 120 aa, Glycine max
  Coding DNA Sequence Number=SeqID_82715
  Gene Ontology: Mol. function=transcription factor activity; Cellular component=cytoplasm; Biological process=regulation of transcription, DNA-dependent
  Homolog annotation: Hit_ID=P45600; Match level="QueryCoverage=94%, HitCoverage=34%, E-value=9e-52, Identity=91%"; Hit description=HTH -type transcriptional regulator cysB
VDSRGSPNRAGLTPRIVFTATDADVIKTYVRLGLGVGVIASMAVDPVQDPDLVTVDASDIFTYSTTKIGFRRSTFLRSYMYDFIQRFAPHLTRDVVDSAVALRSNEEIEAMFKDIKLPIK

SEQ ID NO: 174401 - protein, 307 aa, Glycine max
  Coding DNA Sequence Number=SeqID_82716
  Gene Ontology: Mol. function=oxidoreductase activity, acting on NADH or NADPH; Cellular component=mitochondrion; Biological process =electron transport
  Homolog annotation: Hit_ID=Q11VB5; Match level="QueryCoverage=51%, HitCoverage=39%, E-value=7e-66, Identity=73%"; Hit description=NADH dehydrogenase I chain D
  Pfam annotation: Domain name=Complex1_30kDa; Domain location=8-76; Score=93.9; E_value=5e-25; Accession=PF00329.10; Description =Respiratory-chain NADH dehydrogenase,
  Pfam annotation: Domain name=Complex1_49kDa; Domain location=207-307; Score=-93.7; E_value=2.6e-06; Accession=PF00346.10; Description =Respiratory-chain NADH dehydrogenase,
  Pfam module annotation: Pfam domain module=Complex1_30kDa::Complex1 _49kDa; Domain location=8-76::207-307
MTNFRIRLKVFMSRENIEVDSLTDLYAGANWMERETYDFFGIKFKGHPDLRPILNMEDLGYHPMLKEYRLEDDNSLSNILNQYESKEQIDGQLYTLNLGPTHPATHGIFQNVLTMDGERILHAEQTVGYIHRAFEKISERRNYTQITTLTDRMNYCSAPINNLGWHMTVEKLIGIEVPKRVDYIRVILMELARIGDHLICNGVTGMDSGAITGLTYMFIERERIYDIYEQICGARMTTNMGRIGGVDYDVRVAQPYSSYQDFDFIIPVGTAGDTYDRFMVRQQEIWESIKIIEQAYNNLPEGDFHAD

SEQ ID NO: 174402 - protein, 243 aa, Glycine max
  Coding DNA Sequence Number=SeqID_82717
MTCEDKLWSFRTSLPFRHSRFRWHAETNYGHSAPFCHPETAGPMTCGDKLWSFRTPFAIQTQSCPMSRRDKLWSFCTLLSSRGGGPDDMRRQIMVIPHPFAIQTQSCPMARRDKLWSFYTLLSSRGGGPDDMRRQIMVIPHTFCHSDTVVSDGTQRQIMVIKHPFVMQSGGKYPSGYRIKHSPFCYRKTERLIACRDMVVFCTFCSLGNNKSFACGDFMVTRDSRQIERNEISVLSLLSFYLQ

SEQ ID NO: 174403 - protein, 135 aa, Glycine max
  Coding DNA Sequence Number=SeqID_82718
MERSMIYAASGGALGDMTPPEARNLIEKMASNSQQFNARNDAIVLRGVHEVATDSSSSTENKKFEGKLDALVNLVTQLAMNQKSTPVARVCGLCSSADHHTDLCPSLQQSGVNEKPEAYAKNIYNRPPQQQNQQQ

SEQ ID NO: 174404 - protein, 241 aa, Glycine max
  Coding DNA Sequence Number=SeqID_82719
MHRLPVERHEACLQPFFAQPHGLRQLAHAAAIGVFVLDAAMGLGQPPAVRGRRLVGRAAAGQVRQGQGQRLLGLALQIQRGDLATILAPGQDLAGHARQAGPQRQRRQLGVARRHAAIGRERGGRHLAQGAPPQGAHGFARKTDIDHADVAPALEFVPARHRLDRAVQDDAARLDAQGRAALEAQAELALQHDRHAHAGLGRAAGGPVRFGPAVQAADRDAARQFVLGADPEPVRRQQAQQ

SEQ ID NO: 174405 - protein, 208 aa, Glycine max
  Coding DNA Sequence Number=SeqID_82720
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=25%, HitCoverage=50%, E-value=1e-23, Identity=100%"; Hit description=LacZ protein
MEKRLCRGPLTSLLSIFLASSRKSPPVRKPFPLAAVERPSVASHWHDRFPDWKAGSERNAINDPIHIFHHQQLKNIIVSHIDLLCDLEDHGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 174406 - protein, 120 aa, Glycine max
  Coding DNA Sequence Number=SeqID_82721
QMPCRGCGHKQGAAQECGYRHMQQAVREGGVKHHGEPVHRHDLTVDDLIALRGLHPAVRREDPEGRNNSAQRHHAGGEEVQTRPDFVPAEQHHAEEPGFEEEGGQHFIGQQRAGNAARKL

SEQ ID NO: 174407 - protein, 128 aa, Glycine max
  Coding DNA Sequence Number=SeqID_82722
  Gene Ontology: Biological process=transposition, DNA-mediated
  Homolog annotation: Hit_ID=Q1J7G7; Match level="QueryCoverage=32%, HitCoverage=71%, E-value=5e-12, Identity=72%"; Hit description =Transposase
MVKVGTLTCRSTSHFAKSWPRASRYQQGHQDLFILRSDLPSQVLQWLLFLSAVPPVQLLTGWCVTAKAPPDISAGKCSGRVPFAIQAAQLLGRAIGAGLFAITPAGERGMCCKAIKLGNARVFPVTTL

SEQ ID NO: 174408 - protein, 70 aa, Glycine max
  Coding DNA Sequence Number=SeqID_82723
GEAHGCAFQGRKDARSRHQRLFVENVGKTEGNRKVDKSGAFAPTYPPLERKSDLRSSFLCVNQAILLLEE

SEQ ID NO: 174409 - protein, 276 aa, Glycine max
  Coding DNA Sequence Number=SeqID_82724
  Gene Ontology: Mol. function=fructuronate reductase activity; Cellular component=cytoplasm; Biological process=metabolic process
  Homolog annotation: Hit_ID=A4WCK3; Match level="QueryCoverage=100%, HitCoverage=56%, E-value=1e-144, Identity=90%"; Hit description =Fructuronate reductase
  Pfam annotation: Domain name=Mannitol_dh; Domain location=25-188; Score=287.8; E_value=2.1e-83; Accession=PF01232.14; Description =Mannitol dehydrogenase
MKTIASTSLPAHVQQPRYDRAQLRSRIVHFGFGAFHRAHQALLTNRVLNEKGGDWGICEISLFSGDVLMSQLRAQDHLFTVLEKGAEGNQPIIVGAVHECLNAKLDSLPAIIEKFCEPHVAIVSLTITEKGYCIDPATGKLDLHNARIVHDLENPTEPHSAPGILVEALHRRHERGLPAFTVLSCDNIPDNGHVVKNAVLGMAQKRSAALAEWIESHVSFPGTMVDRIVPAATDASLAEITEALGVEDPCAISCEPFIQWVVEDNFVAGRPEWEVA

SEQ ID NO: 174410 - protein, 16 aa, Glycine max
  Coding DNA Sequence Number=SeqID_82725
MENFAKQSLRIAPNSK

SEQ ID NO: 174411 - protein, 108 aa, Glycine max
  Coding DNA Sequence Number=SeqID_82726
  Subcellular localization annotation: CTP_CleavageSite=78; ConfidenceScore=5.10e-01
MKSGDMRGYLMVTHTFRQPGANEPVDAQRLTSSPAPFCHPGTASQVVGVNTLFFTLVVHKHSSSTMCEILLCWAGTIECTGEEKCRGCPTLSFLGHRSLLTLLILVLF

SEQ ID NO: 174412 - protein, 244 aa, Glycine max
  Coding DNA Sequence Number=SeqID_82727
MEFDEEAIAQLLGISGQDFARTAAGRRVRIMCTSMTTLTQTWMTLLLSNILPSDHNSDLPLPKCQLVYAILTRMSVHVAQLIADAIYLFAGMPPTRHPLDPDKSNWALGFPVLIMGLCQSFGVPVTPSKATDAPPPPHQADPAGSFGMERYFQHLVRQQAANHRGQVQIHECLYQLSLSQQSQGFAPFACPTPDQFRDEVSWPRDWPEDQTEEAPAGAPDGAEDARMDEEMTYLLDFLGGSEAT

SEQ ID NO: 174413 - protein, 67 aa, Glycine max
  Coding DNA Sequence Number=SeqID_82728
  Homolog annotation: Hit_ID=UPI0000ECBAF8; Match level="QueryCoverage =61%, HitCoverage=48%, E-value=1e-16, Identity=100%"; Hit description= UPI0000ECBAF8 related cluster
MVEDMCFLYKSRPAGMQAWHWPSFYNVVTGKTLALPNLIALQHIPLSPAGVIAKRPAPIALPNSCAA

SEQ ID NO: 174414 - protein, 175 aa, Glycine max
  Coding DNA Sequence Number=SeqID_82729
MTDPLNESISCFLIRDDRASEDYTSSPLEDHTSSPSENYTSSPSKDYTSSPSEDYMSSPSEGYTPSPSEDYTSSPSEGYMPSPSENYMPSPSEDYTSLPLEDYTGLHALAFRGLHILTFRVLHVLAFKGLHILAFGGLHALAFKGLHALALRGLHALAFRGLHAIAFRGRMSSRS

SEQ ID NO: 174415 - protein, 74 aa, Glycine max
  Coding DNA Sequence Number=SeqID_82730
MESGDMRGYRMVIRTFRQPGANEPVDAQRLTSSSAPFVILTHGFRDSELGGRRRYHVVVCTFRQSRRTNLMVSG

SEQ ID NO: 174416 - protein, 32 aa, Glycine max
  Coding DNA Sequence Number=SeqID_82731
MDALEIYLNEVEMQIEIKVKIVKCERGSEYNG

SEQ ID NO: 174417 - protein, 101 aa, Glycine max
  Coding DNA Sequence Number=SeqID_82732
MAKCVKHLNSADKDLNGQGEGKEENDSSKKIVKKENYFATKGDIKRALLLKQSFYFLLSRETSLSTVIPLELEVIPQLKELLDEGLVHKSFTPCALLVPKI

SEQ ID NO: 174418 - protein, 63 aa, Glycine max
  Coding DNA Sequence Number=SeqID_82733
MGRQYRVSPKKGWEDKDDIKGYGKDNLHHSMGNLLLQGDVIWAEERWGNISVGHGGIIPRHDT

SEQ ID NO: 174419 - protein, 63 aa, Glycine max
  Coding DNA Sequence Number=SeqID_82734
MEPEQPIQDSSGALALDLNEDQPQDDLQPLEENEHVNRTLTENVSQIVRVIVKECIDHISVRV

SEQ ID NO: 174420 - protein, 87 aa, Glycine max
  Coding DNA Sequence Number=SeqID_82735
MAWDELQRLRLVSAKVDVSLSELNALSECHPLSEASTRLADRRNLEGNLSRRHALSASSAHSASRLSPSRLSASLVLSDYSLTRDKR

SEQ ID NO: 174421 - protein, 118 aa, Glycine max
  Coding DNA Sequence Number=SeqID_82736
MGVNQIVSGSSRDSQGITRLKTNVTILVLEESVEAVKAEVIRDVEMDEVAHACLVLFSPFHPPGVPFLSVPSPCVVTDFLFLLVAPHAQEQACNESYIVVACMDPARSCNSVGIAASV

SEQ ID NO: 174422 - protein, 494 aa, Glycine max
  Coding DNA Sequence Number=SeqID_82737
  Gene Ontology: Mol. function=5-formyltetrahydrofolate transporter activity; Cellular component=chloroplast envelope
  Homolog annotation: Hit_ID=A7NWQ2; Match level="QueryCoverage=91%, HitCoverage=82%, E-value=1e-174, Identity=70%"; Hit description =Chromosome chr5 scaffold_2, whole genome shotgun sequence
  Pfam annotation: Domain name=BT1; Domain location=84-493; Score =576.8; E_value=2.2e-170; Accession=PF03092.7; Description=BT1 family
  Pfam annotation: Domain name=MFS_1; Domain location=80-433; Score =40.7; E_value=5.2e-09; Accession=PF07690.7; Description=Major Facilitator Superfamily
  Pfam module annotation: Pfam domain module=BT1::MFS_1; Domain location=84-493::80-433
MEISGTVPSSGSSLRLSSDDGDPLLGSRIRAGKDDALTADTDLEASSSGRIASRKQKYWVSSIKLFGVELSPDNVAVAMVYFVQGVLGLARLAVNFYLKDDLHLDPAEAAVISGFSALPWLVKPLYGFIRSYLVLSGLLGALSWSLMATFVDNKYSAGFCILLGSLSVAFSDVVVDSMVVERARGESQSTSGSLQSLCWGSSAFGGIVSSYFSGSLLDAYGVRFVFGVTSLLPLITSVVAVLVKEQPMFGTTRGLNILFAGPEFLESSKQRIIQLWGSVRQRSVFLPTLFIFLWQATPQSDSAMFYFTTNSLGFTPEFLGRVKLVTSIASLLGVGLYNGFLKNVPLRKIFFATTLLGSTLGMTQVFLVTGLNRKFGISDEWFAIGDSLILTVLSQASFMPVLVLAARLCPEGMEATLFATLMSVSNGGSVVGGLLGAGLTQLFGITKDRFDNLAALIILCNLSSLLPLPLLGLLPGGNPDVNEEDNSDIEMKCN

SEQ ID NO: 174423 - protein, 347 aa, Glycine max
  Coding DNA Sequence Number=SeqID_82738
  Gene Ontology: Mol. function=adenylosuccinate lyase activity; Biological process=purine ribonucleotide biosynthetic process
  Homolog annotation: Hit_ID=Q8VZX0; Match level="QueryCoverage=57%, HitCoverage=45%, E-value=9e-63, Identity=57%"; Hit description =Adenylosuccinate-AMP lyase
MPCGGVPLLMMLQLTREFSYKDGKCVETGKCFMGDIAAAMVFVQSRMKVNLKLVWIMKIYGLWSLVFRQTKDRAVEWWYFMMWEFGPFHDACQTEQSDFGRQSIVIEDYHSSASVTILSDVVALASVEEITDRDWEFPFMEFTALSNASQLGSINPRRTNLQSLTQTLLLFLMFLSLLPLAEVALAKPFSTPTHPPLAFGPPSADFELSVLTALSPLDGRYWSKVKELTPFLSEYGLIYFRVLVEVKNIERVTNDDVKAVEYFLKQKCQSNAEVVKVLEFFHFACTSEDINNLAHALMLKETMNSVMFPVMDQIIKALCDMAKDNALVPMLSHTHGQECSFVHLLKI

SEQ ID NO: 174424 - protein, 44 aa, Glycine max
  Coding DNA Sequence Number=SeqID_82739
MGVGIGHSLLAYKSTLQGMGKLQVFSATWASVTQFIPYCGDIPF

SEQ ID NO: 174425 - protein, 204 aa, Glycine max
  Coding DNA Sequence Number=SeqID_82740
  Homolog annotation: Hit_ID=A7NWP7; Match level="QueryCoverage=69%, HitCoverage=84%, E-value=4e-51, Identity=70%"; Hit description =Chromosome chr5 scaffold_2, whole genome shotgun sequence
MKVHPVPRKRNISIQFGGDGGNPMSEAQALLGIAGKKLRRLPHVFSCVLELPFRSDADVAVEEAPDCFRFVAETDGIGDVRAHTVEIHPGVTKIVVRDGGSVELSLDQLELDMWRFRLPESTRPELASAVFVDGELIVTVPKGHEEENDGDGDRGMGGGRLVLVVVGTSFSVNFIVAIVQSGTKMFYLDSGEWFIHHGNGNYPK

SEQ ID NO: 174426 - protein, 105 aa, Glycine max
  Coding DNA Sequence Number=SeqID_82741
  Homolog annotation: Hit_ID=A6FJQ2; Match level="QueryCoverage=36%, HitCoverage=84%, E-value=2e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARGGVHVGKESKEASVGVRTHNY

SEQ ID NO: 174427 - protein, 28 aa, Glycine max
  Coding DNA Sequence Number=SeqID_82742
MKVEQLFACHHISEERKVPLATLSFQGN

SEQ ID NO: 174428 - protein, 173 aa, Glycine max
  Coding DNA Sequence Number=SeqID_82743
MAPRKLASKRYRKDKAAEGTSSAPKYDNHHFRSAEHQQRFEAIKGWSFLRERRVQLRDDEYTDFQEEIGRRRWASLVTPMAKFDPNIVLEFYANAWPTEEGVRDMRSWVRGQWIPFDADAIGQLLGYPLVLEEGQECEYGQRRNQSDGFDEEVIAQLLCIPGQDFARTAARRR

SEQ ID NO: 174429 - protein, 267 aa, Glycine max
  Coding DNA Sequence Number=SeqID_82744
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTFTVFDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 174430 - protein, 166 aa, Glycine max
  Coding DNA Sequence Number=SeqID_82745
  Homolog annotation: Hit_ID=A5C9Z7; Match level="QueryCoverage=43%, HitCoverage=3%, E-value=5e-07, Identity=42%"; Hit description =Putative uncharacterized protein
MVAINKQFRWKLGSGNQILFWEDSWVGDGITLKDRYPELYQISSQKLKTVASMGIFGESGWEWKFSWRRYLFDNEMGGEDINSNVPYICPILRGVFIDDSWTDDPHKVKEEVKSFFFHRFQEPIGQRPKIDGIRFQTVNQQQNNELRAPFMDEEIQNAIHKRIAWI

SEQ ID NO: 174431 - protein, 219 aa, Glycine max
  Coding DNA Sequence Number=SeqID_82746
  Homolog annotation: Hit_ID=Q6UUU1; Match level="QueryCoverage=31%, HitCoverage=53%, E-value=2e-14, Identity=59%"; Hit description =Putative uncharacterized protein
ERSGYRYIEQLTEMPQNVLYDAIGIYQRWYIHWNLLRADQRLIFAKSMVQDRAGRQQQLGPGIKLIDTVDLEGGPGYQLLFFSEVGKPVVPAALMNRPTRGERRFAYWALAECILAYYVGTDEGVSEVLHVAGEKRLHRIYIPLPRSLTRYARSFDCGERKWLTNGAEFLEHARKILNREAFPPGGSLVRSPVPAFRFTGVIPLLWPRLSHSTPDTQFR

SEQ ID NO: 174432 - protein, 69 aa, Glycine max
  Coding DNA Sequence Number=SeqID_82747
MYTLVYSTGISSIDHRSLPILRGQGQQQESTADAPPLPPHQPPSLESISAHMQRMELQMHAYMHHLVDQ

SEQ ID NO: 174433 - protein, 89 aa, Glycine max
  Coding DNA Sequence Number=SeqID_82748
MESKILCWFFLMHALLGSFNSGNWIPLRSRPHRDPSFPHGRQDVLAAAIGRPEHPGRVRAVGAGVTIKQYFGSAPRMSRSSSSLPPEEL

SEQ ID NO: 174434 - protein, 125 aa, Glycine max
  Coding DNA Sequence Number=SeqID_82749
MYNHHEKGRGPNLESVLADFMTYQANSKEGLSYLDDLLMQFKGTVDPMQQAFKRAETQIGKLVDDMTKVVVRREEEYAEIETHQESKDKGRLELSVEDQKISFDLFAAMKHPDMSDACFEEEEVE

SEQ ID NO: 174435 - protein, 52 aa, Glycine max
  Coding DNA Sequence Number=SeqID_82750
DVLAATIRRLEHPGHVRAAGAGVTIKQYFGSAPRTPRSTSSLPLDELQQLTQ

SEQ ID NO: 174436 - protein, 145 aa, Glycine max
  Coding DNA Sequence Number=SeqID_82751
MGTNQTGKRFYQVKIKGLDVTSLKELGRLMGPLQMQAFRKAYGKILDLTIAEIFTETVVSLTQYYDQPLRCFTFGDFQLGFGKRVRSCKANSKRHSGPTTEVLGRQGKRYGESRGVGPVCGRISIANLWGCPLSKRGRFGGPSCD

SEQ ID NO: 174437 - protein, 129 aa, Glycine max
  Coding DNA Sequence Number=SeqID_82752
MAPRKLASKRSRKDKTAEGTSSAPEYDSHRFRSAEHQQRFEAIKGWSFLQERRVQLRDDEYTDFQEEIVRRRWASLVTPMAKFDPYIVLEFYANAWPTEEGVRDMRSWVKGQWIPFDADAIGQLLGYPL

SEQ ID NO: 174438 - protein, 237 aa, Glycine max
  Coding DNA Sequence Number=SeqID_82753
MRGAPTEESLSPFLVRDFGTQSFKIIQRVHKAWESPLRKDKELRGIRNGIIGGYHEWLKVHTRGLDWLSKLKIINEENFEAPEEDEEVRALKTELGKARLAKEKFKLVATDVWKECAGLREENAATARALEQETKRARKEEHGHEKFRGALWGRNSELKLRREERDQSRAHSMVLKEELAACSRSKRNLSRRLCETETNMLAIVSKYQEELNQATDHEHIVADEYAQVYAERRLEEG

SEQ ID NO: 174439 - protein, 132 aa, Glycine max
  Coding DNA Sequence Number=SeqID_82754
MGLVFSDLLRSLVGGCAEKKHRPSRSPHVLSRGGYDYLEQKLMAEKTKKKLEEAAQSGSTEGVINPPSPIRRHVKWKMARTKKTGQMTSKAAKEITEKIASQDSFVPHGRHDVLTVAIGRPEHPGCVHAAGA

SEQ ID NO: 174440 - protein, 35 aa, Glycine max
  Coding DNA Sequence Number=SeqID_82755
MAPAAEYRSLVAATADILWIHTLVLELAVPYSRPR

SEQ ID NO: 174441 - protein, 85 aa, Glycine max
  Coding DNA Sequence Number=SeqID_82756
  Gene Ontology: Biological process=transposition, DNA-mediated
  Homolog annotation: Hit_ID=Q1J7G7; Match level="QueryCoverage=38%, HitCoverage=47%, E-value=7e-12, Identity=100%"; Hit description =Transposase
MVKVGTSYVPINVSFSPKVGPGLPGINRDTRIYLFCEVLQWLLFLSAVPPVQLLTGWCVTAKAPPDISAGKCSGHAARNHHTRRA

SEQ ID NO: 174442 - protein, 42 aa, Glycine max
  Coding DNA Sequence Number=SeqID_82757
MQRLSSSPTPSVVLTREVRFLLSSFENIQAQRRTRFFSAGQG

SEQ ID NO: 174443 - protein, 261 aa, Glycine max
  Coding DNA Sequence Number=SeqID_82758
MEHKFHPSKVAARAITLSIRQQFGQPWPRWGAIPKDHQELFFLRFKLSQARSDAASSAGESQLTPLDPDEEQRLRSWCWVATTRPKRKERLYDTGDLVHTYKCGNGSLMQHTQGSSSSVEDAAEINCPREKLRQSKRGDTHFLVSSPSVPTFRGTKHYSSTTITSVTVPRPATTTPGPVATPPAPARTTTGPVKLFKRNTGQVKPRMMGATAVLALGCTGRDISGVGRKVHFFLPSSLPRSALLPFVGQNIDTETYWTCIK

SEQ ID NO: 174444 - protein, 74 aa, Glycine max
  Coding DNA Sequence Number=SeqID_82759
  Subcellular localization annotation: CTP_CleavageSite=37; ConfidenceScore=5.74e-01
MAMTLPCPHPFVPTTKATVLQPNQSNSTTNLAIVSPSSPTKSPLTTRNPNPHRASPSPIKPPTTHDPNHHRTTP

SEQ ID NO: 174445 - protein, 84 aa, Glycine max
  Coding DNA Sequence Number=SeqID_82760
MSHCRNLLFCGRARRGLRVDKSGALAPTYPPSKRKSDLRSFFQRANQAILFTWRVENRGGACHLAHPGEPGCFLQKQPPSGGTS

SEQ ID NO: 174446 - protein, 111 aa, Glycine max
  Coding DNA Sequence Number=SeqID_82761
MSALKEQMVSMMDAMLGLRQLMENNVATAAAVSSAAEADPTLPATAHHPIPNVVGRERSTLGHINNPHPGYNRVAYPYGLPPNYTPPVIRDDAGHVPPPILEGEPSRQLDE

SEQ ID NO: 174447 - protein, 164 aa, Glycine max
  Coding DNA Sequence Number=SeqID_82762
  Gene Ontology: Cellular component=mitochondrion
  Homolog annotation: Hit_ID=A7PL49; Match level="QueryCoverage=94%, HitCoverage=40%, E-value=1e-19, Identity=35%"; Hit description =Chromosome chr7 scaffold_20, whole genome shotgun sequence
MGRRESALGKDIEQQPTLLEEYHLRNKSERSPVTYISSHGFTENSHFPEGKEELKDGYISENGKLVDHFLQAIHAAEKRQADLDAYVSNEQKKLLKGNIWKEVERCSYQRTYARRGGCNVGQELKRERAKASLAIKSLRQKMEDKLKIELEQKEIETDLKLKQT

SEQ ID NO: 174448 - protein, 66 aa, Glycine max
  Coding DNA Sequence Number=SeqID_82763
MAAEWRRKRERRGHFKEKMSLEEAHHHRRPWIRAWRKKEMNEGQLIQDQFQDSPLSVLRCHEACKA

SEQ ID NO: 174449 - protein, 282 aa, Glycine max
  Coding DNA Sequence Number=SeqID_82764
MALKKLSTKRSRKDATGESSSATPGFDRHRFRSAKHQQRFEAIRGWSFHKERCWAPLMTPMAKFDPEIVMEFYANAWPTEEGVWDMRSWASGLDEEAIAQLLCIPGQDFGQTAARKWVWIMRTNMNTLTQIWMTLLLSKILPSDHNSDLPLPKCQLVYAILTWMSVHVAQLIADTIYLFTGMAPMRHLLDPEKSNRALGFPALIMGLCQFYGVPVTPNKEPSSRSGQPLGTEQFGAAVAWPGDWLDTQTGAGLAGTPGDADGAQEDEDMADLLDFLGGRGAM

SEQ ID NO: 174450 - protein, 101 aa, Glycine max
  Coding DNA Sequence Number=SeqID_82765
MRSFNGDFPPWRCSGRQKRRGERRRHPLGNKPWKKELHHQDEPWIRSLEGCFNGGKERERGEHEIEGIKEAKKWNFEVASLRSFLEKTSLRSFFEKTSLRS

SEQ ID NO: 174451 - protein, 117 aa, Glycine max
  Coding DNA Sequence Number=SeqID_82766
MGGACEEPRELLNPAPLQLLHFLVGGPPPAVEETEKLDLIEERLRAIKGFIDYPFADMTKFCLAPDVVIPPKFKVKQARLVKCKFHELVKPLIFWLSASFAKRPIWWLSAWTILEEG

SEQ ID NO: 174452 - protein, 156 aa, Glycine max
  Coding DNA Sequence Number=SeqID_82767
MYALGQEGKLPIARYLKRGLSLQILIGGFNRSLFHLGLKSMPLAYWKKKGRRKARLLKQGSLKPERVLSREREKILSVFRFLGLYSKNLTHGQIKKEQNLKDEANNEHNTQPRMTLYWIKEIGFPLQGSSIRAQEVINCPRFNPILTPFTSGNDKI

SEQ ID NO: 174453 - protein, 185 aa, Glycine max
  Coding DNA Sequence Number=SeqID_82768
  Gene Ontology: Mol. function=hydrolase activity; Cellular component =cytoplasmic membrane-bound vesicle; Biological process=biological _process
  Homolog annotation: Hit_ID=A9PFP5; Match level="QueryCoverage=35%, HitCoverage=23%, E-value=1e-30, Identity=93%"; Hit description =Putative uncharacterized protein
MDDETCYVSALHSLKVHQVLLDMNGKMEGAGFYLNATQEKWKNWRMYDYVVKELPKLLSDNFPQLEISKASIFGHSMGGHGALTIFLKNQDKYKHKPHIPKVYTRKHPRVAYHPTVTTHPKGVNHSIVTIHPKGARSEDVNLGDMTLGNSQNESKGDMTLGNNHNQPKDVNQGDMTLGNSHNQPL

SEQ ID NO: 174454 - protein, 108 aa, Glycine max
  Coding DNA Sequence Number=SeqID_82769
MNTLKHGFKALRVMGSWCRRGRSGRSWWCRKRRSICWSSPYLPDPSEVNCQIIHIPTVFINVGQINGQAQALIGQTVRGNSSSSTQGNDQGWKSEPRGVTLGNGRNLT

SEQ ID NO: 174455 - protein, 154 aa, Glycine max
  Coding DNA Sequence Number=SeqID_82770
MRLSALNEYGSGVIDILIESVRHIGWCIVGRQAIWQEDGGVGFTLTTALVAATAITLASIIFLMLIMASIIVAICSFMASVTTYPSAGGRRITRGCVFQERNTCGVATNVYLRKTSEKPEKTWSTNFKRKVRELYLRTRKVLEPHTSITRDGSL

SEQ ID NO: 174456 - protein, 116 aa, Glycine max
  Coding DNA Sequence Number=SeqID_82771
MEKSDKMNFKEKKEKKGYITWEDNVINYSSDSEKKIISLDIMMKDYENGEEQSRYIDSNFSKHMACIEVYSYFSPRKLEVEVTGSWKLEVEMKVIGSWKLEVENGGWKLEGEVTKN

SEQ ID NO: 174457 - protein, 32 aa, Glycine max
  Coding DNA Sequence Number=SeqID_82772
MDKDQWMYDSIMSEEVDMDDQNKQECGVWYPR

SEQ ID NO: 174458 - protein, 274 aa, Glycine max
  Coding DNA Sequence Number=SeqID_82773
  Gene Ontology: Mol. function=G-protein coupled receptor activity; Cellular component=integral to membrane
  Homolog annotation: Hit_ID=A4WFS9; Match level="QueryCoverage=99%, HitCoverage=79%, E-value=1e-137, Identity=90%"; Hit description =Integral membrane protein TerC
  Pfam annotation: Domain name=TerC; Domain location=4-124; Score =169.9; E_value=6.8e-48; Accession=PF03741.7; Description=Integral membrane protein TerC family
MASLFLTGYALEEVLSVDNLFVMMAIFAWFGVPDKYRHRVLYWGVLGAIIFRGIFVAIGTSLLSLGPYVEVIFALVVGWTAVMMLKRNEESDEVEDYSGHLAYRLVKRFYPVWPKISSNAFILTQKEVDAELEKPENQDVMVGRVKKAKRYATPLLLCVAVVELSDVMFAFDSVPAIIAVSREPLIIYSAMMFAILGLRTLYFVLEALKQYLVHLEKAVVLLLFFVAFKLGLNATDHFWHHGYNIGATASLFVVLGVLALGIIASVMFPGKREA

SEQ ID NO: 174459 - protein, 127 aa, Glycine max
  Coding DNA Sequence Number=SeqID_82774
  Homolog annotation: Hit_ID=A4W8W4; Match level="QueryCoverage=59%, HitCoverage=39%, E-value=2e-32, Identity=85%"; Hit description =Putative uncharacterized protein precursor
  Pfam annotation: Domain name=DUF330; Domain location=1-87; Score= -19.1; E_value=0.00057; Accession=PF03886.4; Description=Protein of unknown function (DUF330)
MCSQLPGWVVASQPLGNDQDTLNVTVTGFHGRYDGAVVISGEWLLNHQGQLIKRPFHLELKQQKDGYDEMVKSPGSGLGTGVGQYRQGNFPAAINKRMRETRHEETETRSPGTGSSTWLSGRHRWTF

SEQ ID NO: 174460 - protein, 544 aa, Glycine max
  Coding DNA Sequence Number=SeqID_82775
  Gene Ontology: Mol. function=glutamate synthase (NADPH) activity; Cellular component=cytosol; Biological process=nitrogen compound metabolic process
  Homolog annotation: Hit_ID=Q1GXP0; Match level="QueryCoverage=99%, HitCoverage=29%, E-value=0.0, Identity=74%"; Hit description =Glutamate synthase
  Pfam annotation: Domain name=GATase_2; Domain location=21-376; Score =228.8; E_value=1.2e-65; Accession=PF00310.12; Description=Glutamine amidotransferases class-II
MSTQQPNPWGLYDPSAGSDSCGVGFITRKDGEQTHEILQMAHSALCTVPHRGGMSAEGVGDGAGVNVDLSLNFFRKLTGQALEAGRFGVGNFFVPKDAALRANAERLVEETLAAYNFPVLLKRDMPLDNSVTRPAAQQFQLPIVQWVFAAPQDVTEQSDFERHIYRALLDIEARAFTESEFGGLYPLSLSSRTQVFKARLNSNEVIPYFKDLTDPDHQVRGLFFHTRFSTNTDPHTTMAQPFRLMAHNGELNTDRKNRIAEAALMLARGKKIVRPKGQSDSSRLDQSIHSRLMEDNLDLINAVVSMMPPAWENDTSLSAEVRAMLEYFSLYEEKNDGPAALIFGNGEVIGARLDRLGLRPLRSVETAEYIGAMSEAGQIAFPPESVLRRGRIEAGGMLYYDHKEKRSYTTVQALEKLAAEKDYLSLVQAARVELQQLPEVPAEKLGSPLRYRGDLKTYQRFVAYYYNQESFKFMMDPMLQTGAEKISAMGYGNAINGLSDHEGGMAHYFSQRFAQVTNPPLDSIREADGMTLRVALGAKPHLGR

SEQ ID NO: 174461 - protein, 105 aa, Glycine max
  Coding DNA Sequence Number=SeqID_82776
  Homolog annotation: Hit_ID=A0ST23; Match level="QueryCoverage=23%, HitCoverage=51%, E-value=3e-07, Identity=100%"; Hit description =Putative reverse transcriptase
  Subcellular localization annotation: CTP_CleavageSite=67; ConfidenceScore=5.22e-01
MVKVGTSYVPINVSFSPKVGPGLPGGARYQLLFPLVRVNFELGVIMVIAVSFGKPVVPAALMNRPTRGERRFAYWALAECILAYYVGTDEGVSEVLHVAGEKRLH

SEQ ID NO: 174462 - protein, 305 aa, Glycine max
  Coding DNA Sequence Number=SeqID_82777
  Gene Ontology: Biological process=transposition, DNA-mediated
  Homolog annotation: Hit_ID=Q6UUU1; Match level="QueryCoverage=19%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDAADSSTLRPCPPLPHLLSFPEEFFQRMGSKTFKGSLAFDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 174463 - protein, 210 aa, Glycine max
  Coding DNA Sequence Number=SeqID_82778
  Homolog annotation: Hit_ID=A0ST23; Match level="QueryCoverage=11%, HitCoverage=51%, E-value=6e-07, Identity=100%"; Hit description =Putative reverse transcriptase
GPGLPGINRDTRIYLFCEVISVTAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSIKKWRGRGARYQLLFPLVRVNFELGVIMVIAVSFGKPVVPAALMNRPTRGERRFAYWALAECILAYYVGTDEGVSEVLHVAGEKRLH

SEQ ID NO: 174464 - protein, 101 aa, Glycine max
  Coding DNA Sequence Number=SeqID_82779
  Subcellular localization annotation: CTP_CleavageSite=60; ConfidenceScore=5.82e-01
MSNLLSVFSNVNGSPPSSPRPSPPTDSTSHSPSTLNRTRKVTRLRSLATRPVGAERPLVHVDPKTGKADSPHRKKLRIYLGIAARDKVDVTYENWKQVPTA

SEQ ID NO: 174465 - protein, 148 aa, Glycine max
  Coding DNA Sequence Number=SeqID_82780
  Subcellular localization annotation: CTP_CleavageSite=50; ConfidenceScore=5.54e-01
TEKSRARRSEAPSSSAAPAPSTSTPSTSALSLPLAAPILPGPSTQSLEPSLSMLHSLHQGQLLIMQSLQDVVQQWPVMSVEEFLQKVAWPGVQPSHLGGEPSTTVLDMSSSQPESSAPVPDLPLSQDSLSGTPALDLNEHAIDSAQDH

SEQ ID NO: 174466 - protein, 88 aa, Glycine max
  Coding DNA Sequence Number=SeqID_82781
MSTFEHFVSKRPYRGNTRSNKDRRESLKVYQSHTGQGLTFSPWVKVYDKLGFWLKAFRTAGHDICQGLASGSGIKGMSYIISMIHMQQ

SEQ ID NO: 174467 - protein, 160 aa, Glycine max
  Coding DNA Sequence Number=SeqID_82782
MEAMKEQITTMMEAMISMRKMMEVYTATVVPASTTIEVGPTHPSSLNQVNHPTSDMVGQGGKALGSTGSLHFVQVQNKHSFPPYGLPPNYTPPNIADEDMTKSKGKDPLEGLGGPMTRARARKAKEALQQVLSILFEYKPKFQGEKSKVVSYIMAQMEED

SEQ ID NO: 174468 - protein, 279 aa, Glycine max
  Coding DNA Sequence Number=SeqID_82783
  Homolog annotation: Hit_ID=Q2HTA0; Match level="QueryCoverage=58%, HitCoverage=26%, E-value=9e-17, Identity=36%"; Hit description=IMP dehydrogenase/GMP reductase, related
  Pfam annotation: Domain name=DUF1723; Domain location=154-203; Score =56.8; E_value=7.2e-14; Accession=PF08330.1; Description=Protein of unknown function (DUF1723)
MVRTRGLGCALGQVTGRGVGRGDRDDSDDAPQRRRPTASARRQRVAVTVDHVDEPVIPAPDVQDDSIEAPAAVEEFPADTGAEPAEDAHEGFSGGLSDPSVLTLYANHVACSVWTGELSSHGRKVHSLGRPVYAIEGLVVGTRLSPLIACSVDTGDRGLLSAFVERWHRETSSFHLPVGELTITLDNVSSLLHLPVIGDLHTFEPLHVDDAVQMLADLLMVSPESARAETVQCRGPYPRLIGQPRLAHIFFTFWVALCLLTRVQPMSMLSTWRPFVTSV

SEQ ID NO: 174469 - protein, 252 aa, Glycine max
  Coding DNA Sequence Number=SeqID_82784
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=26%, HitCoverage=64%, E-value=4e-32, Identity=100%"; Hit description=LacZ protein
  Pfam annotation: Domain name=PIP5K; Domain location=1-165; Score= -98.3; E_value=5.9e-05; Accession=PF01504.9; Description =Phosphatidylinositol-4-phosphate 5-Kinase
  Subcellular localization annotation: CTP_CleavageSite=76; ConfidenceScore=5.09e-01
GRSLWKNASNAAFLRFLAFCWPLAHMFFPALSPDSVDNRITAFEKRKSAQYANRLSPRVGRFINAAGTTGFPTGKRAVSATQLMLRVQLGVNMPAQATRKVEEEVEAKEVELFEVYDVVLYMGVIDILQNYNLRKKIEHAYKSLQFDPMTISVVEPKMDPLESTCRHASLALAVVLQRRDWENPGVTQLNRLAAHPPFASWRNSEEARTDRPSQQLRSLNGEWRLMRPDTRQHPLTRPDGLVCSRHPLTDKL

SEQ ID NO: 174470 - protein, 101 aa, Glycine max
  Coding DNA Sequence Number=SeqID_82785
MTDPLDESISCFLIRVNPWVLVPSPPEDYMSSPSEGRTPSPSEGRTPSPSEDYTSSPSEDFTSSPLEDYTSSPSEDYTSSPSKGHVPSTSEDYTSSPSKGH

SEQ ID NO: 174471 - protein, 136 aa, Glycine max
  Coding DNA Sequence Number=SeqID_82786
  Subcellular localization annotation: CTP_CleavageSite=23; ConfidenceScore=5.12e-01
MAATVNQAARITYRNTQQIANTVTSYQQGGNFNQNQGQGWRSHQGNQFNKDQGGPSNRPPNQGPNLSQCLIIRALSQPSRTWRSKWDNLAKQITKSSSGGFGANTEKNPKEECQAVMTRSKREIVVENESRISEEK

SEQ ID NO: 174472 - protein, 212 aa, Glycine max
  Coding DNA Sequence Number=SeqID_82787
MRFNKTNVETLQKVHKAWEVVQKKDKELKGSNNGPIGGYRKWLKAHLQGLDWLPSLRIAIREEVEALEEDEEVQTLRTKLEQTQIVKERFKSATLKIRKENAELRDINIATTKALEQETKWARREEHDRNKFRGALWGSNSELKLRGEERDQSRVDNLILKDELKVCSRSKKNLSQWLCETETNMLAIISKYQEELNLAMAHEHRVADEYAQ

SEQ ID NO: 174473 - protein, 91 aa, Glycine max
  Coding DNA Sequence Number=SeqID_82788
MKNPTLLGYPPVATCPFAGERGEAHRCAFQMRKDARSRHQRLFVENVGKNRRKPVKTKILSSGVVFTFEEGRQKRGSCSYIPSIEEEIRPT

SEQ ID NO: 174474 - protein, 497 aa, Glycine max
  Coding DNA Sequence Number=SeqID_82789
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=A8TVQ5; Match level="QueryCoverage=90%, HitCoverage=91%, E-value=0.0, Identity=70%"; Hit description=Beta -glucosidase G2
  Pfam annotation: Domain name=Glyco_hydro_1; Domain location=40-492; Score=641.7; E_value=6.2e-190; Accession=PF00232.9; Description =Glycosyl hydrolase family 1
MACNGFCLRLIALVLVISISSVNCIETDAVEPIIDIASLNRDSFPPDFIFGAGSSSYQFEGAANEGGRGLSIWDTFTHKYPEKIQDKSNGDVAIDAYHRYKEDVKIVKDMNLDSYRFSISWSRILPSIQPLVTLFHWDLPQSLEDEYGGFLSPRIVKDFRDYAELCFKEFGDRVKYWVTLNEPWSYSQHGYANGGMAPGRCSAWVNPNCTGGDSGTEPYLVTHYQLLAHAAAVRVYKTKYQVSQKGLIGITLVANWYLPFSNTKADQKATERAIDFMFGWFMDPLTSGDYPKIMRSLVRTRLPKFTTEQSKLLIGSFDFIGLNYYSSTYASDAPHLSNARPNYVTDSLVTPEFERDGKPIGIKIASDWLYVCPRGILDLLLYTKEKYNNPLIYITENGINEFRDETLSLEESLLDTFRIDYHYRHLFYLRSAIRHGVNVKGYYIWSLFDNFEWSSGYTVRFGMILVDYKNNLKRYHKLSAIWIKNFLKKTSLYDSSI

SEQ ID NO: 174475 - protein, 513 aa, Glycine max
  Coding DNA Sequence Number=SeqID_82790
  Gene Ontology: Mol. function=transferase activity; Cellular component= nucleus; Biological process=metabolic process
  Homolog annotation: Hit_ID=A7NZV5; Match level="QueryCoverage=98%, HitCoverage=99%, E-value=5e-79, Identity=60%"; Hit description =Chromosome chr6 scaffold_3, whole genome shotgun sequence
  Pfam annotation: Domain name=JmjC; Domain location=381-504; Score= -5.3; E_value=0.002; Accession=PF02373.13; Description=JmjC domain
MSTTTVSGGDPPSRGFDTPTLDREAAALLHAISEHGGYAYVSMAVLASGGDIRAAEAAREMAWEQLHSGPWHSVLPVWRDAYSMACLHVARHHYGNGEFLDALRVLDLGIIMGGTLLRKDLDSAIEKVSEQTRRSVRVSDLGNSEHRLVDREFDMAEVLQLLPVKSLSTKLVVKKSALSLEKFLKDHYLSGCPVIISDCMSHWPAKMKWNDEDYLLRVAGDRTVPVEEFGKLIGQCQWEERSRCLKMPYVEILEPFTCHASNNLFLSWQGCWKLFSSIQKIPSHTLTGKTGWSGTLYVGKNYLCTEWKQELITFSEFLQRIKSDSCSPGGPTYLAQHPLFDQDLYCFQFLILLRWQINELRKDIFIPDYCFTGGGELRSLNAWFGPAGTVTPLHHDPHHNILAQSYYRANSWHGTVGGIRVVGKKYIRLYSSSLSEELSPHSGTMLHNSSQVDLDDMDEKKFPKVQDLEFVDCILEEGEMLYIPPKWWHYVRSLTTSFSVSFWWSEGESSDAS

SEQ ID NO: 174476 - protein, 487 aa, Glycine max
  Coding DNA Sequence Number=SeqID_82791
  Gene Ontology: Mol. function=nucleotide binding; Biological process =defense response
  Homolog annotation: Hit_ID=A7NZU5; Match level="QueryCoverage=95%, HitCoverage=97%, E-value=1e-168, Identity=66%"; Hit description =Chromosome chr6 scaffold_3, whole genome shotgun sequence
MTMDRLSQSSSDSPTRGDPKVLSIECLKGSSKAHEWTGDMLQTGDIVEELRIGASPNALISFRSPFKNGKSGVNRILQDSYKKKDTSILVLVRRGPHEFAELQACIVPNDSSGKKHYVLRSITDPNYVVAFLDRTETECFQLQASRTTRMVNALTRTRLQDGYVSYPWERRMQELLSVPNSSNFLSILLLPKVSDRIAARYNDVEDTLARANTWLNAAQASGVPIVFMNVQTESLLTKISGETASSTVNAGSLSDLSNLANASLYGFEDYHGVDIGVVRAVRLWYAPIGGEISIEIKLKEDDAKLGFAISRTEEGFIFIQTVIEDNQENVPATRSGLSNLYKAAKDTSKLLVVSRLSNQRVLPWMVSSTGAIRCYDTVSLSQKLSLHRHTKVPILLHVFLWDRTLASSLESTRLSSLSPSVLPLPLSQEVQLAPHPNENQIQPLPHEGSDAGGGVSSVGSQPMQLERDTAGDLSFRFHNFSVSNCWL

SEQ ID NO: 174477 - protein, 1401 aa, Glycine max
  Coding DNA Sequence Number=SeqID_82792
  Gene Ontology: Mol. function=acyltransferase activity; Cellular component=integral to membrane; Biological process=response to oxidative stress
  Homolog annotation: Hit_ID=A5B1G8; Match level="QueryCoverage=100%, HitCoverage=87%, E-value=0.0, Identity=52%"; Hit description =Putative uncharacterized protein
  Pfam annotation: Domain name=AMP-binding; Domain location=229-686; Score=249.4; E_value=7.7e-72; Accession=PF00501.19; Description=AMP -binding enzyme
  Pfam annotation: Domain name=Hexapep; Domain location=1005-1022; Score=2.4; E_value=76; Accession=PF00132.15; Description=Bacterial transferase hexapeptide (three rep
  Pfam annotation: Domain name=Hexapep; Domain location=1092-1109; Score=5.6; E_value=31; Accession=PF00132.15; Description=Bacterial transferase hexapeptide (three rep
  Pfam annotation: Domain name=Hexapep; Domain location=958-975; Score =4.9; E_value=38; Accession=PF00132.15; Description=Bacterial transferase hexapeptide (three rep
  Pfam annotation: Domain name=Hexapep; Domain location=987-1004; Score= 10.3; E_value=7.3; Accession=PF00132.15; Description=Bacterial transferase hexapeptide (three rep
  Pfam annotation: Domain name=PP-binding; Domain location=830-888; Score=16.3; E_value=0.013; Accession=PF00550.16; Description =Phosphopantetheine attachment site
  Pfam module annotation: Pfam domain module=AMP-binding::Hexapep::Hexap ep::Hexapep::Hexapep::PP-binding; Domain location=229-686::1005 -1022::1092-1109::958-975::987-1004::830-888
MDASDLEKDLFSKVETNDYYTTVLKIKGLEHLPVGFYYFSEYMEDPSTMGHPVAMQRFYSDTNIFLLWSYGNSVDIKEPTVMELVIKTIEAIGGEVEHVILQRALCIFLMLAAKLESELQGSRNTYYVGGLMAFELTERNSSYAMALICKNFAYRNDFPIFPYTKNLFPLQALCQKKNRRELGELPEVQFPNLPTLNSYLTHWGTHPITQNRALYTWINEEGTPVCQRTYGELYFNSSCIAHKLLTSQKPVIKPGDKVLLIYVPGLDFIDAFFGCLRAKVIPVPILPPDPMQRNGQALIRIENVAKSCNIVAILSTVAYHSAVRAGSLKNLISLTEKNGKSSARWPNLPWLHTGTWVKNSKSMILEHLDKQCEPQPGDICFLQFTSGSTSDAKGVMITHGGLIHNVKFMRTRYKSTSRTTLVSWLPQYHDMGLIGGLFTSLVSGGSAVLFSPMTFIKKPLLWLETISKYQATHSAGPNFAFELLIQRLESDKDKLQNLDLSSLTFLMVAAEPVRQKTMKRFIELTSPFGLSEKVMAPGYGLAENCVFVSCAFGEGKPIIVDWQGRICCGYVNHKDADVDIRIVDPETCEELQEDGKEGEIWISSPSAGIGYWGREELSQKTFRNELHNHPGRSYTRTGDLGRIIDQKLFITGRIKDLIIVAGRNIYSADVEKTVETSSEFLRPGCCAVIGVPEEILSAKGISTPDGSDQVGLVVIAEVRDGKPVSKDLIEKIKTRVVEEHGVNVASVKLIKPRTISKTTSGKIKRFECVKQFTDETLNLVPQGSKTILTKKSLLRPFTTGAWGEEKRPGTQQVRSILAPRKRISKNEIVEFLKGLISEQTGIPINDISVTDNLTSYGIDSIGVVKATQKLSDFLGTPVAAIDDLLSKSQPQLSSNLPNIPEAESDSTEFIVEAQEISSKILAIHLRGTVLLNYWFEMLGARIGSSVLLDTVDITDPSMVSIGDEVVISEGVLVQSHEVKNGILSFHPIRIGKCSSIGPYAVIQKGSVIGEGVEVQALRKVGQDQHVFKPAKLNNDNKKCYVQHCSIRAINRVSNPELMSIGDGVHLGDFSCVITGFHSSSGYVSGEVEVQDNSVIGSQSLILPGSLVQKNVILGALSVAPMNSTLQEGGVYIGSQSQVVIRNSVKNAYDEGIEEMDMVSKKRVGNLAAALHKNDSQKVTLTRTWYQTFSALFTQPLLQTVLPHMVLGLAVFAPLNCVVYLKSAKNLPIYWLLPLFWIHSGALAALACVIAKWILAGKKKAGEAVPIWSQRITLDSTWQAIRTLVGDYFMDMTSGSFWFVLWMKLMGAKVDMEHAVYVDSMGALLNPEMVKIERGGCVGREALLFGHVYEGEGGMVKFGEIKIGEYGFAGSRAVAMPGVQIESEGNLSALSLAMKEEIIRSR

SEQ ID NO: 174478 - protein, 137 aa, Glycine max
  Coding DNA Sequence Number=SeqID_82793
  Gene Ontology: Mol. function=catalytic activity
  Homolog annotation: Hit_ID=A7NZU1; Match level="QueryCoverage=67%, HitCoverage=11%, E-value=3e-20, Identity=52%"; Hit description =Chromosome chr6 scaffold_3, whole genome shotgun sequence
MKFRSWVPILAGCRLLTLLELRLSVSNEENGGFFVFVTLVLCGCAADLQPRKFLTEQHQHDWAVMYKNIKNMGVFKSPEGFSKKCLFKDVRLHKDSILGGAQQTNLEYLLIWSFRKTVGLSTPGTPYGGWEVVGVQV

SEQ ID NO: 174479 - protein, 94 aa, Glycine max
  Coding DNA Sequence Number=SeqID_82794
MGDSISRLSIPACLHSSGENTETFSSLTSYPELRRSEFLIGGYVGAKASLLSTTLLSVTMTQELVARGDTLRLFAPRVRLIRGGQYAPLRPFRR

SEQ ID NO: 174480 - protein, 189 aa, Glycine max
  Coding DNA Sequence Number=SeqID_82795
MCGEAYETGQCIPTDDNTQEIHFMGNQQRQGYTQGGFLGFQQGPYNQQGQWRTHPGNQFNKDQGGSSNRPIQQGPNIFQRTTKLEETLTEFMQVTMSNHKSTKSALKNLEVQMGQLAKQIVDKSSNSFGANTENNPKEECKAVITRSKRFMEAEDEENVVDKEKKGEKKGVEVKKNNVKSKENQEKGRK

SEQ ID NO: 174481 - protein, 93 aa, Glycine max
  Coding DNA Sequence Number=SeqID_82796
LSEELAKRTYCAKRVHPLRINIHPLAELPMAKQGNLDFFLVIDGIKKKSYNRRHPFIIHSSSSVSNCRTRCAKFTNFSSYATKLIPRIVHYHA

SEQ ID NO: 174482 - protein, 139 aa, Glycine max
  Coding DNA Sequence Number=SeqID_82797
MFALKTKAIYVSRNVIFYENCFPFIGQDKPDHVTVLPIPPSHSINQSDGVSSELPIDHIMPVPNNTNFDPLNLEQSSNITKRSLRQTHRLSKYKDFHVSYPSLTVANYSVVLNLNPIMKASKDPIWIEAMNAEIKPFRT

SEQ ID NO: 174483 - protein, 66 aa, Glycine max
  Coding DNA Sequence Number=SeqID_82798
MSTASCVVDMGKRKVQMAIEDQQISFDMFHEEKALPDQNVCLKVNVMEEKRLQKKVLEVGTLLDPR

SEQ ID NO: 174484 - protein, 135 aa, Glycine max
  Coding DNA Sequence Number=SeqID_82799
MVMGDSISGLSFPACAALIGRNIGLFAKACLHFSGENTETFSSLTSYPELRRSEFLIGGYVGARASLLSTAPLFVTMTQELVARGDTLRLSAPRHSVTPSVIDEQRPMWSSAPFPEMSASSGGDFFKSHKLSRTT

SEQ ID NO: 174485 - protein, 61 aa, Glycine max
  Coding DNA Sequence Number=SeqID_82800
MSVKNLVGCLEVNDKTNHTLASQVTLTRLKEHSNRVTPKAYTPKSPLRPLPPDSGPTQKTF

SEQ ID NO: 174486 - protein, 407 aa, Glycine max
  Coding DNA Sequence Number=SeqID_82801
  Gene Ontology: Mol. function=oxidoreductase activity, acting on the CH-OH group of donors, NAD or NADP as acceptor; Cellular component =cytoplasm; Biological process=branched chain family amino acid biosynthetic process
  Homolog annotation: Hit_ID=A8G9R0; Match level="QueryCoverage=60%, HitCoverage=68%, E-value=1e-135, Identity=96%"; Hit description=3 -isopropylmalate dehydrogenase
  Pfam annotation: Domain name=Iso_dh; Domain location=164-407; Score =320.6; E_value=2.8e-93; Accession=PF00180.11; Description =Isocitrateisopropylmalate dehydrogen
  Pfam annotation: Domain name=LeuA_dimer; Domain location=26-157; Score=226.4; E_value=6.6e-65; Accession=PF08502.1; Description=LeuA allosteric (dimerisation) domain
  Pfam module annotation: Pfam domain module=Iso_dh::LeuA_dimer; Domain location=164-407::26-157
MGYQEQDYNLDTLYAAFLKLADKKGQVFDYDLEALAFINKQQEEPEHFSLGYFSVQSGSSIMATASVKLICGGEEKAEAATGNGPVDAVYQAINRITDYPIELVKYQLTAKGHGRDALGQVDIVVSYNGRRFHGVGLATDIVESSAKAMVHVLNNIWRSQQTYHIAVLPGDGIGPEVMAQARKVLDAVRQRFDIRITTAEYDVGGIAIDRHGSPLPPATVAGCEQADAILFGSVGGPKWEHLPPAEQPERGALLPLRKHFKLFSNLRPARLYQGLEAFCPLRADIAARGFDILCVRELTGGIYFGQPKGREGQGMQERAFDTEVYHRFKIERIARIAFKSARKRRHKVTSIDKANVLQSSILWREVVNQVAKDYPDVSLSHMYIDNATMQLIKDPSQFDVLLCSNLF

SEQ ID NO: 174487 - protein, 261 aa, Glycine max
  Coding DNA Sequence Number=SeqID_82802
  Gene Ontology: Mol. function=two-component response regulator activity; Cellular component=intracellular; Biological process=two -component signal transduction system (phosphorelay)
  Homolog annotation: Hit_ID=P03029; Match level="QueryCoverage=100%, HitCoverage=55%, E-value=1e-128, Identity=88%"; Hit description =Nitrogen assimilation regulatory protein
  Pfam annotation: Domain name=AAA; Domain location=89-261; Score= -41.1; E_value=0.082; Accession=PF00004.20; Description=ATPase family associated with various cellular activities (AAA)
  Pfam annotation: Domain name=AAA_2; Domain location=85-230; Score= -32.1; E_value=0.003; Accession=PF07724.5; Description=ATPase family associated with various c
  Pfam annotation: Domain name=AAA_3; Domain location=89-229; Score= -19.4; E_value=0.045; Accession=PF07726.2; Description=ATPase family associated with various
  Pfam annotation: Domain name=AAA_5; Domain location=89-235; Score =11.3; E_value=0.0004; Accession=PF07728.5; Description=ATPase family associated with various
  Pfam annotation: Domain name=Sigma54_activat; Domain location=66-260; Score=397.8; E_value=1.6e-116; Accession=PF00158.17; Description =Sigma-54 interaction domain
  Pfam module annotation: Pfam domain module=AAA::AAA_2::AAA_3::AAA _5::Sigma54_activat; Domain location=89-261::85-230::89-229::89 -235::66-260
MLPVIIMTAHSDLDAAVSAYQQGAFDYLPKPFDIDEAVALVERAISHYQEQQQPRNQPVSGPTTDIIGEAPAMQDVFRIIGRLSRSSISVLINGESGTGKELVAHALHRHSPRAKSPFIALNMAAIPKDLIESELFGHEKGAFTGANQIRQGRFEQADGGTLFLDEIGDMPLDVQTRLLRVLADGQFYRVGGYAPVKVDVRIIAATHQNLELRVQEGKFREDLFHRLNVILVHLPPLRERREDIPRLARYFLLVAPRELGV

SEQ ID NO: 174488 - protein, 57 aa, Glycine max
  Coding DNA Sequence Number=SeqID_82803
MSVKNLIGRLEVHDKTNHTLGDQSGLRCFARMLQPCGISTGLKEHSNWVYLPPRPRL

SEQ ID NO: 174489 - protein, 177 aa, Glycine max
  Coding DNA Sequence Number=SeqID_82804
  Pfam annotation: Domain name=G-patch; Domain location=2-43; Score =17.6; E_value=0.0014; Accession=PF01585.14; Description=G-patch domain
MMVTRVMLGYSYEPGMGLGKNNGGRTSLVSTRGNRRKFGLGYKSTQADIRKNISERKNKGQGLRSGQQAKEAPPCHISRSFTSAGLRIEGQVTAIYEDDSPRRSDLVQLCPPDFRLGNWRVEELPDVYATSIISDDESLEGTNTRDPAVNFEQEAGRMESEEDEDVGLPLELEKIIA

SEQ ID NO: 174490 - protein, 127 aa, Glycine max
  Coding DNA Sequence Number=SeqID_82805
  Gene Ontology: Mol. function=ATPase activity, coupled to transmembrane movement of substances; Cellular component=integral to membrane; Biological process=transport
  Homolog annotation: Hit_ID=A7NVZ8; Match level="QueryCoverage=94%, HitCoverage=61%, E-value=4e-35, Identity=43%"; Hit description =Chromosome chr5 scaffold_2, whole genome shotgun sequence
MSGDTLLIQEALGEKCVACFLGRLVIAFIKGWLLTLVLLCCIPPLVISGSMMSFTFAKLPSHGQAAYSEAATVVERTIDSIRQVASFTGESQAIAQYNQSLTKAYRTAVQDGVVAGLGLGSILNQSL

SEQ ID NO: 174491 - protein, 215 aa, Glycine max
  Coding DNA Sequence Number=SeqID_82806
  Homolog annotation: Hit_ID=Q6WAY6; Match level="QueryCoverage=100%, HitCoverage=35%, E-value=7e-15, Identity=28%"; Hit description =Putative uncharacterized protein
MLADLYDTFDRRCEKSSTRIVCCTPALYVWLVSHFFRQEVRHACPLEGHRSCTEKGGANWDQLLSNKEGASVNWFPRWKEGRTRVLVSCGGFPNVPLMGKRGCISYNLILTIRQLGYPMRGAPLEEELAPVISRGFSETNVETYRKARKAWEVVQKKDKELRGSNNGPIGGYRKWIRKENAELRDVNIATTKALEQETKSARREEHGRNKFRGAL

SEQ ID NO: 174492 - protein, 255 aa, Glycine max
  Coding DNA Sequence Number=SeqID_82807
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLERDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 174493 - protein, 138 aa, Glycine max
  Coding DNA Sequence Number=SeqID_82808
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=62%, HitCoverage=72%, E-value=3e-24, Identity=68%"; Hit description=LacZ protein
MKHFTDTLISANIGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 174494 - protein, 253 aa, Glycine max
  Coding DNA Sequence Number=SeqID_82809
DFARTTAGRWVQIMRTSMTTLTRMWMTLLLSNVLPSDHNFDLPLPKCQLVYAILTRMSVHVAQMIADTIYLFAGMPPTRNPLDPDKSNRALGFPTLITGLCQSFGVPVTPSKVIRPPITRAFIEKYCTPRQVQGDAPQDADAPLPPHQVDPAGSLGMEHYLQHLVRQQATNHRGQVQIHECLYRFSLSQQGQGFAPFACPTLEQFRAEVAWPGDWPEAQAGEAPAGSPGDAEEARMDEEMTDLLGFLGGSGAT

SEQ ID NO: 174495 - protein, 128 aa, Glycine max
  Coding DNA Sequence Number=SeqID_82810
DRAHKTPSGPEEVQQGPRVSSSGYGPLSVLPGARTPSKEWHPQRHPVDPEKSNKALGFPALVTGLYSPTGCPFPPARSCHHDIEIVPARHPVDPKKSNRILKFSSSNYGSLSVLRSACHLQQGHQAPY

SEQ ID NO: 174496 - protein, 127 aa, Glycine max
  Coding DNA Sequence Number=SeqID_82811
  Gene Ontology: Mol. function=methyltransferase activity; Cellular component=mitochondrion; Biological process=menaquinone biosynthetic process
  Homolog annotation: Hit_ID=Q57HN8; Match level="QueryCoverage=100%, HitCoverage=50%, E-value=4e-65, Identity=95%"; Hit description =Ubiquinone/menaquinone biosynthesis methyltransferase ubiE
  Pfam annotation: Domain name=Ubie_methyltran; Domain location=14-127; Score=77.0; E_value=6e-20; Accession=PF01209.9; Description=ubiECOQ5 methyltransferase family
MVEDSQETTHFGFQTVAKEQKADMVAHVFHSVAAKYDVMNDLMSFGIHRLWKRFTIDCSGVRRGQTVLDLAGGTGDLTAKFSRLVGETGRVMLADINDSMLKMGREKLRNIGIVGNVEYVQANAEAL

SEQ ID NO: 174497 - protein, 132 aa, Glycine max
  Coding DNA Sequence Number=SeqID_82812
  Gene Ontology: Mol. function=aspartic-type endopeptidase activity; Biological process=DNA integration
  Homolog annotation: Hit_ID=A5BKB9; Match level="QueryCoverage=100%, HitCoverage=13%, E-value=2e-19, Identity=36%"; Hit description =Putative uncharacterized protein
MGMVKSMLINLTIPVSLWMYALKIAMYLLNRVPKKSKGYMFYYPNHSMRIVETGNPRFIENGEISGSAVPREVEIKEVRVQVLLVYASSSKVIAPPFSCCYKINEKEQHNNESMMHNEPIMEEPLEVALRRS

SEQ ID NO: 174498 - protein, 119 aa, Glycine max
  Coding DNA Sequence Number=SeqID_82813
MPSTSQGPKKGHMSSSKGPRTKLGYDKYVYRWAETTNQVSQRAPSRASEGEAHGCAFQRRKDARSRHQCLFVGNVGKNRRKLVKMKILSSGVVFTFEEGRQKRGFCSYVPSIEEEIRPT

SEQ ID NO: 174499 - protein, 249 aa, Glycine max
  Coding DNA Sequence Number=SeqID_82814
  Gene Ontology: Mol. function=undecaprenyl-diphosphatase activity; Cellular component=integral to membrane; Biological process=cell wall organization and biogenesis
  Homolog annotation: Hit_ID=A7MJT8; Match level="QueryCoverage=100%, HitCoverage=91%, E-value=1e-111, Identity=81%"; Hit description =Undecaprenyl-diphosphatase
  Pfam annotation: Domain name=BacA; Domain location=9-249; Score =417.6; E_value=1.8e-122; Accession=PF02673.9; Description=Bacitracin resistance protein BacA
  Pfam annotation: Domain name=DUF368; Domain location=8-238; Score= -133.7; E_value=0.097; Accession=PF04018.4; Description=Domain of unknown function (DUF368)
  Pfam module annotation: Pfam domain module=BacA::DUF368; Domain location=9-249::8-238
MADIHQLWVAAILGVVEGLTEFLPVSSTGHMIIVGHLLGFEGEKAETFEVVIQLGSILAVVVMFWRRLFGLIGIHFGQERHEGVGSGKLTLIHILLGMVPAVVIGLVLHDQIKTLFNPINVMYALVVGGVLLLAAEYLKPKQPKAVGIDDITYRQAFIIGCFQCLALWPGFSRSGATISGGMLMGVSRYAASEFSFILAVPMMIGATGLDLYKSMGFLTMQDFPMFAVGFVTAFIVALLAIKVFLELIK

SEQ ID NO: 174500 - protein, 79 aa, Glycine max
  Coding DNA Sequence Number=SeqID_82815
MAKEGRTPSSPVLFSNLKKKSLDRGMKKDLQKKVDDRPLMWYLIFASFQCRTVVNKCDINNCELKKYEVDEEFLFEFEA

SEQ ID NO: 174501 - protein, 86 aa, Glycine max
  Coding DNA Sequence Number=SeqID_82816
MGGAVTLLDILGGGIEWAHRCVFHGRKMCGVATNVYSRKTSEKPERMLQNFTDYLTMSVKYLEAVKRSAVTLLDIPGGGNRVVKEL

SEQ ID NO: 174502 - protein, 150 aa, Glycine max
  Coding DNA Sequence Number=SeqID_82817
MKDSGIFSTESLRRILRIPLGLKHSSWCGGSTASNNDSWRPPVVVGGGEGGVRVWVVFGEEEGGGGNRVFHAEERIYNLAIPSRVGIGLSALILAQCNSLWVGIALSAPLVLSETSKVVIFEIPTVRLENCLRKLQPKFEDNPTVNESGS

SEQ ID NO: 174503 - protein, 81 aa, Glycine max
  Coding DNA Sequence Number=SeqID_82818
  Subcellular localization annotation: CTP_CleavageSite=51; ConfidenceScore=5.30e-01
MAFFQSYLDCKAQNAQVTNALRNGNVAHTPEVFSNIPMGVTHTVKRLTNPRFSQKKKLKRRQSRTGSTKREKGDESKLKIY

SEQ ID NO: 174504 - protein, 254 aa, Glycine max
  Coding DNA Sequence Number=SeqID_82819
MVGLHADSLLDWRPYASTFTIISYAGDASEYQNSIPKVDTITIHTEDELTIQKENFFDIPSLESMGLNLNETLFCYANMWQNVVNNNFLHQFMLFHLMECIPFDFPYTIYLNILFITKTLGGNDDIYYVALLNKILWGQGAYLAFNAVDDSNSKTLVNQRKKRLLHSKGKKGNCSTSKSSYASIQGLLNQKGVPKKQVEEERKVTAQPPTPLAPKKDKVIKAHPTRKKHVLAPNMVKKLKTMTIRVASTLSSLG

SEQ ID NO: 174505 - protein, 87 aa, Glycine max
  Coding DNA Sequence Number=SeqID_82820
MPPKSLLKGSKSATTTKDMEGLRGDGVSRWNPKVGLLLMYWDKWCQHAHPEKCPTFVMKWRNCIRKYHADEDQGYTYYPSLPKDDFW

SEQ ID NO: 174506 - protein, 120 aa, Glycine max
  Coding DNA Sequence Number=SeqID_82821
MEVSMAGIRVPRIICLLVEGHDPRSTEADDGVHDGRTVEGSGPQTTDVVLQSQLLVFLVVYPDLVTDKPSFKEVCDAVLASNGEGAPSPDGFNAWLGNLLADDVKPKEAVGIRREGRRRV

SEQ ID NO: 174507 - protein, 110 aa, Glycine max
  Coding DNA Sequence Number=SeqID_82822
  Subcellular localization annotation: CTP_CleavageSite=32; ConfidenceScore=5.31e-01
MYPLLFLVTTTQVDVPSTCTTKDVPSNVLRKSSQAVSPLKLCEGEKGDTKEFRRLVLCSFGKGRRKTQKEFRRLVLVEFFLAKGEDRYKRIQAVSSSFFWKREKRDTKRI

SEQ ID NO: 174508 - protein, 228 aa, Glycine max
  Coding DNA Sequence Number=SeqID_82823
  Gene Ontology: Mol. function=microtubule motor activity; Cellular component=microtubule associated complex; Biological process =microtubule-based movement
  Homolog annotation: Hit_ID=Q9C9S6; Match level="QueryCoverage=54%, HitCoverage=11%, E-value=5e-17, Identity=42%"; Hit description =Kinesin-related protein; 103921-99132
MMSTELAALLSTKASKKTSSCMVGALCCLVDKFQISLCRLKWILFCFGVGPNSWQLFLFQIALHGMNSSSLNLKETELRLGLPGCESPETKSGLQQNNLFKAREEKYQSRIRVLEALASGTIDKSEGEKIKEKVKKVDENEVVRLIKEQEDKNLEISALKVELETTKRTYEVQFSQMEEEANSFKAALTRKVQEYEHQLEELRNEAEKINEEVKTTDEEESNKFMKEQ

SEQ ID NO: 174509 - protein, 71 aa, Glycine max
  Coding DNA Sequence Number=SeqID_82824
MARVRGLKEKLGTKGSMPFVGDYHKKIDMRLLSGNQFGPLGDNGNLNRFKTGGTVMVPKTPNQEQFSPLSI

SEQ ID NO: 174510 - protein, 179 aa, Glycine max
  Coding DNA Sequence Number=SeqID_82825
MAPTRHPLDLEKSNRALGFPALITGLCQSYGVPVTPSKVIRPSITQAFIEKYCTPRQAQSDAHQAAGAPPPPRQADPAGSLGVERYLQHLVHQQATNHHGQVQIHECLYRFSLSQQGQGSAPFVCPTPKQFGAEVAWPGDWPDAQAGEEPAGSPGEADESHMDEDMSDLLGFLGGSGAT

SEQ ID NO: 174511 - protein, 64 aa, Glycine max
  Coding DNA Sequence Number=SeqID_82826
MAALRRQTDGECGSLFYQHHVILAVHQVLTDGGDLDMNLRFVTKLFDHLHFALKGDIGDVARQQ

SEQ ID NO: 174512 - protein, 260 aa, Glycine max
  Coding DNA Sequence Number=SeqID_82827
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 174513 - protein, 82 aa, Glycine max
  Coding DNA Sequence Number=SeqID_82828
MAPLPGNSHLDPIEDHIMAEEPRKVTLEDYSSSNVPQFFTSIAQPEVQAQTITYPPSLIQNNLFHGLPNEDPYAHLATYIEI

SEQ ID NO: 174514 - protein, 153 aa, Glycine max
  Coding DNA Sequence Number=SeqID_82829
MEGRKNRDSYFVLEISKCSLDGDEGLHQLQSRPRYKTTWLPYERGAIRGRPHTFYYTRFNSTNAGVFQRVHKAWEMSQRKDKELRGSSNGPIGGYRRWLKAYAKDMDWLPSLRITKGVEVETPEEDEEVQALKTKLEKAQTVKEKFKSAAIRI

SEQ ID NO: 174515 - protein, 138 aa, Glycine max
  Coding DNA Sequence Number=SeqID_82830
  Homolog annotation: Hit_ID=A5AK77; Match level="QueryCoverage=63%, HitCoverage=11%, E-value=3e-11, Identity=40%"; Hit description =Putative uncharacterized protein
VHPDHYVHFEHSEHFVHSVVVDFEHSDFEHSAANFHTENMAQSPSHERTLREMAAPDYTYESLCIQYPDEDVPYVLKTGLIHLLPKFHGLAVEDPHKHLKEFHIVCSTMKPPDVQEDHIFLKAFPHSLKGVAKDWLYY

SEQ ID NO: 174516 - protein, 69 aa, Glycine max
  Coding DNA Sequence Number=SeqID_82831
MNRHHLIRRIQLGHLAWSDQFRAEVAWPGDWPEDQTEEAPAEAPGDGEEARMDEEMTNLLDFLGGSGAM

SEQ ID NO: 174517 - protein, 46 aa, Glycine max
  Coding DNA Sequence Number=SeqID_82832
MVEEKKKEKMVEDDKQQLMNGNGMEKEEREETPLQGEDESRRSSPP

SEQ ID NO: 174518 - protein, 49 aa, Glycine max
  Coding DNA Sequence Number=SeqID_82833
MEDAPVSLTSLARKRVAPTGLSIKGPYDRVHGNLRSGGGSMVMLGLRLA

SEQ ID NO: 174519 - protein, 212 aa, Glycine max
  Coding DNA Sequence Number=SeqID_82834
PHDIGVGSQILVPGARAGHGGAQDGLREDRQHRSVVVQEAAMPGIFEPARRLGDEAAQAVHAHHQALLDQVAQRALHRAQAERRELRQFLLGRQLVARLPDAAPDRVDQHLDQPLVLGPAGRIGCVQRLENFQTTFQGTHEIFSLSSIIMSAPFSPITMLPALVLPESSRGMIEASTTRRRSTPRTRSRLSTTEAVSGPMRQVPTGWKMVVA

SEQ ID NO: 174520 - protein, 60 aa, Glycine max
  Coding DNA Sequence Number=SeqID_82835
MTLLLKNVLPSNHNSDLPLPKCQLVYAILTRMSVHVAQVWCLPCTLWTRRSPTGPWGFRL

SEQ ID NO: 174521 - protein, 66 aa, Glycine max
  Coding DNA Sequence Number=SeqID_82836
MEEVRQGLGFPLARRWSRPRTEPNIPTNSFLWAPYDTPEIRPLINDVEVSMIVRAKVPLICFAIVE

SEQ ID NO: 174522 - protein, 163 aa, Glycine max
  Coding DNA Sequence Number=SeqID_82837
  Homolog annotation: Hit_ID=A5BCP7; Match level="QueryCoverage=29%, HitCoverage=33%, E-value=1e-06, Identity=58%"; Hit description =Putative uncharacterized protein
MEQCFCLREGVMVWEWKVGECAVGVGVRLVESVGVRLDGHVPLKDDVLEKEVVFEQCVTRTLSPALTLEEGLEKLKEALQILNSPSPSSPTVLRPSLCFAPNPTPPRKKGSFWFSIPQIELDELESVSILSMTLAWDEFSFSTFQEAHYSLQDSLDQVPDMPF

SEQ ID NO: 174523 - protein, 442 aa, Glycine max
  Coding DNA Sequence Number=SeqID_82838
  Homolog annotation: Hit_ID=A5CZ49; Match level="QueryCoverage=59%, HitCoverage=67%, E-value=2e-17, Identity=31%"; Hit description =Putative uncharacterized protein
MTETYLAWFQAAWRDARDANREVRGFLSVHDTIWRTDLDTGEAFREDAGRVKPAGSDHHGLGHAFGLRDDLAQLADGFALLAQRGGDGVGLGRIHHQHHADAAVEDAVHLGVLDAALLLQPLEQLGHFPAVAPQAGRQAVLQDARHVVEQAAAGDMGQALDGGAVLGQRGQHLLDVDAGRGHDHVDQRLAVEVVVGLGAGAFQDLAQQRIAVGVGAAGRQAQHHVADLDRLAVDDGRLLDRAHGEAGQVVFAIGVHARHFGGFAADQGAARQFAALGDAAHHRRRRVHRKLAATEVIQEEQRLGALHQDVVDAHRHQVDADGVVAVPVERQAQLGADAVGARDQHGLLVVLGHFEQAAKAADTGQHPGAHGARRKRFDTVDQGVARVDVDTGVTVGQGSFGLIRHEKCRGICNNCWELGWNALHFTMLRPDPGRRPVKLASG

SEQ ID NO: 174524 - protein, 100 aa, Glycine max
  Coding DNA Sequence Number=SeqID_82839
  Gene Ontology: Mol. function=aspartic-type endopeptidase activity; Biological process=DNA integration
  Homolog annotation: Hit_ID=P10978; Match level="QueryCoverage=82%, HitCoverage=6%, E-value=1e-09, Identity=42%"; Hit description =Retrovirus-related Pol polyprotein from transposon TNT 1-94 [Includes: Protease (EC ...
  Homolog annotation: Hit description=3.4.23.-); Reverse transcriptase (EC 2.7.7.49); Endonuclease]
MELYQLKMEMGRNLHDHINNFNHLVSQLVNAYDKLSNEEWALLLLASLPRSFKALVQTLLVERSTLNLDEVIAALRENEIMMRTKNVDDEHNTIVVVEFE

SEQ ID NO: 174525 - protein, 111 aa, Glycine max
  Coding DNA Sequence Number=SeqID_82840
  Homolog annotation: Hit_ID=Q51617; Match level="QueryCoverage=48%, HitCoverage=78%, E-value=6e-13, Identity=72%"; Hit description =Putative uncharacterized protein
  Subcellular localization annotation: CTP_CleavageSite=17; ConfidenceScore=5.68e-01
MLCKKAVSSFGPPIVVRSKLAAVLSLMVMAALHNSLTVMPSVRCFSVTGVSRGPFVSRVSVMTVKTSDTCSSRRRSQLVCKRMPGADKPVRARQRCWRCRAGLTIASDRLY

SEQ ID NO: 174526 - protein, 71 aa, Glycine max
  Coding DNA Sequence Number=SeqID_82841
  Subcellular localization annotation: CTP_CleavageSite=51; ConfidenceScore=5.08e-01
TYQGNPCGVYPDLSSFTGSGVYPDLSSFTGSGVYPDLSSFPGSGVIQTFVACIKRSAPTQVHIIWYQSFGS

SEQ ID NO: 174527 - protein, 66 aa, Glycine max
  Coding DNA Sequence Number=SeqID_82842
MSKVHPYLKFEAPQRRGVLHDSENGFLQFGVEMRRNFGASKDNNGGEEGRRKATWKERKKLVKFSE

SEQ ID NO: 174528 - protein, 42 aa, Glycine max
  Coding DNA Sequence Number=SeqID_82843
MMMIHSLILMLVLSPQKSCLTSLDKKKLTMFTQIVMIMMKDN

SEQ ID NO: 174529 - protein, 16 aa, Glycine max
  Coding DNA Sequence Number=SeqID_82844
MVIFHHGNAAEDKGEE

SEQ ID NO: 174530 - protein, 216 aa, Glycine max
  Coding DNA Sequence Number=SeqID_82845
MVETKNKRIKSIGHRLTATKTKSKKEKESANGGSSNNGFILLELLECHRLKKLVEMKDTFYLELVWEDIVGLSLKWMMVNDKGLQDASVKFNKVTKYNALMKDSSTFIVIVSKGKGKEIFGISPLGSNDAQLIDEDLLVICLMQGKMKLNWVNIVVDNMLKAKRIDEIFEIVEPEFEVKSKMDELMRIHKGDYLEPNECFKKYIKEAGCFGITTCG

SEQ ID NO: 174531 - protein, 347 aa, Glycine max
  Coding DNA Sequence Number=SeqID_82846
  Homolog annotation: Hit_ID=A5APQ3; Match level="QueryCoverage=33%, HitCoverage=7%, E-value=1e-13, Identity=38%"; Hit description =Putative uncharacterized protein
  Pfam annotation: Domain name=DUF1723; Domain location=107-156; Score =22.8; E_value=0.0011; Accession=PF08330.1; Description=Protein of unknown function (DUF1723)
MGHKVLLQHLVKTKGDAGVVFEHDIRRWVNSGKGWMLIASAHRQRATVAIPEDVEHVDNLADEVHKQPQEPVTDDVLANAQGFPGRPHNTSVLIYYVYHVAAIVWECPKLKLSSHGRKRWHKETSSFHLPVGKVTITLDDVAFLLHLPIIGVFHNFDAPDAEHVVELLVELLEGATHMHVVFLDAFRDFSQFGSYSWGAAALVHMYDNLNDASKKSTRQLAGYITLCSVGIYEHFLTLASCVVDEDYHERKLRVCRWKSEKALLTFHPHPNAPSLSIEEIDNRWIRFSEYLAPVGQICVAFRQCAANYMEWFYMISHPFMSLTQLGDPPKHSLVVHDETFIVPNPPQ

SEQ ID NO: 174532 - protein, 94 aa, Glycine max
  Coding DNA Sequence Number=SeqID_82847
MPHCHILSEHCVPTSFSTRFLKALHLAICSPEHKIQDHHRIQTQTTHREGRPVRVTVFCENAPTIWDQHKLKGALKPGDPQGLHSEESIRASPS

SEQ ID NO: 174533 - protein, 74 aa, Glycine max
  Coding DNA Sequence Number=SeqID_82848
MCGVEGVTKMRLKNQGSHSVHYVSHQGNQGAGKKFVKNHDKGKGPLKINDDSVQIQKKASKSNNCHFCGKFGHF

SEQ ID NO: 174534 - protein, 79 aa, Glycine max
  Coding DNA Sequence Number=SeqID_82849
  Subcellular localization annotation: CTP_CleavageSite=67; ConfidenceScore=5.22e-01
MGRLAGFTFYYTGLSDTGVSLSGECYVTVSAKLVKLATSPLSLRDSSSLSHMQFSKRMSVHPQNMNSLSAVSELSKFFR

SEQ ID NO: 174535 - protein, 242 aa, Glycine max
  Coding DNA Sequence Number=SeqID_82850
  Homolog annotation: Hit_ID=Q2HTA0; Match level="QueryCoverage=58%, HitCoverage=23%, E-value=2e-12, Identity=31%"; Hit description=IMP dehydrogenase/GMP reductase, related
  Pfam annotation: Domain name=DUF1723; Domain location=39-88; Score =44.4; E_value=4.2e-10; Accession=PF08330.1; Description=Protein of unknown function (DUF1723)
MVKIRGLGRALGRVFRAGQIEGLVAATGLSLLITCSLDTGNWKLISAFAKRWHKETCNFHLLVGEATITLNDVASLLHLPITGAFYSFETLHVDKTVLLLVELLEVSVDEARAETVQCHEAYVRLSWLRDIYRSKCDIAHWTVAAQAYLLHLLGCTLFANKSATPVHLETTCLEDIDDRWMHFSEYLALVGEICVVPGQCAPDYIDLFYMISHPFIRPTQPGDPIRHPPVVQDDTYVEPDIS

SEQ ID NO: 174536 - protein, 108 aa, Glycine max
  Coding DNA Sequence Number=SeqID_82851
MGPDGCRETRGTGTREAACKPRQDFSIQKENFRSFSLFPRCFLLFFFSTIVASIKAPKFLFLSTPNCKEKPFSESWSTPLLRGASNFRKAWAEQMRKRSDKCESKSHL

SEQ ID NO: 174537 - protein, 29 aa, Glycine max
  Coding DNA Sequence Number=SeqID_82852
MGQATLPPSPCYLYPKVRPLAEVRVNSKT

SEQ ID NO: 174538 - protein, 244 aa, Glycine max
  Coding DNA Sequence Number=SeqID_82853
  Gene Ontology: Mol. function=RNA-directed DNA polymerase activity; Biological process=RNA-dependent DNA replication
  Homolog annotation: Hit_ID=Q5NRP4; Match level="QueryCoverage=41%, HitCoverage=6%, E-value=9e-09, Identity=32%"; Hit description =Putative gag-pol polyprotein, identical
  Pfam annotation: Domain name=zf-CCHC; Domain location=104-121; Score =18.7; E_value=0.0023; Accession=PF00098.14; Description=Zinc knuckle
RHRSRLRPHSHRREKERKPQEANINLPYFHGKDDVEAYLDWEISVEQQLKRKSTSKSYGSHSYPKKDQGKGILGVTPSKPKDDKGKTIEKQPLKASMQEKTSSIICFKCFGRGHITSQCPTKKTMIMRGQDIYSSQDEATTSPSSSESEETLVSTVTPLGLDVIPQVKELLDEGVLTDPKRIKVIPEWPTPPTPLIELVRNHVPSWEDLHEKGVEGRSPEYEEPRDLTSNPFQGGGDDAILPPK

SEQ ID NO: 174539 - protein, 226 aa, Glycine max
  Coding DNA Sequence Number=SeqID_82854
  Gene Ontology: Biological process=transposition, DNA-mediated
  Homolog annotation: Hit_ID=Q1J7G7; Match level="QueryCoverage=14%, HitCoverage=45%, E-value=7e-11, Identity=100%"; Hit description =Transposase
VLQWLLFLSAVPPVQLLTGWCVTAKAPPDISAGKCSGHAARRVPFAIQAAQLLGRAIGAGLFAITPAGERGMCCKAIKLGNARVRLGTVGVEEVLGLGHLSDFEQQGLESLKPELKSSIEKGIKFANQYTPWFNNYQAYRYRRPRGGARYQLLFPLVRVNFELGVIMVIAVSFGKPVVPAALMNRPTRGERRFAYWALAECILAYYVGTDEGVSEVLHVAEKKGCT

SEQ ID NO: 174540 - protein, 404 aa, Glycine max
  Coding DNA Sequence Number=SeqID_82855
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=Q6I8E6; Match level="QueryCoverage=64%, HitCoverage=79%, E-value=1e-130, Identity=94%"; Hit description =Pseudo-atpA
  Pfam annotation: Domain name=ATP-synt_ab; Domain location=97-279; Score=-2.8; E_value=8e-08; Accession=PF00006.16; Description=ATP synthase alphabeta family, nucleotide-binding domain
  Pfam annotation: Domain name=ATP-synt_ab_N; Domain location=1-41; Score=9.0; E_value=0.03; Accession=PF02874.14; Description=ATP synthase alphabeta family, beta-barrel domain
  Pfam module annotation: Pfam domain module=ATP-synt_ab::ATP-synt_ab _N; Domain location=97-279::1-41
MVEFASGVKGIALNLENENVGIVVFGSDTAIKEGDLVKRTGSIVDVPAGKAMLGRVVDALGVPIDGRGALSDHERRRVEVKAPGIIERKSVHEPMQTGLKAVDSLVPIGRGQRELIIGDRQTGKTAIAIDTILNQKQMNSRATSESETLYCVYVAIGQKRSTVALRYGLQFLLFFAVFYLISTNINMASVDTFESLVRRLAFYLGNQALSRLLLQRGCSVGLTVAIAVLFGDTPSVGNNMMDPSGSSGSSGGGGSESSWTARGGNACSSRKSGRGASRSGNPEDTTEIIGGDSIDSIRNRLLQSYGNPSAEQISRASYDADDLFQVKVEIIRGMTPLDPEGDWPGRGARALDNPRTSTGEDSLENLYRLKDDLNENGRDSETFKRLKDKVFRRPRPLEDANSTT

SEQ ID NO: 174541 - protein, 90 aa, Glycine max
  Coding DNA Sequence Number=SeqID_82856
MSSFTFQKLQCLQSFTLSKDYNVFIYISKTSMSLVIYAFKRLQCLHLHFKDFNVFSHLRFQKITMLPRGALKGSKVQKLRELREKRKKRK

SEQ ID NO: 174542 - protein, 308 aa, Glycine max
  Coding DNA Sequence Number=SeqID_82857
  Gene Ontology: Mol. function=transcription factor activity; Cellular component=intracellular; Biological process=regulation of transcription, DNA-dependent
  Homolog annotation: Hit_ID=A8GBM2; Match level="QueryCoverage=96%, HitCoverage=99%, E-value=1e-110, Identity=66%"; Hit description =Transcriptional regulator, GntR family
  Pfam annotation: Domain name=FCD; Domain location=167-295; Score =32.6; E_value=2.6e-07; Accession=PF07729.3; Description=FCD domain
  Pfam annotation: Domain name=GntR; Domain location=15-74; Score=17.5; E_value=0.0013; Accession=PF00392.12; Description=Bacterial regulatory proteins, gntR fam
  Pfam annotation: Domain name=GntR; Domain location=95-157; Score=8.6; E_value=0.0093; Accession=PF00392.12; Description=Bacterial regulatory proteins, gntR fam
  Pfam module annotation: Pfam domain module=FCD::GntR::GntR; Domain location=167-295::15-74::95-157
MHKKPEGRMSRSQNLRQNVINQMLEAIARRHVRSPLPPQAALAEMFNISRTTVRHTLQHLHQRGVLEKVAETYVIVRDPCEEDGFSVLSPPIDQQAVQFEQAFFNLINQRLLMPGDSFTELQLAQQVRVSPVVVREFLLRFMRYNLLEPVKRGHWRMKKFDQEYAEKLFELREMLETHALTRFLNLAAGDERWVQARDLLDRHRALRDTIASNYRQFAALDKEMHTLILSAANNPFFNQSLEIISVIFHSHYQWDESDLKQRNIVALEEHMAILTALISRQDVDALCALHAHLRTAKHSMIRSIRQYN

SEQ ID NO: 174543 - protein, 174 aa, Glycine max
  Coding DNA Sequence Number=SeqID_82858
MRGCINYNPALAIRELGYPMKGAPIEESLSPFLVRDFGAQSFKIIQRVHKAWESPLRKDKELRGICNGIIGGYHEWMKVHTRGLDWLSKLKIINEENFEAPEEDEEVRALNRTRKSETCQGKIQLPQEPLNKKPRGLARKSMVVTNFVELYKAATMSSSFEGKRETNHEHIAWS

SEQ ID NO: 174544 - protein, 155 aa, Glycine max
  Coding DNA Sequence Number=SeqID_82859
MMSMKKIREVDMGAVAATNVVAKDVNNSTPILIKSQQPQSDHAHVSQTMGETHEIPHHNLADFEPCLGYATEGQAVGGIPLQNTLEGPQCHPQPQPSHSTAVKNPHAMAEMGKRKGLGPLKEVLDFDKYKGTTCPKNHPKMYCRKIRAYAKMRNC

SEQ ID NO: 174545 - protein, 450 aa, Glycine max
  Coding DNA Sequence Number=SeqID_82860
  Gene Ontology: Mol. function=hydrolase activity, acting on glycosyl bonds; Biological process=cell wall catabolic process
  Homolog annotation: Hit_ID=A1FXU4; Match level="QueryCoverage=100%, HitCoverage=88%, E-value=0.0, Identity=77%"; Hit description=Lytic transglycosylase, catalytic precursor
  Pfam annotation: Domain name=SLT; Domain location=145-255; Score=1.3; E_value=0.0024; Accession=PF01464.11; Description=Transglycosylase SLT domain
RTSARDKVKVDALQQRMTVAEKRYSDALLLVANADPKGSNEADAALEDMEDVLNDCVKQKGCQMGTLLASYKRLLKHDADAAASDDVADEDGDRLEADPDHIGPLTADVPEAARAAALLNDKRHAFDSMVEYNPTVQAGIRRWLTDMRPALLTSYENYQNLRAVMWPEWEKRGLPEALLFMPATGRRFGLGPDGTGFDTRFDARSAAEASASYLNERLRELNNNVEMSVAAYNGGEGRAARVFKQSAGQSFWTDSVYNQFPGETKDYVPMVIAAAWIFLHPQQYGVEFPKISAQPATLRLAKSTTIYELTICLGSHGTRDGYMRALRNLNPRYEADGWIPAGTLINATTRIAGLYQRNCVSGPRADLARTLITADLNAAIKRPTAASYTGSVAVGGVVPVADAAASTSVPTTPVAPVAAPRPAARPKPVRSHKVGKGETLGAIAAKFQCD

SEQ ID NO: 174546 - protein, 46 aa, Glycine max
  Coding DNA Sequence Number=SeqID_82861
MDKSLKVGKDEWREKERRSTNFVPQMRSDFEPTNPRSSPRFSTKCA

SEQ ID NO: 174547 - protein, 69 aa, Glycine max
  Coding DNA Sequence Number=SeqID_82862
MVTIFYGYYAYKILQSALRWLITQRMNCTSACKYNRVDFNMQHKKMGCTRTGRYGQRSIPYEIYLDTCH

SEQ ID NO: 174548 - protein, 122 aa, Glycine max
  Coding DNA Sequence Number=SeqID_82863
MVGYTPSSFTDLVFASKRIEVGLKRGKFGHPALIKTGANEEDENEGETHAVTAIPIRPSFPPIQQCHYSANNKPPPYPPPSYPQRPSLNQPQSLSTALPMTKTTFSTNQKTPTKRNFAAKSL

SEQ ID NO: 174549 - protein, 87 aa, Glycine max
  Coding DNA Sequence Number=SeqID_82864
MRKTKTFNKDEFLRCTRCGKERRFLSRADPDIKNYHDALNNKCWTCSLLALSKSVLSLAKHIICWKKILGTHDVSIRGTNTERMSDK

SEQ ID NO: 174550 - protein, 208 aa, Glycine max
  Coding DNA Sequence Number=SeqID_82865
MTLLLSNILPSDHNSDLPLPKCQLVYAILTQINVYVAQLILDVIYQFIGITPPRHPVDPEKSNRALGFPALITSLYQFYGAQQPGQDQQQQPTTDAPPPPLPQPPSLESISAHMQRMELYMQHLADQQASNHRGQVQLNDSFYKYTLHQQHQDPSPYPWPTPEQFRTTIAWPRDRPNFQARAGPTEALGDEDGAEEDGDMANVMDFFL

SEQ ID NO: 174551 - protein, 160 aa, Glycine max
  Coding DNA Sequence Number=SeqID_82866
PPLGAGRRRADHRQQQSAVAVVQRHAAGAGGGDRRSVRYSSGALAGRIYRRYARTVRTGLWHGRGLAAVRRLFASWPVRYSPPFGPGALPAVDAAAGGGAAGAAPQRPERRAPRVVGASVAAVLRSDVLLSVGKESPADRLPRELCRSKRILDDVQPEKR

SEQ ID NO: 174552 - protein, 41 aa, Glycine max
  Coding DNA Sequence Number=SeqID_82867
MEKGMHEEKEEDGRRKRRLLLLLLLARDSTKLNETSHVQLA

SEQ ID NO: 174553 - protein, 385 aa, Glycine max
  Coding DNA Sequence Number=SeqID_82868
  Gene Ontology: Mol. function=protein binding; Cellular component =cytoplasm; Biological process=ubiquitin-dependent protein catabolic process
  Homolog annotation: Hit_ID=A7QG29; Match level="QueryCoverage=89%, HitCoverage=96%, E-value=1e-136, Identity=73%"; Hit description =Chromosome undetermined scaffold_91, whole genome shotgun sequence
  Pfam annotation: Domain name=Skp1; Domain location=78-152; Score =56.6; E_value=8.7e-14; Accession=PF01466.10; Description=Skp1 family, dimerisation domain
  Pfam annotation: Domain name=Skp1_POZ; Domain location=4-69; Score =18.3; E_value=0.0012; Accession=PF03931.6; Description=Skp1 family, tetramerisation domain
  Pfam module annotation: Pfam domain module=Skp1::Skp1_POZ; Domain location=78-152::4-69
MMKSYIWLQTVDGSIQQVEEEVAMFCPMICQEVLQTGMGSSKNYAISLPQRVNPAILGLILDYCRFHQVPGHSNKERKTFDEKFIRMDTKKLCELTSAADSLQLKPLVDLTSRALARIIEGKTPEEIRETFHLPDDLTEEEKLEPLRNITDDPRIRLLNRLYARKRKELKERKKLKDVEVEEEPKDERSVEDLLSFINGADGDMKGTRTNKNKKKNRRRKDHAKDLSSKNENENDKDLNPLPSAYHNVYFDNALEASASKHSRMQNLPAISFSPKFEFIDGDVDDDLDPAMKEELDREVEDFARRLNSDWPERMQILSLGQDRRLVPISINSNGSTHLYTASENFAQSLLVLRYDYGLRARLAVTVLIKGSAALAGNSISKVSGS

SEQ ID NO: 174554 - protein, 255 aa, Glycine max
  Coding DNA Sequence Number=SeqID_82869
  Gene Ontology: Mol. function=hydrolase activity; Cellular component =nucleus; Biological process=mRNA processing
  Homolog annotation: Hit_ID=A7QG18; Match level="QueryCoverage=85%, HitCoverage=28%, E-value=1e-70, Identity=66%"; Hit description =Chromosome undetermined scaffold_91, whole genome shotgun sequence
  Pfam annotation: Domain name=RMMBL; Domain location=212-250; Score =10.3; E_value=0.041; Accession=PF07521.3; Description=RNA -metabolising metallo-beta-lactamase
MSDFIDQHQRGTLAESSDSLRNVEAGVISSLFATLARMLQADPPPKAVKVVVSKRVALVGEELIAYEEEQNRIKKEALKASLMKEEEFKTSHGADNNTSDSMVIDSGNNHVPPEVSGPRGGGYRDIFIDGFVPPLTSVAPMFPCYENTSEWDDFGEVINPDDYVIKDEDMDQTAMHGGDINGKLDEGAASLILDTKPSKVVSDERTKLIRGTKVQVRCSLVYMDFEGRSDGRSIKNILSHVAPLKLVWISLVLFS

SEQ ID NO: 174555 - protein, 696 aa, Glycine max
  Coding DNA Sequence Number=SeqID_82870
  Gene Ontology: Mol. function=nucleic acid binding; Cellular component= intracellular
  Homolog annotation: Hit_ID=A7QG27; Match level="QueryCoverage=87%, HitCoverage=98%, E-value=1e-137, Identity=47%"; Hit description =Chromosome undetermined scaffold_91, whole genome shotgun sequence
  Pfam annotation: Domain name=zf-C2H2; Domain location=80-102; Score =24.0; E_value=0.00056; Accession=PF00096.17; Description=Zinc finger, C2H2 type
MPIAKLKASGTPDVMKTEDRIDTLIRQAIGKEPFIPFPRASESPVQWIQLLHALDPQGVSNTFSEFPGWPLFSPLKVQLQKCDKCSREFCSPVNYRRHIRVHHRLKKLDKDFTKTKDLLGAYWDKLSVEEAKEVVSFENVLLEEVPASSILKSLTTFIQNQGFYSFPQYYLMAGAALLDIVQSKPSCFPISSQELFSILDDASENTCLCGTAESMQRYVFDGEAGKIGLEPKNLVACTSFLLEQKLVIVFLMVKAWLADKDAEALRCQKQLVEEEEAAQKRQAEILERKRQKKLRQKEQKAREQRHQAEAEIKGDIDSTVKALSPAEASLDTYNFEAHNPSTFSDNAASPVPFQCPDTSEEINGDIHSESETITDQDIVRQSAHGHKHKRQAVARQQGLPKLQWAVANGLHTKQNSPVSKLEINQKYGTHCDQKASSIVNGSKVWTRKSKTEIDKVVLKTIKEKEPDQVKNQEVLIGSISVNLSNCSQSEGNMVASQKDFIVENMGKQNISRDKPMKTDLAMGDNNRSTVKFWRPVSRLETKDPLPVQSGGTKVDAVHENGQNLSGPSSLRVCTAAGGDIGFAKYFSHTEDKADPGSFWFDIQAAKAFLAQRWKEAISSEHVTLVICPDSEPPGCEEIQDLKTAACQSSDMDGCDIVANADKRLPATSKVAKSKPRLKKSEKGTKIKYIPKQKTNT

SEQ ID NO: 174556 - protein, 186 aa, Glycine max
  Coding DNA Sequence Number=SeqID_82871
  Gene Ontology: Mol. function=hydrolase activity; Cellular component =nucleus; Biological process=mRNA processing
  Homolog annotation: Hit_ID=Q9LKF9; Match level="QueryCoverage=89%, HitCoverage=22%, E-value=3e-69, Identity=78%"; Hit description =Cleavage and polyadenylation specificity factor subunit 2
AHKIDLPPHHNIHYFHRFSTEATEHLKQHCLKHVCPHVYAPQLEETIDVTSDLCAYKVLLSEKLMSNVLFKKLGDYELAWVDAVVGKTENDPLSLLPVSGAAPPHKSVLVGDLKLADIKQFLSSKGVQVEFAGGALRCGEYVTLRKVGDASQKGGGSGAQQIVIEGPLCEDYYKIRDYLYSQFYLL

SEQ ID NO: 174557 - protein, 177 aa, Glycine max
  Coding DNA Sequence Number=SeqID_82872
MPKTTLDKLSFDVSYMRPSSMVVRAFDGSCRDLVVASGEEDILVSCPSFMPYVEAAEESLEMSFQALEIMNSAYMESPSIQPRLSDTSLMVARVMLKDEYEPEMGLGRNGGGAPTSSDKRRIALERKKKSLAHLQGQGPQVERILICHINESFVSARWMHEGQVAMLDEETNQDQPN

SEQ ID NO: 174558 - protein, 99 aa, Glycine max
  Coding DNA Sequence Number=SeqID_82873
MHKALRLNAPLPYPHLVTLFLQQFNIPLDYEPYVPIKRSFLIGASVIASFGYQKEHDGSWVKKVDMRFNEMESRITKVEEDMSYIRSSFDLPPSPPPSS

SEQ ID NO: 174559 - protein, 67 aa, Glycine max
  Coding DNA Sequence Number=SeqID_82874
MLLGLKRGKFNHPAWTNEKTGANEEGEIEGETHAATAIPTRGLSKALNGPLCGYWLNVDFQKPKIHT

SEQ ID NO: 174560 - protein, 69 aa, Glycine max
  Coding DNA Sequence Number=SeqID_82875
MYRERRSHRRYGDRQREEGIDGVKGDPRHCRVAPLCLFEGSHSSRYQGGTTSKEETNIQEGERIFIEIS

SEQ ID NO: 174561 - protein, 111 aa, Glycine max
  Coding DNA Sequence Number=SeqID_82876
MKYLSVVYKSKGETKDIELVEEEHARIGADPSIEPLEHTKKRDTGHQSVSLENKTGDSTVLKIGNSGKVVIKQDMKGRRHKYGFNNNKREKAENKRVVDDETGNNISRMKS

SEQ ID NO: 174562 - protein, 244 aa, Glycine max
  Coding DNA Sequence Number=SeqID_82877
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPGITVITSEIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 174563 - protein, 83 aa, Glycine max
  Coding DNA Sequence Number=SeqID_82878
MLATHSRYREIAKKSAPNCRFTSSFIFRDISGFILLSFCFTGEHSGFRDKGVLVVPKQGQQFFTDEGGHTRAYFCFLLFTAGT

SEQ ID NO: 174564 - protein, 185 aa, Glycine max
  Coding DNA Sequence Number=SeqID_82879
MTKAMMSMIKMMEVNTATIFAASTTTEVDPTHPSGLNQNKHSFPPYGLPPNYTPPNVAHAPDENDNNSTPILIESQQPLSGQAQVSQPMGETHEVPRDHTLADSELCLGYATEGQAFGGVPLPNTLGGPQYYPQPQPLHFAVERVPSAMVEREKEAKGSSSSSSTPNDEEGDDNNDSRHVTGVLL

SEQ ID NO: 174565 - protein, 93 aa, Glycine max
  Coding DNA Sequence Number=SeqID_82880
  Subcellular localization annotation: CTP_CleavageSite=51; ConfidenceScore=5.60e-01
MVKVGTSYVPINVSFSPKVGPGLPGAPVASVSSAVPPVQLLTGGRVPFAIQAAQLLGRAIGAGLFAITPAGERGMCCKAIKLGNARVFPVTTL

SEQ ID NO: 174566 - protein, 145 aa, Glycine max
  Coding DNA Sequence Number=SeqID_82881
  Homolog annotation: Hit_ID=Q6UUU1; Match level="QueryCoverage=41%, HitCoverage=40%, E-value=1e-18, Identity=78%"; Hit description =Putative uncharacterized protein
  Subcellular localization annotation: CTP_CleavageSite=55; ConfidenceScore=5.20e-01
MVKVGTSYVPINVSFSPKVGPGLARVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEFPGRLPPPGRYLTG

SEQ ID NO: 174567 - protein, 348 aa, Glycine max
  Coding DNA Sequence Number=SeqID_82882
  Gene Ontology: Mol. function=sequence-specific DNA binding; Cellular component=intracellular; Biological process=regulation of transcription, DNA-dependent
  Homolog annotation: Hit_ID=A7MPK6; Match level="QueryCoverage=30%, HitCoverage=99%, E-value=7e-37, Identity=70%"; Hit description =Putative uncharacterized protein
  Pfam annotation: Domain name=HTH_AraC; Domain location=217-263; Score= 37.5; E_value=4.6e-08; Accession=PF00165.14; Description=Bacterial regulatory helix-turn-helix proteins, araC family
  Pfam annotation: Domain name=HTH_AraC; Domain location=269-313; Score= 56.5; E_value=9.4e-14; Accession=PF00165.14; Description=Bacterial regulatory helix-turn-helix proteins, araC family
  Pfam module annotation: Pfam domain module=HTH_AraC::HTH_AraC; Domain location=217-263::269-313
RQQMLTVVLQLQIFEDGARFRDHPIAIALPAATAPDENGSFPDGERGLTLRLVLLRIEQHRSGALLSQTVTRIAQRAVAHRQAAATNAAVKIVAQTRQGFDAFIQLFAPVLRQRVPLLRRHALIRRHVHQAVADRRQRNPDALGNFDNRHAAQHITAVAALITAIARAADQAFAFIKVQCRYRHAAAFRHFARRQHRFRAITLQKEQAMMQQEIIHSLTNWIDQNLDKTLSIDEVAAKSGYSKWHLQRMFRTVTKQTLGGYIRERRLTLAAEALRQTQRPVFDIAMQYGYDSQQTFSRVFRRQFSQTPTAYRHSMRRQAMVQRPRLVNFDCSEGMNSFAQRTTGECCP

SEQ ID NO: 174568 - protein, 122 aa, Glycine max
  Coding DNA Sequence Number=SeqID_82883
TNTVIDPPSPIRRHVKWKMTHTKEIGQMTSEAAKEITDKIGSFVAHGRQVVSNAAIGRLEHPSRVYVAGAGVMIKQYFGPAPRTSCTSSSMALEDLEQLMQKIRDQLEESIIKSDSTNDVVL

SEQ ID NO: 174569 - protein, 95 aa, Glycine max
  Coding DNA Sequence Number=SeqID_82884
MLHLKGLDDTPQPKSKAAARWIVVKCNRQKGSTEYGYYVMHWMSTIILGTFRNNWETYFHDVRPLEAERLKALRIQWAQYYLKVRNQIYDVRELC

SEQ ID NO: 174570 - protein, 21 aa, Glycine max
  Coding DNA Sequence Number=SeqID_82885
MEVRFGCVKSNGAPRMVNLQD

SEQ ID NO: 174571 - protein, 241 aa, Glycine max
  Coding DNA Sequence Number=SeqID_82886
  Homolog annotation: Hit_ID=P03851; Match level="QueryCoverage=26%, HitCoverage=76%, E-value=6e-31, Identity=96%"; Hit description =Uncharacterized 9.4 kDa protein
MTVKTSDTCSSRRRSQLVCKRMPGADKPVRARQRMRKEKIPHQAPFAIQAAQLLGRAIGAGLFAITPAGERGMCCKAIKLGNARVFPVTTFRETCRASCINESANARGEAVCVLGALPLPRSLTRCARSFGCGERYQLTQRRTIKIPGVSPWKLPRALSCSDPAAYRIPVVRSKLGCVHEPPVQPDRCALSGNYRLESNPVRHDLSPLAAATGNRISRARYVGRATEFLKWWPNYGYTRRT

SEQ ID NO: 174572 - protein, 146 aa, Glycine max
  Coding DNA Sequence Number=SeqID_82887
MASPPASPPPPPSDASTSPPPGAERPLVHVDPATGKADSPHKKKLRTYLGIVDSFEEQVTQGSFISYGCQDVLTTAIRRLVHPRRVHAAGAGVTIKQYFGSALGTSRSSSSLPPEELQQLTQQIRDQLESITKKVTRQLMATFSQI

SEQ ID NO: 174573 - protein, 76 aa, Glycine max
  Coding DNA Sequence Number=SeqID_82888
MKYGSKLFGWRTHERQRNSWGSEKKGRGWRIALEGPHKSIMKHDSKLFGGGCMNENTIHGAPKKRGGWRIALEGPH

SEQ ID NO: 174574 - protein, 276 aa, Glycine max
  Coding DNA Sequence Number=SeqID_82889
MDRARLVYGLVTNMDMNIRALILGQISSIAQSNSSRLGFPALIIALCRARGVTSDSLTYESLSLTINLAYIKKNCWNMDDLTVNFRGARKVRARIADVPSSSTPPAPSTSTTPTPAPPGPSAQDSQRFESMLQSLHQGQILLMQSLQVVAPLGSILTVEQFMDKVSWPGTLPSLEREGGGPSAQVRQEAATPERSPQISPDPPSLVVDQSSLQQPADPSTPVHEMPTDLSTPLLDLPEDPSTPVLGLTTTPPTTPMLHLTDEEDTQDEDTQSQDLS

SEQ ID NO: 174575 - protein, 152 aa, Glycine max
  Coding DNA Sequence Number=SeqID_82890
MDSPRPILDPIAMAPKKLLSKRARKDVMGEGSNAAPQANIEFDEHHFRSEEHQRCHEAIKGWSFLKERWVQQREREYTEFQEEVVRRQWTQLKEPMVKYDPEIVMEFYANAWPTKEGVKDKCSWVQGQWFPYDEDVINQFLGHSLVLDLRVQ

SEQ ID NO: 174576 - protein, 61 aa, Glycine max
  Coding DNA Sequence Number=SeqID_82891
MRGVATNVYSRKTSEKPERCGLRTLSVKGPGVVFMHGEARYILTEQKVILRRWTIKRSLDF

SEQ ID NO: 174577 - protein, 75 aa, Glycine max
  Coding DNA Sequence Number=SeqID_82892
MDPPPRRNSIHEYYCLALFMCPPPSSLQLCFMIAEVRTLKPLFVSSTLEFGAMFHDCLNVDPQGNPPFSPFFGAP

SEQ ID NO: 174578 - protein, 123 aa, Glycine max
  Coding DNA Sequence Number=SeqID_82893
  Subcellular localization annotation: CTP_CleavageSite=22; ConfidenceScore=5.16e-01
MAIYRKSNFGQWQLALASWFLKAEGPSSPRRASCLGLKAFGGSGKPDVSRGELGRARQNRKVHLLMKKMRGSRHQRLFEENIRKTKKGSMDFENKGSGVVYTWGRVLPLLLRILGCDEEFRPK

SEQ ID NO: 174579 - protein, 67 aa, Glycine max
  Coding DNA Sequence Number=SeqID_82894
MATKGWSFVGASMVEKEEENGNSLAFLCTRRGQFSKVGNIYIYQNAQNETPSVVQSHSKCTVYKNSG

SEQ ID NO: 174580 - protein, 21 aa, Glycine max
  Coding DNA Sequence Number=SeqID_82895
MDGKATDIWMTPLPVKEDKSG

SEQ ID NO: 174581 - protein, 149 aa, Glycine max
  Coding DNA Sequence Number=SeqID_82896
GTSFVVQVEGTSTWVVVTENKRGYISCGSVLVEGTSTRLFKENKGGYIPCGSLLVKDFTRLKRNLKDRRSLGDWMNRLFQDHDEDQANLCLMTKSYDNNKEESVRKKWWYIESGCSKHMMGDVSKFTSISPRKVDMVHTATTISVKSQK

SEQ ID NO: 174582 - protein, 123 aa, Glycine max
  Coding DNA Sequence Number=SeqID_82897
MHSSYLLYDRVLKYWSSKFSFYQTWGQTKHPLSKKWFYHVKVKNLELDSLRELGQRMDQDRHQAFSKVYGKIRDLAMIEVSVEAIASLAQYYDQLSYPNFVRGPLFDGMQPSLDRFEELDTHR

SEQ ID NO: 174583 - protein, 108 aa, Glycine max
  Coding DNA Sequence Number=SeqID_82898
MVYEWPSKVYLYVVATYPSAGGRRVTRGMRAPRKEYARSRHQRLFEENVGKTGKDAIYELLSERFGSCIYARGRRETLRHWTINDLLGWSTKAGLLLLRILNEELRPT

SEQ ID NO: 174584 - protein, 45 aa, Glycine max
  Coding DNA Sequence Number=SeqID_82899
MAHHPPMCWDKEFSGGEGKNQKNSQAVSPLNSLGERRETQKNSDD

SEQ ID NO: 174585 - protein, 132 aa, Glycine max
  Coding DNA Sequence Number=SeqID_82900
  Subcellular localization annotation: CTP_CleavageSite=59; ConfidenceScore=5.41e-01
MDTSEPYTGAMKGTMHKPKANLGADQKFSPNRFPTTRFPTSNVQFFEFGVRGPLDESISCFLIRVDPWVLVPIAFRGLHTLAFKGLHALTFKGLHALAFRGLHVLTFRGIHTLNFRELHAFTFKGLHILAFR

SEQ ID NO: 174586 - protein, 86 aa, Glycine max
  Coding DNA Sequence Number=SeqID_82901
MVKVGTSYVPINVSFSPKVGPGHSVSTEIYQDKCVRRPFHSKPCQAAQLLKRNRAIECGPLRYYPAAKGRMCATAITMLARNAGCQ

SEQ ID NO: 174587 - protein, 212 aa, Glycine max
  Coding DNA Sequence Number=SeqID_82902
MHTRSGFCPDRCRDTGADHAHQHDYLDPDLTLLLSNILPSDHNSDLPLPKCQLVYVILTRMSVHVAQLIADAIYLFAGMPPTRHPLDPDKSNRALGFPALITGLCQSFGVPVTPSKVIQPPITRSFIEKYCIARQAQGGDPQAPDALPPPPQADPAGSFDTERYLRQLVRQQAANHRAHVQTHGCLYQLSLSLQSQGFPPFPCPTPDQFRAE

SEQ ID NO: 174588 - protein, 64 aa, Glycine max
  Coding DNA Sequence Number=SeqID_82903
MSSNIVISAQNLRKVYQIYSSPMQRLGALLGYRGAKGREFVALDSVNFEIRKVKQSVLLVSMVP

SEQ ID NO: 174589 - protein, 258 aa, Glycine max
  Coding DNA Sequence Number=SeqID_82904
MAKFDPDIVLEFYANAWPTEEGVRDMRSWVRGQWIPFDADAIGQLQGYPLVLEDGQECEYGQRRNRSDGFDEEAIAQLLCIPGQDFARTAVGRWVRIMRTNMTTLTQIWMTLLLSNILPSDHNSDLPLPKCQLVYAILTRMSIHVAQLIADAIYIFAGMAPTRHPLDPDKSNRALGFPALITGLCQSFGVPVTPSKVIRPPITRAFIEKYCTQRQVQGNAPQAADVPPPHQAGPAGLFDTEQYLRHLVRQQVANHRAH

SEQ ID NO: 174590 - protein, 81 aa, Glycine max
  Coding DNA Sequence Number=SeqID_82905
MLPDVETCSKIEATTSFDSNDPVHDECQFISITADHDPLIGLPLTPTKRQPFNECDDEARSSQISPAQLSSNKLAKHEKIE

SEQ ID NO: 174591 - protein, 89 aa, Glycine max
  Coding DNA Sequence Number=SeqID_82906
  Homolog annotation: Hit_ID=Q6L477; Match level="QueryCoverage=67%, HitCoverage=9%, E-value=3e-08, Identity=35%"; Hit description =Putative uncharacterized protein OSJNBa0009L15.8
VDVTYENWKEVPTAQKDLIWEDIQAEFDIPEASDSRTKRKLLQTVGERWRQFKLDLTRKWALAADHDGVEDTVCEKYVSQPTLRREGDA

SEQ ID NO: 174592 - protein, 171 aa, Glycine max
  Coding DNA Sequence Number=SeqID_82907
  Gene Ontology: Mol. function=protein transporter activity; Cellular component=membrane; Biological process=protein secretion
  Homolog annotation: Hit_ID=A1FSH1; Match level="QueryCoverage=89%, HitCoverage=39%, E-value=9e-73, Identity=92%"; Hit description =Secretion protein HlyD
MSQTQDTAAPAASNRRGNLLRGLFVIVVLLLAALALWYFMFGRWFEETDDAYVQGNQVQITPLVAGTVVAINADDGMRVERGQLLVQLDPSDTSVALQQAEANLAKTVRQTRGLYRSVEGAQADLNARQVTLKRVREDVARRKDLAATGAISNEELAHARDELAAAEAAVA

SEQ ID NO: 174593 - protein, 140 aa, Glycine max
  Coding DNA Sequence Number=SeqID_82908
MQSEEKKVPLTPKALVICFTRKGTGSTPIYPRTAPKPTPFAYQSNKAVPWKYTPPVSSERVATEIDSLSAKVTNITGLSGVTRSGRVFTSPHPVELPSKGKAPMVQEPTDIATPSKEVDPPVVRGVEKKEGLQGKTVTLE

SEQ ID NO: 174594 - protein, 76 aa, Glycine max
  Coding DNA Sequence Number=SeqID_82909
MTKFMVKPRNILLMLKEHNDNNYTTIKQIYNARHAYRSSIRGMKNVFSNATNLLCRFHIDKNVKEKCKTLVAQTNA

SEQ ID NO: 174595 - protein, 173 aa, Glycine max
  Coding DNA Sequence Number=SeqID_82910
YSKEFARHGMRREERTESLGEAVMGSSAAITVRDDEVKASEESDEVQALKAELERARVVEEKFKAAIVSSSSEEVKGIITGQRHDLEGRAKGNMWAIIDKCKEKLNLAATHEQRLEDEYAKISAEREAMERESRTSLIASQGQSNGGHLLLPQEDPQTSQLLSTYDRLNGPYD

SEQ ID NO: 174596 - protein, 331 aa, Glycine max
  Coding DNA Sequence Number=SeqID_82911
MVNGSTSYGRGGNSVNNRKNDPKDYSKKGVQNARGGKNPQGAKGGELRIGVKSSFKKHNQPVIKHKEQIGNELIPKVNSTGGMENKNVTKPYDESLHLLKFHELRNNHMNVPMIPVHMDEDAIKFVNGYKQKMVKGGAANTLVNGNDENNGLLKGMYDTSKEYETSLMFLLETHSYKDSTNRIIPKLGFNNHFIQDGQGWLEETSALVRSEEVGQSLEVLILSTSLMIVVEVLPNRLGEVPTTILPTICNTEIGILDVNIRNFVAQEEGAATRIATKLKEETQEEAASNGGSWWPLMVIGGGGEVSRVEPTFGAKHNFSSLAEFLLGWDLH

SEQ ID NO: 174597 - protein, 186 aa, Glycine max
  Coding DNA Sequence Number=SeqID_82912
MNLASILCGPWVPISLRGHEIHNIIIVCLEICSISSARGVTPPSGEGWTFGQADSLKEVLWRHEWWLERKLDWELMKALDDEALAVEEGDWLVVAGGNTGGEIGGGGTSGASGTARGLTFLGPGKAKLIMGLSDSKVRVSKVTPCALQKAMINAGKLSQEVLDWVICVICLDIMLPRSMSIYVTNP

SEQ ID NO: 174598 - protein, 166 aa, Glycine max
  Coding DNA Sequence Number=SeqID_82913
  Homolog annotation: Hit_ID=O22675; Match level="QueryCoverage=24%, HitCoverage=30%, E-value=4e-07, Identity=58%"; Hit description =Reverse transcriptase
MLDSLLVANEVLDDARRRKKHSLIFKVDFGKAYNCVNCEFLFYMRRMIVRVIEKSTFRGITFNGIRANLSPSAVWFKDNPSKSCMKAAKKSTFRGITLGEGGLGLGEIEGYKVVEVGCRKRFGVEEGWDDIEGFNIGRREVKGLMKGHHEGVLEEGERGKREKGVE

SEQ ID NO: 174599 - protein, 40 aa, Glycine max
  Coding DNA Sequence Number=SeqID_82914
METSSMLTTEGVNGGGTKKEPRKTKKKKAQGEEEEPRRQI

SEQ ID NO: 174600 - protein, 104 aa, Glycine max
  Coding DNA Sequence Number=SeqID_82915
MEFPKKTFEGQLRDVDKVEKYCLKKRELENTSASEDESGGASSDNFCIAKYGSPDKNTHRKSCWKTETVRQKKGNELNGTPKIGKRMIEERQEQKGSPRTVGPQ

SEQ ID NO: 174601 - protein, 111 aa, Glycine max
  Coding DNA Sequence Number=SeqID_82916
MLVVPTELAEPKSFLPKANTTTRVGANGGAEGHDALSMQGPSLFGFWDRLTAVLKANGGAEGKSCDLCLIPTRFHGKKANSSAEGDGALPCKGFLCSIFFALVLILLWTVK

SEQ ID NO: 174602 - protein, 110 aa, Glycine max
  Coding DNA Sequence Number=SeqID_82917
MEEGSPSSNLGTEEATWRGMTTTMAPIATTTTVNNCMKMMMIMLPTTTRTKISTYVCNDDDHATHARNIVCRDLCHVSHPCQLSNMLICVIVVEYGSCNVESVSSSCLGC

SEQ ID NO: 174603 - protein, 17 aa, Glycine max
  Coding DNA Sequence Number=SeqID_82918
MVLVNFGVLVFGGGAKE

SEQ ID NO: 174604 - protein, 99 aa, Glycine max
  Coding DNA Sequence Number=SeqID_82919
MRIRSVHCRKIGLIYEYFWYKSCYIFMMQVAYMEPCKRSQRISNDVKVGLSTYEGQLERIQKKEITSALEEKLMQKLEEKSLKKKLSMKKAHKGAQRRT

SEQ ID NO: 174605 - protein, 85 aa, Glycine max
  Coding DNA Sequence Number=SeqID_82920
  Subcellular localization annotation: CTP_CleavageSite=11; ConfidenceScore=5.12e-01
MLEFTGEGSSSSSMFMSNNAPFEKVFTTNGNLLPSIRFNWSKHAWAPDSTEILKEGISTSNGSTTSISYTKENGVALVDVRTKVR

SEQ ID NO: 174606 - protein, 157 aa, Glycine max
  Coding DNA Sequence Number=SeqID_82921
MEAMKDQMTPMMEAMMSMRKMMEVNTAATAATSVATEVDPTQPFGINQASHPVLDMLGQGGEALGSTGGPHFVQVQSKHPFPPYGLPPNYASPNVVHAPDENVDHSAPIPIESQQPQFGHAHVSQPMGETPKVPRDHTLVDFEPLLGYATKGQAFGG

SEQ ID NO: 174607 - protein, 70 aa, Glycine max
  Coding DNA Sequence Number=SeqID_82922
MDSGRFQVSVPGNSYSSKVFLEEMYQQFLIFCVCPHLPTIHLWMVLGANSPLVLVKVRHLELGRGDDIGY

SEQ ID NO: 174608 - protein, 294 aa, Glycine max
  Coding DNA Sequence Number=SeqID_82923
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPGELELHRGGGRSRTSGSPGLQEFDTPKRVLDKSVDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 174609 - protein, 184 aa, Glycine max
  Coding DNA Sequence Number=SeqID_82924
  Homolog annotation: Hit_ID=Q6UUU1; Match level="QueryCoverage=32%, HitCoverage=40%, E-value=2e-18, Identity=78%"; Hit description =Putative uncharacterized protein
RVPFAIQAAQLLGRAIGAGLFAITPAGERGMCCKAIKLVLIAADQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 174610 - protein, 117 aa, Glycine max
  Coding DNA Sequence Number=SeqID_82925
MWLPPKPWNEKPRGLVGKNMAETSSEGLCGVATASLNSDERKGTNHACSRSKRSLSQRLCETETNMLAIVSKYQQELNLATVHENKVADEYAQVYAEKEARGRVIDSLHQEATMWMD

SEQ ID NO: 174611 - protein, 128 aa, Glycine max
  Coding DNA Sequence Number=SeqID_82926
MAPKKFLLKGLGRPPQGRDLVQPRKRKLRHPLILEEGQHCEYVERISQASGFDEEAISQLLCSPGHDCAQSIAGRRVRIMRTSMTTFTQICMTLLLSNILPSDHNSNLPLPKCQLVYAILTQISVHVA

SEQ ID NO: 174612 - protein, 389 aa, Glycine max
  Coding DNA Sequence Number=SeqID_82927
  Gene Ontology: Mol. function=iron-sulfur cluster binding; Cellular component=cellular_component; Biological process=metabolic process
  Homolog annotation: Hit_ID=P0AEI5; Match level="QueryCoverage=100%, HitCoverage=88%, E-value=0.0, Identity=88%"; Hit description=UPF0004 protein yliG
  Pfam annotation: Domain name=Radical_SAM; Domain location=144-323; Score=100.9; E_value=3.8e-27; Accession=PF04055.12; Description =Radical SAM superfamily
  Pfam annotation: Domain name=UPF0004; Domain location=9-102; Score =152.4; E_value=1.2e-42; Accession=PF00919.11; Description =Uncharacterized protein family UPF0004
  Pfam module annotation: Pfam domain module=Radical_SAM::UPF0004; Domain location=144-323::9-102
MSNVTHQPKIGFVSLGCPKNLVDSERILTELRTEGYDVVPSYDNADMVIVNTCGFIDSAVQESLEAIGEALTENGKVIVTGCLGAKEDQIREVHPKVLEITGPHSYEQVLQHVHHYVPKPKHNPFLSLVPEQGVKLTPRHYAYLKISEGCNHRCTFCIIPSMRGDLVSRPIGEVLAEAKRLADAGVKELLVISQDTSAYGVDVKHRSGFHNGEPVKTSMVGLCEQLSKLGIWTRLHYVYPYPHVDEVIPLMAEGKILPYLDIPFQHASPRILKAMKRPAFEDKTLARIKQWRETCPDLTIRSTFIVGFPGETEEDFQYLLDWMQEAQLDRVGCFQYSPVEGAPANLLDNPVPDEVKQERWERFMEMQQSISTARLARKVGREIEVLIDE

SEQ ID NO: 174613 - protein, 231 aa, Glycine max
  Coding DNA Sequence Number=SeqID_82928
  Gene Ontology: Mol. function=carboxylesterase activity; Biological process=base-excision repair
  Homolog annotation: Hit_ID=A8ADB4; Match level="QueryCoverage=98%, HitCoverage=98%, E-value=5e-75, Identity=59%"; Hit description =Putative uncharacterized protein
  Pfam annotation: Domain name=Abhydrolase_2; Domain location=2-208; Score=139.8; E_value=7.7e-39; Accession=PF02230.7; Description =PhospholipaseCarboxylesterase
  Pfam annotation: Domain name=DLH; Domain location=18-213; Score= -43.1; E_value=0.00027; Accession=PF01738.9; Description=Dienelactone hydrolase family
  Pfam annotation: Domain name=Peptidase_S9; Domain location=32-220; Score=-72.3; E_value=0.027; Accession=PF00326.12; Description=Prolyl oligopeptidase family
  Pfam module annotation: Pfam domain module=Abhydrolase_2::DLH::Peptida se_S9; Domain location=2-208::18-213::32-220
MALRYVIVQQPDNAAQLFLLYHGVNDNPDSMAQIGSWFGQAFPQAQVVSVGAPYPASAPQGRQWYAEIPEHDRSQQQGVDAVMPSFVESVRHWQQQSGVRPEATALVGFSQGGTMVLEGVKAQPDLAGRVVAFSGRYVTLPEQASTRNTIHLIHGDYDEQVPMQHAEAAMQRLTALGGDVTLDIVDDLPHAIDERSMQLALNHLRYTVPRRYFDEALSGAKPGDDDVVMMV

SEQ ID NO: 174614 - protein, 118 aa, Glycine max
  Coding DNA Sequence Number=SeqID_82929
MFKQGMTTKGHLRVDCPSFKKRIERSEKKTFNDKKAKKAYITWEDNDMDSSEDLENEVVNLSLMGKKYESDEEVTSSNNNSSISFDELQDAFTHLHKESVKLAKLVSFSKKTISNLEK

SEQ ID NO: 174615 - protein, 108 aa, Glycine max
  Coding DNA Sequence Number=SeqID_82930
MPCTVRLRQGYTTLGKEAGKSFREISQPSGWRRGKRSSYVMGIMVKSWIRLGGKFLIALELTPKWALPAGRVGVRAVAWGVSLWMGAGALACTGAELDGSPARAEKLG

SEQ ID NO: 174616 - protein, 99 aa, Glycine max
  Coding DNA Sequence Number=SeqID_82931
MGELLHAQEKTVDSPLEMVGQLVLDQPAKVWAQVEQPRWVSPMEVKLQARLLAQENAPYKRTKVCEPWTSCPTITDEGAGVDDEGMSSVLALFLNSICN

SEQ ID NO: 174617 - protein, 253 aa, Glycine max
  Coding DNA Sequence Number=SeqID_82932
  Homolog annotation: Hit_ID=Q8S8J9; Match level="QueryCoverage=31%, HitCoverage=8%, E-value=2e-07, Identity=43%"; Hit description =Putative Athila retroelement ORF1 protein
  Subcellular localization annotation: CTP_CleavageSite=73; ConfidenceScore=5.33e-01
MGNQQRQGYTQGGFSGFQQGPYNQQGQWRTHPGNQFNKDQSGPSNRTIQQRPNILQRTTKLEETMTQFMQVTMSNHKSTESALKNLEVQVGQLAKQNPKEECKTVMTRSKRFVEVEDEDSVVHKKKTADKKSTGGKKNKENIIVKGNCSVVIQKILPPKHKDPGSVTIPCSIGEVNSKKFWVMDIFEDTDIPVILGRPFMLTASCIVDMGKRKLELGFENQKIDFDFFVEDKPAPKHNVCLQVMEGGQEVLKV

SEQ ID NO: 174618 - protein, 138 aa, Glycine max
  Coding DNA Sequence Number=SeqID_82933
MASRKRKSIGLRPTTQYDTRRFSSLDAWTRYTDNVLGRNISPERKVELYRTELDDFKAELERCNLHKRLTNLVDGSIDLALVKEFYANLYSSEDRPPKYYRLPINFREIEAALCIPGRGFILNSEGHPGKILMKDLKH

SEQ ID NO: 174619 - protein, 117 aa, Glycine max
  Coding DNA Sequence Number=SeqID_82934
QCSCVLHLRVWSYVSRWPKCGPSRQSSILPHFSETHECYCLAVHVYSTFEFGAMFPDCLSVDAQGTPPFFPFFGAPRKLLSSAVHVSSTFDIGAMFHDCLSADLQGNPPFSPFFGDP

SEQ ID NO: 174620 - protein, 299 aa, Glycine max
  Coding DNA Sequence Number=SeqID_82935
  Gene Ontology: Mol. function=transporter activity; Cellular component= cell outer membrane; Biological process=transport
  Homolog annotation: Hit_ID=A1G1Q0; Match level="QueryCoverage=39%, HitCoverage=15%, E-value=3e-59, Identity=99%"; Hit description=TonB -dependent receptor precursor
  Pfam annotation: Domain name=Plug; Domain location=45-157; Score =40.7; E_value=5.3e-09; Accession=PF07715.6; Description=TonB -dependent Receptor Plug Domain
MQTRHLTIAVAIALSAAASAHAATAADTGASTDAALSAQTLDTVSVIGQGETRQVQRITTVDKQVLPPGTSGQKILDRLPGVSVQSNDAFGANEESQTISLRGFDKSRLGYTLDGIPLGDNSYGNYNGLSIARAIIAENLAGAELSQGIGSLGVASTEQPRAAPSSTSRWTRPPNSVDAPASPWVTTTSVAATCAWIQATSMVSRPTCPACTRTRTCGPRRTRTRPPASSTPRPCGTSATTASVRSWPPRAPARPTMPTCPRTCWHADWGMTGTSTRRTGIAPSPPRTARRAPTTRRAA

SEQ ID NO: 174621 - protein, 223 aa, Glycine max
  Coding DNA Sequence Number=SeqID_82936
YNPGLAIRQLGYPMRGAPLEEEIAPVRKAWEVVRKKDKELRGSKNGPIRGYSKWLRAHVQGLDWLPSLRTAKREEVEAPEEDEEVQALRAELEQAQIVKERFKSVALKIRKENAELRDINIATTKALEQEIKRARREEHGRNKFRGALWGSNSELKLRREERDQSRVDSLILKDELKTNMLAIISKYQEELNLATAHEHRVADEYAQVYAEKEARGWTNLLLP

SEQ ID NO: 174622 - protein, 103 aa, Glycine max
  Coding DNA Sequence Number=SeqID_82937
MYTTTITHIRLQCSGHWQMVVILPKENVVVWFCSLHNRPDNYLKGIINIALKGLDDTLQPKSKAGARWIVVKYFNDVIPLEAERLNVLRIQWAKFYLKVRNES

SEQ ID NO: 174623 - protein, 175 aa, Glycine max
  Coding DNA Sequence Number=SeqID_82938
MHKALRLNAPLPYPHLVTLFLQHFNIPFDSKPYVPIKRSFLIGAVMVASFGYRKERDDSWVKKGAQPNDDEGHLLAEEDSSLLQSILDRFDGLQTYVGERFVTIKKGEIVEASFMMMKQEILKMPKAQVIDSRLQDQASRIQSKIQDSREEIKKQQVKTSYRISIKRNFQKPNST

SEQ ID NO: 174624 - protein, 68 aa, Glycine max
  Coding DNA Sequence Number=SeqID_82939
MPSWVRVGKLANYRTTGIFLANIISEKESCEGTNIEDPDVDFERLVKNVEDEEDEDWGLPPELQRMVE

SEQ ID NO: 174625 - protein, 72 aa, Glycine max
  Coding DNA Sequence Number=SeqID_82940
MATYQQRIARYYKARVRLHSRVDEKKEQALLSEGKRIKAILLYFTRLATELTQLKEAGKKGLQDSFGNRNSS

SEQ ID NO: 174626 - protein, 132 aa, Glycine max
  Coding DNA Sequence Number=SeqID_82941
MGEVEEVQEQMKADTEALKEQMATMMEAMMSIKEIMEVNAVAIAATCTITETHEIPHHNLANFEPCLGYATEGQAVGDIPLQNILEGPQFRPQPQPFYGKMVGYTPSSFADLIFAGEKIKVGLERGKSDHPP

SEQ ID NO: 174627 - protein, 39 aa, Glycine max
  Coding DNA Sequence Number=SeqID_82942
STLEDPPFHVDPYEGRQYLTRARTRGGNSFSRRAKDNSK

SEQ ID NO: 174628 - protein, 129 aa, Glycine max
  Coding DNA Sequence Number=SeqID_82943
MHKALRANAPFPYPQLVTLFLCHFQIPLDDEPFVQVKRSFAIGAGAVTSFGYHKDCNGQWLKKDALPPQDECTPSPSPQRDDSALMTEVLSELRGLRTYVGMDIRLTQLEEDVGYIRQSFDLPPPPPPS

SEQ ID NO: 174629 - protein, 92 aa, Glycine max
  Coding DNA Sequence Number=SeqID_82944
MKTKANKTRNELKAWDSKTYRFTQGNILEALWKHLDLDFLHRNTFFHPKQLKCIAKGVRDPFEQPPFAYLKEKWGGGWRPTRPGELGCFLLK

SEQ ID NO: 174630 - protein, 28 aa, Glycine max
  Coding DNA Sequence Number=SeqID_82945
MEGGGMVFLDSDSMVVRGYFICFFYFYG

SEQ ID NO: 174631 - protein, 382 aa, Glycine max
  Coding DNA Sequence Number=SeqID_82946
  Pfam annotation: Domain name=Transposase_23; Domain location=67-130; Score=-3.8; E_value=0.0031; Accession=PF03017.5; Description =TNP1ENSPM transposase
MDTFKGQIQQAIKLELSQIASQHSAPLQPHDIQLLAARVSTKGSCAAAETNALAKKPSQLNGDSVGLHVTAENSNKLVAVGKQCDNFGTIHNVPYVDDAVRVSVVEVIFGDAKVPIPTSEIKFVKEALRSFVPWPRHLVKPMLPEEAKKDVSSPLKTVEEEKPAEVIDPLGELVKNLFDIYHRPVQVSWDGAKFGINNVQDGFFITHADVSEIILGDKFIHDWSASIGYGALYGFLEPQCIHNANTRRQECENYIGRWLKEAGKQIYIEPYLNQAHWQLLVLSPGHNLVVWFCSLRKKSDAAIKGAVNNAMKSVTKITEGKPPQHGPQWIEAKVTSAQGGGDKDYKEVSSNHGPSTELELLRGHINQAVTFNRSSYKDHVHH

SEQ ID NO: 174632 - protein, 787 aa, Glycine max
  Coding DNA Sequence Number=SeqID_82947
  Gene Ontology: Mol. function=microtubule motor activity; Cellular component=microtubule associated complex; Biological process =microtubule-based movement
  Homolog annotation: Hit_ID=A7P105; Match level="QueryCoverage=96%, HitCoverage=99%, E-value=0.0, Identity=67%"; Hit description =Chromosome chr19 scaffold_4, whole genome shotgun sequence
  Pfam annotation: Domain name=Filament; Domain location=183-419; Score= -187.7; E_value=0.038; Accession=PF00038.12; Description=Intermediate filament protein
  Pfam annotation: Domain name=Kinesin; Domain location=438-767; Score =545.0; E_value=8.3e-161; Accession=PF00225.14; Description=Kinesin motor domain
  Pfam module annotation: Pfam domain module=Filament::Kinesin; Domain location=183-419::438-767
MLRIQNFEGDVLFLDNKEQRVGAETMVGTPINGRTRQAFTVVNGGGHDLCPSSTPPSNAGSDYGVIEFTREDVEALLNEKAKRKDRFNYKERCENMMDYIKRLKVCIRWFQDLEMYYSLEQEKLKNSLEMTQKKCIEIELLLKIKEEELNSIITEMRRNCTSLQEKLIKEEMEKSAAVESLVKEREARLDIERSHSTLSEDLGRAQREMQSANQKIASLNEMYKRLQDYITSLQQYNGKLHSELSSVEDELKRVEKEKVSVVENITLLRGQLTVSVSSQEEAIKQKDVLATEVSSLRGELQQVRDERDRQLSQVQILSSELEKVKESTKHSSTELDSLTFKANDLEDELPSLQEKCSLKDNQIKALEEQLATAEKKLQVSDISAYETRTEYEGQQIFVNELQRRLADAEYKLIEGERLRKKLHNTILELKGNIRVFCRVRPLLADESCSTEGRIFSYPTSMETSGRAIDLAQNGQKHAFTFDKVFTPEASQEEVFVEISQLVQSALDGYKVCIFAYGQTGSGKTYTMMGRPGHPEEKGLIPRSLEQIFQTKQSQQPQGWKYEMQVSMLEIYNETIRDLISTTTRVENGTPGKQYTIKHDVNGNTQVSDLTVVDVHSAKEVAFLLNQAANSRSVGKTQMNEQSSRSHFVFTLRIYGVNESTDQQVQGVLNLIDLAGSERLSKSGSTGDRLKETQAINKSLSSLSDVIFALAKKEDHVPFRNSKLTYLLQPCLGGDSKTLMFVNISPDPSSVGESLCSLRFASRVNACEIGTPRRQTNGRSIESRLSYF

SEQ ID NO: 174633 - protein, 113 aa, Glycine max
  Coding DNA Sequence Number=SeqID_82948
  Pfam annotation: Domain name=Transposase_23; Domain location=1-62; Score=-11.4; E_value=0.021; Accession=PF03017.5; Description =TNP1ENSPM transposase
MTIVTRYVMMGNELFYEGSTLVHNTPLLPGQVKVSVDEVKDADAAVPVPTAEVSLVGQTLHTFLAWPTHLIKSLSNQVAMSPPKPPPKPDSEVDDPLYLITLTIPKLFLRPYQ

SEQ ID NO: 174634 - protein, 53 aa, Glycine max
  Coding DNA Sequence Number=SeqID_82949
MCARSWLWSAENTGSTSYKVVAECANVMNEMVSDDEAGAGRGGETQPPTGTGW

SEQ ID NO: 174635 - protein, 93 aa, Glycine max
  Coding DNA Sequence Number=SeqID_82950
MEMKNLIRRLGVHDKTNHTLRDQLGSCCFARMLQPCEIDTSLKEHSNRVYLPPRPRFQTVRQGLPPDLGPTQNVMPFIPHIYVLIIKEVRNQN

SEQ ID NO: 174636 - protein, 299 aa, Glycine max
  Coding DNA Sequence Number=SeqID_82951
  Gene Ontology: Mol. function=drug transporter activity; Cellular component=membrane; Biological process=multidrug transport
  Homolog annotation: Hit_ID=A7P3U9; Match level="QueryCoverage=27%, HitCoverage=15%, E-value=2e-21, Identity=57%"; Hit description =Chromosome chr1 scaffold_5, whole genome shotgun sequence
MVYYDVIIRLHGPDALTNFTPPQRDSPSPSSLSAVAEVIAILDKLKNHKSQNKELLDSSPNEDDDDWDGEDPEEGIIYSVEKEESLRKRAWEESKKMWVVAGPAIFTRFSTFRIMVVSQSFIGHIGSTELVAYAIVMTVLVRFVNGALFKFGLNGAMTSTLLAYWIPNIGQLLFIMTKCPDINYGSFYNLEIWYNTVLILVTGNMKNAEVSINALAICIEEFIPLLRERMNVLNPYVRQFLVGWITVLDSVPYIDMLGFLPDFLDVLLLKFLDYGRMAEILVQRAVSPDEFTRLTAITW

SEQ ID NO: 174637 - protein, 119 aa, Glycine max
  Coding DNA Sequence Number=SeqID_82952
MRNKSECTPHESREPSGHDQETNDKADTKVHKYEIMNTIYVVQILLPFTWKGKSLYSCSHHSTRFCTSLKGTPSKTMLTSARLRRSLKTATSKMVIVAPSLKVSTFHDVEIYDGHPPSL

SEQ ID NO: 174638 - protein, 329 aa, Glycine max
  Coding DNA Sequence Number=SeqID_82953
  Gene Ontology: Mol. function=mismatched DNA binding; Biological process=response to DNA damage stimulus
  Homolog annotation: Hit_ID=A7NYD4; Match level="QueryCoverage=34%, HitCoverage=9%, E-value=9e-17, Identity=40%"; Hit description =Chromosome chr6 scaffold_3, whole genome shotgun sequence
  Pfam annotation: Domain name=PHD; Domain location=214-267; Score=5.3; E_value=0.0032; Accession=PF00628.20; Description=PHD-finger
MALCFMVMGSSIERNCVKVFRHLIEKVNCRMLFATHYHSQSKEFASHSRVIMQHMACAFKSKSDTHSMHDQELASRDVGCDRRSRDWLQTCKLHLDLLHSAVRVILCRKLGCRCQSSTVACSAPGSDCTAAESGLQWAGLGPQPASSASSRAAKTGARAMCCPMTTRECWDFLFQNEAFSSPRVPIQQTGSLPLNEPGIKVIAPGVNHPFPSWICRQTKIEGTEDGDLLACIQCEHKYHVGCLKDREKSESRRYMKNWLCGKECERIYEGLQSLLGKPLIVGANNLTWTSVKFINSESCDVGSTKNDLLAEKYSKHSVALLVISQFTVN

SEQ ID NO: 174639 - protein, 108 aa, Glycine max
  Coding DNA Sequence Number=SeqID_82954
  Gene Ontology: Mol. function=protein dimerization activity; Cellular component=nucleus; Biological process=regulation of transcription, DNA-dependent
  Homolog annotation: Hit_ID=Q9ZTX9; Match level="QueryCoverage=63%, HitCoverage=8%, E-value=4e-23, Identity=78%"; Hit description=Auxin response factor 4
MENWEQQYMGFGEEDPSFVAFSVCECADYNYLIKLLIGDSASDTSTHGWFSVPRRAAKTVFLVWCDTSHDYKQQRPSQELVAKDLHGVEWKFRHIYRGQPRWHLLTTG

SEQ ID NO: 174640 - protein, 26 aa, Glycine max
  Coding DNA Sequence Number=SeqID_82955
MDPYWGQEIDWERSSHQSSIQVSLLL

SEQ ID NO: 174641 - protein, 1266 aa, Glycine max
  Coding DNA Sequence Number=SeqID_82956
  Gene Ontology: Mol. function=transmembrane receptor activity; Cellular component=intrinsic to membrane; Biological process=innate immune response
  Homolog annotation: Hit_ID=A5B905; Match level="QueryCoverage=80%, HitCoverage=85%, E-value=1e-162, Identity=34%"; Hit description =Putative uncharacterized protein
  Pfam annotation: Domain name=LRR_1; Domain location=1000-1021; Score =7.0; E_value=16; Accession=PF00560.24; Description=Leucine Rich Repeat
  Pfam annotation: Domain name=LRR_1; Domain location=626-647; Score =6.5; E_value=19; Accession=PF00560.24; Description=Leucine Rich Repeat
  Pfam annotation: Domain name=LRR_1; Domain location=649-670; Score =9.2; E_value=6; Accession=PF00560.24; Description=Leucine Rich Repeat
  Pfam annotation: Domain name=LRR_1; Domain location=672-694; Score =12.9; E_value=1.2; Accession=PF00560.24; Description=Leucine Rich Repeat
  Pfam annotation: Domain name=LRR_1; Domain location=696-717; Score =14.2; E_value=0.51; Accession=PF00560.24; Description=Leucine Rich Repeat
  Pfam annotation: Domain name=LRR_1; Domain location=719-741; Score =13.7; E_value=0.72; Accession=PF00560.24; Description=Leucine Rich Repeat
  Pfam annotation: Domain name=LRR_1; Domain location=779-801; Score =16.4; E_value=0.11; Accession=PF00560.24; Description=Leucine Rich Repeat
  Pfam annotation: Domain name=LRR_1; Domain location=803-825; Score =9.4; E_value=5.7; Accession=PF00560.24; Description=Leucine Rich Repeat
  Pfam annotation: Domain name=LRR_1; Domain location=826-848; Score =13.7; E_value=0.7; Accession=PF00560.24; Description=Leucine Rich Repeat
  Pfam annotation: Domain name=LRR_1; Domain location=850-872; Score =9.4; E_value=5.5; Accession=PF00560.24; Description=Leucine Rich Repeat
  Pfam annotation: Domain name=LRR_1; Domain location=873-895; Score =15.7; E_value=0.17; Accession=PF00560.24; Description=Leucine Rich Repeat
  Pfam annotation: Domain name=LRR_1; Domain location=897-919; Score =10.2; E_value=4; Accession=PF00560.24; Description=Leucine Rich Repeat
  Pfam annotation: Domain name=LRR_1; Domain location=921-946; Score =5.9; E_value=24; Accession=PF00560.24; Description=Leucine Rich Repeat
  Pfam annotation: Domain name=LRR_1; Domain location=955-976; Score =10.0; E_value=4.3; Accession=PF00560.24; Description=Leucine Rich Repeat
  Pfam annotation: Domain name=LRR_1; Domain location=978-998; Score =14.3; E_value=0.46; Accession=PF00560.24; Description=Leucine Rich Repeat
  Pfam annotation: Domain name=LRR_3; Domain location=626-645; Score =29.5; E_value=1.2e-05; Accession=PF07725.3; Description=Leucine Rich Repeat
  Pfam annotation: Domain name=NACHT; Domain location=226-379; Score= -15.9; E_value=0.001; Accession=PF05729.3; Description=NACHT domain
  Pfam annotation: Domain name=NB-ARC; Domain location=186-488; Score =51.9; E_value=1.4e-13; Accession=PF00931.13; Description=NB-ARC domain
  Pfam annotation: Domain name=TIR; Domain location=25-162; Score =157.1; E_value=4.8e-44; Accession=PF01582.11; Description=TIR domain
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_3::NACHT::NB-ARC::TIR; Domain location=1000 -1021::626-647::649-670::...
  Pfam module annotation: Domain location=672-694::696-717::719 -741::779-801::803-825::826-848::850-872::873-895::897-919::921 -946::955-976::978-998::626-645::226-379::186-488::25-162
MASKAIIQYSSSSSSSHAIITTYDVFVSFRGEDTRNNFTAFLFDALFENGIHAFKDDTHLQKGESIAPELLLAIQGSRLFVVVFSKNYASSTWCLRELAHICNCTIEASPSRVLPIFYDVDPSEVRKQSGYYGIAFAEHEERFREDKVKMEEVQRWREALTQMANLSGWDIRNKSQPAMIKEIVQKINYILGPKFQNLPSGNLVGMESRVEELEKCLALESVTDVRVVGISGMGGIGKTTLALALYEKIAYQYDDVNKIYQHYGSLGVQKQLLDQCLNDENLEICNVSRGTYLIGTRLRNKRGLIVLDNVSQVEQLHMFTGSRETLLRECLGGGSRIIIISRDEHILRTHGVNHVYRVRPLNQDNAVQLFCNNAFKCDYIMSDYKMLTHDALWHAQGHPLAIKVIGKSLFGLDVSQWEGTLVRLSENKSKNIMDVIRISYDALEEKDKEIFLDIACFSGQHYFEDNVKEILNFRGFNSEIGLQILVDKSLITISYGKIYMHDLLRDLGKCIVREKSPKEPRKWSRLWDCEDLYKFMSSNKEAKNLEAIVVEDEPGMFSETTMRFDALSKMKNLKLLILPRYYEKGLSTIEEEKFSGSLNYLSNELGYLIWHFYPFNFLPKCFQPHNLVELNLSGSNIQHLWDSTQPIPNLRRLNVSDCDNLIEVQDFGEALNLERLDLSGCGQLSRFHPSIGFPRNLTYLNLSDCKSLVELPHFEQALNLEKLNLGGCELLKQLPPFIGHLRKITFLLDLQECKSLTDLPHFVEDLNFEELNLYGCDLNLEELNLQGCVQLRQIHPSIGHLKKLTHLNLKYCKSLVNLPHFVEDLNLEELNLQGCVQLRQIHPSIGHPKKLTHLNLKYCKSLVNLPHFVGDLNLKELNLEGCVQLRQIHPSIGHLRKLTVLNLKDCKSLISFPSNILGLSSLTYLSLFGCSNLHTIDLSEDSVRCLLPSYTIFSCMRQLDLSFCNLLKIPDAFGNLHSLEKLCLRGNNFETLPSLEELSKLLLLNLQHCKRLKYLPELPSATDWPMKKWGTVEEDEYGLGLNIFNCPELVDRDCCTDKCFFWMMQMVQLFTISLNCHPSGDSMAWRVPLISSIIPGSEIPSWFDEQHLGMGNVINIDISHFMQLDKYWIGIALSVIFVVHKERRMPPPDMEQRKKERPSLYIPVLFREDLVTDESDHLWLFYYPRSHFDVSNFDELKVVCRPRDLDYQDLDVEVKKYGYCWVYEHDLDLSNLTTMRNKNSSPRKRKYFTIEELETLLNMDAQWKQQ

SEQ ID NO: 174642 - protein, 278 aa, Glycine max
  Coding DNA Sequence Number=SeqID_82957
MMNSNCDILITVWEDYAIQLHDAIDKNLLLQEPLVVMLTLGKIKDAIGGSGVDKYPLSVQNIKFGSKLYVNADITEIHQFRQSLSVPFYSGGIIHDKDGSQSQSSQSNVVENFLQNAQDCYCLTVGTVDEIIIDAPWSYDSCPNCTTTFDPSKGGPACRSCHTSVIDTVPQMEHNRDKGNFLLWDATCIKLFGKTAGECRDELIAAVRFKFRSQLRQSSVLDVSEELHHIQSLIATLGLKPSLSQSSDYDPGNSTCLTPTKRINCQQTSSNFDSDEHT

SEQ ID NO: 174643 - protein, 263 aa, Glycine max
  Coding DNA Sequence Number=SeqID_82958
LKELSKLLHLNLQHCKRLRYLPELPSRTDWPGSWTPVKHEEYGLGLNIFNCPELVERDCCTNNCFSWMIQILQCLSLSGFSGLFSFPLFSSIIPGSEIPRWFKKEHVGTGNVINIDRSHFTQHYKNRIGIALGVIFVVHKERRMPPPDMEQPSILSITCGPSIPPQQREGVREDLHIPVHYREHLHIPVLFREDLVTEESDHVGLFFFKRPYFDELKVESRFRDLHDEDLYVEVKKYWYRWLGLLHSEELETYLNMDAELKQQ

SEQ ID NO: 174644 - protein, 958 aa, Glycine max
  Coding DNA Sequence Number=SeqID_82959
  Gene Ontology: Mol. function=transmembrane receptor activity; Cellular component=intrinsic to membrane; Biological process=innate immune response
  Homolog annotation: Hit_ID=A7QUW7; Match level="QueryCoverage=97%, HitCoverage=95%, E-value=1e-157, Identity=32%"; Hit description =Chromosome chr13 scaffold_181, whole genome shotgun sequence
  Pfam annotation: Domain name=LRR_1; Domain location=639-660; Score =3.5; E_value=69; Accession=PF00560.24; Description=Leucine Rich Repeat
  Pfam annotation: Domain name=LRR_1; Domain location=662-683; Score =8.4; E_value=8.4; Accession=PF00560.24; Description=Leucine Rich Repeat
  Pfam annotation: Domain name=LRR_1; Domain location=685-707; Score =6.0; E_value=24; Accession=PF00560.24; Description=Leucine Rich Repeat
  Pfam annotation: Domain name=LRR_1; Domain location=709-730; Score =14.6; E_value=0.38; Accession=PF00560.24; Description=Leucine Rich Repeat
  Pfam annotation: Domain name=LRR_1; Domain location=732-754; Score =12.5; E_value=1.5; Accession=PF00560.24; Description=Leucine Rich Repeat
  Pfam annotation: Domain name=LRR_1; Domain location=781-803; Score =7.8; E_value=11; Accession=PF00560.24; Description=Leucine Rich Repeat
  Pfam annotation: Domain name=LRR_1; Domain location=805-827; Score =8.6; E_value=7.9; Accession=PF00560.24; Description=Leucine Rich Repeat
  Pfam annotation: Domain name=LRR_1; Domain location=828-850; Score =14.1; E_value=0.52; Accession=PF00560.24; Description=Leucine Rich Repeat
  Pfam annotation: Domain name=LRR_1; Domain location=852-874; Score =5.6; E_value=28; Accession=PF00560.24; Description=Leucine Rich Repeat
  Pfam annotation: Domain name=LRR_1; Domain location=875-897; Score =14.7; E_value=0.34; Accession=PF00560.24; Description=Leucine Rich Repeat
  Pfam annotation: Domain name=LRR_1; Domain location=899-921; Score =11.0; E_value=2.8; Accession=PF00560.24; Description=Leucine Rich Repeat
  Pfam annotation: Domain name=LRR_1; Domain location=922-944; Score =16.3; E_value=0.12; Accession=PF00560.24; Description=Leucine Rich Repeat
  Pfam annotation: Domain name=LRR_3; Domain location=639-658; Score =19.5; E_value=0.013; Accession=PF07725.3; Description=Leucine Rich Repeat
  Pfam annotation: Domain name=NACHT; Domain location=226-385; Score= -5.2; E_value=0.00015; Accession=PF05729.3; Description=NACHT domain
  Pfam annotation: Domain name=NB-ARC; Domain location=186-487; Score =76.8; E_value=7e-20; Accession=PF00931.13; Description=NB-ARC domain
  Pfam annotation: Domain name=TIR; Domain location=25-162; Score =164.1; E_value=3.7e-46; Accession=PF01582.11; Description=TIR domain
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _3::NACHT::NB-ARC::TIR; Domain location=639-660::662-683::685 -707::709-730::732-754::...
  Pfam module annotation: Domain location=781-803::805-827::828 -850::852-874::875-897::899-921::922-944::639-658::226-385::186 -487::25-162
MASKAIIQYSSSSSSSHAIITTYDVFVSFRGEDTRNNFTAFLFDALFENGIHAFKDDTHLQKGESIAPELLLAIQESRLFLVVFSKNYASSTWCLRELAHICNCTIEPSSSRVLPIFYDVDPSEVRKQSGYYGIAFAEHERRFREDIEKMEEVQRWREALIQVANISGWDIQNESQPAMIKEIVQKIKCRLGSKFQNLPNGNLVGMESRVKELEKCLKLESVSDVRVVGISGMGGIGKTTLASALYEKIAYQFDFHCFVDDVNYIYRRSGSLGVQKQLLSQCLNDKNLEICNASVGTYLIGTRLRNKRGLIVFDNVNQVEQLRMFTGSRETLLLECLGGGSRIIIISRDEHILRTHGVHHVYEVQPLEDDNAVQLFCKNAFKCDYIMSDYKMLTYDVLSHADGHPLAIEVIGKSLHGRNVSQWRGILVRLSDNKSKDIMDVLRISYDDLEENDREIFLDIACFFDQDYFEHCEEEILDFRGFNPEIGLQILVDKSLITIFDGRIYMHSLLRDLGKCIVREKSPKEPRKWSRLWECEDLYKVMSNNMEAKNLEAIVVDDKSWMFFNTIMRVDALSKMKNLKLLKLPEYDSLYGDEEEELCTYTKKDFFSGNLNYLSNELGYLIWQCYPFNSLPQCFQPHNLFELDLSWSSIQHLWDSTQPIPNLRRLNVSYCKYLIEVPNFGEALNLYWLNLERCERLKRFHPSVGFPRNLTYLNLRGCNSLVELPHFEQALKLEILDLRRCELLKQLPSSIGRLRKLTPSLELGGCKSLTDLPHFVEDLNLLKKLNLERCEQLRQIDPSIGRLRKLTALNLTDCKSLVNLPHFVEDLNLQELNLKGCVQLRQIHSSIGHLRKLTALNLIDCKSLVNLPHFVEDLNLEELNLKGCEELRQIHPSIGHLRKLTVLNLRDCKRLVNLPHFVEELNLEELNLEGCVQLRQIHPSIGHLRKLTILNLKDCKSL

SEQ ID NO: 174645 - protein, 67 aa, Glycine max
  Coding DNA Sequence Number=SeqID_82960
MQHEGKLMQILYNLANKIIFIGYHKILVPRSGFGDTKLRAPHPIYRVCPSQSSLNLLSEREIGSYQT

SEQ ID NO: 174646 - protein, 76 aa, Glycine max
  Coding DNA Sequence Number=SeqID_82961
MTMLDWEKGKLENKKHLSLLPSTSGIALASSTIIHAIRTYDVFVSLLGLDARKNFATLLLQALHRNDIDAFKDNVH

SEQ ID NO: 174647 - protein, 179 aa, Glycine max
  Coding DNA Sequence Number=SeqID_82962
MQIEEEEEEEEEELIEQEKGLIDTEREFPLLEILRLKMHSLESLESPGWFRDCKSKLLNPNKLLSLGSYIGRQLSRESAHSAHPALSMWSLDLVGHACLVQVSCSTHKKVQIGGQLLKHIKRKETIVSLTSKKPTRSRGAEEQGSKEAIAEGNQFLERWLICLNPFLFHFFPFISHLYL

SEQ ID NO: 174648 - protein, 1067 aa, Glycine max
  Coding DNA Sequence Number=SeqID_82963
  Gene Ontology: Mol. function=transmembrane receptor activity; Cellular component=intrinsic to membrane; Biological process=innate immune response
  Homolog annotation: Hit_ID=Q19PN0; Match level="QueryCoverage=94%, HitCoverage=89%, E-value=1e-107, Identity=29%"; Hit description=TIR -NBS-LRR-TIR type disease resistance protein
  Pfam annotation: Domain name=LRR_1; Domain location=559-582; Score =6.2; E_value=22; Accession=PF00560.24; Description=Leucine Rich Repeat
  Pfam annotation: Domain name=LRR_1; Domain location=600-621; Score =14.1; E_value=0.54; Accession=PF00560.24; Description=Leucine Rich Repeat
  Pfam annotation: Domain name=LRR_1; Domain location=623-645; Score =11.2; E_value=2.6; Accession=PF00560.24; Description=Leucine Rich Repeat
  Pfam annotation: Domain name=LRR_1; Domain location=647-669; Score =10.8; E_value=3.1; Accession=PF00560.24; Description=Leucine Rich Repeat
  Pfam annotation: Domain name=LRR_1; Domain location=670-692; Score =15.3; E_value=0.23; Accession=PF00560.24; Description=Leucine Rich Repeat
  Pfam annotation: Domain name=LRR_1; Domain location=694-716; Score =11.0; E_value=2.8; Accession=PF00560.24; Description=Leucine Rich Repeat
  Pfam annotation: Domain name=LRR_1; Domain location=718-743; Score =8.0; E_value=10; Accession=PF00560.24; Description=Leucine Rich Repeat
  Pfam annotation: Domain name=LRR_1; Domain location=752-773; Score =12.6; E_value=1.4; Accession=PF00560.24; Description=Leucine Rich Repeat
  Pfam annotation: Domain name=LRR_1; Domain location=775-795; Score =12.4; E_value=1.6; Accession=PF00560.24; Description=Leucine Rich Repeat
  Pfam annotation: Domain name=LRR_1; Domain location=797-818; Score =8.6; E_value=8; Accession=PF00560.24; Description=Leucine Rich Repeat
  Pfam annotation: Domain name=LRR_3; Domain location=536-555; Score =18.2; E_value=0.03; Accession=PF07725.3; Description=Leucine Rich Repeat
  Pfam annotation: Domain name=NACHT; Domain location=225-386; Score= -30.7; E_value=0.015; Accession=PF05729.3; Description=NACHT domain
  Pfam annotation: Domain name=NB-ARC; Domain location=185-482; Score= -6.2; E_value=7.1e-10; Accession=PF00931.13; Description=NB-ARC domain
  Pfam annotation: Domain name=TIR; Domain location=24-161; Score =160.7; E_value=4e-45; Accession=PF01582.11; Description=TIR domain
  Pfam module annotation: Pfam domain module=LRR_1::LRR_1::LRR_1::LRR _1::LRR_1::LRR_1::LRR_1::LRR_1::LRR_1::LRR_1::LRR_3::NACHT::NB -ARC::TIR; Domain location=559-582::600-621::623-645::647-669::670 -692::694-716::718-743::...
  Pfam module annotation: Domain location=752-773::775-795::797 -818::536-555::225-386::185-482::24-161
MASNTIIQCGSSSSSHAIITAYDVFVSFRGEDTRNNFTAFLFDSLSQNGIHAFKDDTHFPKGESIAPELLQAIEESRLFLVVFSKNYASSTWCLRELAHICNCTIEASPSRVLPIFYDVDPSEVRKQSGYFGIDFAEHEERFREDKEEMEEVQRWREALTQVAHLSGWDIRNKSQPAMIKEIVQKLKYILGPKFQNLPNGNLVGMESRIEEFEKCLALELVSDVRVVGISGMGGIGKTTIALALYKKIAHQYDVHCFVDVENSYGPGRQSNSLGVQKELLHQCLNCENLQISDVFRGYYMVSSRLHNKRGLIVLDNVSRDEQLCMFTENIETILYECLGEGSRIIIISRNEHILRAHGVNYVYQAQPLNHDNAVQLFCKNAFKCDYIMSDYKMLTYRVLSYVQGHPLAIKVIGKSLFGLNDSQWRGKCIVREKSPKEPRKWSRLWDCEDLYKVMSDNMEAKNLEAIVVEDESWMFFETTMRVDALSKIKNLKLLMLPTYKKKRFSGNLNYLSNKLGYLIWEYYPFNFLPQCVQPHKFFELNLSRSNMQHLWHNTQPIPNLRRLNVSYCENLIEALSLKVINLKGCGKLRRLHLSVGFPRNLTYLKLSGCNSLVELPHFEQALNLERLNLEGCGKLRQLHSSMGLLRKITVLNLRDCRSLVNLPHFVEDLNLKELNLEGCIELRQIHPSIGHLRKLTVLNLKDCQSLVSLPSTILGLSSLRYLSLFGCSNLQNIHLSEDSVRCLLPSFPVFSYMRELDLSFCNLLKIPDAFGNLHCLEKLCLRGNNFETLPSLKELCNLLHLNLQHCRRLKYLPELPSRTDLCMPEWRTVEYEEYGLGLNIFNCPELVERDRCTEMCFPWMMQIVQLLTLSFLDHSSSYLMPWWVPFISSIIPGSEMPRWFDEQHLGMGNVINIDRSHFMQLDDNWIGIVCGVIFVVHKERRMPPPDMEQRSILSITCGPSIPPEQRKKERPSLYIPVLFREDLVTDESDHLWLFYYTRSRFDVSNFDQLKVESRFSDLHDQDLDVEVKKYGYRWVYKHELELSNLTAMHSKNLSSRKRKFLAIEETK

SEQ ID NO: 174649 - protein, 185 aa, Glycine max
  Coding DNA Sequence Number=SeqID_82964
MCVFFEGINPISTESLKEKSSEVVARVFTAEADKHAICRSGRMRYRRTAPDDEYINHCKSCEGAKEGQWFPPTFHLLGSTETLSLIKYVTWLLAHRSCREIRIKVHYHQLKLSKKVHRLLEGSSQKLRMWTIPRQERKMMLVALRNYHGVQKVHINARLKGINPGHPFSISALVPRKTKLMALYI

SEQ ID NO: 174650 - protein, 643 aa, Glycine max
  Coding DNA Sequence Number=SeqID_82965
  Gene Ontology: Mol. function=nucleoside-triphosphatase activity; Cellular component=intrinsic to membrane; Biological process=innate immune response
  Homolog annotation: Hit_ID=Q9C784; Match level="QueryCoverage=58%, HitCoverage=43%, E-value=7e-48, Identity=39%"; Hit description =Disease resistance protein, putative
  Pfam annotation: Domain name=LRR_1; Domain location=122-144; Score =10.4; E_value=3.6; Accession=PF00560.24; Description=Leucine Rich Repeat
  Pfam annotation: Domain name=LRR_1; Domain location=146-168; Score =4.2; E_value=51; Accession=PF00560.24; Description=Leucine Rich Repeat
  Pfam annotation: Domain name=LRR_1; Domain location=169-191; Score =14.6; E_value=0.37; Accession=PF00560.24; Description=Leucine Rich Repeat
  Pfam annotation: Domain name=LRR_1; Domain location=193-215; Score =9.3; E_value=5.9; Accession=PF00560.24; Description=Leucine Rich Repeat
  Pfam annotation: Domain name=LRR_1; Domain location=216-238; Score =16.5; E_value=0.098; Accession=PF00560.24; Description=Leucine Rich Repeat
  Pfam annotation: Domain name=LRR_1; Domain location=240-262; Score =10.5; E_value=3.4; Accession=PF00560.24; Description=Leucine Rich Repeat
  Pfam annotation: Domain name=LRR_1; Domain location=264-285; Score =0.9; E_value=2.1e+02; Accession=PF00560.24; Description=Leucine Rich Repeat
  Pfam annotation: Domain name=LRR_1; Domain location=27-49; Score =14.1; E_value=0.55; Accession=PF00560.24; Description=Leucine Rich Repeat
  Pfam annotation: Domain name=LRR_1; Domain location=345-366; Score =10.2; E_value=3.9; Accession=PF00560.24; Description=Leucine Rich Repeat
  Pfam annotation: Domain name=LRR_1; Domain location=368-388; Score =13.1; E_value=1.1; Accession=PF00560.24; Description=Leucine Rich Repeat
  Pfam annotation: Domain name=LRR_1; Domain location=390-411; Score =6.5; E_value=19; Accession=PF00560.24; Description=Leucine Rich Repeat
  Pfam annotation: Domain name=LRR_1; Domain location=4-25; Score=9.9; E_value=4.5; Accession=PF00560.24; Description=Leucine Rich Repeat
  Pfam annotation: Domain name=LRR_1; Domain location=51-72; Score=9.3; E_value=5.9; Accession=PF00560.24; Description=Leucine Rich Repeat
  Pfam annotation: Domain name=LRR_1; Domain location=74-96; Score =16.4; E_value=0.11; Accession=PF00560.24; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1; Domain location=122-144::146-168::169-191::193-215::216 -238::240-262::264-285::...
  Pfam module annotation: Domain location=27-49::345-366::368-388::390 -411::4-25::51-72::74-96
PIPKLRRLNLSFCVNLIEVPDFSEALNLESLDLSGCTRLSRFHPSIGFPRNLTNLRLWDCKSLVELPHFEQALNLEYLDLTGCEQLKQLPSSIGRLRKLKFSLDLEECKSLTDLPHFAEDLNFSWLNLRGCIELRQIHPSIGHLRKLSGLVLQNCKSLVKLPDFAEDLNLRQLNLEGCEQLRQIHPSIGHLTKLEVLNLKDCKSLVKLPDFAEDLNLRELNLEGCEQLRQIHPSIGHLTKLVKLNLKDCKSLESLPNNILRLSSLQYLSLFGCSKLYNIRSSEEQRGAGHLKKLRIGEAPSRSQSIFSFFKKGLPWPSVAFDKSLEDAHKDSVRCLLPSLPIFPCMRELDLSFCNLLKIPDAFVNFQCLEELYLMGNNFETLPSLKELSKLLHLNLQHCKRLKYLPELPSRTDLFWWNWTTVDDYEYGLGLNIFNCPELAERDRCPNNCFSWMMQIAHPDLLPLVPPISSIIPGSEIPSWFEKQHLGMGNVINIGRSHFMQHYKNWIGLALSVIFVVHKERRIPPPDMEQPSILSITCGPSIPPQQRKKERPSPYIPVLFREDLVTDESDHLWLFYFTLDLFDDRNFDELEVKCRSRDLLHDQDLVVEVKKYGKLVAIAIRQGLLHSEELKTDLNMDAELKQQ

SEQ ID NO: 174651 - protein, 209 aa, Glycine max
  Coding DNA Sequence Number=SeqID_82966
  Gene Ontology: Mol. function=transporter activity; Cellular component= integral to membrane; Biological process=transport
  Homolog annotation: Hit_ID=A7P130; Match level="QueryCoverage=96%, HitCoverage=38%, E-value=2e-89, Identity=80%"; Hit description =Chromosome chr19 scaffold_4, whole genome shotgun sequence
MTGSLLDVIRTPMTRARLVLAVVINFLCSVVYYGLSLNVVNLETNLYLTVILNAVAEMPAFMITAMLLDRWGRKPLTIGTLWFSGAFCFAGSLVNNVGVWKGVRVVCGILGIFGMAGTYNLLFIYTAELFPTVVRNAALGCATQAAQMGAILAPLVVVLGGSLPFLVFALCGIVGGVFAFYLPETLNQPLYDTLTGMEAKENTAISTKV

SEQ ID NO: 174652 - protein, 1143 aa, Glycine max
  Coding DNA Sequence Number=SeqID_82967
  Gene Ontology: Mol. function=transmembrane receptor activity; Cellular component=intrinsic to membrane; Biological process=innate immune response
  Homolog annotation: Hit_ID=A7PQ07; Match level="QueryCoverage=79%, HitCoverage=80%, E-value=1e-169, Identity=38%"; Hit description =Chromosome chr18 scaffold_24, whole genome shotgun sequence
  Pfam annotation: Domain name=LRR_1; Domain location=642-663; Score =11.2; E_value=2.5; Accession=PF00560.24; Description=Leucine Rich Repeat
  Pfam annotation: Domain name=LRR_1; Domain location=665-687; Score =9.5; E_value=5.3; Accession=PF00560.24; Description=Leucine Rich Repeat
  Pfam annotation: Domain name=LRR_1; Domain location=689-711; Score =11.9; E_value=1.9; Accession=PF00560.24; Description=Leucine Rich Repeat
  Pfam annotation: Domain name=LRR_1; Domain location=712-734; Score =16.3; E_value=0.12; Accession=PF00560.24; Description=Leucine Rich Repeat
  Pfam annotation: Domain name=LRR_1; Domain location=736-758; Score =11.4; E_value=2.4; Accession=PF00560.24; Description=Leucine Rich Repeat
  Pfam annotation: Domain name=LRR_1; Domain location=760-781; Score =4.4; E_value=48; Accession=PF00560.24; Description=Leucine Rich Repeat
  Pfam annotation: Domain name=LRR_1; Domain location=841-862; Score =11.9; E_value=1.9; Accession=PF00560.24; Description=Leucine Rich Repeat
  Pfam annotation: Domain name=LRR_1; Domain location=864-884; Score =12.4; E_value=1.6; Accession=PF00560.24; Description=Leucine Rich Repeat
  Pfam annotation: Domain name=LRR_1; Domain location=886-907; Score =6.5; E_value=19; Accession=PF00560.24; Description=Leucine Rich Repeat
  Pfam annotation: Domain name=LRR_3; Domain location=619-638; Score =27.2; E_value=6e-05; Accession=PF07725.3; Description=Leucine Rich Repeat
  Pfam annotation: Domain name=NACHT; Domain location=224-378; Score =2.4; E_value=3.8e-05; Accession=PF05729.3; Description=NACHT domain
  Pfam annotation: Domain name=NB-ARC; Domain location=184-484; Score =95.8; E_value=1.4e-25; Accession=PF00931.13; Description=NB-ARC domain
  Pfam annotation: Domain name=TIR; Domain location=23-160; Score =155.5; E_value=1.5e-43; Accession=PF01582.11; Description=TIR domain
  Pfam module annotation: Pfam domain module=LRR_1::LRR_1::LRR_1::LRR _1::LRR_1::LRR_1::LRR_1::LRR_1::LRR_1::LRR_3::NACHT::NB-ARC::TIR; Domain location=642-663::665-687::689-711::712-734::736-758::760 -781::841-862::864-884:...
  Pfam module annotation: Domain location=:886-907::619-638::224 -378::184-484::23-160
MASNTIIQYSSSSSHSIITTYDVFVSFRGEDTRNNFTAFLFDALSQNCINAFKDDADLKKGESIAPELLQAIEGSRLFVVVFSKNYASSTWCLRELAHICNCTIEASPGRVLPIFYDVDPSEVRKQSAYYGIAFEEHEGRFREDKEKMEEVLRWREALTQVANLSGWDIRNKSQPAMIKEIVQNIKYILGPKFQNPPNGNLVGMESSVEELEKCLALESVSDVRVVGISGMGGIGKTTLARALYEKIADQYDFHCFVDDVNNIYRHSSSLGVQKQLLSQCLNDENLEICNVSKGTYLVSTMLRNKRGLIVLDNVGQVEQLHMFTQSRETLLRECLGGGSRIIITSRDEHILRTHGVNHVYQVQPLSWDNAVKLFCINAFKCTYIMSDYEMLTHGVLSHAQGHPLAIEVIGKSLFGRNVSQWTSTLDRLRDNKSRNIMDVLRISYDDLEEKDREIFLDIACFFNDDHEQHVKEILNFRGFDPEIGLPILVEKSLITISDGLIHMHDLLRDLGKCIVREKSPKEPRKWSRLWDFEDIYKVMSDNMEAKNLEAIVVKYISWRVLGTTMRVDALSKMRNLKLLMFPIAWTFSGNLNYLSNELGYLYWKRYPFNLLPPCFQPHKLVELNFCGSKIKQLWEGRKPLPNLRLLDVSNCKNLIEVPNFGEAPNLASLNLCGCIRLRQLHSSIGLLRKLTILNLKECRSLTDLPHFVQGLNLEELNLEGCVQLRQIHPSIGHLRKLTVLNLKDCISLVSIPNTILGLNSLECLSLSGCSKLYNIHLSEELRDARYLKKLRMGEAPSCSQSIFSFLKKWLPWPSMAFDKSLEDAHKDSVRCLLPSLPILSCMRELDLSFCNLLKIPDAFGNLHCLEKLCLRGNNFETLPSLKELSKLLHLNLQHCKRLKYLPELPSRTDVPSPSSNKLRWTSVENEEIVLGLNIFNCPELVERDCCTSMCLSWMMQMVQAFSKPKSPWWIPFISSIIPGSKIPRWFDEQHLGMGNVIKIEHASDHFMQHHNNWIGIACSVIFVPHKERTMRHPESFTDESDERPCFYIPLLFRKDLVTDESDHMLLFYYTRESFTFLTSFEHHDELKVVCASSDPDQYFDVEVKKYGYRRVYRHDLELSNLTTMHRKNLLPRKRKFLAIEENK

SEQ ID NO: 174653 - protein, 149 aa, Glycine max
  Coding DNA Sequence Number=SeqID_82968
  Gene Ontology: Mol. function=protein serine/threonine kinase activity; Cellular component=integral to membrane; Biological process=recognition or rejection of self pollen
  Homolog annotation: Hit_ID=A7P1A2; Match level="QueryCoverage=100%, HitCoverage=19%, E-value=9e-35, Identity=49%"; Hit description =Chromosome chr19 scaffold_4, whole genome shotgun sequence
MTPEYAVDGQFSIKSDVFNFGILLLEIVCGIKTNLCHKYQTLNLVGYAWTLWKEHNALQLIDSSIKDSSVIPEVLRCIHVSLLCVQQYPEDRPTMTSVIQMLGGCEMDVVVPKEPGFFPRQILKERNQGTNLKQMTSNDELTVTSLSGR

SEQ ID NO: 174654 - protein, 546 aa, Glycine max
  Coding DNA Sequence Number=SeqID_82969
  Gene Ontology: Mol. function=sugar binding; Cellular component =integral to membrane; Biological process=recognition or rejection of self pollen
  Homolog annotation: Hit_ID=A7P194; Match level="QueryCoverage=70%, HitCoverage=70%, E-value=1e-94, Identity=43%"; Hit description =Chromosome chr19 scaffold_4, whole genome shotgun sequence
  Pfam annotation: Domain name=B_lectin; Domain location=74-186; Score =96.0; E_value=1.2e-25; Accession=PF01453.15; Description=D-mannose binding lectin
  Pfam annotation: Domain name=PAN_2; Domain location=336-401; Score =102.7; E_value=1.1e-27; Accession=PF08276.2; Description=PAN-like domain
  Pfam annotation: Domain name=S_locus_glycop; Domain location=200-319; Score=106.0; E_value=1.1e-28; Accession=PF00954.11; Description=S -locus glycoprotein family
  Pfam module annotation: Pfam domain module=B_lectin::PAN_2::S_locus _glycop; Domain location=74-186::336-401::200-319
  Subcellular localization annotation: CTP_CleavageSite=45; ConfidenceScore=5.13e-01
MKFILTVTSFILYILFVSSLVVSIAADTSSISQSQSLSFGRTIVSPNGVFELGFFNLGNPNKSYLGIWFKNIPSQNIVWVANGGNPINDSFALLSLNSSGHLVLTHNNTVVWSTSSLRETQNPVAKLLDSGNLVIRDENEVIQEAYLWQSFDYPSNTGLSGMKIGWYLKRNLSIHLTAWKSDDDPTPGDFTWGIILHPYPEIYLMKGTKKYYRVGPWNGSPGLINSIYYHEFVSDEEELSFTWNLKNASFLSKVVVNQTTQERPRYVWSETESWMLYSTRPEDYCDHYGVCGANAYCSSTASPICECLKGYTPKSPEKWKSMDRTQGCVLKHPLSCKYDGFAQVDGLKVPDTKRTHVDQTLDIEKCRTKCLNDCSCMAYTNYNISGAGSGCVMWFGDLLDIKLYSVAESGRRLHIRLPPSELESIKSKKNSKIIIGTSVAAALGVVLAICFIHRRNIAEHPLKYWLCGRIAWKRVVSGAFEAMEDKVRKRHNIVVDAYVLYLGGVNIILEVELLETLCKTTKIGERRGQVFRITVTVLLHLRGIKF

SEQ ID NO: 174655 - protein, 487 aa, Glycine max
  Coding DNA Sequence Number=SeqID_82970
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=A7P134; Match level="QueryCoverage=98%, HitCoverage=96%, E-value=0.0, Identity=74%"; Hit description =Chromosome chr19 scaffold_4, whole genome shotgun sequence
  Pfam annotation: Domain name=Glyco_hydro_1; Domain location=12-483; Score=663.2; E_value=2.2e-196; Accession=PF00232.9; Description =Glycosyl hydrolase family 1
MTKLLVGAESISRADFPEGFVFGTASSAHQFEGATDEGNKGDSIWDTFSRIPGRIVDFSNADKAVDQYHRFQDLGMDSYRFSISWPRIFPNGTGEPNKEGIKYYNSLIDSLLVKGIQPFVTLYHWDLPQMLEDKYEGWLSSQIIKDYEHYANTCFKAFGDRVKHWITFNEPHNFALHGYDLGIQAPGRCSLLGHLLCKKGKSSTEPYIVAHNILLSHAAAYRSYQLHFKEQQGGQIGIALDVIWYEPITELDEDKDAAARAMDFSLGWFLDPLFFGKYPLSMEKLVAKRLPEISDTASKFLVGSLDFIGINHYTSVYTRNDRTRIRKLVMQDAATDAAVITTAYRRGSAIGEKAASSWLHIVPWGIRKLVKHVKDKYGDTPVIITENGMDDPSGPFRTLEKALNDDKRIRYHRDYLSNLSAAIREDGCNVRGYFVWSLLDNWEWNMGYTVRFGLYYVDFRNNLTRIPKDSVQWFKNMLRIETEHSEI

SEQ ID NO: 174656 - protein, 204 aa, Glycine max
  Coding DNA Sequence Number=SeqID_82971
  Homolog annotation: Hit_ID=A9P8A3; Match level="QueryCoverage=58%, HitCoverage=72%, E-value=1e-49, Identity=82%"; Hit description =Putative uncharacterized protein
  Pfam annotation: Domain name=DUF538; Domain location=14-153; Score =158.6; E_value=1.7e-44; Accession=PF04398.3; Description=Protein of unknown function, DUF538
  Subcellular localization annotation: CTP_CleavageSite=55; ConfidenceScore=5.45e-01
MAARAKTPLNTLSSFTFTLFLSFSLLQLSLSSPTTIHDLLRSKGLPPGLLPEEVKSYTFSETGHLEVFLDAPCLTKYENRVLFEQVVTANLTYGSLIGVEGLQQEELFVWLPVKDIIVNDPSSGLILFDIGLAHKQLSLSLFEDPPHCKNQGGKKYNILRNMSVPEAPYSASHSNIFRPDQCRWVEESCEEGKRFLRGPEVLVA

SEQ ID NO: 174657 - protein, 171 aa, Glycine max
  Coding DNA Sequence Number=SeqID_82972
  Gene Ontology: Mol. function=nucleic acid binding
  Homolog annotation: Hit_ID=A3BTE5; Match level="QueryCoverage=48%, HitCoverage=8%, E-value=1e-09, Identity=37%"; Hit description =Putative uncharacterized protein
MNTFILCDLVQACKKYSRIGDCFWLTDKDLDFNHGLRSYTTYRDILYLVKAALENENEINVYFHHEVDPIPEEVPLMLDLKWMSCRHAIVAISHKGGKPGDLCHDWLSIEAYNKTYHHFIQLVQGPKYWAHAQYGQPVLPHKKVQRGRPKKNRRRDANEDNVIGHRSFGGD

SEQ ID NO: 174658 - protein, 603 aa, Glycine max
  Coding DNA Sequence Number=SeqID_82973
  Gene Ontology: Mol. function=protein serine/threonine kinase activity; Cellular component=integral to membrane; Biological process=recognition or rejection of self pollen
  Homolog annotation: Hit_ID=A7P194; Match level="QueryCoverage=64%, HitCoverage=70%, E-value=4e-98, Identity=44%"; Hit description =Chromosome chr19 scaffold_4, whole genome shotgun sequence
  Pfam annotation: Domain name=B_lectin; Domain location=164-276; Score= 101.4; E_value=2.8e-27; Accession=PF01453.15; Description=D-mannose binding lectin
  Pfam annotation: Domain name=PAN_2; Domain location=432-497; Score =104.3; E_value=3.8e-28; Accession=PF08276.2; Description=PAN-like domain
  Pfam annotation: Domain name=S_locus_glycop; Domain location=290-415; Score=129.1; E_value=1.3e-35; Accession=PF00954.11; Description=S -locus glycoprotein family
  Pfam module annotation: Pfam domain module=B_lectin::PAN_2::S_locus _glycop; Domain location=164-276::432-497::290-415
MAPEYAVDGQFSIKSDVFSFGILLLEIVCGNQNKALSHENQALNIVGYAWTLWKEQNALQLIDSSIKDSCVISEVLLCIHVSLLCVQQYPEDRPTMTSVIQMLGSEMDMVEPKEPADTSSISQSQSLSFGRTIVSPNGVFELGFFNLGNPNKSYLGIWFKNIPSQNIVWVANGGNPINDSFAILSLNSSGHLVLTHNNTVVWSTSSLRETQNPVAKLLDSGNLVIRDENEVIQEAYLWQSFDYPSNTGLSGMKIGWYLKRNLSIHLTAWKSDDDPTPGDFTWGIVLHPYPEIYLMKGTKKYYRVGPWNGLSFGNGSPELNNSIYYHEFVSDEEEVSYTWNLKNASFLSKVVVNQTTEERPRYVWSETESWMLYSTRPEDYCDHYGVCGANAYCSTTASPICECLKGYTPKSPEKWKSMDRTQGCVLKHPLSCKYDGFAQVDDLKVPDTKRTHVDQTLDIEQCRTKCLNDCSCMAYTNSNISGAGSGCVMWFGDLLDIKLYSVAESGRRLHIRLPPSELESIKSKKSSKIIIGTSVAAPLGVVLAICFIYRRNIAERIRKRVVSGVFEAIEDKTLCKTTKIGERRGQVFRIMVAVLLHLRGIKF

SEQ ID NO: 174659 - protein, 640 aa, Glycine max
  Coding DNA Sequence Number=SeqID_82974
  Gene Ontology: Mol. function=transmembrane receptor activity; Cellular component=intrinsic to membrane; Biological process=innate immune response
  Homolog annotation: Hit_ID=A7PPZ5; Match level="QueryCoverage=97%, HitCoverage=68%, E-value=1e-127, Identity=41%"; Hit description =Chromosome chr18 scaffold_24, whole genome shotgun sequence
  Pfam annotation: Domain name=LRR_3; Domain location=621-640; Score =35.2; E_value=2.4e-07; Accession=PF07725.3; Description=Leucine Rich Repeat
  Pfam annotation: Domain name=NACHT; Domain location=219-377; Score= -33.7; E_value=0.025; Accession=PF05729.3; Description=NACHT domain
  Pfam annotation: Domain name=NB-ARC; Domain location=178-479; Score =112.3; E_value=1.5e-30; Accession=PF00931.13; Description=NB-ARC domain
  Pfam annotation: Domain name=TIR; Domain location=21-154; Score =143.7; E_value=5.1e-40; Accession=PF01582.11; Description=TIR domain
  Pfam module annotation: Pfam domain module=LRR_3::NACHT::NB-ARC::TIR; Domain location=621-640::219-377::178-479::21-154
MASTSNAIIQCTSSSSFEYDVFVSFRGEDTRNSFTAFLFGALKKQGIEAFKDDKDIRKGESIAPELIRAIEGSHVFGVVLAKDYASSTWCLRELAHIWDCIQTSHRPLLPIFYDVDPSQVRNQSGDYEKAFAQHQQSSRFQEKEIKTWREVLEQVASLSGWDIRNKQQHPVIEEIVQQIKNILGCKFSILPYDYLVGMESHFAKLSKLICPGPVNDDVRVVGITGMGGIGKSTLGRALYERISHQFNSRCYIDDVSKLYQGYGTLGVQKELLSQSLNEKNLKICNVSNGTLLVWERLSNAKALIILDNVDQDKQLDMFTGGRNDLLGKCLGKGSIVIIISRDQQILKAHGVDVIYRVEPLNDNDALGLFCKKAFKNNYMMSDFKKLTSDVLSHCQGHPLAIEVLGSSLFGKDVSHWGSALVSLREKKSKSIMDVLRISFDQLEDTHKEIFLDIACFFNHYPVKYVKEVLDFRGFNPEYGLQVLVDKSLITMDSRWIQMHELLCDLGKYIVREKSPRKPWKWSRLWDFKDFLKVMSDNKAADNVEAIFLIEKSDILRTISTMRVDVLSTMSCLKLLKLDHLDFNVKINFFSGTLVKLSNELGYLRWEKYPFECLPPSFEPDKLVELILPKSNIKQLWEGTK

SEQ ID NO: 174660 - protein, 528 aa, Glycine max
  Coding DNA Sequence Number=SeqID_82975
  Homolog annotation: Hit_ID=A7UQU7; Match level="QueryCoverage=49%, HitCoverage=59%, E-value=2e-20, Identity=28%"; Hit description=IMP dehydrogenase/GMP reductase, putative
  Pfam annotation: Domain name=DUF1723; Domain location=177-226; Score =45.5; E_value=1.9e-10; Accession=PF08330.1; Description=Protein of unknown function (DUF1723)
MGFPLTPLTPHKEPSLHSLPLTVTSGMFETYDKCISEVKRDGENRPPSETGTGDKFLTSSFSGTGANFCPCCHAYLGKKLIYVIVGLLTLPANSINILRFFNAYIFDKGIRVAVIAAVQLNMVYSGRILDSNSVECPELKLSSHGRKVHNLGRLVPAIEDMVAGTRLSPLIACSINTGDRGLISSFFEKWHWKTSSFHLPVGEISITLDDVAALLHLSIVGALHDFQPLRSDEAVLLLVELLMVSPEVAMAETGQCGGPYALHDLTLAERYAWGAVGLVHMYDQLNDASLSTSRQLAGYITLLQYWIYEHFLSVAECNGDPDYDEVSPHACRWIATKKTVKKDFHPISCFSRQLCWGPVVVRYRPERVMRQFGYVQCIPAHPVHPWMSYDDIDDTWTHYSDHLATVGNPCVVPGQGAPDYIDWFFRISHPFMTTTQPSDPPADAPAAQPRHVPQVLELDIPQVPDDPARSDVDEPRHIVEAYDAMAERLERHLSLGIVMPGTSTHEVIKECLKVARSVTQGRIVYVRS

SEQ ID NO: 174661 - protein, 305 aa, Glycine max
  Coding DNA Sequence Number=SeqID_82976
  Gene Ontology: Mol. function=transmembrane receptor activity; Cellular component=intrinsic to membrane; Biological process=innate immune response
  Homolog annotation: Hit_ID=A5B6G5; Match level="QueryCoverage=88%, HitCoverage=24%, E-value=1e-14, Identity=25%"; Hit description =Putative uncharacterized protein
  Pfam annotation: Domain name=LRR_1; Domain location=32-52; Score =15.4; E_value=0.22; Accession=PF00560.24; Description=Leucine Rich Repeat
  Pfam annotation: Domain name=LRR_1; Domain location=54-79; Score=5.5; E_value=30; Accession=PF00560.24; Description=Leucine Rich Repeat
  Pfam annotation: Domain name=LRR_1; Domain location=9-30; Score=8.0; E_value=10; Accession=PF00560.24; Description=Leucine Rich Repeat
  Pfam module annotation: Pfam domain module=LRR_1::LRR_1::LRR_1; Domain location=32-52::54-79::9-30
MPSSPIFPCMRELDLSFCNLVEIPDAIGIMCCLQRLDLSGNNFATLPNLKKLSKLVCLKLQHCKQLKSLPELPSRIYNFDRLRQAGLYIFNCPELVDRERCTDMAFSWTMQSCQESGNNIEMSLLYQVLYIYPFCHVSGGVSPGSEIPRWFNNEHEGNCVSLDACPVMHDHNWIGVAFCAIFVVPHETLSAMCFSETERIYPDFGDILVDFYGDVDLELVLDKSDHMCLFLVKRMDFIYHFHLKHKYLGRLVLECDDEWKESYAEVKKYGYRWLYEEDIEGPSNPLARKSKFGGNEEKVSRREKR

SEQ ID NO: 174662 - protein, 247 aa, Glycine max
  Coding DNA Sequence Number=SeqID_82977
  Gene Ontology: Mol. function=oxidoreductase activity; Cellular component=extracellular region; Biological process=response to oxidative stress
  Homolog annotation: Hit_ID=Q18PR1; Match level="QueryCoverage=100%, HitCoverage=77%, E-value=1e-112, Identity=80%"; Hit description =Peroxidase
  Pfam annotation: Domain name=peroxidase; Domain location=1-211; Score= 347.6; E_value=2.2e-101; Accession=PF00141.14; Description=Peroxidase
GCDGSILLDDTATFTGEKNAGPNRNSARGFEVIDTIKTNVEASCNATVSCADILALATRDGIVLLGGPSWTVPLGRRDARTASQSAANNQIPGPSSDLSTLISMFASKGLTASDLTVLSGAHTIGQAQCQFFRTRIYNETNIDTNFAATRKTTCPATGGNTNLAPLETLTPTRFDNNYYADLVNRRGLLHSDQVLFNGGSQDSLVRSYSGNSAAFSKDFAAAMVKLGNISPLTGSSGEIRRNCRVVN

SEQ ID NO: 174663 - protein, 352 aa, Glycine max
  Coding DNA Sequence Number=SeqID_82978
  Homolog annotation: Hit_ID=A9P9U9; Match level="QueryCoverage=68%, HitCoverage=98%, E-value=5e-42, Identity=42%"; Hit description =Putative uncharacterized protein
  Pfam annotation: Domain name=DUF1685; Domain location=103-190; Score=- 21.3; E_value=0.04; Accession=PF07939.2; Description=Protein of unknown function (DUF1685)
MAAEHVLRLLDSFWFEASILSNKTLSNSISHDHNKVVEEVLPLDDAKLLLVPTPTLEVRSYSDQNLDSTTCLLCDYSQSPNSVLTPQRLRTIPSEREIREFSSGNHGKEGMSIKRKQKSFGHGRRARKVRTSRSLSELEFKELKGFMDLGFVFSEEDKDSKLASLIPGLQRLGREEDEEGQGDDQSVVSDNNNKPYLSEAWDVLDQREMGNPLLNWRVPARGNEIDMKDNLRFWAHTVASIRGVASVEVKVLWIGGDCCGGWFSCDIVEDTPILYGLDDTYNSYGSCGPYALYGPTTMLHSAAAINEGGEAYLDGRSGGDVSTEAANARKMNQQVAEMSSNAHAQEEKKPIG

SEQ ID NO: 174664 - protein, 76 aa, Glycine max
  Coding DNA Sequence Number=SeqID_82979
MDYPWKQDIISDPTTKVITNWQIKDGELIQSNLPPTTQYPLPKVKDSHDKPVMATPFKTENVNEEVTSKDIKSLME

SEQ ID NO: 174665 - protein, 124 aa, Glycine max
  Coding DNA Sequence Number=SeqID_82980
MTTSRMSAPYRLTVCSLFNSLTSTDCALLSQASLLGVEIGRGREGVRIEEGEEGAGPGGCVDGEVISSQLGEGVEGEEGEEGQEAGEEGGGGGGGSGGGSEGGGCGGGGSAVVEDFEEAGVAEP

SEQ ID NO: 174666 - protein, 89 aa, Glycine max
  Coding DNA Sequence Number=SeqID_82981
MGFPPREKIITPVDLSLGDNIKSKGKRKYCDVAPCGARRPWIFFINGVLCFLKFDGSRMEKEKYDWRRHFKKKMSLEEVHHHRKPWIRA

SEQ ID NO: 174667 - protein, 97 aa, Glycine max
  Coding DNA Sequence Number=SeqID_82982
MVQRYTLNEIAAELDRIQYCGNDPSSCGCSMRSTHGFPCACMGEESWPMVRNELIKELGKWSHDYINLFSGTERLEQLRMSLHVDGFSQVSVEKWMD

SEQ ID NO: 174668 - protein, 132 aa, Glycine max
  Coding DNA Sequence Number=SeqID_82983
  Gene Ontology: Mol. function=nucleic acid binding; Biological process= DNA integration
  Homolog annotation: Hit_ID=Q8H023; Match level="QueryCoverage=73%, HitCoverage=17%, E-value=5e-09, Identity=34%"; Hit description =Putative retrovirus-related pol polyprotein
MEEEIPSKHLRRPICARSCQGSLSIYTTAEFQMELYKLKMEMRGDLHDHINKFNRLVSQLLNTDDKLSDEKHSLLLLASLPRFFKALVQTLLVGRSTLNLDEVTVALRENEIMIRTENVDNEHNAIVVVESE

SEQ ID NO: 174669 - protein, 706 aa, Glycine max
  Coding DNA Sequence Number=SeqID_82984
  Homolog annotation: Hit_ID=A5C114; Match level="QueryCoverage=51%, HitCoverage=31%, E-value=2e-78, Identity=48%"; Hit description =Putative uncharacterized protein
  Pfam annotation: Domain name=DUF688; Domain location=1-675; Score =111.1; E_value=3.4e-30; Accession=PF05097.3; Description=Protein of unknown function (DUF688)
MEEKQLDFNQPLLSVRRISSTAASENDNKRKADKSVRKRPPLPFYKSELKSGPVTNPGTVPFVWEKTPGRPKNESKLQTRAVERPSVAPKLPPGRVLKVEQQCSDKVPKGASVTQSRTGSSVSDSPRTASLDNKVTKHESPQEVIEEKESSGSDDEDENYLDALDTLSRTESFFMSCSVSGLSEWDDQEVQLSGNFSTDQQARDFMIGRFLPAAKAMASETPQIQHNSRKPLVTQEQPKQAWKVVSGANSRPLNPKWQKVLPHYAQDIGREESEDESDDNDGYENNAPKVCGLFPRFCLLNPVPGLRMEGRIRSSTFHGVQSKSITSHRRTAKEHGRTATNGKKSVNSQSGYTEERDFLSTAEKSKHDIDPHRRACSKSSASESTEFESSCDSPVVEKTLYVDSVHKVKSSDTNIRGDDFDTLRKDTDLDKSLSIDSSIEDSKPLGIVDEKEVSEPKSSASLDSSLPVCSDNSNDNMQMEMKNHSNKICPEKQELTKPDYQGSNLDRDLVAISSPDMVACKKIESESKDFSTKESSNGLIKNPVSMRNRKFASDVKFDSKCQQATKVVDQECTLGSSEDPSNLASSKVVGDTKINLESQLRMKLSHGKTSNASSSKLPLALPSPKAPSESWLKRTLPTVPSKSISLRSNLATYFHAPVKTSEVNHGHLQFAQGPKNFFFWGLKLMPNLSCILQGRDLELLPPIPEA

SEQ ID NO: 174670 - protein, 138 aa, Glycine max
  Coding DNA Sequence Number=SeqID_82985
MQSTAVSRRNGVVASIPRHSSPRHDVEAMDSTTFLPGNEVPFDVIAFSSNDVEDLTFQALVVTRYVGAAIPDLKSLPFNVVPHAGNIFEGKPTTTGLQSSPSQESCVSKTVEGDRRRLAGGLRRRLIQRRPCTVVELR

SEQ ID NO: 174671 - protein, 29 aa, Glycine max
  Coding DNA Sequence Number=SeqID_82986
MERNRGFRRMERKENGKRRVEKQWETERA

SEQ ID NO: 174672 - protein, 75 aa, Glycine max
  Coding DNA Sequence Number=SeqID_82987
  Gene Ontology: Mol. function=endonuclease activity
  Homolog annotation: Hit_ID=Q2HUP4; Match level="QueryCoverage=96%, HitCoverage=26%, E-value=1e-18, Identity=63%"; Hit description =Endonuclease/exonuclease/phosphatase
MGENCKSFKESSHIFVESKQGPLHRRPDVVKSKQGFPHFRERVWVKKLVHDRRIRFGTWNIGTLTGKSMEIVDVM

SEQ ID NO: 174673 - protein, 560 aa, Glycine max
  Coding DNA Sequence Number=SeqID_82988
  Homolog annotation: Hit_ID=Q2HW90; Match level="QueryCoverage=76%, HitCoverage=88%, E-value=1e-42, Identity=30%"; Hit description =Putative uncharacterized protein
MGSSQTPPLKKRFYQVKIKSLKVTSLQELRGLIGQLQQQAFHKTYGKIWDLATIEVSAKAIASLTQYYDQSLRCFTFEDFQLVPTVEEFEEILGCPLEGRKPYLLSGFYPSMPRIAKIVRISAQELDRVKQNRNGVIGIPRKYLEERARALAGQNEWLLFIDVLALLIFRVVLFPNMDGLVDLAAIDAFLAFHHSKESPIVTILADIYDTFDRRCERSNTRIVCCTTALYVWLVSNLFRQDARHTCPLQSHCSCTENREANWDQLLANIERVSINWFPRWKERRSRILVSCGEFPNVPLMGTRGCINYNHVLAIRQLGYPMRGAPSVESLTPFITRGFSDPNARVLQGVRKAWEVVQRKDKELRGSNNGNVSGYHRWLRAYTQGLDWLPKLRAAKEEEAEASEESEGVQALKAELEKAQVVKEKFKTTTREERDQSRVEGMILKDELKTCRRSKRSLSQQLSETEANMLAIISKYKEELELATAHEHKVADEYAQLYAKKEAKGMVIGSLHQEATMWMDRFALTLNRSQKLPRLLAKAKAMADVHSAPKEIHGSLAIVSI

SEQ ID NO: 174674 - protein, 339 aa, Glycine max
  Coding DNA Sequence Number=SeqID_82989
MAPKKLTTKRPRKDTLGEGSCAIQDFDIHRFRSAEHQQRFEAIKGWSFLRERQEVARRRRTQLISPMAKFNPEIVMEFYTNDWPTEEGIRDMHSWVRGQWVPFDTDAINQFLDHPLILEEGQQYEYRQWRDQANGFNEEAIAQLLCTPGQDFARTAAGRRVRIMCTSMTTLTQMWMTLLLNNVLPSDHNSNLPLPKYQLVYAILAGISVHVAQLIVDAIYIFAGMAPTRYPLDPEKSNRALGFPALITGLFQFYGVPVTPSKATERGALPTSCGPPASGQPPWTGAVTRVPLPPHPQPAGSGFHPIYMPYPGVVQSCGRLARRLARRSDRSRTRRGPRS

SEQ ID NO: 174675 - protein, 97 aa, Glycine max
  Coding DNA Sequence Number=SeqID_82990
MRQVAGGYTQVIIRTKTTYVDPDPCVKWQTDMPKYTQVIIRTKTTSVDPDPCIRWQAEIARVVIRTNATSVNPDPCVRWQADIPSVNSLASVPNRHK

SEQ ID NO: 174676 - protein, 34 aa, Glycine max
  Coding DNA Sequence Number=SeqID_82991
LTSNIKGKVAIDIVDLKMAKISFTIIFAFALIFT

SEQ ID NO: 174677 - protein, 195 aa, Glycine max
  Coding DNA Sequence Number=SeqID_82992
  Homolog annotation: Hit_ID=A7P0V3; Match level="QueryCoverage=75%, HitCoverage=26%, E-value=3e-60, Identity=78%"; Hit description =Chromosome chr19 scaffold_4, whole genome shotgun sequence
MSERDIAWDFHLRKLSASGRDSNTANDPASDSSLLPSVKKLHEICKNEYSEDLVARVYPSINKIFQRAVASLSQSRTSNGLLLLEILQFYLDFGEVVLHDADPSLRTFFRLCLSREFADPVVAEATLEFLIINKKKLLTSFPNLLPQSNLKHEIMIYEAPTLTRIPDTDTWTPVKHIKLNLNTGVGVVSNTRHDK

SEQ ID NO: 174678 - protein, 76 aa, Glycine max
  Coding DNA Sequence Number=SeqID_82993
MEPRRECDGLQQWNQLINEEIATTTIETQDQRCDRSGENKASWRERRFYLVESVYDKLVDLNCIHCLKKLVHNGPP

SEQ ID NO: 174679 - protein, 129 aa, Glycine max
  Coding DNA Sequence Number=SeqID_82994
MSSTTKAPPSSNDAMSTEESGWTTYFDDFFNNHVVDNNKCSMPLSGGVASSSLVSDAASSAEKKKVANSKQVEEFNYVNRYVKRSSFKKRKDVITALIDDSLEDTATSPLNSPKVLYANQKIDKANRRK

SEQ ID NO: 174680 - protein, 568 aa, Glycine max
  Coding DNA Sequence Number=SeqID_82995
  Homolog annotation: Hit_ID=A5BEB2; Match level="QueryCoverage=24%, HitCoverage=83%, E-value=5e-07, Identity=33%"; Hit description =Putative uncharacterized protein
METSKKKAITMKKSFDPWAFLEHIEAPMWVDLTLEVKSGCVDTGDDEWFNTSHPFHQMSARELKSRFSHGEEILTSGVDSPELPSSVSRSRGKHYNNKKWEGIDLNSLLDKQKGLSRRGFQQGSSFGQEVKPKPNSNVNKPKGGKLGLAFERKSRGKTDSMVNCSNPPSSSSSNHKCEGSTARSTITSENTQKYREVSSKPFDQKRSSSIRRVSLGKSCVTRKVSSILPQKECLEVSSQPCDQKSRSSSVISVRRSYVSGKASKVEIGGDSTARSMITSENTRKYREVSSKPCAQQSSSVGRVSLGKSCVTRKVSSIQPQKKCLEVSSQPCDQKSRSSSVISVRRSYVLGEASKVESGGDSMRSRGRKSSSGKSSIGSCSNPGYEVKFVSRQQREKITIDKGEVTMNLAVKNRCKPSERSKTSTISVEEAKSGNRKRNSINFAKPAYHRTAKSLVQYSSASSKALLQHTVNKENTCIGGAKEKLRTTKVKSLTAKGKENVSRNVAVNQKCISRGASAGGLVRSHRTTEHNHPQKGDKAGSTALTIVCIEKLITKNPKSSQNSCELLDY

SEQ ID NO: 174681 - protein, 211 aa, Glycine max
  Coding DNA Sequence Number=SeqID_82996
  Gene Ontology: Mol. function=ion channel activity; Cellular component= integral to membrane; Biological process=plant-type hypersensitive response
  Homolog annotation: Hit_ID=A7P1E8; Match level="QueryCoverage=65%, HitCoverage=19%, E-value=3e-43, Identity=61%"; Hit description =Chromosome chr19 scaffold_4, whole genome shotgun sequence
MATTITEQEASSRAPHVLDYATTTSDDDTEKEEEELVHEQNESSGGGRWFPAACGGGTRRSGGGALGRVLDPRAKWVQEWNRVFLLVCAAGLFVDPLFFYALSVSDSCMCVFVDGWLAVTVTVLRCMTDALHVWNMVIRCKMAKRTFGLGASTTSSGRGTSSSSVGLRDTRPRSVAMGYLMSRTGFFFDLFVILPLPQWVVSSDELETMAT

SEQ ID NO: 174682 - protein, 90 aa, Glycine max
  Coding DNA Sequence Number=SeqID_82997
  Gene Ontology: Cellular component=integral to membrane; Biological process=peroxisome organization and biogenesis
  Homolog annotation: Hit_ID=Q85V22; Match level="QueryCoverage=70%, HitCoverage=14%, E-value=2e-18, Identity=63%"; Hit description =Histidine amino acid transporter
MWRGVSVAYTIVIICYLSVAVFGFWGYGNVVDDDILITLEHPNWLIAIANFMVFVHVLGSFQIPGILWLKAKSPQRWSFHWIASWVYFLY

SEQ ID NO: 174683 - protein, 121 aa, Glycine max
  Coding DNA Sequence Number=SeqID_82998
MKTKDQQPPPTTTTSTEEDEGPTITNNNQPLAWRKTNDEQKWNKHQHQRVKDIFAFSPRLLGAPAKMLGAPTFDLDNLIFVEPNDDAQSEEDLDDDDGDGDDDENDDIHGDDPIRGLDMLL

SEQ ID NO: 174684 - protein, 38 aa, Glycine max
  Coding DNA Sequence Number=SeqID_82999
MQLQDIEQVLSYNACSVRVSNELGARSPKSASLSCVLV

SEQ ID NO: 174685 - protein, 135 aa, Glycine max
  Coding DNA Sequence Number=SeqID_83000
MVVAEMKEGFSRDRTSSATVGGYSQNQSQGIELGVQRDEGCAAMKRGQVPTSKNGKDKSNPKYPNSKYAFIPLPTHLLEDTMLSHGFALFLRTVHVCMMPAMLYVPSSWAFGAYFLQTHLTIPIKHQGTTLNKAT

SEQ ID NO: 174686 - protein, 86 aa, Glycine max
  Coding DNA Sequence Number=SeqID_83001
MPPSLLVEVFKDVIVAAGEEDKCDSTQNPGKISGPKGSAKGQRDGKNSSTNVPTYSVISVLSVSEIVLIISNFHLREEIVYAQGIN

SEQ ID NO: 174687 - protein, 90 aa, Glycine max
  Coding DNA Sequence Number=SeqID_83002
MTMSSTWTKMAMNDEHVPLVNKLSDGPSVVEIHGCKFILNGLFLVRKIDGLLVRIITSAWSNVRAERISGPCCKFFVFERKDVFIELHVP

SEQ ID NO: 174688 - protein, 440 aa, Glycine max
  Coding DNA Sequence Number=SeqID_83003
  Homolog annotation: Hit_ID=A7PYF0; Match level="QueryCoverage=93%, HitCoverage=77%, E-value=1e-99, Identity=75%"; Hit description =Chromosome chr15 scaffold_37, whole genome shotgun sequence
  Subcellular localization annotation: CTP_CleavageSite=48; ConfidenceScore=5.27e-01
MNWVLLTWTKALNRIHSSNSRSGVDGSITFVTVFTIYNSSLNDVDDKSSNTVVGNASYNKFGRSTALLNVFINFIQTFGVFQHEIVEYSCLHEFFTFFPTLTLVFLPMYPNVIHPCLHLANDKFQLVRKVTTEVWMPIRGLRMLLKEEEGITREIDIFWMLDDVQLPYITNNSYCFCPRARFLTIIPHRHHSFNNMSKVIILTDPVSDLSVLRNGVSLYPIEGEYSRDKLMLQRIRSYITFLETRLQNLSQKKPKNITHYIFTDSDIAVVDDLGQIFRDHPNFHVALTFRNNKAQPLNSGFIAVRGTPEAILRAKLFLQEVLKVYSTKYRNASRMLGDQLALAWVVKSKPHFDASRFGKALAFSEDIGGTSVVFLPCSLYNWTPPEGAGQFHGMPLDAKVVHFKGSRKRLMLESWNFYSSSLEQLVALTAPDLSTEKTQP

SEQ ID NO: 174689 - protein, 247 aa, Glycine max
  Coding DNA Sequence Number=SeqID_83004
  Gene Ontology: Mol. function=methyltransferase activity; Cellular component=nucleus; Biological process=regulation of transcription
  Homolog annotation: Hit_ID=A7QEG3; Match level="QueryCoverage=55%, HitCoverage=28%, E-value=3e-40, Identity=49%"; Hit description =Chromosome chr1 scaffold_84, whole genome shotgun sequence
  Pfam annotation: Domain name=PPR; Domain location=129-163; Score =21.3; E_value=0.0036; Accession=PF01535.11; Description=PPR repeat
  Pfam annotation: Domain name=PPR; Domain location=193-227; Score =45.6; E_value=1.7e-10; Accession=PF01535.11; Description=PPR repeat
  Pfam module annotation: Pfam domain module=PPR::PPR; Domain location =129-163::193-227
MVVSWVLEGLVSDELERVELDVRFKCMVVGYSSNEVLKDNNAVDATSVTTLYLTHKALSDITCLTVNLEKLDLKLNNLTSLEMCWVGLEASVSTVLSLLSATGYIGNFGVGYIFLAHQVFDRVAKKDVVLWNYLIGNYARNGMVGEALASFEQMSKLKLDAVLGTTLVDVCAKCGFLDEAMDIFDRMEDKDVKSWTAMISGLGVHGQPNNAIRLFNRMEKEGFKPNELTFLAILTACSHGGLVVEGM

SEQ ID NO: 174690 - protein, 368 aa, Glycine max
  Coding DNA Sequence Number=SeqID_83005
  Gene Ontology: Mol. function=catalytic activity; Cellular component =integral to membrane; Biological process=recognition or rejection of self pollen
  Homolog annotation: Hit_ID=A0MF94; Match level="QueryCoverage=93%, HitCoverage=86%, E-value=1e-108, Identity=56%"; Hit description =Putative uncharacterized protein
  Pfam annotation: Domain name=Peptidase_C12; Domain location=23-353; Score=149.6; E_value=8.4e-42; Accession=PF01088.12; Description =Ubiquitin carboxyl-terminal hydrolase, family 1
MALSSKHPHLFNHIRTFVNAKVKWVRDPYLDNAVLKEKDLKQTISLKNQIISSPSKSLSIYAASQLKASLYLPTTTTKFIDKYHCIFTQFQPGPGLPPVVKLTPQALSLHKEEMAVYKTPINREDTVQRLARLLMLAGMEKLPLYVIEKLKWDMGLPHDYVTTLLADYPDYFDLCVVEDPSSGKEMLALELVSWRKELSVSELEKRAMSLGYSGDKRRHDIAFPIFLPKGFDLEKRVKTWVENWQKLPYVSPYEDAFHLDSNSDQAEKWTVAILHELLSLLVSKKTERDNLLCFGECLGLALRFKKALVHHPGIFYLSNKIRTQTVVLREAYRKDFLVKNHPLVVVGSGTNATGVINQTIAGEWSGHL

SEQ ID NO: 174691 - protein, 225 aa, Glycine max
  Coding DNA Sequence Number=SeqID_83006
  Subcellular localization annotation: CTP_CleavageSite=43; ConfidenceScore=5.55e-01
MSTSGLMLTPPPMSTSSPMPTVPPCPTTVQPFPAPLLTPCPIPVAYLPDLRHTRAIVSCNKLFDTVASYSRATTPNDKALEGRNMTLFEIGIEYHGPTMVACKHQPTVFALWTPQHLEDKVFLMGQGKMLGAVNQDNLVFEEPVPPEENKEKRMKGILALCSFCWALPLAPPLSPSSYHSLTLVQNNERKWENTKRKKGSVIVIHRKSPPATMIDGRSENCKDGY

SEQ ID NO: 174692 - protein, 181 aa, Glycine max
  Coding DNA Sequence Number=SeqID_83007
MQAVSPYTLAIPPGTATWLSATATGEIASGYRHQCWQVRDNSLRQFDWRVTCNGGRHREGLQSSAQRCKGVGFFQRCKGYRHSYWREAFRRGVSPFVLARSLQSYSDTWRKALLPSCASLLYERHLPRHVHQIYKLSLVQLMMTLYGCKLSMFQNIFRMWKKTENYSSDELSPRIKVKKKY

SEQ ID NO: 174693 - protein, 424 aa, Glycine max
  Coding DNA Sequence Number=SeqID_83008
  Gene Ontology: Mol. function=electron carrier activity; Cellular component=mitochondrion; Biological process=electron transport
  Homolog annotation: Hit_ID=A7P0V7; Match level="QueryCoverage=93%, HitCoverage=93%, E-value=3e-80, Identity=71%"; Hit description =Chromosome chr19 scaffold_4, whole genome shotgun sequence
  Pfam annotation: Domain name=ETF; Domain location=30-200; Score=15.3; E_value=2.5e-05; Accession=PF01012.12; Description=Electron transfer flavoprotein domain
  Pfam annotation: Domain name=ETF_alpha; Domain location=299-384; Score=204.8; E_value=2e-58; Accession=PF00766.10; Description =Electron transfer flavoprotein alpha subunit
  Pfam annotation: Domain name=TPP_enzyme_M; Domain location=302-416; Score=-29.1; E_value=0.043; Accession=PF00205.13; Description =Thiamine pyrophosphate enzyme, centra
  Pfam module annotation: Pfam domain module=ETF::ETF_alpha::TPP_enzyme_ M; Domain location=30-200::299-384::302-416
MATRALLGAIKKRTVSFPAFRGHSIYRHGSTLVVAEHEGGFIKPPSLSALAAATCLPDPDSSVSVLLAGSGPSLHQAASHAASCHPSISKVLVADSDKFKNPLAEPWAKLVHLVHQSGGYSHIIAAASSFGKNVVPRAAALLDVSPITDVTGISDSNTFVSPELKTEKPVNLNYLGTFELREGIAIRAYLPYIDIFWVWIIRHQNRYESMMILTQLRTEIVIHAYRGRPIYAGNALCTVRYTGANPCILTIRSTSFPVPQNSVDSKSNEAPISQVDLSTFDEDLDKSRYISQTSQDDERPDLGNARIVVTGGRALKSAENFKLIEDLANKLGAAVGATRAAVDAGYVPNDLQVGQTGKIVAPELYMAFGVSGAIQHLAGMRDSKVIVAVNNDADAPIFQVADYGLVGDLFEVIPELMEKLPEKK

SEQ ID NO: 174694 - protein, 102 aa, Glycine max
  Coding DNA Sequence Number=SeqID_83009
  Subcellular localization annotation: CTP_CleavageSite=36; ConfidenceScore=5.79e-01
MGSPPASTLLPPPPSPPPPPPSDASASPSSVKRTRKASRLRSLSTRPPGAERPVVHVDPATGKADGPHRKKLRTYLGIVARDKVDITYENWKEVPTAQKDLI

SEQ ID NO: 174695 - protein, 217 aa, Glycine max
  Coding DNA Sequence Number=SeqID_83010
  Gene Ontology: Mol. function=transferase activity; Cellular component= endoplasmic reticulum; Biological process=vesicle-mediated transport
  Homolog annotation: Hit_ID=Q9FFV2; Match level="QueryCoverage=100%, HitCoverage=100%, E-value=3e-78, Identity=70%"; Hit description =Transport protein particle component Bet3p-like protein
  Pfam annotation: Domain name=TRAPP_Bet3; Domain location=37-204; Score=182.8; E_value=8.9e-52; Accession=PF04051.7; Description =Transport protein particle (TRAPP) component, Bet3
MPPVAPRSGDAIFANVERVVSNPYPKAKPSLCLNAELFTLTYGAIVRQLLTDLEEVEEGRENRNGKMKKIECKRCDQTRRKMGGYNIGIRLIDEFLAKSNVSRCNDFRETTDVIAKVGFKMFLGVTASVTNWDADGTCCSIVLEDNPLVDFVELPDNCQGLYYCNILSGVIRGALDMVSMKTEVTWLRDVLRGDDVFELQVKLLKHVPEEYPYKDDE

SEQ ID NO: 174696 - protein, 119 aa, Glycine max
  Coding DNA Sequence Number=SeqID_83011
  Homolog annotation: Hit_ID=A7P0Y7; Match level="QueryCoverage=61%, HitCoverage=17%, E-value=8e-21, Identity=64%"; Hit description =Chromosome chr19 scaffold_4, whole genome shotgun sequence
  Pfam annotation: Domain name=PPR; Domain location=35-69; Score=31.7; E_value=2.7e-06; Accession=PF01535.11; Description=PPR repeat
MLLVPHRLDVVRVWFEGAYRMIADLEDMNFKPTTNMYNAIMAGYFREKNIRGGLRVLNQMRGANVKPDSHTFYYLIQNCETEEDIIKLCINLLPFGTIDYCHRIGGSGEVVLVPFATNP

SEQ ID NO: 174697 - protein, 566 aa, Glycine max
  Coding DNA Sequence Number=SeqID_83012
  Pfam annotation: Domain name=RRM_1; Domain location=54-124; Score =19.2; E_value=0.0025; Accession=PF00076.13; Description=RNA recognition motif. (a.k.a. RRM, RB
MSASQIYLNSHEVIERERVRLRVDSRRTHVGNRDGQQQCYNQTNWRDQNEISSFYFTRFSDNVTKKELWYQFKKWGDVREIFISKQRNKDGRRYGFIRFKGVHDMHILERQLDSIVIRGMKLYVNIPKYGRERGRKTNSEDKQKGQEQRNENEASRSTQRCTRTNQASYAEVVARKAHISPKYMGDDMVLLLGLTDTKAEQLIQEEIHETPPLFYTLQKWNPSLCPGYGLTWVQCWGIPLLAWDTMQIKKIVVEVDDDVDERRRLDRARVLIKTPWKPAIQHTLNVYIDSEVYEVRILEECGYSTDICHCRRSSVMVSPEEIDSDGSFMGSPIKERTHASEKDDAARDTETPATTRAHYGAIAEPIAEVRQKGNKEDSTMGMVAEWAARQSMWTEINHLDVEIYKGHEVGELSWKEKEARDPMWKRKLVQMSWAFLFTPLLKPQHPMVGCANSEAHNTESRLNITSTQQQQNKISAQQQQVTDRDKGGKGYNHNLVHREVLSVQDAVEDASLGENNMQHATKIWEIAKHLGATGAADQGRIIGKIMTMEERDRKEAKRLGNRSDNP

SEQ ID NO: 174698 - protein, 788 aa, Glycine max
  Coding DNA Sequence Number=SeqID_83013
  Homolog annotation: Hit_ID=A2Q4W6; Match level="QueryCoverage=40%, HitCoverage=47%, E-value=1e-13, Identity=20%"; Hit description=RNA -binding region RNP-1
  Pfam annotation: Domain name=RRM_1; Domain location=62-132; Score =42.4; E_value=1.6e-09; Accession=PF00076.13; Description=RNA recognition motif. (a.k.a. RRM, RB
MERESRKRNSGWERVRSRREKRESARARTTEGSGLTIEGRTTGQDHSYMRANWRDHRDITSFYFTRFPEDATAEDLWHHFKQTGDVREVFIPRKRNRQGRRYGFVRFKGVRDIQQIQKKLDSMIFGGMKMYVNVPKYGRAKKEEPQTEEGGRTEARQQQQGKKDMYLSRNAETKVGVQRGSYADMVTRNNQRAEQRRVPVKVSDNSHNSTSEVILDIPLTGQQWLKEAWVGRLQNLASFESLEDEIWWDSGQNISLKYIGGDMVLILGLTVEKAERMLNNKDEGWGELFYSIEKWNPKLWPGFRLTWLQCWGIPLVAWDRHHIQQIVLGIGDVVDVEDCVEERRSLEVARILVKTTWKPLIQHTVNVNIQGEKFQVHVAEECGYSGDRRQQRRGSDFSSSEEIISEEGEDEVSIGGVFQSRWHRFRVTDSAAGRKTVDEDGGVEAIGTEEDTTTGAKEQEDDARHRRDNEDPAKSETGARGMRDMTGGAVTDSVEEEMTARGEECRRPLPSNPLEPLPSGTDSADQNNGVSGQSSGPVDNANVQWVSKGTDTVQTKALHAQSCSAVAAEVQGKGVHETGDEQNLGNCDSTVITHSLHENGKREETVNVGGEEFEEGQCNFKSAIQRSRDLEIKGPMDLGLAIHTPSKVVSIHNKSPASREARFSTPWLVYSRKKGKDKNTAHTATGAIMNQINISLVFFDNEPSQQKNDESGLQHQQLNMDQSLTQQRLNIQNQAENQDHYAESVWNMVTELGLTTGTSKRNYVQMLEEMEERDGEEAASLGIKRWTP

SEQ ID NO: 174699 - protein, 1402 aa, Glycine max
  Coding DNA Sequence Number=SeqID_83014
  Gene Ontology: Mol. function=transmembrane receptor activity; Cellular component=intrinsic to membrane; Biological process=innate immune response
  Homolog annotation: Hit_ID=Q9FVK4; Match level="QueryCoverage=92%, HitCoverage=89%, E-value=0.0, Identity=75%"; Hit description =Resistance protein LM17
  Pfam annotation: Domain name=LRR_1; Domain location=1299-1324; Score =6.3; E_value=21; Accession=PF00560.24; Description=Leucine Rich Repeat
  Pfam annotation: Domain name=LRR_1; Domain location=384-405; Score =13.3; E_value=0.92; Accession=PF00560.24; Description=Leucine Rich Repeat
  Pfam annotation: Domain name=LRR_1; Domain location=407-427; Score =13.7; E_value=0.71; Accession=PF00560.24; Description=Leucine Rich Repeat
  Pfam annotation: Domain name=LRR_1; Domain location=429-450; Score =7.7; E_value=12; Accession=PF00560.24; Description=Leucine Rich Repeat
  Pfam annotation: Domain name=NACHT; Domain location=944-1097; Score= -12.4; E_value=0.00055; Accession=PF05729.3; Description=NACHT domain
  Pfam annotation: Domain name=NB-ARC; Domain location=906-1190; Score =100.9; E_value=4e-27; Accession=PF00931.13; Description=NB-ARC domain
  Pfam annotation: Domain name=TIR; Domain location=26-163; Score =139.9; E_value=7.2e-39; Accession=PF01582.11; Description=TIR domain
  Pfam annotation: Domain name=TIR; Domain location=558-698; Score =135.5; E_value=1.5e-37; Accession=PF01582.11; Description=TIR domain
  Pfam annotation: Domain name=TIR; Domain location=754-884; Score =145.9; E_value=1.1e-40; Accession=PF01582.11; Description=TIR domain
  Pfam module annotation: Pfam domain module=LRR_1::LRR_1::LRR_1::LRR _1::NACHT::NB-ARC::TIR::TIR::TIR; Domain location=1299-1324::384 -405::407-427::429-450::944-1097::906-1190::26-163::558-698::754-884
  Subcellular localization annotation: CTP_CleavageSite=22; ConfidenceScore=5.07e-01
MASNAIIQYGSSSSSSSHAIITASDVFVSFRGEDTLNNFTVFLFDALSQNGIDAFKDDTHLQKGESIAPEVLQAIEESLLFLVVFSKNYASSTRCLRELAHICNCTDEASPSRVLPVFYDVDPSEVRKQSGYYGIAFAEHERRFREDIEKMEEVLRWREALTQVANISGWDIRNKSHPAMIKEIVQKIKYILGPKFQNFPNGNLVGMESRVEELEKCLALELVGDVRVVRISGIGGIGKTTLALAFTGGTDTLLSECLGEGSRIVIICKDEQLLRTHEVYHVYRVQPLNRHIAVQLFCKNAFKCDYIMSDYETLTHDVLSHAQGHPLAIEVISKSLHCRNVSQWRGRLVRLSDKVSKHTLKVLGIRSFCNPVRCLFPSFSIFSCIRELDLSFCNLLKIPDAFGNLHCLERISLSGNNFETLPSLKELSKLLRLDLRHCKRLKYLPELPSQTDWRPSDIRLSSLQDDESDDESDHLRLFYYTRSHFDVSNFDELKVESRFRDLYDQDLDVEVKKCGYDRVYVRDLEPSLNTGIGKRKRGFDYEDLIKDVPSSSSFTNDVFLSFRGEDTRYSFTGNLCRALRDSGIHTFVDDDELQRGDEITSELEKEIEDSRFFIIVLSQNYASSSFCLNVLAYILECVKRKRLLVLPIFYKVDPSSIRFHGGSFGEALANHEMKFKAKMDGLEHNMEKLEKWKMALHETANFSGYHFKQGDGYEYEFITRIVELVSSKIKQYPFHVGDYRVGLESYSEAFNYDVFLSFRGSDTLHGFTGYLYKALHDRGIHTFIDEDLKRGEEITPEIVKAIEESRIAIIVLSINYASSSFCLDELATILDCLERKRLLVLPVFYNVDHYQVLGGSYVEALVKHGKSLKHSMEKLEKWEMALYEVADLSDFKIKHGARYEYDFIGEIVEWVSSKINPAHYPVGLGSKVLEVRKLLDVGRDDGVHMLGIHGIDGVGKSTLAREVYNKLISDHFDASCFIENVREKSKKHGLHHLQNILLSKILGEKDINLTSAQQEISMMQRHRLQQKKVLMVLDDVDRPEQLQAVTGKPAWFGPGSKVIITTQDKQLLTSYDINRTYEVKKLNKDDALQLLKWKAFKMHYFDPRYKMLLNRAVTFASSLPLTLEILASYLFGKSVKEWKFTFHQFVRSPNNPMEMILKVIFDSLKEKEKSVLLDIACYFKGYELTEVQDILHAHYGQCMKYYIDVLVDKSLVYITHGTEPCNDTITMHELIAKEIVRLESMMTKPGECRRLWSWEDVREVFLGYKTATSKIEIICLDYPIFDEEEIVQWDGTTFQNMQNLKTLIIRNGNFSKGPEYLPNSLRVFEWWGYPSHCLPSDFHPKELAICKLPCSRISTTELTNLLTKFVNVKRLKFSSEKQWLKQEDGEEKAGSIVSSKVERLCA

SEQ ID NO: 174700 - protein, 240 aa, Glycine max
  Coding DNA Sequence Number=SeqID_83015
  Gene Ontology: Cellular component=cytoplasm
  Homolog annotation: Hit_ID=A7R0F6; Match level="QueryCoverage=38%, HitCoverage=24%, E-value=1e-28, Identity=69%"; Hit description =Chromosome undetermined scaffold_306, whole genome shotgun sequence
  Pfam annotation: Domain name=HABP4_PAI-RBP1; Domain location=3-70; Score=28.5; E_value=2.5e-05; Accession=PF04774.6; Description =Hyaluronan  mRNA binding family
NETAKNFGDEKQNPSDEDDVAADGNKENPTNEAEQKEPENKEMTLEEYEKVLEERRKAFHALKTEERKVDTKVFESLQHLSNKKDNDDIFIKLVELVLAQFRRAKGRVDEPAVRLYEDMLSVYNNSSDAATELMNDPVIVSTGQENGEESFEELQQLFEDMFQADIGLDGGPSLASSDSSTSSAYMTYSESSSSNKRNSSEMNFGKAENSSVFDAKSASYYISAYVTTDVEVSMFNIVAF

SEQ ID NO: 174701 - protein, 114 aa, Glycine max
  Coding DNA Sequence Number=SeqID_83016
  Gene Ontology: Mol. function=ATP binding; Cellular component =cytoplasm; Biological process=protein folding
  Homolog annotation: Hit_ID=A2Q4J1; Match level="QueryCoverage=55%, HitCoverage=70%, E-value=2e-16, Identity=65%"; Hit description=GroES- like
  Pfam annotation: Domain name=Cpn10; Domain location=1-85; Score=3.0; E_value=0.00052; Accession=PF00166.12; Description=Chaperonin 10 Kd subunit
MVLSNSVPHKAPTTMRMTKNWSRLNSEKVIAVGPGFHSKNGKLIPVAVKEGDTVLLPEYGGTEVKLDNKDLFYTLIQFFNFILKFNMQIKRKMKGRESLTIRACKKDMKWRERN

SEQ ID NO: 174702 - protein, 45 aa, Glycine max
  Coding DNA Sequence Number=SeqID_83017
MSFLTDVKSTLCSSEEEGEEKAGSTVSSKDLHEAGNTLSFARSNI

SEQ ID NO: 174703 - protein, 146 aa, Glycine max
  Coding DNA Sequence Number=SeqID_83018
MDRTGQVIVCLDTECDFASKITSSTGIRTSFWCHCRGGEASAAHEPQPEPKAVAQEADPDAYPEATPDIPKGDPETDLAAQENTIEATPKMTLQASPVTTHGLELSSPQASPVAAHVLELSEEEDEATYMDYAAAQDDPSPGPQDP

SEQ ID NO: 174704 - protein, 390 aa, Glycine max
  Coding DNA Sequence Number=SeqID_83019
  Gene Ontology: Mol. function=transmembrane receptor activity; Cellular component=intrinsic to membrane; Biological process=innate immune response
  Homolog annotation: Hit_ID=Q8H6S7; Match level="QueryCoverage=100%, HitCoverage=69%, E-value=1e-170, Identity=74%"; Hit description =Resistance protein KR3
  Pfam annotation: Domain name=NACHT; Domain location=53-182; Score= -31.4; E_value=0.017; Accession=PF05729.3; Description=NACHT domain
  Pfam annotation: Domain name=NB-ARC; Domain location=20-289; Score =75.6; E_value=1.6e-19; Accession=PF00931.13; Description=NB-ARC domain
  Pfam module annotation: Pfam domain module=NACHT::NB-ARC; Domain location=53-182::20-289
MEKWRTALHEVTYLAGFPFKDGLRYVADHPVGLDSQVPTIRMFVKAESSNAISMIGIHGMGGVGKSTLAGAVYNLHTDDFDDSCFIQNDINLASEQQGTLMIKNKLRGKKVLLVLDDVDEHKQLQAIVGNSDWESKSGTRVVLIITTRDKQLLTSYGVKITHEVKELDTDDAIQLLKWKAFKTYDEVDQSYKQVLNDVVTWTSGLPLALEVIGSNLFGKSIKVWESAIKQYQRIPNQEIFKILKVSFDALEEEEKSVFLDITCCVKGHKRTEIEDILHSLYDNCMKYHIEVLVDKSLMQISDNDRVTFHDLIENMGKEIDRQKSPKEIGKRRRLWLLEDIIQVLEDNPGTSEVKIIRLDFPISDKQETSIEWNAFNDMENLKALIIRNDI

SEQ ID NO: 174705 - protein, 131 aa, Glycine max
  Coding DNA Sequence Number=SeqID_83020
  Homolog annotation: Hit_ID=A7P221; Match level="QueryCoverage=85%, HitCoverage=45%, E-value=6e-13, Identity=56%"; Hit description =Chromosome chr19 scaffold_4, whole genome shotgun sequence
MVEIIYDANLKDEGNIVSDPSRKTAILEAKSKEFQGLSPSHFITVLRHTVRSIINFVRLIVDDMRYAGWDIDATVDAIEQNVVYMAEDHKCFTKMAKRVWLLHCLAFSYEPQASIFQVGKWCIFSDVYMEV

SEQ ID NO: 174706 - protein, 339 aa, Glycine max
  Coding DNA Sequence Number=SeqID_83021
  Homolog annotation: Hit_ID=A5BUF0; Match level="QueryCoverage=54%, HitCoverage=49%, E-value=1e-09, Identity=25%"; Hit description =Putative uncharacterized protein
  Subcellular localization annotation: CTP_CleavageSite=51; ConfidenceScore=5.52e-01
MAEPSKKKKGIVTSFAVTGTRSHGTSKAQTSQILPSISSPTLFSSEEQRIRYNSLFSSRSIIDPKFVDLAFSNDEVFDCFQAFQNSGLIQFISMKLPFYPKLVKAFYSNLEIQEDSLISEVYGIKMVIDQSLFFDLTQLSSDSVPFEGSLDDELKFDFSVSDACRMVCTNQADMTGRLLADSLAFECRIMHYLIVHILLPRSSNLAQVSEEDLIIMWVFLTGRQINWALLRSFSIGANVVSSFGYRKEKDGSWVKKDAPVQAAEDRCPSPHSHRDDSSSLMHNILERFDELQTYVGERFDALERQVDTRFDKMDSRITKVEEDVTIIRDCLDLPPPPSV

SEQ ID NO: 174707 - protein, 121 aa, Glycine max
  Coding DNA Sequence Number=SeqID_83022
MLSRNRVRQYLLCSDPVAVTGDTEPIRMESISTDKMKNNYHMAAAVNQTKAERNVIKSWPSKEKRKELKSLLLHPSVWESESLPEEVCFLLANVPAEIFELEKSEKARMVHSHGKTEKKST

SEQ ID NO: 174708 - protein, 1227 aa, Glycine max
  Coding DNA Sequence Number=SeqID_83023
  Gene Ontology: Mol. function=transmembrane receptor activity; Cellular component=intrinsic to membrane; Biological process=innate immune response
  Homolog annotation: Hit_ID=Q9FVK4; Match level="QueryCoverage=92%, HitCoverage=89%, E-value=0.0, Identity=69%"; Hit description =Resistance protein LM17
  Pfam annotation: Domain name=NACHT; Domain location=204-358; Score =1.5; E_value=4.5e-05; Accession=PF05729.3; Description=NACHT domain
  Pfam annotation: Domain name=NB-ARC; Domain location=164-466; Score =64.4; E_value=3.7e-16; Accession=PF00931.13; Description=NB-ARC domain
  Pfam annotation: Domain name=NB-ARC; Domain location=764-1068; Score =65.3; E_value=2.1e-16; Accession=PF00931.13; Description=NB-ARC domain
  Pfam annotation: Domain name=TIR; Domain location=13-145; Score =134.3; E_value=3.5e-37; Accession=PF01582.11; Description=TIR domain
  Pfam annotation: Domain name=TIR; Domain location=414-554; Score =130.1; E_value=6.4e-36; Accession=PF01582.11; Description=TIR domain
  Pfam annotation: Domain name=TIR; Domain location=610-742; Score =147.4; E_value=4.1e-41; Accession=PF01582.11; Description=TIR domain
  Pfam module annotation: Pfam domain module=NACHT::NB-ARC::NB -ARC::TIR::TIR::TIR; Domain location=204-358::164-466::764-1068::13 -145::414-554::610-742
MAATTRSLASYDVFLSFSGLDTLYGFTGNLYNALYDRGIYTFIDDQERSRGDEIAPALSKAIQESRIAITVLSENYAFSSFRLNELVTILDCKSEGLLVIPVFYNVDPSDVRHQKGSYGEAMTYHQKRFKANKEKLQKWRMALHQVADLSGYHFKDGDSYEYKFIGSIVEEVSRKISRPSLVGLESQVTEVMKLLDVGSHDVVHIIGIHGMGGSGKTTLAREVYNLIALHFDESCFLQNVREESNKHGLRHLQSILLLELLGEKNITLTSWREGASMIRHRLRQKKVLLILDDVDKHKQLRAMVGRSGWFGAGSRVIITTRDKHLLKYHGVERTYEVEVLNHNTALQLLTWNAFKREKIDPSYEDVESALEHYKRSPGNEIILEILKVSFDALGEEQKNALKHVPSSSSFTNDVFLSFRGEDTRYSFTGNLCRALHDSGIHTFVDDEELQRGDEITSELEKEIEDSRFFIIVLSQNYASSSFCLNVLAYILECVKRKRLLVLPIFYKVDPSNIGYHRGSFGEALANHEMKFKAKMDGLEHNMEKLEKWKMALHETANFSGYHFKQGDGYEYEFITRIVKLVSSKIEQDPFHVGDYPVGLESYSDAFNYDVFLSFRGSDTLHGFTGYLYEALHDSGIHTFIDEDLKRGEEITPAIVKAIEESRIAIIVLSINYASSSSCLDELATILDCLKRKRLLVLPVFYNVDHSQVRLQEGSYGEALVKHEESLKHSMEKLEKWKMALHQVANLSDIKIKHGARYEYDFIGEIVEWVSSKINPAHYPVGLRSKVLEVRKLLDVGRDDGVHMLGIHGIDGVGKSTLAREVYNKLISDHFDASCFIENVREKSKKHGLHHLQNILLSKILGEKDINLTSAQQVISMMQRHRLQQKKVLMVLDDVDRPEQLQAVTGKPAWFGPGSKVIITTQDKQLLTSYDINRTYEVKKLNKDDALQLLKWKAFKMHYFDPRYEELLNHAVTYASSLPLTLEILASNLFGKSEKEKSVLLDIACCFKGYELTEVQDILHAHYGQCIKYYIDVLVDKSLVYISHGTEPCNDTITMHDLIAEEIVRQESMTKPGERRRLWSLEDVREVLGYNTATSKIEIICLDYPIFDEEEIVQWDGTAFQNMQNLKTLIIRNGNFSKGPEYLPNSLRVFEWWGYPSHCLPSDFHPKELAICKLPCSHISTTELTNLLTKFVNVKLLKFSSEKQWLNQEDGEEKAGSIVSSKVERLCA

SEQ ID NO: 174709 - protein, 72 aa, Glycine max
  Coding DNA Sequence Number=SeqID_83024
MRSFNGDFPPWRCNERQRRRGERKRQPLGNKPWKKELHHQECALDKKLGEDVSMKEKKETEKERGGRGGAQN

SEQ ID NO: 174710 - protein, 104 aa, Glycine max
  Coding DNA Sequence Number=SeqID_83025
MAKNTSSNETYPPTLIPKTIPKLQNSLRVGKWNIGSKGLSKELIQGRLIWLEAYKNKIPKSFLNMHVNQEVSTRVKPRLLCKQSMGQNTPNKIDDDDGSKSHQG

SEQ ID NO: 174711 - protein, 73 aa, Glycine max
  Coding DNA Sequence Number=SeqID_83026
MECDAILPPRVLDRRLQEDWARVAKEGPGVLMNLGLSSSFSRNLLKEASQGSFSRKLLKEVSLVIRGVYVAKL

SEQ ID NO: 174712 - protein, 54 aa, Glycine max
  Coding DNA Sequence Number=SeqID_83027
MAPPKEIATVIYHNGHIVDNPVQGSVVKHIIFQHNYLIMMISEAQWKQLSKIHN

SEQ ID NO: 174713 - protein, 43 aa, Glycine max
  Coding DNA Sequence Number=SeqID_83028
MIARPGELLLHLEATLLAQASSARPATGVKHLNSASKNQNVSK

SEQ ID NO: 174714 - protein, 485 aa, Glycine max
  Coding DNA Sequence Number=SeqID_83029
  Gene Ontology: Mol. function=sugar:hydrogen symporter activity; Cellular component=integral to membrane; Biological process =carbohydrate transport
  Homolog annotation: Hit_ID=Q40373; Match level="QueryCoverage=94%, HitCoverage=93%, E-value=1e-163, Identity=59%"; Hit description =Sugar transporter
  Pfam annotation: Domain name=MFS_1; Domain location=18-412; Score =64.8; E_value=2.8e-16; Accession=PF07690.7; Description=Major Facilitator Superfamily
  Pfam annotation: Domain name=Sugar_tr; Domain location=23-460; Score =499.6; E_value=3.7e-147; Accession=PF00083.15; Description=Sugar (and other) transporter
  Pfam module annotation: Pfam domain module=MFS_1::Sugar_tr; Domain location=18-412::23-460
MASGHMEALVGYPGKLTLRVVLTCVMAATGGLIFGYDHGVSGGVTSMDSFLKEFFPSVYEQESTMKASTDSYCKFNSQILTLFTSSLYLTALVAGLVASSITRLMGRRATMIIGGIFFVLGALLNGLATGLWMLIVGRMLLGFGIGCANQSVPIYVSEMAPYKYRGGLNICFQLSITIGIFIANLFNYYFAHILDGQGWRLSLGLGAVPAVIFVVGSICLPDSPNSLVERDRLEEARKELQKLRGTTEVDAELNDIVAASEASKKQFTGLNVITFYAPILFRSIGFGSTASLMSAVIIGSFKPISTLISILVVDKFGRRSLFLEGGAQMLICQITMAIAIAVAFGTSGNPGTLPKWYASVVVGVICVYVSGYAWSWGPLGWLVPSEIFPLEIRPAAQSVTVCVNMISTFIVAQFFTTMLCHMKFGLFIFFGCFVVIMTIFIYKLLPETKGIPIEEMTMVWQKHPIWSKFLDSNKSVQISNQDSKC

SEQ ID NO: 174715 - protein, 167 aa, Glycine max
  Coding DNA Sequence Number=SeqID_83030
  Homolog annotation: Hit_ID=A5BSC1; Match level="QueryCoverage=85%, HitCoverage=9%, E-value=9e-17, Identity=29%"; Hit description =Putative uncharacterized protein
  Pfam annotation: Domain name=zf-CCHC; Domain location=108-125; Score =27.5; E_value=4.8e-05; Accession=PF00098.14; Description=Zinc knuckle
MVVGNATIEKPREEWDDDERRKLQEHEMGLMRLHQHEENDKKRKGIAFKASSSSIQEESDKEDLNEIEEDDDFRFFVKRFNKFLRNKRNQRKLNTNPKKKGEDSSLAPKCYECDQPGHLRFDCPTMKAEKSWHIDSGCSKHMAVDASKIIHISPKDSEYVIYGDNKQ

SEQ ID NO: 174716 - protein, 273 aa, Glycine max
  Coding DNA Sequence Number=SeqID_83031
  Homolog annotation: Hit_ID=Q2HTA0; Match level="QueryCoverage=23%, HitCoverage=9%, E-value=4e-08, Identity=46%"; Hit description=IMP dehydrogenase/GMP reductase, related
  Pfam annotation: Domain name=DUF1723; Domain location=88-134; Score =28.7; E_value=2.2e-05; Accession=PF08330.1; Description=Protein of unknown function (DUF1723)
MTASPYRDANLARQQQQQSLEVQVEPKAQLEIPHVDCIIGLLFGGGPMDLSVLQSYTDHMVGHVWIDQLREEMKLKSLFDAWYTFAIKGIINAFIERWFSYTYSFHLLVGEMTITFNDVSCLLHLPISGRCCNKKWKLSVFDLATKAYLLRFLDNTIFADKSLTHLIFMISCRIRACMAASSGQLYDATNAWVFKHLPTIPCHKKVLDFDRKLREKPLATKWLPLRGTGKVVENRELLDLLQMTDVMSSHIWIAKTSNLWRSRHISLATSELG

SEQ ID NO: 174717 - protein, 108 aa, Glycine max
  Coding DNA Sequence Number=SeqID_83032
MWTIIDRYKEKLNLAASHEQRLEDEHSKVSALQVEREARERMIDSLHGEAMTWMDRFVFTLNGSQELPRLLAKAKAMADVYSAPKEVRGLFNYCQHMIDLMSHIIRNR

SEQ ID NO: 174718 - protein, 68 aa, Glycine max
  Coding DNA Sequence Number=SeqID_83033
MLPFDFRCATETYGLCINIFLVFRHVLEFHKLPNDGCQAPHKDQRMVACHQAKSWPSLVQQEESTDNA

SEQ ID NO: 174719 - protein, 67 aa, Glycine max
  Coding DNA Sequence Number=SeqID_83034
MTGELILVATCPSAGGRRVTHGMRVPRKEYARSRHQRLFEENVGKTGKDAIYELLSERFGSCIYARG

SEQ ID NO: 174720 - protein, 149 aa, Glycine max
  Coding DNA Sequence Number=SeqID_83035
  Subcellular localization annotation: CTP_CleavageSite=15; ConfidenceScore=5.41e-01
MATPPASPPPPPSVVALVSPSTLKWKCKVTRLRSLATRLPGVERPVVHVDPAIGKANGPHKKKLRTYLGIIARDKVDVTYETWKEVPAAQKDLIWEDIQDSVDDTVSEKYDISKEKWAQFCQTHRDPSWEKKAQAIQKQNTALHVLSRG

SEQ ID NO: 174721 - protein, 99 aa, Glycine max
  Coding DNA Sequence Number=SeqID_83036
  Homolog annotation: Hit_ID=Q0KIL1; Match level="QueryCoverage=82%, HitCoverage=9%, E-value=8e-07, Identity=38%"; Hit description =Gag/pol polyprotein, 3'-partial, putative
  Pfam annotation: Domain name=G-patch; Domain location=32-76; Score =20.6; E_value=0.00061; Accession=PF01585.14; Description=G-patch domain
MEESLETSFQSFEVVSIASVDSFTGQPCQSDTTVMVARVMLGNGYEPGMGLDKNNGGRTYLISTRGNRGKFGLGYKPTQADIRKSVVGRKSGSQGSQLG

SEQ ID NO: 174722 - protein, 74 aa, Glycine max
  Coding DNA Sequence Number=SeqID_83037
  Subcellular localization annotation: CTP_CleavageSite=45; ConfidenceScore=5.45e-01
MLRVCMKWPRGSLPQRGPGRIKRPKEPVPLPSMTATALGVLNTSSASRPSGVGHFSGSDASSSGTMSMPISRGR

SEQ ID NO: 174723 - protein, 341 aa, Glycine max
  Coding DNA Sequence Number=SeqID_83038
  Gene Ontology: Mol. function=hydrolase activity
  Homolog annotation: Hit_ID=A1WCI0; Match level="QueryCoverage=37%, HitCoverage=35%, E-value=6e-49, Identity=71%"; Hit description =Putative uncharacterized protein
AAYSSALTSLSCCPVVASFFCMRPRGPGHHDGKGLFIGLEAQRDGHHVLDVFAERALPAALDAGLQVALEGGLAGEGGLGGLARAGGVHRLESARLVREADGLLGFGDDQIDHLVVRQLGQQGGFAGQVAHPRQHRLDHRVQRVAAADQGGDVDQLLRRVIAVFLADLVEIAARHHGLEQAMAAGQRNLHLRGDFAVQQWLLRLGKEEPRHMRWKNRPEGSNWGDFGPDDQRGCLNYITPANVMKGIQEVREGLSFCLSLPLDYPGGNGVNVRRHPPKLRPTERDGDQYLNFPLGRLRPGCVDVLSDDIVEMSLQYSTQWDSLAHVGALFDANGDGLPGIL

SEQ ID NO: 174724 - protein, 155 aa, Glycine max
  Coding DNA Sequence Number=SeqID_83039
MASRKRARTDDIPSSSIPALQSIAIEPDVQHPQTLVPMLQSLFRGQLIIMHSLRELAQNRPIVPLEYFLEKVAWPEAQLPLVRTDEVAPSEPTLARVEPMPAEPRTLVVNPPPSSELEVVPPSPPLIIISYASSDEAVAPTDSPAEETVDPLASL

SEQ ID NO: 174725 - protein, 54 aa, Glycine max
  Coding DNA Sequence Number=SeqID_83040
MDKSLKVGEDEWRKKERRSTKFCASNELWFSLLIQDQVQDSLPSVLRCHEACKA

SEQ ID NO: 174726 - protein, 146 aa, Glycine max
  Coding DNA Sequence Number=SeqID_83041
  Homolog annotation: Hit_ID=A5BCP7; Match level="QueryCoverage=32%, HitCoverage=33%, E-value=8e-07, Identity=58%"; Hit description =Putative uncharacterized protein
MNKRKPKKISFIPILVYGSNCFLIPQQKVVFEQCVTRTLSPALTLEEGLEKLKEALQILNYPSPSSPTVLRPSLCFAPNPTPPRSFLSFIKKGSFWFSIPQIELDELESVSILSMTLAWDEFSFSTFQEAHYSLQDSLDQVPDMPF

SEQ ID NO: 174727 - protein, 322 aa, Glycine max
  Coding DNA Sequence Number=SeqID_83042
  Gene Ontology: Mol. function=hydrolase activity, acting on glycosyl bonds; Cellular component=extracellular region; Biological process =metabolic process
  Homolog annotation: Hit_ID=Q7VZF2; Match level="QueryCoverage=71%, HitCoverage=60%, E-value=1e-100, Identity=77%"; Hit description =Membrane-bound lytic murein transglycosylase B
MASSLCGLSGCQLPISCKRHAGWVRYMVSIRKIMFICRRLLQLGTLSALLAGCSTTAPTAPNPAAGQPPAATTGTTPIRIGPSTPTLGSEPADDGPAALTPSGALRPEVRAFVEGLAAERDLPLKPMVAALESARYNATVARLIAPSPPGKKIWRSWLTYRSRFVEPKRIGWGVEFYNEHRDQLNQAAQRFGVPAPIIASIIGVETLYGRNMGNFRVLDALTTLAFDYPDPAKPERATMFRGQLADFLTLAMKGKLDMETRGSYAGAIGMPQFMPTSIKHYAVDGDDSGHIDLTNNTRDAIMSVGSFLSQHGWPRGLPVFAP

SEQ ID NO: 174728 - protein, 192 aa, Glycine max
  Coding DNA Sequence Number=SeqID_83043
  Gene Ontology: Mol. function=RNA-directed DNA polymerase activity; Biological process=regulation of transcription, DNA-dependent
  Homolog annotation: Hit_ID=A5BZZ9; Match level="QueryCoverage=95%, HitCoverage=19%, E-value=2e-20, Identity=34%"; Hit description =Putative uncharacterized protein
MPLRGRIASNKDTLRKYFYSPKNEPQRRWFFQHFKSSNRKQIQDKFYEFVEGVKIKVLSFDWFHAYTIRENIDYPWKQDNIGDSTTNVITNWQIKDGELIQSELPPTTQYQLLKVKDSNDKPVMASPFKTKDVNKEITSKDIKCLMEQANYTNKYLQVLGESIKTKATPKQKSHEESSSYIPIEKPLFKPFK

SEQ ID NO: 174729 - protein, 75 aa, Glycine max
  Coding DNA Sequence Number=SeqID_83044
MQALYLNCPQLNDLNLNSCRNLHPGSHFTPCSIAIISQKFDATLQIIQMYGLGFVSTGGFGMPSYFPFFPYTLLS

SEQ ID NO: 174730 - protein, 144 aa, Glycine max
  Coding DNA Sequence Number=SeqID_83045
  Gene Ontology: Mol. function=helicase activity; Biological process =viral genome replication
  Homolog annotation: Hit_ID=Q9C7W5; Match level="QueryCoverage=100%, HitCoverage=18%, E-value=1e-31, Identity=43%"; Hit description =Putative uncharacterized protein F15H21.18
MHTIEFQKRGLPHVHLLLFLHPDNKYPSSTDIDQIISAEIPSHQDDPELYRLVEKHMIRGPCGILQPNSPCMKEGKCSHFYPKQFQPQTLLDSNGYPVYRRRNNGHSISKNGYDRVTAVMFSDSNNAAQNVNIQNDELKEYLDC

SEQ ID NO: 174731 - protein, 51 aa, Glycine max
  Coding DNA Sequence Number=SeqID_83046
STLEDPTIVTAGLKDDWHKWFSDGSPLDVEAITTVRQKWATYFLTFRKSSC

SEQ ID NO: 174732 - protein, 289 aa, Glycine max
  Coding DNA Sequence Number=SeqID_83047
  Homolog annotation: Hit_ID=A4RTB0; Match level="QueryCoverage=29%, HitCoverage=19%, E-value=6e-19, Identity=52%"; Hit description =Lipoprotein Q-related gene
MHARVATRRAQTRRREFEQMFASTYNCIERVPITHMYRPEFGASNAFARARTSTSLRSDARFVSNSDHPSALGSGGDCGVRIQGSFTGAAISAPFDSADASFTLCENCAAALVGKAAAQHGLCYGHVDASVLRHVVCRTGAIASKNSRPRHQASDRLFWRQCVRLGEYAVVGSVWPMTTRESKCVSVSGDYAVVGAPGDNSNAGSAYISAIKFENRAALKAAVDNCLAADDTGNCDCSSASVDCGAAGSLPISQWDTSLITDMNHLFYDESSFDANISAWNTAKVTKMD

SEQ ID NO: 174733 - protein, 137 aa, Glycine max
  Coding DNA Sequence Number=SeqID_83048
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=37%, HitCoverage=50%, E-value=4e-24, Identity=100%"; Hit description=LacZ protein
MAPKCKSSDAGNLERTKHPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 174734 - protein, 153 aa, Glycine max
  Coding DNA Sequence Number=SeqID_83049
MAKTKSRERSPYHRVANALHKKGLVAFAFPVGWRNPMNKLTAEIALRNINLLKEMQSAPNIGLSMRSELFLQALEIALPILEQQEKGEMAILMRGGATHPFGRIKNTISLMVKLRAYVAEGIGSMNFPEIAQDGKVTKELNAANVSEEWKKWD

SEQ ID NO: 174735 - protein, 49 aa, Glycine max
  Coding DNA Sequence Number=SeqID_83050
MGNYAQSSCYGPARPTRLDDINRSSSMIGKPCTVRLSGLGFSHGTRKLC

SEQ ID NO: 174736 - protein, 23 aa, Glycine max
  Coding DNA Sequence Number=SeqID_83051
MNVVSLLVRGSYYVISVFGLVRM

SEQ ID NO: 174737 - protein, 140 aa, Glycine max
  Coding DNA Sequence Number=SeqID_83052
  Homolog annotation: Hit_ID=A5B6M9; Match level="QueryCoverage=75%, HitCoverage=27%, E-value=8e-08, Identity=31%"; Hit description =Putative uncharacterized protein
EERKVPLATLIFQLYWWNFLVRERRIHGDPPVEYWNDLKSALRKRHDTSPSTMKGSLWTSSKGLDKGLWVLKKVKDKVELFPYRDLDDLVQLCIRVEQQLKRKPTSKSYGSYSYPEKDQGQGILGAAPSKLKDDKGRTIE

SEQ ID NO: 174738 - protein, 112 aa, Glycine max
  Coding DNA Sequence Number=SeqID_83053
ALITGLCQLFGVPVAPSKVIRQPITQAFIEKYCTQRQAQGGDPQAPDAPPPPPQADPAGSFDTEREEVAWPGDWPEAQAAEASAEAPGEPDEAREDEEMSDLLGFLGGSGAT

SEQ ID NO: 174739 - protein, 142 aa, Glycine max
  Coding DNA Sequence Number=SeqID_83054
  Subcellular localization annotation: CTP_CleavageSite=54; ConfidenceScore=5.09e-01
MQRTDIVFGTFCSRGNNKSFAYGNFNGHPRLSSTERNEISVLSLLSWCLAPIIRQFVKFRDMPKKKRKIDAQSVRFRDTPEIKWKHRCTISEGGVLSKNGGANSNQAHLGPPEDSSRRLLLLEEATLLAWASWVASFSPNFL

SEQ ID NO: 174740 - protein, 181 aa, Glycine max
  Coding DNA Sequence Number=SeqID_83055
MGKAEEVQEQMKANMEAMKEKMATMMEAMISMKKIMEANAVAVAATSTVAKVNPMPPSGLNQMNHPTSAIVGKDLGSTGGPHYVQIQNKHAFPPYGLPPNYTPPNVAYTPSENVNNSTPILIESRQPQTDHAHVSQPMGETHEMPHHNLADFEPCLGYATEGQAIDGIPLQNPLEGPQYHP

SEQ ID NO: 174741 - protein, 165 aa, Glycine max
  Coding DNA Sequence Number=SeqID_83056
MGLNQFRFFNMVHDILVKVKLEVTRTSMVLNVLGNRRSSDKWVYDPNMVGSWYLTHATKNAFVFILQRKTCAKAQLGDVHNMTISTNNHTAKAYTTFRSTCMAVLKMARNVFAPCPYFRDLHGRKLKGLLVIIPKVVISLLMVSRGIIPFEEHITAVGTTSNNML

SEQ ID NO: 174742 - protein, 89 aa, Glycine max
  Coding DNA Sequence Number=SeqID_83057
  Homolog annotation: Hit_ID=Q2R0G5; Match level="QueryCoverage=65%, HitCoverage=2%, E-value=3e-08, Identity=53%"; Hit description =Retrotransposon protein, putative, unclassified
MGTNAIKEEKRMMDTDASRVKEKSNDVSQQKDMLGLSRELVEHKLSICEGKKLVKQAPRRFALNVSKAIKAEIKRLLKAKFIRTTRYVD

SEQ ID NO: 174743 - protein, 136 aa, Glycine max
  Coding DNA Sequence Number=SeqID_83058
  Gene Ontology: Mol. function=acetylglucosaminyltransferase activity; Cellular component=membrane; Biological process=isopeptide cross -linking via N6-(L-isoglutamyl)-L-lysine
  Homolog annotation: Hit_ID=A7PF28; Match level="QueryCoverage=82%, HitCoverage=26%, E-value=2e-57, Identity=89%"; Hit description =Chromosome chr11 scaffold_13, whole genome shotgun sequence
MMLSRPFIEYCIWGWDNLPRIVLMYYANFLSSPEGYFHTVICNAEEFRNTTVNHDLHFISWDNPPKQHPHFLTVNDYQRMVDSNAPFARKFGRNEPVLDKIDTELLGQNADGKSVFLTPEFGMPIMLIAALPSSNS

SEQ ID NO: 174744 - protein, 181 aa, Glycine max
  Coding DNA Sequence Number=SeqID_83059
KLQNGGLRDFLHRILEEDYENSALIKVFLLVWGFCGKQWWLAAATSGRGWWKMRLSGGQLRWSSVAAWVGLMRNNVVDFMGGLACNLGGSSVLQHYREATYLVIEGCDELNDNFFIVRAIKEAIGPQMHISFKHIFREGNVVANVMAKFGLSMSQGILFFVDPSIRNRHGNEAQVQVFSDN

SEQ ID NO: 174745 - protein, 83 aa, Glycine max
  Coding DNA Sequence Number=SeqID_83060
  Subcellular localization annotation: CTP_CleavageSite=45; ConfidenceScore=5.16e-01
MPLRGRIASNSFMAMAGVCNITVSLEPQIPLPSRNLPLTAAPSVMQSYPARALDRRLQVDWAIDPREGPRVLMSLRVDFEPMG

SEQ ID NO: 174746 - protein, 196 aa, Glycine max
  Coding DNA Sequence Number=SeqID_83061
  Gene Ontology: Mol. function=serine carboxypeptidase activity; Cellular component=cellulose and pectin-containing cell wall; Biological process=proteolysis
  Homolog annotation: Hit_ID=A7QT61; Match level="QueryCoverage=51%, HitCoverage=20%, E-value=4e-34, Identity=66%"; Hit description =Chromosome chr1 scaffold_166, whole genome shotgun sequence
  Pfam annotation: Domain name=Peptidase_S10; Domain location=12-196; Score=-166.4; E_value=2.1e-05; Accession=PF00450.13; Description =Serine carboxypeptidase
MDKVEATEALIPNVRLKILTCGVTNYKKKYRCIQIYMDLFYYFVESKTDPASKPLILWLNGGPGCSSLGMGAFSKNGPFRPNGEVLIKNEYSWNKELLCDGETNMLYLETPVRVGFSYAKGGSSYDTVNDETTVASSIGTVVALKDKLGVCRWNYALRSLQHHAKNNIGSYSQARKLSSTSSTAVFNRILNKRKEM

SEQ ID NO: 174747 - protein, 82 aa, Glycine max
  Coding DNA Sequence Number=SeqID_83062
MAVRMSTALTETLWRALTERWPWSLSRCRKITMNPRDGIRRETTQRVRVRESVMKSYPPPPQGHWIEDYKKIGPEMQEKALG

SEQ ID NO: 174748 - protein, 65 aa, Glycine max
  Coding DNA Sequence Number=SeqID_83063
MVQLSAHRCAKPNIFTVVALSLNHSLLSAYCRKIFGVAESAKCCCCAKPQMLTGSYNFRLGLARG

SEQ ID NO: 174749 - protein, 196 aa, Glycine max
  Coding DNA Sequence Number=SeqID_83064
  Gene Ontology: Mol. function=4 iron, 4 sulfur cluster binding; Cellular component=mitochondrion; Biological process=metabolic process
  Homolog annotation: Hit_ID=Q6YNR9; Match level="QueryCoverage=66%, HitCoverage=16%, E-value=6e-35, Identity=55%"; Hit description =Putative aconitase
MDEQDLRIDQEEPSEYLLKLEAEAVMLGQTSVVLTIGEVIPMSMVLPGVVGFKLLGKLRDGEGMNELSLADHATIANMSPEYGVTMGFFDVDRVTLQYLRLTGRSDEIVSKIESYLRANKMFVDYSENPVSQVQKVSNYVMSNNIVECRSNVFQDYFDDAKESRVNKVSRIKIKIQDSRIKTQDSRIKRRLNQDKY

SEQ ID NO: 174750 - protein, 40 aa, Glycine max
  Coding DNA Sequence Number=SeqID_83065
MCRAGPIGATGRALRASALTRALVQGALGRTVVPGALKNT

SEQ ID NO: 174751 - protein, 616 aa, Glycine max
  Coding DNA Sequence Number=SeqID_83066
PIPLKLLRPLVQQYLREGNAYQEVWGKNYDSHVTKAVYQENDEKNLPFDLPHTIYINILRNLKGLDGLDNIYYSTLINKILWNQGVYHVFNKMYEDSKHTLISKGLVVAKQQKLSKTNLNVMKIALEQSLKEAHLVDLEAINKRKQKMLAKAIIDEDQGLNSFGIFRKIQKIMHRTKRRHKTTTSAPVHPPTTTSVPQRLKDLSETDEEDEGLVQTYQEEGNQGQPKIGDKEWAAAFTGNKEDSASSSSSSSSPSSYSEATPREPLTNAQRFRLAFINDNPTPETPYSESILYEPVARETIIVQAPTWTKHDCEHTPTEAFKALPINVIKGPFARSGTPKIEFQKKVHMWMPITKLLLVHPVDLNLSQEECSSLGKLHEQMYLKDHAIAHPLGLHILRATDIKMVADKVSPCLQKLIRTPDVYDARTLWNQIVWMDSKKAFTTGYDGSDNTEHHDVIQVLRPVRKYHFDDACVYFKKDKDEEEAVAIVVKEDVASVQAKVSAKVVDDTIVHGVIIDLTNTGVMDETLEASNATINGEVERNALELASKQSINEATSIDKGETNTIIVYSTNSDPTPLNYAQFTTVTRDQVQDMIRQAIETFAKQQCQENEQFKLSM

SEQ ID NO: 174752 - protein, 85 aa, Glycine max
  Coding DNA Sequence Number=SeqID_83067
MQVEMVVQKTKTEKTKGEKLRKKRNEQEDAEEGSGTGNTNMPKFTDQRQNKSPQGFIEVKSLLIYRKHALLLKSHPSPGTTSTGN

SEQ ID NO: 174753 - protein, 37 aa, Glycine max
  Coding DNA Sequence Number=SeqID_83068
MSAREKMQAVQQFLANRGMRLANDGSVRADIVVGIWA

SEQ ID NO: 174754 - protein, 179 aa, Glycine max
  Coding DNA Sequence Number=SeqID_83069
  Subcellular localization annotation: CTP_CleavageSite=28; ConfidenceScore=5.13e-01
SIQGARRERARPTELPSTSAAPTLASTSAAPSVPAQRSIPSVEQFLERVAWLRAQPSLYREDEGPTAQVPQHVEDESSEATILKPFIVEEEAGETQVRHEVAATPERSLKGTSKPPAPVVDLSSPQHAVDPSTPILEIPEDPTTPILTLNTSPSATPVLHLTDEEDVQTQDTQDQSQEF

SEQ ID NO: 174755 - protein, 106 aa, Glycine max
  Coding DNA Sequence Number=SeqID_83070
MSRNFTDCLTMGVKFLEAVKRRLHAIKQWSPDEIRLSSHATYSLTLDDKGAEFVYARLPPNLLLFNDKGKKCGTKMVPACHWARRLWMTKGAEDDVSLCVLSCFES

SEQ ID NO: 174756 - protein, 277 aa, Glycine max
  Coding DNA Sequence Number=SeqID_83071
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
GTSYVPINVSFSPKVSPELPEYQQRHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPVTTLNSIGALKPCDPQPKTYTLKSLQGLSLLIQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPEDT

SEQ ID NO: 174757 - protein, 309 aa, Glycine max
  Coding DNA Sequence Number=SeqID_83072
  Gene Ontology: Biological process=transposition, DNA-mediated
  Homolog annotation: Hit_ID=Q6UUU1; Match level="QueryCoverage=19%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSMMLYDIFYVWVLKLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPAFPPGGSLVRSPVPAFRFT

SEQ ID NO: 174758 - protein, 68 aa, Glycine max
  Coding DNA Sequence Number=SeqID_83073
MTKDIFVFEILPYRASLHATGHLSLTPEMRLFRDLGQKTLTSLGRVQMTTWVSACQRARLPLANERYG

SEQ ID NO: 174759 - protein, 83 aa, Glycine max
  Coding DNA Sequence Number=SeqID_83074
  Gene Ontology: Mol. function=phosphoprotein phosphatase activity
  Homolog annotation: Hit_ID=A5C0F5; Match level="QueryCoverage=86%, HitCoverage=11%, E-value=7e-14, Identity=48%"; Hit description =Putative uncharacterized protein
  Pfam annotation: Domain name=DUF1723; Domain location=2-42; Score =31.0; E_value=4.2e-06; Accession=PF08330.1; Description=Protein of unknown function (DUF1723)
MPLLKGGGQRHTFHLTHGEATITLQDVSVLLGLPVDDNPLIGSTNIDVIDMCEQYLGVRPNANALADGNTLKLSWLASEFANI

SEQ ID NO: 174760 - protein, 243 aa, Glycine max
  Coding DNA Sequence Number=SeqID_83075
MARRDKLWSFCAFYHPEAACPMTCGDKLWSFRTPFRHPEAIVSDGTQRQIMVILRLSIQARSCPMARKDKLWSFGALLSSRGGGLDGIWRQIMVIMHTFSPSRGDRVRWRAETNYVHSAPFHPGSIVSDGAQRQTMVILRPLSFKGSKSSDKRAETIYGHFAPFVIQGQHIKAASRVMNAQRRIMVILRPLSFKDSESSDKRVETNYGHSASFVIQGQRVEHDRVRWHAETDYGHSAPFVIQR

SEQ ID NO: 174761 - protein, 56 aa, Glycine max
  Coding DNA Sequence Number=SeqID_83076
MNKDLEVAATPEEEPRSSEASSSFPIPGQSHTDLIEEVIMAEEPRKVTLEDYSTST

SEQ ID NO: 174762 - protein, 68 aa, Glycine max
  Coding DNA Sequence Number=SeqID_83077
MVEASGNRLPVCVIDYTEEWVTGNRLPKGDEDPLPEVDSPEEVMSASEADSTEDSGPREMATNGGSSS

SEQ ID NO: 174763 - protein, 205 aa, Glycine max
  Coding DNA Sequence Number=SeqID_83078
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTHDSSFCFGGEGVGRSPLPHKKGLVFQSEHASLALAVVLQRRDWENPGVTNLIALQHIPLSPAGVIAKRPAPIALPNSCAA

SEQ ID NO: 174764 - protein, 359 aa, Glycine max
  Coding DNA Sequence Number=SeqID_83079
  Gene Ontology: Mol. function=protein transporter activity; Cellular component=membrane; Biological process=protein secretion
  Homolog annotation: Hit_ID=A4WA96; Match level="QueryCoverage=100%, HitCoverage=99%, E-value=1e-179, Identity=91%"; Hit description =Secretion protein HlyD family protein precursor
  Pfam annotation: Domain name=HlyD; Domain location=60-351; Score =125.4; E_value=1.7e-34; Accession=PF00529.11; Description=HlyD family secretion protein
MSQQDAAKEQANTRKNVRIVSVFTAAAIGIVGVLVILYAWQLPPFTRHAQFTDNAYVRGQTTFISPQVNGYITEVHVQDFVQVKKGDLLLQIDDRIYRQRVHQAEAQLAMKIAALNNNLQQRKSAEAVIAKNDAALKNARAQSLKTQADLKRVKELTADGSLSIRERDAALASAAQGSADIDQAKAALEMSRQDLQTVIVNRGALEADVENAKAALELAQIDLQNTRIVAPRDGQLGQIAVRLGAYVTAGTHLTTLVPPQHWVIANIKETQLAELRVGQPVKFTVDALNNKAYQGRVESISPATGVEFSAITPDNATGNFVKIAQRIPVRIEVLGKPEDSALLRPGMSVQVTIDTREAK

SEQ ID NO: 174765 - protein, 15 aa, Glycine max
  Coding DNA Sequence Number=SeqID_83080
MASMDTSAKVNSKIF

SEQ ID NO: 174766 - protein, 69 aa, Glycine max
  Coding DNA Sequence Number=SeqID_83081
MEENLPCIYALNASSARSTSSLSFLTLKLDRAGLDNYITGVRRDIRERGLNRVSPFTRGIGVWCIGPQH

SEQ ID NO: 174767 - protein, 31 aa, Glycine max
  Coding DNA Sequence Number=SeqID_83082
MASIKFGAIAGEQWAKETDSALLFTQHYISD

SEQ ID NO: 174768 - protein, 172 aa, Glycine max
  Coding DNA Sequence Number=SeqID_83083
  Gene Ontology: Mol. function=chitin binding; Cellular component =extracellular region; Biological process=chitin metabolic process
  Homolog annotation: Hit_ID=UPI00006A17C9; Match level="QueryCoverage =94%, HitCoverage=100%, E-value=8e-13, Identity=26%"; Hit description= UPI00006A17C9 related cluster
  Subcellular localization annotation: CTP_CleavageSite=57; ConfidenceScore=5.35e-01
MARMCGPLKVWVCDPLMATTCSPLKVSTYCPLMARTCSPLKARASSPLKTRTCSHLKASACRPLKVRVRDPLMARMCSPLKVWVRDPLMETTCSPLKVRACSPLIARTCSPLKARASNPLKTRTCSHLKASACIPLKVRVHDPIMARMCSPQKARACSPLKVRTCSTLKERA

SEQ ID NO: 174769 - protein, 133 aa, Glycine max
  Coding DNA Sequence Number=SeqID_83084
MVYHLRAPLMRTRSLISPVMMPAVKRSFSIRVGIVTSFRYRKERDGSWVKKDVPAHAVDDRSPSPPPQRDDSSSLMKSVLDRLDGLHTYVGERFDSLESRIDTRFADMDTRIDRLEEDVSFIRQCFDLPPPPS

SEQ ID NO: 174770 - protein, 81 aa, Glycine max
  Coding DNA Sequence Number=SeqID_83085
MMKEKKELPKGVFLGFRYVLECSNPKTTQIQGPMTKSRTKQSVDTLQQMVTDILNTAQVEKDEGPKAEALLRILIVVEGPN

SEQ ID NO: 174771 - protein, 316 aa, Glycine max
  Coding DNA Sequence Number=SeqID_83086
  Gene Ontology: Biological process=transposition, DNA-mediated
  Homolog annotation: Hit_ID=Q6UUU1; Match level="QueryCoverage=18%, HitCoverage=40%, E-value=5e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDRDLIQEHRQTSYIPTATLKLTIMQYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPAFPPGGSLVRSPVPAFRFTGVIP

SEQ ID NO: 174772 - protein, 189 aa, Glycine max
  Coding DNA Sequence Number=SeqID_83087
  Homolog annotation: Hit_ID=A5BU47; Match level="QueryCoverage=56%, HitCoverage=6%, E-value=3e-08, Identity=31%"; Hit description =Putative uncharacterized protein
  Subcellular localization annotation: CTP_CleavageSite=38; ConfidenceScore=5.86e-01
MGSPPASTPPPHPPPSPSSPPPPPPPTSDASASTSAVKRTRKASRLRSLSTRPPGVERPVVHVDPAIGKADGPHRKKLRTYLGIVARDKVDITYENWKEVPTAQKDLIWEDIQRLLTVGRKRKLLQTVGDRWRQFKSDLTRKWALATDQDGIEDTVCYKYGINKEKWAQFCQTRRDPSWEDVRMKAQTI

SEQ ID NO: 174773 - protein, 149 aa, Glycine max
  Coding DNA Sequence Number=SeqID_83088
MLGRSVETQGLGQRRESVDAEAHVIPAMPERQHGMYYTPDQFTQEPSQMSSLYPYPYQSGTSSDAYFIGTQPPLQPGYVMADLFGSLSPAGTPSFAHGCQISTPNAPMGPPWTVSGNIPNITDLLGIDFGNQFSVKADERKGDRRRNPD

SEQ ID NO: 174774 - protein, 89 aa, Glycine max
  Coding DNA Sequence Number=SeqID_83089
MVEDAGIALGNQFMGLRIRFEDLKVEDRRTALGITSWGSRLDGGGCMNSARQSILEMGESTHHSWGSRFDGGGIMNNARQSIHETPNKI

SEQ ID NO: 174775 - protein, 155 aa, Glycine max
  Coding DNA Sequence Number=SeqID_83090
MAPKKLSAKRSRRDATGEGSSAASEFDSHRFRSVKHQRRFEAIKGWSFHRERRVQLREDEYTDFQEEIARKRWTLLVTPTAKFDSEIVLEFYANAWPTEEGVQDMRSWVRGQRIPFDADVLSQLLGDPLVLEEGRQCKFSQRRNMADGFDEEAIT

SEQ ID NO: 174776 - protein, 259 aa, Glycine max
  Coding DNA Sequence Number=SeqID_83091
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTFWSAIAQSQLTATSAPIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 174777 - protein, 16 aa, Glycine max
  Coding DNA Sequence Number=SeqID_83092
MGSRGFLIHNQSSNVQ

SEQ ID NO: 174778 - protein, 231 aa, Glycine max
  Coding DNA Sequence Number=SeqID_83093
  Gene Ontology: Mol. function=protein binding; Cellular component =endoplasmic reticulum lumen; Biological process=response to stress
  Homolog annotation: Hit_ID=P30236; Match level="QueryCoverage=74%, HitCoverage=89%, E-value=3e-61, Identity=67%"; Hit description=22.0 kDa class IV heat shock protein precursor
  Pfam annotation: Domain name=HSP20; Domain location=109-213; Score =135.8; E_value=1.2e-37; Accession=PF00011.12; Description=Hsp20alpha crystallin family
  Pfam annotation: Domain name=WD40; Domain location=15-53; Score=25.1; E_value=0.00025; Accession=PF00400.23; Description=WD domain, G-beta repeat
  Pfam module annotation: Pfam domain module=HSP20::WD40; Domain location=109-213::15-53
MKYKLKVWDIRGHSTSLVWDIKEHEKSVTCFSLHESSDSLLRGSTDKTIRYWEFIQIPSWLPFTNHPNTLLGDLWSNHFPDPFQVLDQIPFGVHRDETITSLSSHARVDWKETPEGRVIMLDVPGLKRDAIKIEVEGNRVLRVSGERKRKEEKEGDHWHRVERSYGKFWRQFKVPDNVDLDFVKAKMENRVLTLTMNNLSPNKVKGPRLVSIAGDDEQAPKLKGNEDKQEL

SEQ ID NO: 174779 - protein, 147 aa, Glycine max
  Coding DNA Sequence Number=SeqID_83094
  Homolog annotation: Hit_ID=A5AWC6; Match level="QueryCoverage=61%, HitCoverage=18%, E-value=4e-09, Identity=38%"; Hit description =Putative uncharacterized protein
  Pfam annotation: Domain name=Retrotrans_gag; Domain location=55-129; Score=23.3; E_value=0.00029; Accession=PF03732.8; Description =Retrotransposon gag protein
MGRQRTGRNYPKSGKNIWRPSWGQSGISFGHKIYGSDQELDTTVNYHGREFNNIRVFQISLKGFALSWWHQLPSRMIDMFDTLVAPIILRQADNESLRDFMGRFSQIAVMIHDLELGVALHAMIAALKPGVFAYSLCKKQPMSMNKK

SEQ ID NO: 174780 - protein, 83 aa, Glycine max
  Coding DNA Sequence Number=SeqID_83095
MFIIFNSALKGLDDTPQPKSKAAARWIVVKCNRQKGSTECGYYVMHWMSTIILGSFRNNWKVTIGAREIKGASHPVGMILSPT

SEQ ID NO: 174781 - protein, 209 aa, Glycine max
  Coding DNA Sequence Number=SeqID_83096
  Homolog annotation: Hit_ID=Q84WV0; Match level="QueryCoverage=53%, HitCoverage=24%, E-value=2e-09, Identity=32%"; Hit description =Serine hydroxymethyltransferase
  Subcellular localization annotation: CTP_CleavageSite=15; ConfidenceScore=5.19e-01
MDLSHPQSNLSLGFSSSHASPPPRSNPPVSLQLMEPQTENGNLDVESDDDEDKEVEEFRILGHSICLKRRRDCDSSSSSFATKRVSVEPDLDTHNVVVRAWGCQPLYIGIVDDDHAMPMDMVIGGDERGSFDFVHKSGNDSRIICSKKGNIEDVALVFAQDKDRSLGTSCYLFGSPCNLMHDIHEWGDPRKKEFYFYMKSYSPVDNVKA

SEQ ID NO: 174782 - protein, 59 aa, Glycine max
  Coding DNA Sequence Number=SeqID_83097
MATEWRRKKDDWRRHFKEKMSQEEAHHHRKPWIRKGLKVGEDEWRDREKRSTKFCASNE

SEQ ID NO: 174783 - protein, 45 aa, Glycine max
  Coding DNA Sequence Number=SeqID_83098
MVMEKKGRRRRKGMNDARACVRKAEEGLSLIPSVYELPPKKNVVT

SEQ ID NO: 174784 - protein, 52 aa, Glycine max
  Coding DNA Sequence Number=SeqID_83099
  Subcellular localization annotation: CTP_CleavageSite=33; ConfidenceScore=5.03e-01
MEPGDRRGFLLSSSGDIQARRRTRFFSTGQGRSSAMAWGSVVVVPFYRFQRN

SEQ ID NO: 174785 - protein, 250 aa, Glycine max
  Coding DNA Sequence Number=SeqID_83100
  Homolog annotation: Hit_ID=UPI00006A2D9E; Match level="QueryCoverage =41%, HitCoverage=81%, E-value=6e-09, Identity=14%"; Hit description =UPI00006A2D9E related cluster
  Subcellular localization annotation: CTP_CleavageSite=46; ConfidenceScore=5.25e-01
RAARPRLVGATRPHLQGATRLHLQRATCPRLQRTARPRLHRAACPRLQRASRPHLRRSVCPHLQRIARPHHQRTARPHRQRATRPHLQRTARPQLRWLHALAFRGLYLLTFRGLQVLAFRGLHALAFRGLHVLAFRGLHVLAFTELHVLAFRGLHALAFRGLHVLAFGGVHVLAFTNLHALPFKGLHVLAFRGLHALAFKGRCRNLPFEGRATRDSRDACSTKGIRAESPPTFIRGKRRKNRKRRDLRTF

SEQ ID NO: 174786 - protein, 259 aa, Glycine max
  Coding DNA Sequence Number=SeqID_83101
  Homolog annotation: Hit_ID=Q2HW90; Match level="QueryCoverage=70%, HitCoverage=44%, E-value=2e-12, Identity=26%"; Hit description =Putative uncharacterized protein
MGSSQKPSLKKRFYQVKIKSLEVTSLRKLGQLMGQLQQQAFRKAYGKIWDLARVEVSMEPIASLSQYYDQPLRCFTFEDFQLVPTVKEFKEILGCPLGGRKPYLFLWVLSLHDKSCQGSENLSTRVEPGKAKQKWSSRSTKEVFGAIDVFLAYHNHKESPVVAMPADLYDTFDRRCEESNARIVCCTPALYVGLVSHLFLQEGRPVYPLQGYRSCVEKGKANWDQLLASMEGRLLICSLARRKEESGFYLHAKDVQMFP

SEQ ID NO: 174787 - protein, 91 aa, Glycine max
  Coding DNA Sequence Number=SeqID_83102
MATADALERETKKAQKEEHESSRVKGMILKDELKAYLRSKRNLSQQLSETEGNMWAVIDECKEKLNLAATHEQRLEDEYAKISAEREARER

SEQ ID NO: 174788 - protein, 64 aa, Glycine max
  Coding DNA Sequence Number=SeqID_83103
MVLWRGKIDPLKKNKKMKLFRKMIMLLKMISNLKNLKKAKRSQVERLKNFLENGELRKTSLWIT

SEQ ID NO: 174789 - protein, 80 aa, Glycine max
  Coding DNA Sequence Number=SeqID_83104
MHEYEVSSPSKKHIAAVGATSNNMLSKRKTLDEGSLLSSKSKTQHDHKFTSTPYVPMDPGIGPLFNSPCVKKGVGVVCIK

SEQ ID NO: 174790 - protein, 227 aa, Glycine max
  Coding DNA Sequence Number=SeqID_83105
  Homolog annotation: Hit_ID=Q6WAY3; Match level="QueryCoverage=55%, HitCoverage=5%, E-value=2e-07, Identity=29%"; Hit description =Gag/pol polyprotein
MADISRGSAKRENQPARQSWREAVNAIESDRPPRSKPLKNVATPRRFIFEALQKGEQHICMQSADERSFGRPKPLVIYFTKDAASQKSRYPSTAKPVPFPYQNSHAVPWRYTPPSEKEEEATNISSLSAKVTNITGRSGVTRSGRVFSPSNLPSQPANVKGKAKMVEEQNDKTTLTPNEDIPVKGLPEKRDGCGMKEVSLEEASEFLRIIQQSEFKVIEQLNKTPAR

SEQ ID NO: 174791 - protein, 99 aa, Glycine max
  Coding DNA Sequence Number=SeqID_83106
MVPRKEEWGQNKFRWALWGSNNELKLQRVERDQSRVEGIILEDELKACQRSKRCLSDQLSKTEENMWAIIDQYKEKLSLAATHEQRLEDEYAKVSVLQA

SEQ ID NO: 174792 - protein, 61 aa, Glycine max
  Coding DNA Sequence Number=SeqID_83107
MCTCAIFGTPNALSMHAIFVLRVAFLGNGPEEACLKRSKKDNAVEGTSSAPEYDSHRFRSV

SEQ ID NO: 174793 - protein, 54 aa, Glycine max
  Coding DNA Sequence Number=SeqID_83108
  Homolog annotation: Hit_ID=A5B4I3; Match level="QueryCoverage=75%, HitCoverage=9%, E-value=9e-09, Identity=63%"; Hit description =Putative uncharacterized protein
VKRDKLDKKAEAGIFVGYSSTSKAYRIFLPQKEKWSKESEKLQVQEESEEDVDD

SEQ ID NO: 174794 - protein, 113 aa, Glycine max
  Coding DNA Sequence Number=SeqID_83109
MDIFEDTDIPIILGRPFMLTASCIVDMGKRKLELGFEDQKIDFNLFVEDKPAPEHNVCLQKNIFLKNNPFAKRKPRAKRISVHALSCESQALSSQPLHLRQIWSAKLAKVELS

SEQ ID NO: 174795 - protein, 190 aa, Glycine max
  Coding DNA Sequence Number=SeqID_83110
  Gene Ontology: Mol. function=phosphoprotein phosphatase activity
  Homolog annotation: Hit_ID=A2Q4S5; Match level="QueryCoverage=74%, HitCoverage=23%, E-value=2e-20, Identity=40%"; Hit description=IMP dehydrogenase/GMP reductase, putative
  Pfam annotation: Domain name=DUF1723; Domain location=70-119; Score =61.0; E_value=3.9e-15; Accession=PF08330.1; Description=Protein of unknown function (DUF1723)
GFPGGPCDPSVPTSFAEHVAHAIWTGQERPELKLVSHGRKMALIGRPVPAIEGLVVATGLSPLIECSVVTGDPRLISAFVERWHRETSTFHLPVGELTITLDDVSSLLHLPISGAFHSFEAFSVDEAVFLLMELLEVSGEEARAETAFRDLGQSRGYAWGAAALVHMYDQLDEASRTTTRQIGGYLTLLQ

SEQ ID NO: 174796 - protein, 31 aa, Glycine max
  Coding DNA Sequence Number=SeqID_83111
PMGACIMWYQEHLHLGVEGKKPRVSRTSGFE

SEQ ID NO: 174797 - protein, 225 aa, Glycine max
  Coding DNA Sequence Number=SeqID_83112
  Gene Ontology: Mol. function=3-isopropylmalate dehydratase activity; Cellular component=3-isopropylmalate dehydratase complex; Biological process=branched chain family amino acid biosynthetic process
  Homolog annotation: Hit_ID=Q6D0G6; Match level="QueryCoverage=58%, HitCoverage=28%, E-value=4e-69, Identity=94%"; Hit description=3 -isopropylmalate dehydratase large subunit
  Pfam annotation: Domain name=Aconitase; Domain location=82-225; Score= -182.6; E_value=2.3e-05; Accession=PF00330.11; Description=Aconitase family (aconitate hydratase
  Pfam annotation: Domain name=Iso_dh; Domain location=1-92; Score= -210.6; E_value=0.024; Accession=PF00180.11; Description =Isocitrateisopropylmalate dehydrogen
  Pfam module annotation: Pfam domain module=Aconitase::Iso_dh; Domain location=82-225::1-92
MGMLPSASLNEEGFGLFEPAGGSAPDIAGQNIANPIAQILSLAMLLRFSLNADAAADSIERAVSRALEAGHRTRDLAGDGPAVSTDEMGSIIADETPLLYIDRHLIHEVTSPQAFDGLRAHGRKVRQPSKTFATMDHNVSTQTKDINASGEMARIQMQELMKNCAEFGIQLYDLNHPFQGIVHVIGPEQGMTLPGMTIVCGDSHTATHGAFGSLAFGIGTSEVEH

SEQ ID NO: 174798 - protein, 139 aa, Glycine max
  Coding DNA Sequence Number=SeqID_83113
  Gene Ontology: Biological process=transposition, DNA-mediated
  Homolog annotation: Hit_ID=Q1J7G7; Match level="QueryCoverage=29%, HitCoverage=71%, E-value=2e-12, Identity=74%"; Hit description =Transposase
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDADEHMLSSRVIGLAVSG

SEQ ID NO: 174799 - protein, 173 aa, Glycine max
  Coding DNA Sequence Number=SeqID_83114
  Gene Ontology: Mol. function=RNA-directed DNA polymerase activity; Biological process=RNA-dependent DNA replication
  Homolog annotation: Hit_ID=Q2HTK5; Match level="QueryCoverage=97%, HitCoverage=66%, E-value=1e-12, Identity=30%"; Hit description=H+ -transporting two-sector ATPase, alpha/beta subunit, central region
MGSFGEAGWEWEFSWRRNLFDNELGRASAFIEQATTLSPNAALKDYWVWGADPKGIFTTRTAYLCIKGDQPIGYLNRGFSQLWEIKVPPRALSFAWRLLWDRLPTKENLTRRQVVIENDLCTFCQSQVECASHLFFTYKKVMPTWWEFNSWVKEDRVMHCRPGDNFSQHFSLA

SEQ ID NO: 174800 - protein, 89 aa, Glycine max
  Coding DNA Sequence Number=SeqID_83115
MYMTPIVRQSVKFCDMSGVEGKCQCAICKKKNQQKKWQRGVYLVNRGVQIAIRPTWAFQDVPTEGGAFWWKQPSSPGRARRQPPPSLPL

SEQ ID NO: 174801 - protein, 247 aa, Glycine max
  Coding DNA Sequence Number=SeqID_83116
MNGLSAPAALSLFIATVKILDFQMIALSGPSLSLACQAKHHFASVVSPLNKAKCSYCAKPLLCVEEAKHAMCAKPECHSGGTRKKTLDEELTSFADGSIDVAIVKEFYANLYDPKDKSPKQVRGENLCSYFRFALLRPDPQELAVKLCILGRGFELNVDGQPLKILRKNMTTLAQTWSVLSFSNLIPTSHTSDVTLDRAKLIYGIIMKMDMNVGYLISHQISLTTQHDSSRLGFPALITALCKARGV

SEQ ID NO: 174802 - protein, 103 aa, Glycine max
  Coding DNA Sequence Number=SeqID_83117
MLTKGEEKIKDKIVVVIIKKGENVNHEAFDDIKKNLLEKEGDVNHASFDGVEKKSHVCHLKKGENVNLEVGSSYWKLKVKNGSWKLEVEVTGSWKLEMKVIGS

SEQ ID NO: 174803 - protein, 120 aa, Glycine max
  Coding DNA Sequence Number=SeqID_83118
MSVEQFIEKVAWPGARPSFVGHNESFTAQAPQKHEPEPENDHSSEATIPGAVDFAKRRLETRSNEAAHPGLVPASADAPFYLFVKNGSPRPIWALQKIPPEGGCFWRKQPCSPGRAGGIL

SEQ ID NO: 174804 - protein, 231 aa, Glycine max
  Coding DNA Sequence Number=SeqID_83119
  Gene Ontology: Mol. function=motor activity; Cellular component=cell projection
  Homolog annotation: Hit_ID=UPI00016621D1; Match level="QueryCoverage =97%, HitCoverage=40%, E-value=5e-20, Identity=33%"; Hit description =UPI00016621D1 related cluster
GLHVLTFRGLHVLTFRGLHALAFRGLHVLTFRGPHALAFRGLHVLTFRGPHALAFRGLHVLTFRGLHVLTFRGLHALAFRGLHVLAFRGLHVLAIRGLHVLAFRGLHVLAFRGLHILTFRGLHALTLRGLHVLTFRGLHALTLRGLHVLAFRGLHALAIRGLHILAFRGLQALAFVGLHALTFRGLHALAFKGLHVLVIRGLHALAFRGLHVLAFIGLHIYAFRDLKVLRP

SEQ ID NO: 174805 - protein, 261 aa, Glycine max
  Coding DNA Sequence Number=SeqID_83120
MASSARTATCSGRRREEGGIMAWPSRRCRLAWRAGRRSWAGRRSAWRPPPSSPAGRADVGFHARGAAVRRGRRRAGPPGLGNDRPPRCRRGRGTGCRRAPTSAGLGDCSGGGQAVGVQGGGQRGVEPRHGLALRRLQCLGDGCHDGTDARAVGDGLKLFLQIGRASACQSRKAGDRIAFSLGAVAEHTGGRAVGAPGADEQCVRRAMNRAGHYGKHTGEEDRHARPSGAGQKAGGHEEERCRRFWLDYISKDDDIEPLCTK

SEQ ID NO: 174806 - protein, 121 aa, Glycine max
  Coding DNA Sequence Number=SeqID_83121
  Subcellular localization annotation: CTP_CleavageSite=68; ConfidenceScore=5.32e-01
MVKVGTYYVPINVSFSPKVGPGLSRYQQGRQDLFILRSDLPSQHRRTSALASVAVTLRVTTTPAALKCAATGRVPFAIQAAQLLGRAIGAGLFAITPAGERGMCCKAIKLGNARVFPVTTL

SEQ ID NO: 174807 - protein, 450 aa, Glycine max
  Coding DNA Sequence Number=SeqID_83122
  Gene Ontology: Mol. function=phosphoprotein phosphatase activity
  Homolog annotation: Hit_ID=Q2HTA0; Match level="QueryCoverage=72%, HitCoverage=57%, E-value=6e-28, Identity=29%"; Hit description=IMP dehydrogenase/GMP reductase, related
  Pfam annotation: Domain name=DUF1723; Domain location=157-206; Score =60.2; E_value=6.9e-15; Accession=PF08330.1; Description=Protein of unknown function (DUF1723)
MVRTRGLGHALARVIGRGRQDEHDAVDVTKDVPHMAEDVPQVTEDFPHMANDVAQRSEDVPQMTTDVDANVAKDLGRDGAEGSHADEGFPGGPRDPSVLTSFAEHVAHAIWTGHERPELKLVSHGRKVALIGRPVPAIEGLVVATGLSPLIECSVVTDDPGLISAFVERWHRETNTFHLPVGDLAITLDDVSSLLHLPISGAFHSFEALSVDEVVFLLMEFLEVSGEEARAETAFRDLGQSGGYAWGAVALVHMYDQLDEASWTTTRQIGGYLTLLQCWIYEHFLSVHQCVTDDAYEETSPHASRWLTTKAHMKGITGAPYRAHCDAFTVTDVCWFPYSDHRGVRGFELISSFQGQLRWGPTVVAVRPKRVLCQFGYIQSIPPSPVSADYMNWFFQISHPFMIPTQAGDQPRHAPAPDHEDYMQPDIPQVSVAFDPPLTCSGKIVCGFNV

SEQ ID NO: 174808 - protein, 61 aa, Glycine max
  Coding DNA Sequence Number=SeqID_83123
MADGRHGGRVNKARRKKVESDYNCGGGSGAATPATHLSLKSLKLVLARKLEKRVEGDKEKK

SEQ ID NO: 174809 - protein, 101 aa, Glycine max
  Coding DNA Sequence Number=SeqID_83124
MDEDQWRYDYAMSQEVHMDYDYDNEEECVVNEPHVDCSNAFNTSQVFGTRDDVLQWAQTVAHENGFVAVIMRSDTKTDSRGRSSFVLIGCERSGAYKCRNK

SEQ ID NO: 174810 - protein, 326 aa, Glycine max
  Coding DNA Sequence Number=SeqID_83125
  Gene Ontology: Mol. function=nucleic acid binding
  Homolog annotation: Hit_ID=A2Q1T7; Match level="QueryCoverage=21%, HitCoverage=18%, E-value=5e-13, Identity=58%"; Hit description=IMP dehydrogenase/GMP reductase, related
  Subcellular localization annotation: CTP_CleavageSite=60; ConfidenceScore=5.36e-01
MVVVPFVPLAFLDDGSSPPPSPSSPPQKSFAKVLSNACDIPLRQLLVPCLKGDALSVKIPEDEYKARLEGCKNNLHGRLSLSKGDTLLNYQYLHIKLEKGFGHGFLAFKPWITQTILSWLFHPLCLQPFLMTAMPYPLRYQRMNTKHDWRDVKTIFMEGKKVFVEKQKEPIIQDDGVIPPGLSFAQKNDLGGSLKYNQGDDAHISNLDDNCKSSVEGGTQSYDESLHLDLPLVDRFGAETPELKDNPIVHQYFGIITSRWGYIVDDVSLCVDVNEGGLSLDGFTMVHSKSQRKKLHGNKKKMPRRSYFLLGSMHHPNQRPGWLLLT

SEQ ID NO: 174811 - protein, 349 aa, Glycine max
  Coding DNA Sequence Number=SeqID_83126
  Gene Ontology: Mol. function=voltage-gated potassium channel activity; Cellular component=integral to membrane; Biological process=potassium ion transport
  Homolog annotation: Hit_ID=Q94A76; Match level="QueryCoverage=30%, HitCoverage=22%, E-value=3e-33, Identity=52%"; Hit description =Potassium channel GORK (Guard cell outward rectifying K(+) channel)
  Pfam annotation: Domain name=Ank; Domain location=239-271; Score=7.1; E_value=3.1; Accession=PF00023.21; Description=Ankyrin repeat
  Pfam annotation: Domain name=Ank; Domain location=272-304; Score =15.2; E_value=0.21; Accession=PF00023.21; Description=Ankyrin repeat
  Pfam module annotation: Pfam domain module=Ank::Ank; Domain location =239-271::272-304
MKKALSDSVDLIQRRTRCRRKDERLKFKGLQSRNYCGSPQLRLEVLLLASVKREELELAMDEDELAMVESTRSKSNLDSIEEAIAKLASNQLHVTFKLDELLQQLTTLRGDTTRKLVAPLHPTLPLENGNNIHRGTRLPLNVLSVGNNVLQTILKKVLKDSTSQIVNPEFHNVLHVVAQHHLVPLGSSLVSLLRPLYPPPSPPPPPPKPPPPPQPRLVWVCASWTVMFDRQGASMTIENVDSFLCTAVTRGDSDYLKRLLSNDMDPNFKDYNYRSPLRIAAAEGLYFMAKLLLEGGTSVFTKDRWGNTTLEEARMCGNKNLIKLLEDAKSAQQSQHLEDKVFLMGQGML

SEQ ID NO: 174812 - protein, 201 aa, Glycine max
  Coding DNA Sequence Number=SeqID_83127
MVLFFMGAACNLQANRNLQWRLRCHTTRGRPNRQRCWRLYVEGHLASATGDFAIATEIAALTGEFRGCRRRKSRKKEGKFSPLALASFGGGFKEVKSLLGLLLCALQLSLQPPSETAFASPAPPKLASQSCDFSSSGEVASCTGEMPFHMKSPAPLTVWPSTCRMVAKSPLQVAVCLEIACSSRKKEHHAGNCSKRTPFEE

SEQ ID NO: 174813 - protein, 153 aa, Glycine max
  Coding DNA Sequence Number=SeqID_83128
MEQPGVDGGHDVTMSRETETRAKRRHCQRQFTPPLENVENDKDEALPWRDSRKSQRQRKRKSRQCYSNQLKSGLGKHKKILMCSNRSSPVRNERVRRKGSGGQRGGGEEAEDKEEEEREGGERERKRMKEKQCNKRTLMVQTGLPVLEKPPEI

SEQ ID NO: 174814 - protein, 203 aa, Glycine max
  Coding DNA Sequence Number=SeqID_83129
  Homolog annotation: Hit_ID=A7NZK6; Match level="QueryCoverage=81%, HitCoverage=29%, E-value=1e-41, Identity=48%"; Hit description =Chromosome chr6 scaffold_3, whole genome shotgun sequence
MWGCLPGHDHVIFVLLEDPLMSQRTIQRRILSCFGSLVALSDASSRMEGWLYLIRFNRIGLQFSRKRYFVLDGNLLRSFKSVPVSNNQDPVRSTDKFLFFFYAFEIRSGAPDGGDDVVGCSKRGWQSFRLSGSSSGISHPNFVDWTLSSADVIALSPWTIFGCQNGLRLFKEAKDRDSNGKKWDDHPAIMVVGVVDGTSEAIF

SEQ ID NO: 174815 - protein, 68 aa, Glycine max
  Coding DNA Sequence Number=SeqID_83130
MLAFPFGMLRNFTDYATMLGLTVRMLRNFMDYATILVLRVSKGTNKWSGPLRSDLYSLRVRGNPLITI

SEQ ID NO: 174816 - protein, 108 aa, Glycine max
  Coding DNA Sequence Number=SeqID_83131
MRKRILPRRLLRRKIILQQKVILKEYSFLNNLSTFSYQGKHPLAPPYLLSLSDQGLPMDPKRIKVISEWPTPPSVEEKINEFQEPLDLRSNPFQGGGNDAILPPKGIG

SEQ ID NO: 174817 - protein, 296 aa, Glycine max
  Coding DNA Sequence Number=SeqID_83132
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSILFLLITHPGIPNGFWSMEVPFLDFECSYGYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 174818 - protein, 208 aa, Glycine max
  Coding DNA Sequence Number=SeqID_83133
MTTLAQTWSVLSYSNLVPTSHTSDITLDRAKLIYGIIMKMDISHQISIIAQHDSSRLGFPALITALCKGRGVTLDSRSLESLSPAINLAYIKKNCWNLDDPTSLQSSGLQSIMSIDEFLTQVAWPGVQPSSSRGGGTSAAQVPEQATEELVLAEDELTSLEPSSVVADTSMAQEEVSSPGPMPEPSSTPISEDTMPSVPAIEPEQSIL

SEQ ID NO: 174819 - protein, 105 aa, Glycine max
  Coding DNA Sequence Number=SeqID_83134
MTSRRIKIQEKMISQGKTNRLRILCLNTLEGTSFVVQVEGTSTWVVVPENKRGYISCGSVQVEGTSTWLFKENKEGYIPCGSLLVKVFTRLKRNLKDRSLLGDWM

SEQ ID NO: 174820 - protein, 93 aa, Glycine max
  Coding DNA Sequence Number=SeqID_83135
WAKLNSLAKRITTTKRNFSALSAKENLTEHQHQSRALREMNVLSAASAFNQAKLETGAKPNFTYSPRHRITQQPQCLIREKSPGSSKEEQLVH

SEQ ID NO: 174821 - protein, 318 aa, Glycine max
  Coding DNA Sequence Number=SeqID_83136
  Homolog annotation: Hit_ID=Q6WAY6; Match level="QueryCoverage=69%, HitCoverage=44%, E-value=2e-14, Identity=28%"; Hit description =Putative uncharacterized protein
HRKQVENGVVGVSRKCLEAKARVLAGKGEWALFIDILALLIFEGVLFPNVDGLVDQYKDCLLYSDPLRMVGFAPFPPRASKEGASVNWFPRWKEGRTGILFSCGGFPNVPLMGTRGCINYNPVLPIRQLGYPMRGAPLEEDLMPIIARGFNSTNAKAIQKVRKAWEMEQKKDKELRGSSNGPISGYHRSLKAYMQALRIRKENAELRDVNIATTKAMEQETKRARREEHGRNKFRGALWGSNSELKLRREERDQSRVDSLILKDELRICLRSKRSLSQQICETETNMLAIISKYQEELNLATAHEHKVADEYARVYAE

SEQ ID NO: 174822 - protein, 116 aa, Glycine max
  Coding DNA Sequence Number=SeqID_83137
MWALCKARGVQSDSRSLESLSPAINLAYIKKNYWNLDDPTATFRGPRKAKGKRSEVPTTSAAPEIATPSSSTAPTPPISTPTQTPAIPAPSAQIPLPAPLSFVYTTDASFHAPELT

SEQ ID NO: 174823 - protein, 149 aa, Glycine max
  Coding DNA Sequence Number=SeqID_83138
MTSRDQVWSFCTHDTRRCLMVIRTRLSSRGGGPDDKQRPKTKFGHSAPMIRGDTLWLFAPFCHPEAAGPMTSRDQVWSFCTHDTRRYLMVIRTLLSSRGGGPDDKQRPKTKFGHSATLYHPEAAGPMIRGNTRVVIRINILLLSVRQNA

SEQ ID NO: 174824 - protein, 97 aa, Glycine max
  Coding DNA Sequence Number=SeqID_83139
MDEFDVQVAWPEAHPSPSGGSWASAAQEPEPEQPGAEAAEEEDELTPPEPFYFDAGVHMAQEEEETSTDQIPEPSLASIPDDAIPSAPASELEQPIS

SEQ ID NO: 174825 - protein, 81 aa, Glycine max
  Coding DNA Sequence Number=SeqID_83140
LSSRSTAPPGRHRARHHNSLGIVGSGQQTHRCHLQSPSAPLQKLEHCLRPVVDQQVTKSKAKGSEDTLDMHVARYLGCASI

SEQ ID NO: 174826 - protein, 162 aa, Glycine max
  Coding DNA Sequence Number=SeqID_83141
  Homolog annotation: Hit_ID=UPI0000ECBAF8; Match level="QueryCoverage =25%, HitCoverage=48%, E-value=1e-16, Identity=100%"; Hit description= UPI0000ECBAF8 related cluster
LSGFATSDLSVDFCDARQGGGAYGKTPATRPFYGSWPFAGLLLTCSFLRYPLILWITVLPPLSELIPLAAAERPSAATGTTGFPTGKRAVSATQLIYDHDYEFELGTKAGMQAWHWPSFYNVVTGKTLALPNLIALQHIPLSPAGVIAKRPAPIALPNSCAA

SEQ ID NO: 174827 - protein, 109 aa, Glycine max
  Coding DNA Sequence Number=SeqID_83142
MKNGEERWKTFTDLLTKTSRKRYRCTSAWIFFTKTIFSPKTAEMHSQGELYGLYNDTYFLSRMLRNFTDYATIPFLTSGMLRNFTDCATIIPFDFRHVAELHGLSNDGC

SEQ ID NO: 174828 - protein, 104 aa, Glycine max
  Coding DNA Sequence Number=SeqID_83143
  Gene Ontology: Mol. function=ARF GTPase activator activity; Biological process=regulation of ARF GTPase activity
  Homolog annotation: Hit_ID=Q2HV28; Match level="QueryCoverage=83%, HitCoverage=50%, E-value=6e-39, Identity=91%"; Hit description=C2
EVFDKDLLKADDKMGNAFLNLQPIVSAARLRDILRVSSGETTLRKVIPDGENCLVRESSINCVNGEVVQNVWLRLRGVESGELELTINRVLLLINSCIDVSTQK

SEQ ID NO: 174829 - protein, 197 aa, Glycine max
  Coding DNA Sequence Number=SeqID_83144
  Gene Ontology: Mol. function=oxidoreductase activity; Cellular component=cytoplasm; Biological process=response to DNA damage stimulus
  Homolog annotation: Hit_ID=Q2HV29; Match level="QueryCoverage=94%, HitCoverage=94%, E-value=5e-59, Identity=54%"; Hit description=2OG -Fe(II) oxygenase
  Pfam annotation: Domain name=2OG-FeII_Oxy; Domain location=83-190; Score=2.0; E_value=0.09; Accession=PF03171.11; Description=2OG -Fe(II) oxygenase superfamily
MDVLKLKAVSEENPSETVKRETEATSFTFRGLTELTYSGYQPHAYSWDDYPRLKNMLDAVRMILIINSANDDDNVYKALPGSSFNSLLLNRYNCGNDYVGWHSDDEKLYGRTPEIASLTFVLKKKPYGSGEPASKRLKKGSHDADQHTFRLRHGSLMVMRGYTQRDWIHSVPKRAKAEATLINLTFRLYVDANVHTI

SEQ ID NO: 174830 - protein, 120 aa, Glycine max
  Coding DNA Sequence Number=SeqID_83145
  Gene Ontology: Mol. function=methyltransferase activity; Cellular component=cytoplasm; Biological process=tRNA processing
  Homolog annotation: Hit_ID=A2Q1R6; Match level="QueryCoverage=90%, HitCoverage=28%, E-value=1e-37, Identity=70%"; Hit description=TRNA (Guanine-N1-)-methyltransferase
  Pfam annotation: Domain name=tRNA_m1G_MT; Domain location=1-113; Score=1.7; E_value=7.8e-05; Accession=PF01746.12; Description=tRNA (Guanine-1)-methyltransferase
KRIPGIDKWIIEKENRSYIEALSNRKEDLVYLTADSETVLEELDLKKAYVIGGLVDRNRWKGITLKKAEEQGIQTAKLPIGNFMKMSSSQRKKMEEKNRDNNTQERKEIQGWLDGWEGGA

SEQ ID NO: 174831 - protein, 59 aa, Glycine max
  Coding DNA Sequence Number=SeqID_83146
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=49%, HitCoverage=28%, E-value=2e-10, Identity=100%"; Hit description=LacZ protein
HPPFASWRNSEEARTDRPSQQLRSLNGEWDAPCSGALSAAGVVVTRSVTATLASADQGQ

SEQ ID NO: 174832 - protein, 638 aa, Glycine max
  Coding DNA Sequence Number=SeqID_83147
  Gene Ontology: Biological process=pollen maturation
  Homolog annotation: Hit_ID=A2Q4W6; Match level="QueryCoverage=58%, HitCoverage=55%, E-value=3e-17, Identity=23%"; Hit description=RNA -binding region RNP-1
  Pfam annotation: Domain name=RRM_1; Domain location=90-160; Score =16.6; E_value=0.0043; Accession=PF00076.13; Description=RNA recognition motif. (a.k.a. RRM, RB
MGSPIIVITLRKGRGVDARHGAKTQDEQGRLRFHFQSFVSFNVAHRGRGKQREGERPRVDPKTNYDNNKLGQFQRYHHHNWRDKDDITTFYFTRFHEHITEEDLWAQFKKWGDVRDIFIHKHRNKGGRRYGFVRFKGVLDKYRLEKQLDNIILEGLKMYVNVPKYGRGKARVKECTSKLGILKEGHSREVEAGRHRAVQHRNPQKSYAKVVSTIQTDDGKMKHPKLPQLRYVESHSSVHLQLAVGEKKWFTDAWVGRLKKLQALERIEDDIPWELGVNVVLKYLGDDMVLLLGLADNKAEHIIAEETQHGTSPFHSLERWNPTMRLGHRLVWAQCWDIPIEAWDLGNIRKIAAAIGELVKVDDDVKEMRRMDRARILIRTPWKPFFHHTVSLDSDGIDGESIISPYSPRYEIRRQPNNPHDDPKAVVDSGGGPRIGTGIPIGRATDPPEANHSDDPGGNPLNVAHVQSISCRGRKASSDGDTVPVATDKPRSPLPKGPTTIENTVDINQGSWVILPNLGNGSRISSERVMEQEDKGKGSETTINNGEINVGEAQKRKQQGEIESLTETVVHPEATIREIAVEDVQFQMRVDHVTSSGPSHSQLPPPIETLGPPQHFRSSPSYQVKDHELLTPSTTRGN

SEQ ID NO: 174833 - protein, 299 aa, Glycine max
  Coding DNA Sequence Number=SeqID_83148
  Gene Ontology: Mol. function=protein serine/threonine kinase activity; Cellular component=cytoplasm; Biological process=protein amino acid phosphorylation
  Homolog annotation: Hit_ID=A7Q9B0; Match level="QueryCoverage=82%, HitCoverage=54%, E-value=1e-124, Identity=89%"; Hit description =Chromosome chr19 scaffold_66, whole genome shotgun sequence
  Pfam annotation: Domain name=Pkinase; Domain location=1-199; Score= -39.1; E_value=2.8e-06; Accession=PF00069.16; Description=Protein kinase domain
MLSDFDLSLRCAVSPTLVKTSSTDSEPLRKNAVYCVQPACIEPPSCIQPSCVAPTTCFSPRLFSSKSKKDRKPKNEIGNQVSPLPELIAEPTDARSMSFVGTHEYLAPEIIKGEGHGSAVDWWTFGIFLYELLFGKTPFKGSGNRATLFNVVGQPLRFPEAPVVSFAARDLIRGLLVKEPQHRLAYKRGATEIKQHPFFEGVNWALIRCATPPEIPKAVEFEKIPSPASSSGGEKAVNHMSIANQKGLRLVEKFVSSPLGKVPPRDECNIGGKLPDGGLINSRQLLECTLSPELGQILK

SEQ ID NO: 174834 - protein, 85 aa, Glycine max
  Coding DNA Sequence Number=SeqID_83149
MKKIQGDAILPRKGPVTRAVSKRLQEDWARAAEEGPRVLMNLRMNGSGMEKEEREEMPLQGEDESRRSSPPLEAMDKSLEEEGDE

SEQ ID NO: 174835 - protein, 119 aa, Glycine max
  Coding DNA Sequence Number=SeqID_83150
MVRTRGLGRALGHITDRGVGRGDRDDSDDAPQRRRPTASTRRQRVPVIATHDESVVPAPNVDADIFLDDSMAPADVEDIVADILANTGAHVAEDEHEGFPGGSSDPSVLTQYTDHVTCS

SEQ ID NO: 174836 - protein, 38 aa, Glycine max
  Coding DNA Sequence Number=SeqID_83151
MNATSITSTNDAIVETTKTTFLRCSCLPSTRIDRLIMK

SEQ ID NO: 174837 - protein, 117 aa, Glycine max
  Coding DNA Sequence Number=SeqID_83152
MVVGHHMALETSFVGKDFMVERAIFVGWAPDWEGSRCWPNNLVGAGNIASVNSLSAPPSTLRLSEKTGAKPEVTYAVFGCGETERELSLTRKPSCGALDEILRDCEVSRGGGDIPTT

SEQ ID NO: 174838 - protein, 231 aa, Glycine max
  Coding DNA Sequence Number=SeqID_83153
  Gene Ontology: Mol. function=chloramphenicol O-acetyltransferase activity; Biological process=response to antibiotic
  Homolog annotation: Hit_ID=P62577; Match level="QueryCoverage=94%, HitCoverage=99%, E-value=1e-130, Identity=99%"; Hit description =Chloramphenicol acetyltransferase
  Pfam annotation: Domain name=CAT; Domain location=6-209; Score=528.7; E_value=6.6e-156; Accession=PF00302.9; Description=Chloramphenicol acetyltransferase
MEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWSEYHDDFRQFLHIYSQDVACYGENLAYFPKGFIENMFFVSANPWVSFTSFDLNVANMDNFFAPVFTMGKYYTQGDKVLMPLAIQVHHAVCDGFHVGRMLNELQQYCDEWQAGRNFLRQLCARIFI

SEQ ID NO: 174839 - protein, 100 aa, Glycine max
  Coding DNA Sequence Number=SeqID_83154
MSWVNLTSALPQNPRDHFLQHGTELAEGVKSKRWKCWWIALTWTIWQHRNKVVFQNATFHGSKLLDDALLLLWSWIRAMDKDFTLHFNQWSSNLKEGLCN

SEQ ID NO: 174840 - protein, 18 aa, Glycine max
  Coding DNA Sequence Number=SeqID_83155
MGQNPPNDYDDGWLKFSQ

SEQ ID NO: 174841 - protein, 94 aa, Glycine max
  Coding DNA Sequence Number=SeqID_83156
  Homolog annotation: Hit_ID=Q84VH5; Match level="QueryCoverage=56%, HitCoverage=7%, E-value=4e-20, Identity=96%"; Hit description =Envelope-like protein
KAAASGAVSKDALIAELKDTCKVLEATIKATTEKKMELERLIERLTDSGIDDGEAAEEEEDPAEEEEAAEQEEEAAEEEEDAAEETESDSEATP

SEQ ID NO: 174842 - protein, 122 aa, Glycine max
  Coding DNA Sequence Number=SeqID_83157
MDSRGINPVDKHIATIGTTSNNMLSKRKTLDEGSLLSSKSETQHDHRFTSTPYVPMEPDIRPLFNSPCVQKVPSGVVNCRNLPFGGRATQGSRVSLPREEGARSHHQHLFEENVGKTGMCGL

SEQ ID NO: 174843 - protein, 171 aa, Glycine max
  Coding DNA Sequence Number=SeqID_83158
  Gene Ontology: Mol. function=4 iron, 4 sulfur cluster binding; Cellular component=integral to membrane; Biological process=protein -chromophore linkage
  Homolog annotation: Hit_ID=P56767; Match level="QueryCoverage=100%, HitCoverage=30%, E-value=3e-92, Identity=75%"; Hit description =Photosystem I P700 chlorophyll a apoprotein A2
  Pfam annotation: Domain name=PsaA_PsaB; Domain location=1-171; Score=- 315.4; E_value=0.1; Accession=PF00223.10; Description=Photosystem I psaApsaB protein
PAFNAGRSIWLPGWLNAVNENSNSLFLTIGPGDFLVHHAIALGLHTTTLILVKGALDARGSKLMPDKKDFGYSFPCDGPGRGGTCDISAWDAFYLAVFWMLNTIGWVTFYWHWKHITLWQGNVSQFNESSTYLMGMELIETLAWAHERTPLANLIRWRDKPVALSIVQARL

SEQ ID NO: 174844 - protein, 45 aa, Glycine max
  Coding DNA Sequence Number=SeqID_83159
MAPKKPSAKRSRRDIVAKGTNAALEFDGHRFRALSTSSASRPSKD

SEQ ID NO: 174845 - protein, 138 aa, Glycine max
  Coding DNA Sequence Number=SeqID_83160
  Homolog annotation: Hit_ID=A5ATL8; Match level="QueryCoverage=41%, HitCoverage=45%, E-value=3e-19, Identity=82%"; Hit description =Putative uncharacterized protein
RRQIPGLNPGQAVETTKLEYETKARGANGIRYPSSPSRKRWILGAVRIDPCNAVANALSIPPGEYRRTLPGLDMPRILLKERGAFGNADTGGAWLSSARATAGDKPEEGEDDVKSSCPLCPGRHTCYNGRDKGSRSRE

SEQ ID NO: 174846 - protein, 19 aa, Glycine max
  Coding DNA Sequence Number=SeqID_83161
DTCDDQEPCSWEQNDSGRV

SEQ ID NO: 174847 - protein, 253 aa, Glycine max
  Coding DNA Sequence Number=SeqID_83162
  Gene Ontology: Mol. function=intramolecular transferase activity; Biological process=metabolic process
  Homolog annotation: Hit_ID=A6EMM1; Match level="QueryCoverage=98%, HitCoverage=23%, E-value=1e-88, Identity=64%"; Hit description =Methylmalonyl-CoA mutase
  Pfam annotation: Domain name=B12-binding; Domain location=12-134; Score=76.1; E_value=1.2e-19; Accession=PF02310.10; Description=B12 binding domain
MGTQKYTPKNKVRIVTAASLFDGHDAAINIMRRVIQGTGCEVIHLGHDKSAEEVVNTAIQEDANAIALTSYQGGHNEYFKYIYDLLREKNSPQIKIFGGGGGVILPEEIQDLMSYGIDRIYSPDDGRELGLQGMIDDLVNRSDFATGKDVTAQDLDSINFENSTSIAKIISAVENFSDEKPELVKAIDEKAKDLNIPIIGITGTGGADKKIAIISIDPSKKKTGGALLGDRIRMNAINDPRVYMRSMATRENN

SEQ ID NO: 174848 - protein, 304 aa, Glycine max
  Coding DNA Sequence Number=SeqID_83163
  Gene Ontology: Biological process=transposition, DNA-mediated
  Homolog annotation: Hit_ID=Q6UUU1; Match level="QueryCoverage=19%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSMKQPDANHGSKYGKDECQAERYQREWERGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 174849 - protein, 74 aa, Glycine max
  Coding DNA Sequence Number=SeqID_83164
MSAKNLVGCLGVHDKTNHIIISQSGSQCFARMLQPYGIKIGLKEHSNRVTPKAYTPKSPLGPLPLDSGPTQKTF

SEQ ID NO: 174850 - protein, 267 aa, Glycine max
  Coding DNA Sequence Number=SeqID_83165
  Homolog annotation: Hit_ID=A5AKA6; Match level="QueryCoverage=94%, HitCoverage=27%, E-value=1e-09, Identity=20%"; Hit description =Putative uncharacterized protein
DQRLSYNSQFSSKIILDPKYLDINFFNDETFDCYQVFQNSGLVDFMSLTLPYYPELVSVLYSNLKIQDGIICSEVHVISMIIDQSLFFSLTKLPSQGAPFEGTIINDWKFDYSSHDARRMVRNDQADMTDRLLPGSLTFDCRIMHYIIIRILLPRSSNLAQASEEDLILMWAFLTCRQIDWAHLVRYRMHKALRANTPFPYPQLVTLFLRHFQIPLDDEPFVQVKRSFAIGAGVVTSFGYHKDRDGQWLKKDALPPQDEHTPSPPPQ

SEQ ID NO: 174851 - protein, 104 aa, Glycine max
  Coding DNA Sequence Number=SeqID_83166
MGSNQAPFFKKMFYHVKIKSLEVASLQELGQRMDQVQRQAFHKTYGKIWDLAMIEVSVEAITSLTQYYDQPLREKGPSSKEFRELLLCEDWQRTELEEEAILRA

SEQ ID NO: 174852 - protein, 207 aa, Glycine max
  Coding DNA Sequence Number=SeqID_83167
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=25%, HitCoverage=50%, E-value=1e-23, Identity=100%"; Hit description=LacZ protein
  Subcellular localization annotation: CTP_CleavageSite=25; ConfidenceScore=5.16e-01
MTMITPSSKLTLTKGNKSWYRAPPREGGKGSPKSSSLSPYEEAMEALSSLITRRTRADDSNVGDQFSLLYDYLKMLELEEPIANMKVIHVAGTKGKRPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 174853 - protein, 116 aa, Glycine max
  Coding DNA Sequence Number=SeqID_83168
  Subcellular localization annotation: CTP_CleavageSite=41; ConfidenceScore=5.55e-01
MAEPSKKRKGSSSTATAAAYRRHGPSGAPTTPIPPSLSSPRSSTLFSSDDQRLRQGAPFEGTIVDDWKFDYSSHDARRMVCNDQAEMTVVRSTGPIWFGTECIRHYGPMHLFLIHI

SEQ ID NO: 174854 - protein, 131 aa, Glycine max
  Coding DNA Sequence Number=SeqID_83169
  Gene Ontology: Mol. function=chitin binding; Cellular component =extracellular region; Biological process=chitin metabolic process
  Homolog annotation: Hit_ID=UPI000066154C; Match level="QueryCoverage =70%, HitCoverage=100%, E-value=2e-10, Identity=38%"; Hit description= Homolog of Homo sapiens "Keratin-associated protein 10-1
  Subcellular localization annotation: CTP_CleavageSite=22; ConfidenceScore=5.43e-01
PLKARACSPLKVRMCSPLKARVCSPLKERTCSPLKARACSPLKVRACGPLKARTCSPLMARTCSPLKVRMTCSPLKAKACNPQMARTCSPLRRGREGVYSSDGEGMYPSEGEGTSTQGSTLMRKQEIDSMR

SEQ ID NO: 174855 - protein, 155 aa, Glycine max
  Coding DNA Sequence Number=SeqID_83170
  Homolog annotation: Hit_ID=UPI000065F7CF; Match level="QueryCoverage =94%, HitCoverage=18%, E-value=2e-09, Identity=34%"; Hit description =Homolog of Homo sapiens "Leucine-rich repeats and IQ motif containing 1
MHALAFIGLHALTFRGLHVPSEDYASSPSEGYTPSPSEDYTPSPSEGYTLHLQRATRPHLQRTTRPHLQTTTRPHLQRATRPRLQSNIEGYTPSPLEGYTLLAFRRDTHPHLRRTAHPHLQRTTHPRLQRNTRPRLQRHYTSSPSEGYTPSPSEG

SEQ ID NO: 174856 - protein, 248 aa, Glycine max
  Coding DNA Sequence Number=SeqID_83171
  Homolog annotation: Hit_ID=A5C7Z4; Match level="QueryCoverage=31%, HitCoverage=28%, E-value=5e-07, Identity=35%"; Hit description =Putative uncharacterized protein
  Pfam annotation: Domain name=Transposase_23; Domain location=37-107; Score=-2.5; E_value=0.0022; Accession=PF03017.5; Description =TNP1ENSPM transposase
MQSQGLAVPPEPLVGPSGPRVSTKGSCVDPSGNDPEMGDSDRCGLYIKADPARLVAMGRVYEGSTIVHNTSLLPGQVKVSVEEVTDADALVPIPTDAVSLVGQALHTFLAWPTHLAKSLSQQSSQSDVYLGAYLNGFHCSGHWQMVVILPKEDLVVWFCSLHNRLDNYLKGIINSAIKGLDDAPQPKSKASARWIVVKCNREKGSTECGYYVMHWMSTIILGTFRNNWEAYFNDPRPLEPERLKALWI

SEQ ID NO: 174857 - protein, 50 aa, Glycine max
  Coding DNA Sequence Number=SeqID_83172
  Gene Ontology: Mol. function=protein binding; Cellular component =anaphase-promoting complex; Biological process=regulation of mitotic metaphase/anaphase transition
  Homolog annotation: Hit_ID=A7PUT4; Match level="QueryCoverage=98%, HitCoverage=28%, E-value=2e-14, Identity=72%"; Hit description =Chromosome chr4 scaffold_32, whole genome shotgun sequence
MLIVLFLVFKLDESYTPSKVSIRAGDEIKTVELVKATGWVYLSLSGADPR

SEQ ID NO: 174858 - protein, 107 aa, Glycine max
  Coding DNA Sequence Number=SeqID_83173
MKSGENEPIDAQRLTSSSAPFVIQGQQVRWQAEIPYGHPHLSSTEANEFDSFYCRRPKTFKPDDARDSSLLGGGRSSSMAWGNVVVVPFIAFKTLKFVTLLMPFLSF

SEQ ID NO: 174859 - protein, 118 aa, Glycine max
  Coding DNA Sequence Number=SeqID_83174
  Gene Ontology: Mol. function=nucleic acid binding; Biological process= DNA integration
  Homolog annotation: Hit_ID=A5AV98; Match level="QueryCoverage=99%, HitCoverage=15%, E-value=9e-22, Identity=50%"; Hit description =Putative uncharacterized protein
FVENGEISGSTIPREVEIKEVRVQVPLACASSSKVIAPLVVVTNYNEEAQHNNEPMIYNEPIVEEPQEVALTRSQRERRPAISNDYVVYLHETETDFNINDNDPVSFSQAVRCDNSEK

SEQ ID NO: 174860 - protein, 151 aa, Glycine max
  Coding DNA Sequence Number=SeqID_83175
  Homolog annotation: Hit_ID=A5B4G8; Match level="QueryCoverage=63%, HitCoverage=11%, E-value=2e-07, Identity=33%"; Hit description =Putative uncharacterized protein
MTRGNPSDLQPFDPEIDRTFHRLVRHHFIPFDNPEHSITGESVHSIIGDFEHPDFKHSDFEHSENMAQPPPRERTLREMVAPDFTYKSLCIQYPDEDVPHVLKTRLIHLLPKFHGLAGEDLHKHLKEFHIVCSTMKPPDVQEDHIFLKGIL

SEQ ID NO: 174861 - protein, 298 aa, Glycine max
  Coding DNA Sequence Number=SeqID_83176
MQNFAVKIGAAGFWLCAEKCLCVVGCGKSSAERVLVRKAVILVGVLSKVFCLCPVFLAVRNEDMSYVGVREFSWRWATRDGGVKLPAFIVDHRVVPGDMSRGLGDLGDVRLKNEDRRLRWSLVIDYQGKGDWNIVEASGNRLPACVIDYTEGWIVMAAQLIHDRVEMKCLEGAWETLEGNTRCRFRGTIRFTATSLVHPDEPGRTLQRTVEWILPTPTPYRLVEPVQVIEVTSFEEDPEEDLEELPPEPAVDALDFLEGDEDPLLEVDSPEEVMSASEADSTEDSGPGEMAISGGSSS

SEQ ID NO: 174862 - protein, 126 aa, Glycine max
  Coding DNA Sequence Number=SeqID_83177
TLHAHDPAGSACRGGGSASAADVHHLRLPRRAVLLDEGSGDRRLDYFTGGDENSVGPAEARDQRRKPQGPIGLIWVQRDGIHQLALRQREIRVVITRQDIAEQQCHPCLGQGGHASVHDPHPPPCS

SEQ ID NO: 174863 - protein, 45 aa, Glycine max
  Coding DNA Sequence Number=SeqID_83178
MVVKKDFMLGQKVLLYIFRLGLMSGTSEDQKRLPNQELQGQRTST

SEQ ID NO: 174864 - protein, 174 aa, Glycine max
  Coding DNA Sequence Number=SeqID_83179
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=29%, HitCoverage=50%, E-value=6e-24, Identity=100%"; Hit description=LacZ protein
MVGNYFIPKGSHVLLSRHGLGRNLKVWNNEPHKFKPERHIKNDGSMIVLSEPDLNPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 174865 - protein, 138 aa, Glycine max
  Coding DNA Sequence Number=SeqID_83180
MSISPCRCIGWDRAHKTPNRALGFLALVTGLCSLTGCPFPPARSRHHDIGITPTRHPVDPKKSNRVLELSSSNYGSLSVLRSACHLQMSHDHKILKLECPHGCMYDQFCIILPNHHCCMYIMEIMWDVPFIPEPLAKP

SEQ ID NO: 174866 - protein, 136 aa, Glycine max
  Coding DNA Sequence Number=SeqID_83181
IADKKVAAAEAWIEALKASKKEILMETKIAQRQLKESKLEQELEVYTKEKMLSRRVSSEELHNSYAYFTLRWHHPVFSLQLHEPQKKHQMQDTMVWKADPSGFYSTKSAYRILMTFNRPVPQRRILQTIEACNAHK

SEQ ID NO: 174867 - protein, 107 aa, Glycine max
  Coding DNA Sequence Number=SeqID_83182
  Gene Ontology: Mol. function=transferase activity, transferring nitrogenous groups; Cellular component=cytoplasm; Biological process= biosynthetic process
  Homolog annotation: Hit_ID=A4W7Z5; Match level="QueryCoverage=100%, HitCoverage=27%, E-value=8e-50, Identity=90%"; Hit description=2 -keto-4-methylthiobutyrate aminotransferase
MLRAEPGHYRELPHFYRERRDLFVSALGKSRLEILPSEGTYFLLADYSAVSDLDDVSFCQWLTKEVGVAAIPLSVFCADPFPHKLIRLCFAKQESTLLAAAERLNAL

SEQ ID NO: 174868 - protein, 224 aa, Glycine max
  Coding DNA Sequence Number=SeqID_83183
MAPRKLSSKRSRKEAAAAGTSAAPEFDSHRFRSVEHQQRFEAIKGWSFHRERRVQLRDNEYTDFQEEIARRRWTSLVTPMAKFDPDIVLEFYANAWPTEEGVRDLRSWVRGQWIPFDADALSQILGYPLVLEEGQECKYGQRRNRADGFDEEAIAQLLCIPGQDFARTAAGRRVRIMRTNMTTLTQTWMMLLLSNILPSDHNSNLPLPKCQLVYATYQALSRPR

SEQ ID NO: 174869 - protein, 46 aa, Glycine max
  Coding DNA Sequence Number=SeqID_83184
MVHDIFVKKWVYDPNMVVSYPNFVRGPLLDDVRPFFGPREVLGTHH

SEQ ID NO: 174870 - protein, 49 aa, Glycine max
  Coding DNA Sequence Number=SeqID_83185
MGARDANNGEILESNCKVLGLSNFNYNNYLLQCGSPNYQSWIAAYSSRL

SEQ ID NO: 174871 - protein, 74 aa, Glycine max
  Coding DNA Sequence Number=SeqID_83186
MATKMKRCPFEALGSMTPITSMPHIENGQGVAKISNGTGPRQVFLVFDVSFDIEVPYHPHLLLSNNNVRAHHDI

SEQ ID NO: 174872 - protein, 156 aa, Glycine max
  Coding DNA Sequence Number=SeqID_83187
  Gene Ontology: Mol. function=GTP binding; Cellular component =intracellular; Biological process=small GTPase mediated signal transduction
  Homolog annotation: Hit_ID=A1FYE5; Match level="QueryCoverage=70%, HitCoverage=25%, E-value=2e-45, Identity=85%"; Hit description=Small GTP-binding protein
MFDRSKKGEHALLIQPHFGKLEDDVLEEFGDLARSAGASIAATITARLDRPNPSTLIGSGKLDEIKAAADASGADLVLVNHALSPGQERNLERFLERRVIDRTGLILDIFCPACAQPRGQAAGRAGAAASPGHAAGARLDPPGAPARRFDRPARPG

SEQ ID NO: 174873 - protein, 98 aa, Glycine max
  Coding DNA Sequence Number=SeqID_83188
  Gene Ontology: Mol. function=phosphoprotein phosphatase activity
  Homolog annotation: Hit_ID=A7PHV0; Match level="QueryCoverage=64%, HitCoverage=19%, E-value=1e-17, Identity=59%"; Hit description =Chromosome chr13 scaffold_17, whole genome shotgun sequence
MWAWERCTTLAPKRTPPFMWEPYTTTIMSALPPICLVGSVAWCAVLPLICFHVVEWHQPDRVLRQFGMQQPIPECPSQLGVEMSQAKPSLTRLELGLS

SEQ ID NO: 174874 - protein, 171 aa, Glycine max
  Coding DNA Sequence Number=SeqID_83189
  Homolog annotation: Hit_ID=A1FW55; Match level="QueryCoverage=69%, HitCoverage=45%, E-value=3e-40, Identity=68%"; Hit description =General secretion pathway protein K precursor
MAVIVALLVVALVAVIATALLTRQSAQLRALRSDQLRAQVRMAVDATLERAAQQLREDVKEQLTTLQLVDAQSMFNLRNLLAHGRPDPEARRAFIALCAAQGLGQGACASAADHIQARLRDGDIQAQAPLPRESLIAQALADPGQRQHQRPERSAGGDACGRAGTAAGAAR

SEQ ID NO: 174875 - protein, 43 aa, Glycine max
  Coding DNA Sequence Number=SeqID_83190
APSKAVLRSTKSDESPAQVGASYMAYNKHLRSSDDPSVTCTSL

SEQ ID NO: 174876 - protein, 108 aa, Glycine max
  Coding DNA Sequence Number=SeqID_83191
MSGQIQRQRQIEVNDNAATVCCAMLFLAVATYPSAGGRRVTRGMRVPRKEYARSRHQRLFEENVGKTGKDAIYELFSERFGSCIYARGRVFPFAPTYSSIWDEKIRPT

SEQ ID NO: 174877 - protein, 87 aa, Glycine max
  Coding DNA Sequence Number=SeqID_83192
MLKLSDNIIRFHRRVVLGYLEVVSRPWRLTVGNWLCDSDLVNPTGIERVLTEKDLLAYSYSDLEASIFDENEFLLLKVGDQTVWPSP

SEQ ID NO: 174878 - protein, 132 aa, Glycine max
  Coding DNA Sequence Number=SeqID_83193
  Subcellular localization annotation: CTP_CleavageSite=81; ConfidenceScore=5.31e-01
MHPPPIESGAPRSYCVALFANSPFSTFFGDPMNLLPSAVHAVLHLRVWSPAKLLRSAVRQFSILHFIRRPMNLLPNVVHVSSSIDSAAARSYCEARCSPILHCPLYSETHECWLALFMCPPPLSLEPREVIA

SEQ ID NO: 174879 - protein, 127 aa, Glycine max
  Coding DNA Sequence Number=SeqID_83194
  Homolog annotation: Hit_ID=Q75HR7; Match level="QueryCoverage=32%, HitCoverage=5%, E-value=3e-08, Identity=68%"; Hit description =Putative uncharacterized protein P0628H02.8
MELASTEIELLAIVIALEKFRSYLLGTRVIIYTDHAALKLLGDAFQTMKSTRSCNSVTLPHQVAILAYRGQLARRLTAISIGPPSSRMRGESVALVSLVREQAAHIHGDSKCLNNPCCSVRCLMSGV

SEQ ID NO: 174880 - protein, 210 aa, Glycine max
  Coding DNA Sequence Number=SeqID_83195
  Gene Ontology: Mol. function=transferase activity, transferring phosphorus-containing groups; Cellular component=intracellular; Biological process=two-component signal transduction system (phosphorelay)
  Homolog annotation: Hit_ID=A8GG46; Match level="QueryCoverage=100%, HitCoverage=32%, E-value=1e-106, Identity=96%"; Hit description=CheA signal transduction histidine kinase
  Pfam annotation: Domain name=CheW; Domain location=69-197; Score =109.9; E_value=7.6e-30; Accession=PF01584.10; Description=CheW-like domain
  Pfam annotation: Domain name=HATPase_c; Domain location=1-64; Score =11.2; E_value=0.0045; Accession=PF02518.17; Description=Histidine kinase-, DNA gyrase B-, and HSP90-like ATPase
  Pfam module annotation: Pfam domain module=CheW::HATPase_c; Domain location=69-197::1-64
MSDEEVGMLIFAPGFSTAEQVTDVSGRGVGMDVVKRNIQEMGGHVEIRSQAGKGTTIRILLPLTLAILDGMSVKVNDEVFILPLNAVMESLQPQAEDLHPLAGGERVLQVRGEYLPLVELYRVFEVDGAKTDATQGIVVILQSAGRRYALLVDQLIGQHQVVVKNLESNYRKVPGISAATILGDGSVALIVDVSALQTLNREKRLTDAAA

SEQ ID NO: 174881 - protein, 135 aa, Glycine max
  Coding DNA Sequence Number=SeqID_83196
MVHLLGLLTENEKGYISCGSVLLEGTSTRFKENKGGYIPCGSLLVKGFLQGWKRNLKDRRSLGDWMLLQDHDEDQVNLCLMTKSNENNKEDSVRKKQWMFQAHDGRYIQIHNHFPQEKWTRYIWRQQQRKNYWSR

SEQ ID NO: 174882 - protein, 224 aa, Glycine max
  Coding DNA Sequence Number=SeqID_83197
  Homolog annotation: Hit_ID=A5B383; Match level="QueryCoverage=94%, HitCoverage=28%, E-value=3e-15, Identity=31%"; Hit description =Putative uncharacterized protein
MNTWASRVLLKPQKGETTLFITDMTKANVSLPRQIKWDEVTLPKRWVMDKATPSVPRPAPTIEHIKQDNSGKVEITFNRRNSFSSRIEASRSEYESARRKDIDYPWKQEIIGDPTTNVITNWQVRDGELIQSELPPTTQYQLPNIKDSNNKPVMAIPFKTKDVNEEVTSKDIKSLMEQANYTNKYLQALGETIKTKVVPKQKSIEGASPSVPIEIEKPLFKPFK

SEQ ID NO: 174883 - protein, 170 aa, Glycine max
  Coding DNA Sequence Number=SeqID_83198
MYICVKKSRKDAAAAGTSAAPEFDSHRFRSAEHQQRFEAIKGWSFHRERRVQLRDDEYTDFQEEIAHRCLMSLVMPMAKFDPDIVLEFYANAWPIEEGVQDLRSWVRGQWIPFDADALSQFPRYPLVLEEGQECEYGQRRNRADGFDEEAIAQLLCIPGQDFAQTAAGRR

SEQ ID NO: 174884 - protein, 21 aa, Glycine max
  Coding DNA Sequence Number=SeqID_83199
MELSTALPENSNCLTTTMLEA

SEQ ID NO: 174885 - protein, 60 aa, Glycine max
  Coding DNA Sequence Number=SeqID_83200
MAFGASGTPSICKAGLLLEEATQLAWASWVATSSPFFPINRQKGVVLRVPDSPGYAFQLF

SEQ ID NO: 174886 - protein, 106 aa, Glycine max
  Coding DNA Sequence Number=SeqID_83201
MYIEKVSSVDSSPTVQGDENPKTVQIQGPMTRNRTKQSVDTLQQIIAGIFSKAQVEKDKSPNGEGRRPKWKRTKPQVEKDKGPSGEGRKTQVEKDEGPEAEALLSI

SEQ ID NO: 174887 - protein, 159 aa, Glycine max
  Coding DNA Sequence Number=SeqID_83202
MSGGRAAEVDAGMVNGTMVVGREERKQMDRKKVCQASWGDPEARWEVLPARNSAGGLTMYLLWDEDSLGTDQMGQPKADWTKFLYPLAPLLFNIVAEGLNDDTLFFGAVSMENVRAIKVILSSFELDRLPTKINLRRRNVEFNDVICPFCRNNEEDAAH

SEQ ID NO: 174888 - protein, 81 aa, Glycine max
  Coding DNA Sequence Number=SeqID_83203
MVPLIYGGWVDLQSGRDKAWHSHWWKDLRRLYNQPDFHSIHQNMVWRVGCGDKIKFWQDSWLSEGCNLQQKYNQLYTISRQ

SEQ ID NO: 174889 - protein, 274 aa, Glycine max
  Coding DNA Sequence Number=SeqID_83204
  Gene Ontology: Mol. function=aspartic-type endopeptidase activity; Cellular component=small subunit processome; Biological process=DNA integration
  Homolog annotation: Hit_ID=A5C4F6; Match level="QueryCoverage=91%, HitCoverage=20%, E-value=4e-22, Identity=29%"; Hit description =Putative uncharacterized protein
MASSGPIFSFSGTRTITTAKRHHDHLEKAFDSVPDDKRPEWEKLDYQLCAVLWQSVEPDILEILRSFKSCRSFWKKAQEIFANDIQSLFDVTMKVTALKQTNHDMIAHVDFDHVRDQVLAGDQVPSMNSLITRLLRVPHLLKDENPADGVERSAMVASQGREAAATIEEIAMEGVDVLIAPIARGWVTPKRIGIRCMGFPTRSHRSLDKRKQSLDSLMRTCISQSIEGPSPWILDSGAANHIFGNKSSFSSFSFPKIHHLVTVANGSKVASQGS

SEQ ID NO: 174890 - protein, 119 aa, Glycine max
  Coding DNA Sequence Number=SeqID_83205
MTASESNILKPWGQNQLLACALELLEPNFTTKQLLYKHERIVPLSRLNLNDNLRTQTKPKEVDEHNHGIAPEFQWPDTSMWVGRDGWATLGEMHQIQVSLETRPGEQVRPYEILEDTKS

SEQ ID NO: 174891 - protein, 103 aa, Glycine max
  Coding DNA Sequence Number=SeqID_83206
MGKENNGRNAQPVKHRKVAGKGCRLESSLLENERQEIKFEPNVMCEPIDKKVTFRTSQGCWCPLSTYQLWQTVVDSGDVGRRCLPLSVSGRLAMALSCRGVAI

SEQ ID NO: 174892 - protein, 60 aa, Glycine max
  Coding DNA Sequence Number=SeqID_83207
  Subcellular localization annotation: CTP_CleavageSite=21; ConfidenceScore=5.23e-01
MSVEKQHLSRLDFRNCSVGSSAVMLFGMPRPSNVTRNATSVEFARNTIGNLDRKHFEQQQ

SEQ ID NO: 174893 - protein, 103 aa, Glycine max
  Coding DNA Sequence Number=SeqID_83208
MWHPCSIVADEDYHERKAMCLSMEVWEAITSVDVSWGSSIVIHRLKRVVRQLGYVQTIPQHRATPSLSKENIDDRWLQLLLEYLAPVTHICSAPRQCAANYME

SEQ ID NO: 174894 - protein, 163 aa, Glycine max
  Coding DNA Sequence Number=SeqID_83209
MSAHVAQVWRLLGTLWTQISPTGPWGFYADHGPLAYCTPRQAQGDAHQAADALPPPRQTDPAGSLGVEHYLQHLVHQQAANHRGQVQIHECLYRFSLSQQGQGSAFFACPTPEQFGAEVAWPGDWLDAQAGEEPAGSPGEPDESHMDEDMTDLLGFLGGSGAT

SEQ ID NO: 174895 - protein, 83 aa, Glycine max
  Coding DNA Sequence Number=SeqID_83210
  Homolog annotation: Hit_ID=A6FJQ2; Match level="QueryCoverage=45%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLDCLTMGVKCLEVVKRGSHPNKQMVPRTKLGYDKCQPR

SEQ ID NO: 174896 - protein, 48 aa, Glycine max
  Coding DNA Sequence Number=SeqID_83211
MLTQELYGLCNNTLFDLWNVAELYGLRNNACFDFQNVARLYGLHNDGC

SEQ ID NO: 174897 - protein, 352 aa, Glycine max
  Coding DNA Sequence Number=SeqID_83212
  Homolog annotation: Hit_ID=A5ASR8; Match level="QueryCoverage=62%, HitCoverage=46%, E-value=7e-10, Identity=24%"; Hit description =Putative uncharacterized protein
  Subcellular localization annotation: CTP_CleavageSite=41; ConfidenceScore=5.35e-01
MAEPSKKRKGSSSTAAAAAHRRHRPSEAPTTPIHPSLSSPRSSTLFSSDDQRLWYLSQFSSRIILDPKYLDVDFFNDETFDCYQVFQNSGLVDFMSLKLPHYPELVKVFYCNLKIQDDIISSEVHGIPMIIDQSLFFSLTHLPSQGAPFEGTIVDDWKFDYSSHDAHHMVCNDQAEMTGRLLAKSLTFDNRIMHYIIVRILLPRSSNLAQASEEDLILMWAFLTGRQIDWAHLVRYRMHKALWANAHLPYPQLITLFLRHFQIPLDDEPFVQVKRSFAIGASAVTSFGYRKDQNALMNGVFSELRGLRSYVGERFDSLDTRFAEMDIRLTQLEEDVGYIRQSFDLPPPPPPS

SEQ ID NO: 174898 - protein, 91 aa, Glycine max
  Coding DNA Sequence Number=SeqID_83213
RRSNVFVATCPFAGERGEGHGCAFQGRKDAWSRHQHLFVENVGKTEGNRSKRKFQVWELYLRLRKVDKSGALAPTYPPSKRKSDLRSSSLR

SEQ ID NO: 174899 - protein, 70 aa, Glycine max
  Coding DNA Sequence Number=SeqID_83214
  Gene Ontology: Mol. function=RNA-directed DNA polymerase activity; Cellular component=intracellular; Biological process=RNA-dependent DNA replication
  Homolog annotation: Hit_ID=Q0KIL1; Match level="QueryCoverage=74%, HitCoverage=5%, E-value=2e-08, Identity=51%"; Hit description =Gag/pol polyprotein, 3'-partial, putative
RFTERKEGFSGREISLEEANEFLRFIQQSEFKIIEQLKKTSTRVSLLELLMSSEPHRALLVKVLNKAHVA

SEQ ID NO: 174900 - protein, 83 aa, Glycine max
  Coding DNA Sequence Number=SeqID_83215
  Homolog annotation: Hit_ID=A0ST23; Match level="QueryCoverage=54%, HitCoverage=91%, E-value=1e-11, Identity=73%"; Hit description =Putative reverse transcriptase
MDASLNEAHLMQDGDVTGIARGQTRDDVDFLDTVTKMGTELEFVIMVIAVSFGKPVVPAALMNRPTRGERRFAYWALFRFLAH

SEQ ID NO: 174901 - protein, 102 aa, Glycine max
  Coding DNA Sequence Number=SeqID_83216
MLGVATYPLAGGRCEGSRVRLPWEENARSRHQRLFEGNVGKTRKGVSLAPTYSSIVIRKSDLRSSFKRGESSDSFYLEEGHLRHWTLKLSILLGEKAKALDL

SEQ ID NO: 174902 - protein, 243 aa, Glycine max
  Coding DNA Sequence Number=SeqID_83217
  Homolog annotation: Hit_ID=A6FJQ2; Match level="QueryCoverage=15%, HitCoverage=84%, E-value=8e-11, Identity=92%"; Hit description=50S ribosomal protein L5
MRKEKIPHQAPFAIQAAQLLGRAIGAGLFAITPAGERGMCCKAIKLGNARVFPERAGGFGQLKQRFLLPPGVIGDVGRQRGGMAVANQRYRRCVTLRLALRIAGGPRGAVIQQAGIALGGDFPFVAELHRFTDARFQATALPQQHHGTGCQQRRGAVAGDQPARTAARPTEWLFDEAPGYRARIRNHGHSCFLRETCRASCINESANARGEAVCVLGALPLPRSLTRCARSFGCGERYQLTQR

SEQ ID NO: 174903 - protein, 66 aa, Glycine max
  Coding DNA Sequence Number=SeqID_83218
MKEREWKIFRPDKFLASLARCFPCVSFIHKYIVSLRYGALANAFHFSSLPNAVHVSSTLRVWSYAS

SEQ ID NO: 174904 - protein, 422 aa, Glycine max
  Coding DNA Sequence Number=SeqID_83219
  Homolog annotation: Hit_ID=Q6WAY4; Match level="QueryCoverage=84%, HitCoverage=62%, E-value=4e-45, Identity=33%"; Hit description =Putative uncharacterized protein
MGTNQNGKRFYQVKVKGLDVTSLKELGRLMGPLQRKAFCKVYGKILDLITAEVFTEAVVSLAQYYDQPLRCFTFGDFQMVPTIEEFEEILGCPLGGRKPYLFSGFLPSLSKIAAMVRDSAKELDRMKQTRNGVVGLPRKYLEGKARDMASQEKWGPFADILALLIYGVVLFPNVDGLVDLAAIDAFLAYHHSKESPVVAILADLFDTFDRRCEKNSARVVCCLPALSVWLVSHLFQQDTRHPCPLQSYRSCVENGRVDWDQHLARIGGSAINWFPRWKEGKEGVLFSCGDYPNVPLIGTRSCINYNPALAIRQLGYPMRGAPTEGSLSPFLVRDLGAQGLKVIQRIHKAWRSPLRKDKELRGIRNGVIGGYHGWLRIHTRGLDWLSKLKVIDEENFEAPEEDEEVQALKLELGKARLAKEKF

SEQ ID NO: 174905 - protein, 83 aa, Glycine max
  Coding DNA Sequence Number=SeqID_83220
MNRNEENVTGVWIDGDPVLRRTRIRATWEYVSSVEGEQLGMSTCTIARPPPSTTCDGVVPGDMSRGSGDLGDVRWGAIAQNHA

SEQ ID NO: 174906 - protein, 59 aa, Glycine max
  Coding DNA Sequence Number=SeqID_83221
MEFQRPPTAWEVMEKTKKLKLGEWVNDKFGEFAAREISTSSRGHLTTFDRGRHIYIGFP

SEQ ID NO: 174907 - protein, 78 aa, Glycine max
  Coding DNA Sequence Number=SeqID_83222
MEREMITVIVDTLLMFYYEKMVGYMPSSFVDLVFAGERIEVGLRRGKFDYPALMNRKPGENGENKKEGGTHPVTIVPT

SEQ ID NO: 174908 - protein, 69 aa, Glycine max
  Coding DNA Sequence Number=SeqID_83223
MASSSSSSSNIKIKSGPIDGDVLWMQAKHVSEHVWNGEEDRKLHIRRAVPTYQGEEEIPEEIIPLLWQC

SEQ ID NO: 174909 - protein, 105 aa, Glycine max
  Coding DNA Sequence Number=SeqID_83224
MVDHYSLGDDLGSLPRYCIFNVYLIRVRPRSLGPFWTPTKWCSSACTTSDGGLPTPGHNMSFRAKTPCGACRPWIFFINGVLGFLKMNGNGMEKKDDWSTNSRRR

SEQ ID NO: 174910 - protein, 126 aa, Glycine max
  Coding DNA Sequence Number=SeqID_83225
HLLFPGRLRWGPLMVIHQPKRVVQQFGYIQTIPPHPTVPLCSSDYMEWFYFILHPFMTPAQPRDPPRVPLLQQYDTFVEPDDGYVAIADKLERLLNLRILTEGIEVYTVAEECLSIARSYIGQPTI

SEQ ID NO: 174911 - protein, 284 aa, Glycine max
  Coding DNA Sequence Number=SeqID_83226
LHPLEENEHVIGIMTENVSQFVRLIVKECNDSIPAMFDCDNHLAKNLTTFLNELSLAPTFAKRNTQWLSARKNPEEDELYTDNVLGRHILAERKVEIYHTVLDEFKAKLERRNFHKHLTKLVDSSIDLALVKEFYANLYSPEGPSPKQGEPLSAYSRYCRMPTDIKEIETALCIPGRGFILNAEGHPRKILIKDLTTLAQVWSVLSYFNLAPTSHSSNLTVDRAKLIFGLVTQLDMNVRALISGQITSMAQSNSSRLEFPALITALCRSRGVASDSLVFERLSP

SEQ ID NO: 174912 - protein, 29 aa, Glycine max
  Coding DNA Sequence Number=SeqID_83227
MYIGVWQLEYVGCSGDGPEETCLKEIQEG

SEQ ID NO: 174913 - protein, 145 aa, Glycine max
  Coding DNA Sequence Number=SeqID_83228
  Homolog annotation: Hit_ID=A4W4U1; Match level="QueryCoverage=98%, HitCoverage=95%, E-value=8e-34, Identity=49%"; Hit description =Putative uncharacterized protein
  Pfam annotation: Domain name=DUF1198; Domain location=1-145; Score =198.0; E_value=2.3e-56; Accession=PF06711.2; Description=Protein of unknown function (DUF1198)
MIWLMLATLAIVFVVGFQLLTAGSRHAAQALSKRLQLPPVHVESLLAQMGKEAANEFTDYIRGDNEVHLNNGAAVLLIWQVLIVDGSDENAQRWHHILTKAGFSALISRQQLLLALGFLRQLEPDSQELNALREQYNARFTPQGI

SEQ ID NO: 174914 - protein, 162 aa, Glycine max
  Coding DNA Sequence Number=SeqID_83229
GGLFAGSRATNSFSEGHHFKNSVAPPTYLALLILLPVAAASGDKSCLTGATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQL

SEQ ID NO: 174915 - protein, 232 aa, Glycine max
  Coding DNA Sequence Number=SeqID_83230
MHYIIVRILLPRSSNLAQASEKDLILMWAFLTGRQIDWAYLVRYRMHKLLRANAPLPYPQLVTLFLRHFQIPLDDEPFVQVKRSFAIGAGAVTSFGYRKDRNGQWLNKDALPPQDERTPSPPPQRNDSALMTEVLSELRGLRTYVGERFDSLDNRFARIDVRLTQLEEDVGYIHQSFDLPPPPPPSYSLVYNFLFKPRILAIIIWILQEIIQLLEDLDLEDGLGVKTTLSFC

SEQ ID NO: 174916 - protein, 73 aa, Glycine max
  Coding DNA Sequence Number=SeqID_83231
MVSFVNVRIQGDSPQISASPHQLDFAPYASRSYNAQWNAPGLLHDKHTLRSSRILRKMEVVFVIGSAVDRLCG

SEQ ID NO: 174917 - protein, 135 aa, Glycine max
  Coding DNA Sequence Number=SeqID_83232
MEMSMIDAASGGALGDMTLVEARNLIEKMASNSQQFSARNYVIVLRGVHEVATDSSSFAENKKLEGKLDALVNLQSGVNEQPKAYAANIYNRPHQQQNQQQQNNYDLSSNRFNTSWRKHPNLRWASDVSLFSPIS

SEQ ID NO: 174918 - protein, 187 aa, Glycine max
  Coding DNA Sequence Number=SeqID_83233
MGDQEETREQMKVGMSALKEQMASMMEAMLGMRQLMEKNVATAVAVSSVAEADPTLLATAHHPPPNVVGQGRSTLGHNSNPHLGYSWVAYPYRLPPNYTPLVMQDDTGHVSSPILEGEPPRQPDKVHEDHQEYAKGILSSTPRSPSRGRHPTLCLSPTSQHNQYSCPQKDHPRRPKKEGNSISSKRD

SEQ ID NO: 174919 - protein, 115 aa, Glycine max
  Coding DNA Sequence Number=SeqID_83234
MDAMKEKMAAMMEAMISVKKIMEVNAVIIAATSTVAKVNPMPPSGLNQMNHPTLDMVGKDLGSRDGLHDVQNQNKHAFPPYGLPLNYTPPNVAYTLNEDVNNSTPIPIESQQPPN

SEQ ID NO: 174920 - protein, 43 aa, Glycine max
  Coding DNA Sequence Number=SeqID_83235
MENRTKQSLRMAPNSKAITTDGSKLEGGGHMNENAIHGAPKKG

SEQ ID NO: 174921 - protein, 419 aa, Glycine max
  Coding DNA Sequence Number=SeqID_83236
  Homolog annotation: Hit_ID=Q6WAY6; Match level="QueryCoverage=50%, HitCoverage=39%, E-value=2e-24, Identity=31%"; Hit description =Putative uncharacterized protein
MSPPPLEPHNHSQTHLKLLGRLPLQAPRVLFSLSGWTEVVRLVGLPFAQCQCIAHPSSRFFLTLNKGVLRSADGSLSQKIGLARALASQGEWAVFINVLTLLLFGTILFPNVDRLVDLVAIDTFLAYHHCKESPIIAVLADTYDMFNLRCEKSSARIICCMPALYGKANWEELLADMIGASISWFPRWKEGGARVLCSCEGFPNVPLMGTRRCINYNPVLAIRQLGYPMRGAPSEEIITPIIVRGFSEANAKILQKIRKSWNRVERKDKELRGSSNNVIDDYHKWLKSRTQGITWILKLKSLSGKEAKIPEETEEVQALKAELESTSVVKKKLKTTVTRVKKDCDELKDINMTTLKALERETKRARKKEWSRNKFRGALWGSSNVLKLRKVERDESRMESMVLEDKLKAYQRLKRCLTE

SEQ ID NO: 174922 - protein, 167 aa, Glycine max
  Coding DNA Sequence Number=SeqID_83237
MRTTHDLPCACELSRYVVGTIPLDTIHMFWRRLSFTNQGLSEPKVSTTEEMETISKQFEEVDVCGKVTLKSIGEDSWSLVRNHLLKEPSKWSDEYINLLGGIDRFEELKRSLLVDGLSMNEFKIESRTLQGSRGNLISRIKIQGSSFQESRSRFKTQDSRIKNQEKT

SEQ ID NO: 174923 - protein, 573 aa, Glycine max
  Coding DNA Sequence Number=SeqID_83238
  Homolog annotation: Hit_ID=Q5XM22; Match level="QueryCoverage=17%, HitCoverage=72%, E-value=2e-19, Identity=44%"; Hit description =Resistance-like protein HAAS-2
MAAPPQNGKEDSFANCHRQFVKGGLLWRNLGLLLSSIDNTDLETGSVPGPRFGESNDHTFEVEVEEDLASEPGVLVEGSGSGIADEDVLLVVGARGELVEPLLGNVDLAVGRAGVDLLEAVGLRVDQARVDQGLQQGLAGQAHHLVLLSHEVDRREPYDAVGDLLRGRGGAAVDQGFGEEREGGEAVRLRGQSLQIRDCHWCFLFWEARREWSFGWEIGTKEMIGFGREMGGIQGSKFLGAPIPISAVMWNKPLSVEGRQHLHVDNGQLQLLLRMLIIQLTRFMNSLRSQLLMIHSLGMRERPELKLSSHGRKVQKFGRHAPEIEGIMVVTGLSLLIACSLGTGHFTITLDDVAFLLHLPITGAFHTFDALHVDQVVDLLVELLEWTVATRAHLLHLVGCTLFSNKSVIHVHVVFLDAFPNLSQSGSYSLGAIALVHMYDNLNDASKKSARQLVGYITLLQYWIYEHFPTIVSCVSDKDYHERKPRACWWKSGKALTVSTYRKRLDRLTSNVVCWIPYGDHRAFKEFELISLFSDKLDVVHKIDDRRMQFSEYLAPVGQICVAPRQCATDYME

SEQ ID NO: 174924 - protein, 83 aa, Glycine max
  Coding DNA Sequence Number=SeqID_83239
MMRILKLAKYRLKAQTYQGNPCGVYPDLSSFTGSGVYPDLSFFTGSGVYPDLSSLSGSSIIQNLYSLYQAIRSYSGSHQKACE

SEQ ID NO: 174925 - protein, 153 aa, Glycine max
  Coding DNA Sequence Number=SeqID_83240
MKEKIEGLFSTESLRQILLQFLWWPLVVVGGGGGVSRMVWQSFERGRDLGAIDRSNLIIPCENIASVNYCRNLPFGGRATRGSQVCLPREEGARSRHQRLFEENARKTRTCGLRNLIVKGSRVVFTHGEGISTPCVRHKGRQPSIKCANMTSK

SEQ ID NO: 174926 - protein, 80 aa, Glycine max
  Coding DNA Sequence Number=SeqID_83241
MARIAKVVKISEQELDRVKQNRNGVAGKCSVVESAPDRTNTQVFTSSTYKEEPTEDLALISGKLPLQQREEKDEGLKKYK

SEQ ID NO: 174927 - protein, 176 aa, Glycine max
  Coding DNA Sequence Number=SeqID_83242
MTDVWSRTSHHIEDEELMARKRAMEKKETRWTSGSTPASKLHHKEYMKPCNNWNKGIVDHMPRRDGGWKNYDQGRQKIGDTQPDSIDNFTMRNSDGGIEYLIKINPLAKKINKLDEKGKDKHDKSDPPLPPPTPSVSKASGHQQLIFGDFNTIAGGFSREGENSLARKHYARSIMS

SEQ ID NO: 174928 - protein, 197 aa, Glycine max
  Coding DNA Sequence Number=SeqID_83243
  Homolog annotation: Hit_ID=A7PHU1; Match level="QueryCoverage=33%, HitCoverage=43%, E-value=1e-16, Identity=69%"; Hit description =Chromosome chr13 scaffold_17, whole genome shotgun sequence
  Subcellular localization annotation: CTP_CleavageSite=76; ConfidenceScore=5.10e-01
MERTRKRQPMTEPMAEPSMPSLRALRLMWARKASSASLLLSRFSASFSPCATSDEKRKKLNDTTSKTRSFLATSTSASQEERFSRLRWPGVVRERPTKTAIVKREFTFTRPSRAVTWTLVVEEDEDEETLLVRVWSLGEREREILVHGESMPVREGVFWIVSKSKGKVNATSKESEGGHRTNTSEIFRTDNNITTRS

SEQ ID NO: 174929 - protein, 221 aa, Glycine max
  Coding DNA Sequence Number=SeqID_83244
MACPEDKKVSYVVFMLATKAEFWWHGTQSMIEAHGEAFKERFLGKFKVQRTIFLMAIIEFLAMVEKMKIVDVTPQSNHTRMRGIQRLYNPSLKNFIVKYAWLGVVVGWVTIWEVSQKACLKKGYLWSVLTNGGDVIMEHLECNNRVLKTHGDGSSRPKKGNHQKKPYNRPQQHHGGPIVSRTGNKGVRHISKNCQVVVKTRVCVASHQVLGCVLCGSNAFK

SEQ ID NO: 174930 - protein, 37 aa, Glycine max
  Coding DNA Sequence Number=SeqID_83245
MGRVATNVYLRKTSEKSEKVWSTKSVKGSGVVFTHGE

SEQ ID NO: 174931 - protein, 77 aa, Glycine max
  Coding DNA Sequence Number=SeqID_83246
  Subcellular localization annotation: CTP_CleavageSite=48; ConfidenceScore=5.45e-01
MRLADRKNLEGNLSRRHALSASSARSASRLSPSRLSGSLALSENSLTRAKSENGAKRDVEELPCYEMLNPQLGILVE

SEQ ID NO: 174932 - protein, 80 aa, Glycine max
  Coding DNA Sequence Number=SeqID_83247
  Subcellular localization annotation: CTP_CleavageSite=52; ConfidenceScore=5.17e-01
MFWFFRRFPRINIGGNSARLPSLEDAPVSPASPSRRRALFDAILPRKGPVTRAMSKRLQEDCARAVEEGPKVLMSLRVDF

SEQ ID NO: 174933 - protein, 105 aa, Glycine max
  Coding DNA Sequence Number=SeqID_83248
  Subcellular localization annotation: CTP_CleavageSite=41; ConfidenceScore=5.33e-01
MAESSKKRKGSSSTAAAAAHRHHGPSKAPTAPIHPSLSSPRSSTLFSSDDQRLRYLDIDFFNDETFDCYQVFQNSGLVDFMSLKLPYYPELVKVFYCNLEIQGIL

SEQ ID NO: 174934 - protein, 115 aa, Glycine max
  Coding DNA Sequence Number=SeqID_83249
TTKAKGVQPYWAEIYIDTQTRKDGSIVTEKTGIVIDELKKKTVEAKSSQNLQTTQDSTYWTNDIYSKVKGPEKKGRAGCLGKLPHQTSISQSSYAYNKIQKLENLLRNLVSVLKV

SEQ ID NO: 174935 - protein, 196 aa, Glycine max
  Coding DNA Sequence Number=SeqID_83250
  Pfam annotation: Domain name=G-patch; Domain location=62-106; Score =32.0; E_value=2.1e-06; Accession=PF01585.14; Description=G-patch domain
MDPFSGSRSLYTSSEIEVRSGKAFGHRIKRGRHLGELSILYAIYGGRRGVVRNHFPVFRGDTTVMVARVMLGNGYEPEMGLGKDNGGISSLISAKGNRGKFGLGYKPTQADIRKSIAGRKNGGQGSRLRQEDEGSPLCHISRSFISMGLGDEGQVVAICEDDAPSGSDLVPPCPPDFQLGNWRVEERPGIYATSIM

SEQ ID NO: 174936 - protein, 102 aa, Glycine max
  Coding DNA Sequence Number=SeqID_83251
  Gene Ontology: Mol. function=aspartic-type endopeptidase activity; Cellular component=chromatin; Biological process=chromatin assembly or disassembly
  Homolog annotation: Hit_ID=Q55TA8; Match level="QueryCoverage=83%, HitCoverage=5%, E-value=2e-10, Identity=38%"; Hit description =Putative uncharacterized protein
DQGVPMNPKRIKVIPEWPTPSSLRKIWGFHDLANFYKRFAPYFSILVAPLIELVRNHVPSWEDAQEIGVEGRSPEYEEPQDLRSYPFQGGGNDAILPCKSIG

SEQ ID NO: 174937 - protein, 136 aa, Glycine max
  Coding DNA Sequence Number=SeqID_83252
MGAVKDQMTSMMEAMLSMRRMMEDNAAIIATTSAAVEANLTHPSCINQTSRPAPNMVDQGREVLDSTGGPYMVQSKNSFPPYGLPPNYTPPNVVHVPSENTNHFIPILLESQQPQLGHHPLLNLWEKPVKSLGITL

SEQ ID NO: 174938 - protein, 53 aa, Glycine max
  Coding DNA Sequence Number=SeqID_83253
VKGRSPEFQELLDLRSNSFHGGGDDAILPPLGHWIEDSKKIELEMQEKALRFS

SEQ ID NO: 174939 - protein, 84 aa, Glycine max
  Coding DNA Sequence Number=SeqID_83254
  Homolog annotation: Hit_ID=A5AWG3; Match level="QueryCoverage=100%, HitCoverage=16%, E-value=2e-08, Identity=39%"; Hit description =Putative uncharacterized protein
MNIEESIHVTFDESNAILSRKNMLDDIADSLEHMNIDEQDSKGNDKGNNEDPPEEVKSNDELPREWKASRDHPLDNIIGDISKG

SEQ ID NO: 174940 - protein, 100 aa, Glycine max
  Coding DNA Sequence Number=SeqID_83255
  Subcellular localization annotation: CTP_CleavageSite=23; ConfidenceScore=5.17e-01
MGHFKVQRLKRTSFQLSFGTNVRGANTFLKRKYNSRIWNILHDRFPSIFPTFFTNNVGGDSAHFPPLEDAPVSLASLARKRVGCDRHGFHFLSYGHLSLT

SEQ ID NO: 174941 - protein, 157 aa, Glycine max
  Coding DNA Sequence Number=SeqID_83256
MAEIINEENFEAPEEDEEVRALKTELRKARLGKEKFKLVATDVRKECVGLREENAATARALERETKKACKEEHGRDKFLGALWGSNSDLKLRREERDQSRAHSMVLKKELAACSRSKRSLSQRLCETETNMLAIVSKYQEELNLATDHEHKVAYEYA

SEQ ID NO: 174942 - protein, 138 aa, Glycine max
  Coding DNA Sequence Number=SeqID_83257
MASKKRKSIGTRPTTQYDTRRFSSLDAWTRYTDNVLGRNILPERKVELYHTELDDFKDELERRNFHKRLTNLVNGSIDLALVKELYANIYSSEDRPPKQSRVRDHLVKIDADSLNTLLETPMVLVEGETLPAYSRYYR

SEQ ID NO: 174943 - protein, 97 aa, Glycine max
  Coding DNA Sequence Number=SeqID_83258
LGPRTCLPWVLSLPWSCVEAYQGRALDFVNPYGSASAKVGFDESCVQCKYCALTYTPLTKWQVLETRWCLSVGLTKGGPWVSQALWRIDQGIFRLGF

SEQ ID NO: 174944 - protein, 72 aa, Glycine max
  Coding DNA Sequence Number=SeqID_83259
MSLEEAHHHRRSWIRAWRKKEMNEGRGREEHEILCSKRALKFELWFMMWTLRGGSLDTGYGVLDDATSSEGR

SEQ ID NO: 174945 - protein, 45 aa, Glycine max
  Coding DNA Sequence Number=SeqID_83260
MDDFSEDEDQQFFDHINHQSDDQSDGKGVGRPTTPPSPPLQYHQP

SEQ ID NO: 174946 - protein, 84 aa, Glycine max
  Coding DNA Sequence Number=SeqID_83261
MDPKKSNRALGFPALVTGLYQSYKVHVTSSKGIRLPTNRAFIKKYCVPRQVQGETPQKPGDGRQRATDTPPSPLEFTSAHPQKG

SEQ ID NO: 174947 - protein, 36 aa, Glycine max
  Coding DNA Sequence Number=SeqID_83262
MARTKKNGQTTSEAAKEIADKIDSLEEQAPQDIRMY

SEQ ID NO: 174948 - protein, 276 aa, Glycine max
  Coding DNA Sequence Number=SeqID_83263
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGIRSAEAAIILLEHNSIDLGTTALQPSSCNKPAQESLSSNMPNIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 174949 - protein, 608 aa, Glycine max
  Coding DNA Sequence Number=SeqID_83264
  Gene Ontology: Mol. function=motor activity; Cellular component=cell projection
  Homolog annotation: Hit_ID=UPI00006A16D8; Match level="QueryCoverage =63%, HitCoverage=92%, E-value=3e-25, Identity=32%"; Hit description =UPI00006A16D8 related cluster
GCMPHTFRGLHDLTIRGLHGVTFRGLNVLAIRGIHVLTIRGLGLHVLAIRGIHVLTIRRLYAFTLRGLHALTFRGLQVLAIRGSHALIFRGLHILTIRGSHGLIFRGLHVLTFRELQFFTIRGLHVLPFRGLHVLTIRRLHALTCRGLHALPIRGLHALTFRGLHVLTIRGLHALTCRGLHVLTIRGLHALTFRGLHVLAIKGLQALIFRGLHVLAIRGELQFFTIRGLHVLAIRGLHALTFRGLHVLTIRGLHALTCRGMHVLTIRGLHALTFRGPYVLDIRGLDALTFRGLHVLAIRGLHALTCRGLHVLTIRGLHALAIKGLHALSFGGLHVLAIRGLHTLTFRGLHVLAIRGTHALTFRGLHVLASEGYTPSSLEDYTGLDIHVLRALHVFAIGGLHASTFRGQHVLAIKGLHALTFRGLHVLAIRGLHILTIRGLYSLTFRGLHVLAIRGLHALIFRGLHVLAIRGLHALTFRGLDILAFRGLHVLPSEGCTPSPLEDYTSLPAEDCTPSPSEDYTAARSHLQRTNILAFRGLHVFAIELHASTFRGLQVFLPLEGACPHLQRTTRLCHQGARPHFRDYTSFTIRGLHVLPFRGHTSSPSEDY

SEQ ID NO: 174950 - protein, 118 aa, Glycine max
  Coding DNA Sequence Number=SeqID_83265
MAAQVATPMIERELIAMIVDMLPVSYYEKMVVYMPSSFADLVFAGERIEVGLRRGKFDCLALTSKKPGANRENEKGEGTCVLTAIPTWPNFLPAQQFHYSANVSPFHYPPPNHPRGHH

SEQ ID NO: 174951 - protein, 113 aa, Glycine max
  Coding DNA Sequence Number=SeqID_83266
  Subcellular localization annotation: CTP_CleavageSite=88; ConfidenceScore=5.61e-01
MRRNSLASSSDTYFLPQPSFFSEKPFTGIFSFGVGITLSLCSSAIFAFPLTFAGCVDRSGGANTRPLRVTPLSPLILVTLADNELMSVASSFLSLGGAYLHGTAWLFWYGGIL

SEQ ID NO: 174952 - protein, 166 aa, Glycine max
  Coding DNA Sequence Number=SeqID_83267
  Subcellular localization annotation: CTP_CleavageSite=50; ConfidenceScore=5.36e-01
MAYIRKNCWNPDDLTISIRGARRAKARPTNLPSTSTVPTPASTLVAPSVLAQLDSQCFEAMLQSIHQGHIILLQSLQVVAPPRFIPSIEQFLERVACLGEEQVRPETAATPERSLESTSKPSTPVADLFSLQPEADPCTPVLDIPEDQTTPVWTLNTSPPATPVLH

SEQ ID NO: 174953 - protein, 68 aa, Glycine max
  Coding DNA Sequence Number=SeqID_83268
MKGRKHKYGFNNNKREKTEKKKKIALDDVNQFSFIMIISISMNVVSFFFSDNVTSDLSGQRTNIGVHV

SEQ ID NO: 174954 - protein, 311 aa, Glycine max
  Coding DNA Sequence Number=SeqID_83269
  Homolog annotation: Hit_ID=UPI00016621D1; Match level="QueryCoverage =94%, HitCoverage=42%, E-value=3e-16, Identity=29%"; Hit description =UPI00016621D1 related cluster
LSIQRATSPCLQGPHILALRGQHIIALRGLHFLAFSGLHALAFVGLHTLTIRGLLILTFIGLHVLSFRGLRVLICIGLHALAFRGLLALAFRGLHVFHFRGLHVLPIRGPHIPALRGLHALAFKGLHALVFRGLHVLTFRRLHALALKGLQVLTFRGLHNLAFRGLHVLAFRGVHILPLRGLHALTFKRVHVLTFRGLYVVAIRGLHVLAFRRLHVLPFRGLHAHNFRGLHVLAFRGLHVLPFRGQHDLPFRGMQALALTGLHVLTFRGLHNLAFRGLDALAFRGVHILPLRGLYALAFVGLDTLTFKGVH

SEQ ID NO: 174955 - protein, 44 aa, Glycine max
  Coding DNA Sequence Number=SeqID_83270
MHHFKDNPRIAMNALSAPAALSLFIATVKFFRISDDRAERMMSR

SEQ ID NO: 174956 - protein, 335 aa, Glycine max
  Coding DNA Sequence Number=SeqID_83271
  Gene Ontology: Cellular component=integral to membrane
  Homolog annotation: Hit_ID=UPI0000510348; Match level="QueryCoverage =43%, HitCoverage=39%, E-value=9e-41, Identity=60%"; Hit description =COG0387: Ca2+/H+ antiporter
GICYPGVFGDRGGRPPAGDADRGRPRLEESGDVTHGTHATDRHHGRRPRRPGMGSLRGDPDPAPGARRPGSEPRAHHRARGDHRRDPGVCVRCGEAGRGAGAPARRPLRIARPDAVDRADRGDPDLGGDARTGRARHHRPRFGHGRRHDHPEPRDRAGAPGRGRPPSRHGAQPHRHLGVPVDARRAGRAREIPIVVLTLALYAFFLARQMGAQADDFTEVDPRLPRSTPHGERATGGIREVLAEHRTEVIVRLALLVVTVIPIVLLSHDMATLLDDGLGRLGAPVALAGVLIAGIVFLPESITAVRAALGGEAQRVINLCHGALVSTVGLTIPAV

SEQ ID NO: 174957 - protein, 83 aa, Glycine max
  Coding DNA Sequence Number=SeqID_83272
MICVNDYNDLGTSFVVQVKGTSTWVVVTENKRGYISCGSVLVEGTFTRLFKENKGGYIPCGSLLVKEFTRLKRNLKDRRSLGD

SEQ ID NO: 174958 - protein, 166 aa, Glycine max
  Coding DNA Sequence Number=SeqID_83273
  Gene Ontology: Mol. function=nucleoside-triphosphatase activity; Cellular component=integral to membrane; Biological process=defense response
  Homolog annotation: Hit_ID=A7PPH7; Match level="QueryCoverage=34%, HitCoverage=3%, E-value=5e-19, Identity=77%"; Hit description =Chromosome chr8 scaffold_23, whole genome shotgun sequence
  Pfam annotation: Domain name=TPR_1; Domain location=87-120; Score =16.0; E_value=0.063; Accession=PF00515.19; Description =Tetratricopeptide repeat
MIYLLQPAPETYELFDDIIIRSDGQIVYQHPRENVLKFFEYMGLKCLERKGITNFLQGAAVTLVELGGYARTDSLLDDLTKEKPNDADVFCLLGEVKYELKDYEGSVVAYKSSTRISEDLFIRSTRCTREKTGASLKPPRAKTLWEKDSRRKKRTPKYMLMCSVDT

SEQ ID NO: 174959 - protein, 150 aa, Glycine max
  Coding DNA Sequence Number=SeqID_83274
  Gene Ontology: Mol. function=NADH dehydrogenase (ubiquinone) activity; Cellular component=mitochondrion; Biological process =electron transport
  Homolog annotation: Hit_ID=A5BAM7; Match level="QueryCoverage=36%, HitCoverage=59%, E-value=2e-11, Identity=57%"; Hit description =Putative uncharacterized protein
  Subcellular localization annotation: CTP_CleavageSite=40; ConfidenceScore=5.50e-01
MAASVWPPTGTPSSSSLSFHLCNHLNFSPLTCGLCFCVWRGMQQPQSGESIDQRGRDGSGRVIEEDDSDTGRLAEFYLPWKCKNECHFYEKCEYELIMERMQKIRQHQQKSNPKQPLIPFPKPANTLFISPSHFSTCLTHVDEANDIKNN

SEQ ID NO: 174960 - protein, 125 aa, Glycine max
  Coding DNA Sequence Number=SeqID_83275
MEKQHPKQQERTSYQTNKLSISTKRILYVPIIRVIGMRNMSRLHSGVDMSSYMSQGHSSTDMSSYTFRVHNGIHISRRWVRFEFLLKSERELSSEGMTRSEYEAAVDGGGDGRFITAGGVSNGQN

SEQ ID NO: 174961 - protein, 35 aa, Glycine max
  Coding DNA Sequence Number=SeqID_83276
  Homolog annotation: Hit_ID=Q2PMQ2; Match level="QueryCoverage=88%, HitCoverage=22%, E-value=8e-08, Identity=87%"; Hit description =Chloroplast 30S ribosomal protein S11
MMYGVISWSSAGTCGFKGTQRGLHFAAQTATGNAI

SEQ ID NO: 174962 - protein, 179 aa, Glycine max
  Coding DNA Sequence Number=SeqID_83277
  Gene Ontology: Mol. function=serine carboxypeptidase activity; Cellular component=cellulose and pectin-containing cell wall; Biological process=proteolysis
  Homolog annotation: Hit_ID=A7QT61; Match level="QueryCoverage=50%, HitCoverage=19%, E-value=7e-37, Identity=76%"; Hit description =Chromosome chr1 scaffold_166, whole genome shotgun sequence
  Pfam annotation: Domain name=Peptidase_S10; Domain location=1-174; Score=-138.2; E_value=5.3e-07; Accession=PF00450.13; Description =Serine carboxypeptidase
MALFYYFVESKTDPASKPLVLWLNGGPGCSSLGVGAFSENGPFRPNGEVLIKNEYSWNKETNMLYLETPVGEGFSYAKGGSSYDFANDETTQIIGPFLIPNLFLSYTMSTSTKAWIVASRIGAVEALKDQLGVCRWNYALRSLQQHAKNNIRSYSQARKLSSASSVAVSNRILNKRKEM

SEQ ID NO: 174963 - protein, 38 aa, Glycine max
  Coding DNA Sequence Number=SeqID_83278
MTREVVIIKKGEIVEAKLHDESTMIQRCFGDNNDDNKR

SEQ ID NO: 174964 - protein, 229 aa, Glycine max
  Coding DNA Sequence Number=SeqID_83279
  Gene Ontology: Mol. function=chloramphenicol O-acetyltransferase activity; Biological process=response to antibiotic
  Homolog annotation: Hit_ID=P62577; Match level="QueryCoverage=82%, HitCoverage=86%, E-value=1e-111, Identity=100%"; Hit description =Chloramphenicol acetyltransferase
  Pfam annotation: Domain name=CAT; Domain location=45-229; Score =429.6; E_value=4.6e-126; Accession=PF00302.9; Description =Chloramphenicol acetyltransferase
MGNCCRSPAAVAREDVKSSFSNADHGKRGGGFSGAKEAKMEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWSEYHDDFRQFLHIYSQDVACYGENLAYFPKGFIENMFFVSANPWVSFTSFDLNVANMDNFFAPVFTMGKYYTQGDKVLMPLAIQ

SEQ ID NO: 174965 - protein, 472 aa, Glycine max
  Coding DNA Sequence Number=SeqID_83280
  Gene Ontology: Mol. function=adenosine deaminase activity; Cellular component=cytoplasm; Biological process=purine ribonucleoside monophosphate biosynthetic process
  Homolog annotation: Hit_ID=A7MML7; Match level="QueryCoverage=71%, HitCoverage=98%, E-value=1e-155, Identity=80%"; Hit description =Putative uncharacterized protein
  Pfam annotation: Domain name=A_deaminase; Domain location=145-469; Score=389.6; E_value=4.7e-114; Accession=PF00962.13; Description =AdenosineAMP deaminase
DRRAWFHALKQQDGLSSPAVMALAATIAAYRHGAPWLDALRDYLRANMQHIAQRLNAAFAGLNWQPPQATYLAWIDTAPLAIDDVALQQRLIQQHKVAIMPGSTYGSASRSYLRLNAGCPRSKLDDGLDRLIAALQSECDMIDAKLPLTDLHRHLDGNIRAQTILDLGRQFNLALPADTLDTLRPHVQVTANQPDLVSFLQKLDWGVKVLGDLDACRRIALENVADAAQAGIHYAELRFSPGYMAMNHQLPIAGVVEAVIDGVRAGVQQYGVDVKLIGIMSRTFGEEACLRELEGLLAHRDGITAVDLAGDELGFPGSEFLSHFNRARDAGFRITVHAGEAAGPESIWQAIRELGAERIGHGVKAIEDRALMDFLAEQRIGIESCLTSNIQTSTVASLASHPLKAFLQHGILATINTDDPAVQGIELAHEYEVAAPQAGLSAAEIRQAQENGIAIAFLTEAEKAALRQRVAA

SEQ ID NO: 174966 - protein, 90 aa, Glycine max
  Coding DNA Sequence Number=SeqID_83281
MWLRIRYDGGGCANSAMQSIRGASDSEVEDAINSWGCTLNGGGCMNNNQFMGLRIRWMEDARTVLGNQFVGLRRLNGGGCMNNNQFMGLE

SEQ ID NO: 174967 - protein, 51 aa, Glycine max
  Coding DNA Sequence Number=SeqID_83282
PFAKRKPRAKHKPRAKHISVHVLSCESQELSAQPLHLRLIWSTKLAKVELS

SEQ ID NO: 174968 - protein, 72 aa, Glycine max
  Coding DNA Sequence Number=SeqID_83283
  Subcellular localization annotation: CTP_CleavageSite=41; ConfidenceScore=5.51e-01
MGPKSTLRLIRTLGPSLASLAKSTWSLLSNALAGASASKPRAKRKMSVLSAARAFSQAKGETSAKPNSTYSR

SEQ ID NO: 174969 - protein, 96 aa, Glycine max
  Coding DNA Sequence Number=SeqID_83284
  Subcellular localization annotation: CTP_CleavageSite=70; ConfidenceScore=5.09e-01
MGDQATSMHNISTDRNNEHIKTTSNIYFSSILCSALGSRSLFRPPLHSPQFRLKKGFLSVKRHSRAKRIRDNLLAEQADDALSAKRLMSSLAVESH

SEQ ID NO: 174970 - protein, 178 aa, Glycine max
  Coding DNA Sequence Number=SeqID_83285
  Gene Ontology: Mol. function=motor activity; Cellular component=cell projection
  Homolog annotation: Hit_ID=UPI00016621D1; Match level="QueryCoverage =80%, HitCoverage=40%, E-value=6e-15, Identity=35%"; Hit description =UPI00016621D1 related cluster
MAPLSSPQNGQVFKSNRTYTLREFPERFAKDRISTLTFRGLQALAIRGLHVLAFRRLHAFAFRGLHVLTFRGLHVLAVRGLHIHTLRGLHVLTFKGLHALAFRRLHVFTFRGLHVLTFRGLHVLAFIGLHVLAIRGLHVLVFRGLHVLTFRGLHALTFRGLHVLAFRGLHVLTFKGLH

SEQ ID NO: 174971 - protein, 142 aa, Glycine max
  Coding DNA Sequence Number=SeqID_83286
MEKAFPSQPGPVPVPTDEVSLVGQTLHTFLSWLTHLVKSLSQQVVVSPAKPPPKPDDPLYLMTLTIPELFSRPYQVRWDATMFGVFNPDFPLYIKHEDLSEIAHGGQCLSISVLQLWILHLTETCMRAGNFDIYGFLEPQSI

SEQ ID NO: 174972 - protein, 202 aa, Glycine max
  Coding DNA Sequence Number=SeqID_83287
  Homolog annotation: Hit_ID=Q2HTA0; Match level="QueryCoverage=67%, HitCoverage=21%, E-value=1e-17, Identity=39%"; Hit description=IMP dehydrogenase/GMP reductase, related
  Pfam annotation: Domain name=DUF1723; Domain location=86-135; Score =41.9; E_value=2.2e-09; Accession=PF08330.1; Description=Protein of unknown function (DUF1723)
ASTQDTGAEDIGDEPEGFPGGPRDPLVLTEHADHVVASVWSGQECLELKLSSHGRKVHNLGRPIPAIEDMVAGTGLSPLITCSIDTGNRGLISSFVKRWHRKTSSFHLPVAEISITLDDVATLLHLPIVGALHDFQPLYSDEAVLLLIELLMVSPEVAMAETGQCGGPYALRDLTLAGLYAWGAAGLVHMYHQLNDASLSTS

SEQ ID NO: 174973 - protein, 84 aa, Glycine max
  Coding DNA Sequence Number=SeqID_83288
MTIVSTCYHALSLRDSKRSAGPNGSRMSSGPLPLDDKWYRRRQIAKEVRDQMVPACHRGRCLWMAKGAEDDIILCVLSCFEFYR

SEQ ID NO: 174974 - protein, 90 aa, Glycine max
  Coding DNA Sequence Number=SeqID_83289
MDDFSEDEDQRFFDHLNQQSDNQSYDQTDDEGVARLTTSLSPPLQYQQPMCPVDLNFDHLPHYIDRHYCVHQQTQCTTNSRYTRGWHDLQ

SEQ ID NO: 174975 - protein, 143 aa, Glycine max
  Coding DNA Sequence Number=SeqID_83290
  Homolog annotation: Hit_ID=Q9SJS1; Match level="QueryCoverage=35%, HitCoverage=6%, E-value=3e-07, Identity=49%"; Hit description =Putative Athila retroelement ORF1 protein
DLAPLDLEIEATFWRNNAERRRKILQDRTTQPSPEEAQSSKSSSIFPEPRESKVGASEADIMAKDQPRRVTLEDYSSSTVPQFFTSIAWLEVQAHNITYPHSLIQLIQGNLFHGLPNKDPYEHLATYIEICNTVKIAGVLEDA

SEQ ID NO: 174976 - protein, 96 aa, Glycine max
  Coding DNA Sequence Number=SeqID_83291
EIYANLYVPEDKFPKQVRVQGHLINFDDDSLNTFLETPVVVEQGESLPSYSRFARLRLDPQELAARLCIPRRGFVFNVKGLPWKLLRKDITTLAQT

SEQ ID NO: 174977 - protein, 81 aa, Glycine max
  Coding DNA Sequence Number=SeqID_83292
MGTKIYPKVHENPRAFFSSSSPSLLESSIQYPWGTYQGNPYGVYPDLSSFTESGVIQISVACIKRSAPSQDHIIWYQSFGS

SEQ ID NO: 174978 - protein, 191 aa, Glycine max
  Coding DNA Sequence Number=SeqID_83293
MLHAIMQSLHRGQPSPFGESGTSAAQEPEPTEEHTPVVEDELTPPEPFSFASDSVVAQEEVPLPEPIPEPSPTLISNVYVPIFEKLHVCEKQLIEAVHDIQFIWLNFSVKQTPFLRDHYSLSLEDNGLSAHPPLSAASTCLARQKNLAGHQYQGRAPSMSARLALSSNPLTLAKREGGAKRNVMNSEIIQS

SEQ ID NO: 174979 - protein, 110 aa, Glycine max
  Coding DNA Sequence Number=SeqID_83294
MASRDQVWSFCTHDTRRYLTVIRTPLPFRHSRVQWHAETKFGHSAHMIRGDTLWLFATLSFAICKTERLIACRGLTQSSAPFVPPGNNKVIYMREISWSPATLVSREERN

SEQ ID NO: 174980 - protein, 62 aa, Glycine max
  Coding DNA Sequence Number=SeqID_83295
MENWRTVLGDDIRGAPDSKRQAMTFMGIREKVENGELANSARQRHPRGSRLEDGGHMNSARQ

SEQ ID NO: 174981 - protein, 56 aa, Glycine max
  Coding DNA Sequence Number=SeqID_83296
MAFVDKWVVGKEEVCYWLSNDIVGRPSRMIKFASFRTHIDPFTGEDQIRKALRVPL

SEQ ID NO: 174982 - protein, 108 aa, Glycine max
  Coding DNA Sequence Number=SeqID_83297
MDSASKSYTQERKRNKRKLTKDEVTILHDIRRPNSLKTVPSGVANCRNLPISKRATRGLTDASSKKGKCTELPPTFIRGKRRKNRKRMWSTNFKCERFGSCIYARGRY

SEQ ID NO: 174983 - protein, 179 aa, Glycine max
  Coding DNA Sequence Number=SeqID_83298
TTKALEQETKRARREEHGRNKFRGALWGSNSELKLRREERDRSRVDSLILKDELKACSRSKRNLSQRLSETESNMLAIVSKYQEELNLATAHEHRVADEYAQAYAEKEARGRVIDSLHQEETMWMDRFALTLNGSQELPRLLAKAKAMADTYSSPEEIHGLLGYCQHMIDLMAHIIRNR

SEQ ID NO: 174984 - protein, 124 aa, Glycine max
  Coding DNA Sequence Number=SeqID_83299
  Gene Ontology: Mol. function=receptor activity; Cellular component =plasma membrane; Biological process=protein amino acid phosphorylation
  Homolog annotation: Hit_ID=Q9LT98; Match level="QueryCoverage=43%, HitCoverage=15%, E-value=3e-13, Identity=64%"; Hit description =Similarity to elicitor-inducible receptor-like protein EIR
  Pfam annotation: Domain name=LRR_1; Domain location=71-94; Score=6.0; E_value=24; Accession=PF00560.24; Description=Leucine Rich Repeat
  Pfam annotation: Domain name=LRR_1; Domain location=96-118; Score =13.5; E_value=0.8; Accession=PF00560.24; Description=Leucine Rich Repeat
  Pfam module annotation: Pfam domain module=LRR_1::LRR_1; Domain location=71-94::96-118
  Subcellular localization annotation: CTP_CleavageSite=70; ConfidenceScore=5.12e-01
NAAFLRFLAFCWPFAHMFCPALSPDSVDNRITAFEKRKSAQYANRLSPRVGRFINAAGTTGFPTGKRAVSATQLMDLSYNTGLTGTVPQEIGNLKKLKSLSLVGCGFSGRIPDSIGSLKQLTFL

SEQ ID NO: 174985 - protein, 187 aa, Glycine max
  Coding DNA Sequence Number=SeqID_83300
  Gene Ontology: Mol. function=DNA binding
  Homolog annotation: Hit_ID=A7QPS6; Match level="QueryCoverage=100%, HitCoverage=100%, E-value=5e-50, Identity=59%"; Hit description =Chromosome chr10 scaffold_138, whole genome shotgun sequence
  Subcellular localization annotation: CTP_CleavageSite=2; ConfidenceScore=5.07e-01
MASATKQQQEGEKPAKRKPVFTKVDQLKPGTNGHTLVAKVLSSNTVLQKGRPSSSHNIRPTLIAECLIGDDTGTIIFTARNEQDVTFFLTPLRAVDMMKPDNTVILRNAKIDMFKGSMRLAVETIDMMKPDNTVILRNAKIDMFKGSMRLAVDKWGRIEVTDPAKFVVKEDNNLSLVEYELVNVAEE

SEQ ID NO: 174986 - protein, 1576 aa, Glycine max
  Coding DNA Sequence Number=SeqID_83301
  Gene Ontology: Mol. function=sequence-specific DNA binding; Cellular component=nucleus; Biological process=regulation of transcription, DNA-dependent
  Homolog annotation: Hit_ID=A2Q504; Match level="QueryCoverage=97%, HitCoverage=86%, E-value=0.0, Identity=61%"; Hit description=DDT; Homeodomain-related
  Pfam annotation: Domain name=DDT; Domain location=351-410; Score =87.9; E_value=3.3e-23; Accession=PF02791.8; Description=DDT domain
  Subcellular localization annotation: CTP_CleavageSite=51; ConfidenceScore=5.02e-01
MEMEKDTGGKIIILNALSSFDTNDPLSVFSFTALARTFRDNQFLPNKSGIRSDASGQFSQSHLHDPIEGFVRNPPFAHGNEHLPRIHATKGHSSRVRLLSQQDKQLIPYQSPSRDDDAAPQRELYPNIANAGKNSHSTGHQIVGPENLHALPSVQVLHNNATWIEKKRKSDDAHDVEAHEMKIRKELEKQDNLRRKSEERTRKEMERQDRERKKEEERLMRERQREEERARREQKREMERREKFLLKENLKAEKTRQREELRKEREAERRKAALEKATARRMAKESMELIEDEQLEMMELAASSTGFSSIVHLDFDTLQHIESFRDSLCVFPPKSVKLRKPFAIKPWINSENNVGNLLMVWRFLINFADVLELWSFTLDEFVQAFHDYDSRLLGEIHVSLLKVIIKDIEDVARTPSTGLGANQNGAANTGGGHPEIVAGAYAWGFDIRNWHKHLNLLTWPEIFRQLALSAGYGPQLKKRSISWSYANNKDEGRSCEDIISTLRNGSAAENAVAKMHERGLLAPRRSRHRLTPGTVKFAAFHVLSLEGEKGLNVLELAEKIQKSGLRDLTTSKTPEASISVALTRDAKLFERIAPSTYCVREAFRKDPADAESILSEARKKIQIFENGFLAGEDADDVERGESESDEIDEDPEVDDLVNPTSANKTSEQCDDFSSNGKENLGHNVELQGEFDKNLPCFPESGSKNADAPIAVTGQSGACEDLDVGNLGEDNMEIDERKPGESWVQGLAEEEYSDLSVEERLNALAVLVGVANEGNSIRVVLEDRLEAANALKKQMWAEAQVDKVRLKDDTFSKSDFPSINGNKVEIQYSCPVTEGKQSPLLGINIGNNINNSVPSPSIAENHKAASGSQSLSVEKHSSVQDLCTGPDNPQAQSFVQYSKRSRSQWKSYISHMAEEMYVYRSLPLGQDRRRNRYWQFVASASSNDPGSGRIFVEYLDGNWRLIDTEEAFDVLLNSLDSRGIRESHLRLMLQKVEISFKENVRLNTQCSKIGSIGETCVKNEADETDSSPDRHTGSDSPSSTLCGLNSDTSETSSSFKIELGKSESDKKSALRRYQDFQKWMWKECYNSPILCAMKYGKKRCKPQVVICDICLNPYFFEDSHCSGCHQTFSSNSGFSFSKHAFQCGDKLSKNICILDSSLPLRTRLLKAMLAFIEVSVPPEAFQSNWTEDIRRHWSVKLSKSSSVEELLQILTLLERALKRDFLSSTFSTTGEQLGLNSMSKSAAQTSTDPESVAVLPWVPLTTSAASLRLLEFDASIVYVPHEKPEPCEEKEDRVYMKLPSRYNPSKSSKAAEAADLDHDEFMKVKSASVKIVQSNNKRGRGSRDKGRGKKLSKTKQNTGHRGAKVAGNASQRIKQQEVGSQGQAGGRGRRTVRKRRVGKKAVEDLLLGHRGATHSSSIGRESLRSMDEDWDDEKASPVTPIHMGAANNSNSIEEAESDDNVQAMESDDNVQAMESDDNEQAAESDDNGQAVEYDQGNWEIGFNGAPSRWSRDLVGMSDDDVEASEDDDDNDNVIGIENNGEEDSEVDAMSEEGSDGTANRIVNEESSESDVSEDSSD

SEQ ID NO: 174987 - protein, 125 aa, Glycine max
  Coding DNA Sequence Number=SeqID_83302
  Homolog annotation: Hit_ID=A7PSZ2; Match level="QueryCoverage=45%, HitCoverage=13%, E-value=4e-09, Identity=49%"; Hit description =Chromosome chr8 scaffold_29, whole genome shotgun sequence
MPSLPHSTCALTHWLSKVSLVPCCVAIVCHHRHRGFKDVLRQNLMNEDSYVVRKFNGPCSKVLKRPRFLNDLLPDDCDTVVFFIFILALARGDKKNLGEVVAKTFLTRKEETKLAKKSNDAMLKD

SEQ ID NO: 174988 - protein, 99 aa, Glycine max
  Coding DNA Sequence Number=SeqID_83303
MSSCRNLNSNLLSGRVPSTVGGRLLYRASFNFTDNAGLCGLPGLPTCGPHLSGGGARISSELSKWQNCPTNIVDEWHCNLIDLLMVLVLHNIGFTTTKY

SEQ ID NO: 174989 - protein, 26 aa, Glycine max
  Coding DNA Sequence Number=SeqID_83304
MALRFGYFVETVNSSYFNGKKILFEL

SEQ ID NO: 174990 - protein, 118 aa, Glycine max
  Coding DNA Sequence Number=SeqID_83305
  Homolog annotation: Hit_ID=A6FJQ2; Match level="QueryCoverage=32%, HitCoverage=84%, E-value=4e-09, Identity=84%"; Hit description=50S ribosomal protein L5
MQLPETVTAFCKRMPGADKPVRARQRMRKEKIPLRAPFAIRAAQLLGRAIGAGLFAITPAGERGMCCKAIKLGNARVFPVRTLSTLEDPRVQAIGLFAQATCAPEFGLPRPFKDYSSC

SEQ ID NO: 174991 - protein, 60 aa, Glycine max
  Coding DNA Sequence Number=SeqID_83306
MTHQDFQVQAIGQFARATCAPEFGLPRLFNQRLLVLHIGGVAVKQRLLVIDYRRANLNLK

SEQ ID NO: 174992 - protein, 127 aa, Glycine max
  Coding DNA Sequence Number=SeqID_83307
MESPPVQPRSSGAALMVARVMLGHGYEPRMGLDQNGNGIANLVERIALERRERNTGQPQGLQVKGVPLCHIDESFLSAGWMSKGRVAMIHEDTPQVQPNWVRACPLEFELGNWQVVKQSGISMAKLM

SEQ ID NO: 174993 - protein, 375 aa, Glycine max
  Coding DNA Sequence Number=SeqID_83308
  Homolog annotation: Hit_ID=Q6WAY6; Match level="QueryCoverage=33%, HitCoverage=21%, E-value=3e-13, Identity=33%"; Hit description =Putative uncharacterized protein
MDWDQLLARIGGRTISWFPLWKEGKEGVLFSCGRYPNIPLVGTRGCINYNPTLAIRQLGYPMRGAPTEESMSPFLMRDLGAQNSKTIQRIHKAWETPLRKDQELRGIRNGIIGGYHEWLKVRIRGLDWLAKLKVVSEENFEAPEEDEEVQALKSELGKAKLAKEKFKLAATHVRKECAGLREENAITARALERETKRARKEEYGRNKFRGALWGSNSELKLRREERDQSRAHSMVLKEELMACSRSKRSLSQRLCETETNMLAIIAKYEEELGLATAHEHRIADEYAQVYAEKEARGRVIDSLHQEATMWMDRFALTLNGSQELPRLLAKAKAMADTYSTPEEIHGLLGYCQHMIDLMAHIIRIVRNLYGLLDID

SEQ ID NO: 174994 - protein, 46 aa, Glycine max
  Coding DNA Sequence Number=SeqID_83309
MENQSCHHQKMGDCRSKLQDIESRLIQGVLMITKMMTTSPRVCIQD

SEQ ID NO: 174995 - protein, 244 aa, Glycine max
  Coding DNA Sequence Number=SeqID_83310
  Gene Ontology: Mol. function=catalytic activity; Cellular component =cytoplasm; Biological process=metabolic process
  Homolog annotation: Hit_ID=A7P0K8; Match level="QueryCoverage=92%, HitCoverage=48%, E-value=2e-93, Identity=73%"; Hit description =Chromosome chr19 scaffold_4, whole genome shotgun sequence
  Pfam annotation: Domain name=MoeZ_MoeB; Domain location=56-142; Score= 163.0; E_value=8.2e-46; Accession=PF05237.4; Description=MoeZMoeB domain
MKKLCRLPTLWKFSANATDNAPTRYLISDCCVVLGKPLVSGAALGLEGQLTVYNYNGGPCYRCLFPTPPPRTACQSCAEGGVLGVVPGIIGCLQALEAIKIAASVGEPLSGRMLLLDALSGRIRIVKIRGRSMQCEACGENATFTQQQFREFDYEKFTQTPLRVPPLKLNLLPRESRISSKEYSEVIIKKGPHVLVDVRPAHHFKIASLPKSLNIPLSTLEARLPEVSSALKKEEEESGAVSGS

SEQ ID NO: 174996 - protein, 89 aa, Glycine max
  Coding DNA Sequence Number=SeqID_83311
ESPTVATCPFAGERGEAHGCAFQGRKDAWSRHQRLFVENVRKAEGNWSKRKFQVRELYLRLRKVDKSGVLAPTYPPSKRKSDLRSSFLR

SEQ ID NO: 174997 - protein, 179 aa, Glycine max
  Coding DNA Sequence Number=SeqID_83312
MRSDCLVQFSILAFYSEPHELIVVHASSTHEFGTMRRDCLVQFSILAFYSEPHELIVVHASSTHEFGAMRSDCLVQFFILAFSSEPHELIVVHASSTHEFGAMRSDSLVQFSILAFSSEPHELIVVHASSAHEFGAMRSDCLRKKKKRRRSSWTNYGKGEDGRNQCLIFAFLLSPIKGK

SEQ ID NO: 174998 - protein, 95 aa, Glycine max
  Coding DNA Sequence Number=SeqID_83313
  Subcellular localization annotation: CTP_CleavageSite=51; ConfidenceScore=5.33e-01
MKKIQPEVLPQRFREVFISKSVKIFLCSSPFFIRFSSVLRSSTGRFSLEVSLNELTNNQSETKAKINSQIKLCPQKSLKTALGSNALNGPLAFYH

SEQ ID NO: 174999 - protein, 88 aa, Glycine max
  Coding DNA Sequence Number=SeqID_83314
MVQPKRKKEHEQEEKDGKLARFKGWAVTNFLGLNKVDLGIKWMNGMKCRNGYNSSYRAPNENKVEDEMVEGKNHSFRRGQHTKDVKDL

SEQ ID NO: 175000 - protein, 196 aa, Glycine max
  Coding DNA Sequence Number=SeqID_83315
MHPASHASPSRRRVGCDNSELVKAFYSNLEIHEGTLISKVYGIKMVIYQSLFYDLTKLPSEGVPFEGALIDDWKLNFSVHDARQLVCTNQADMTGRLLAGSLAFESHILHYLIVRILLPRSSNLAQVSEEDLIVMWTFHKGLQIDWAHLVRYRMHKALRLNAPLPYPHLITLFLQHFNIPLDFEPYVPIKRSFLIK

SEQ ID NO: 175001 - protein, 148 aa, Glycine max
  Coding DNA Sequence Number=SeqID_83316
MSELPSRLSTLNEGLEMVLATLPKLTNEEHGQCCEMAKIMLKVMVSPYTILNTVNAKDQIYSEVSMSFAVRWKDVLDYLWHFIDKDENFHTVVYNQDLDKAAIVAGWITLRDFYHLTRDHQVPLTHYGKSVFFLTIFKSSSLRKSFPR

SEQ ID NO: 175002 - protein, 31 aa, Glycine max
  Coding DNA Sequence Number=SeqID_83317
YFNNPRSLESERLKALWIKWTQFYLRVRDQT

SEQ ID NO: 175003 - protein, 126 aa, Glycine max
  Coding DNA Sequence Number=SeqID_83318
MLQSIHQGKIVLLQSLQLVAPPDSIPSVEQFNEWVAWPGTQPPLHREDEGLTAQLQPLLRNLLRPLLSLQNQWQASIQQAIDPSTPKDQITPVLSPNTSPPATPMLRLTDEKDVQTPDTQDRSQDF

SEQ ID NO: 175004 - protein, 68 aa, Glycine max
  Coding DNA Sequence Number=SeqID_83319
MCNFSWAKCASTTKRSFNMLIMIEESGRASISRSRAKREISALSAAVIFSQAQRMTGAKRNVTDSEPI

SEQ ID NO: 175005 - protein, 150 aa, Glycine max
  Coding DNA Sequence Number=SeqID_83320
LELLRADQRLISPKVGPGLPGINRDTRIYLFCEVISVTAVLPVQLRTGWCVTAKAPPDISAGKCSGRVPFAIQAAQLLGRAIGAGLFAITPAGERGMCCKAIKLGNARVFPVTTLNSIGKGKNQKNYQIVSILEFFEKGGKGGTTKRKFR

SEQ ID NO: 175006 - protein, 98 aa, Glycine max
  Coding DNA Sequence Number=SeqID_83321
MASRQASTQVTMLYSWMIKTVLEGETTMWKRLTLEGEMCWVISVRPPYVVARGPQMSMQVPQVARMASGTACPAGGAGWPEWLAGRASTAGGHDYTRG

SEQ ID NO: 175007 - protein, 96 aa, Glycine max
  Coding DNA Sequence Number=SeqID_83322
MDDASFLLWTWLRCLEKDFVTDFNHWTSNLRSGSPYVVARSPQVYSSNLPNNWYQSRLFKLVTGSDEYASTAGGAGWPNGLAGRASTTGDHGYTRG

SEQ ID NO: 175008 - protein, 77 aa, Glycine max
  Coding DNA Sequence Number=SeqID_83323
MSHGEKHQNQGTNSELALQKSWPKTLVEDGIVDWSEVLTEDRCTEVEQVGHIHTEVRKPHTELAELVVLSEGKTGVH

SEQ ID NO: 175009 - protein, 105 aa, Glycine max
  Coding DNA Sequence Number=SeqID_83324
MGKGGSRRSLPEDPLGVLPEVPEEHFPESFRKKCSSGNNQMPSGRTLLPEDSRKTSSGNFPEEVVHPEEFRKTRSSGRTFKFPEDLSGRTTSSGSGFRKNHFFWK

SEQ ID NO: 175010 - protein, 147 aa, Glycine max
  Coding DNA Sequence Number=SeqID_83325
MDVFIGGEIFKVHVVEESGGGYRECSGKARSMGGSSEEIASHDSHLECLSPTSMEKMLSEDRMRNSPERMTEKSMFADQRTIELSRSLDNHKNPLGNGDNLRFSGGKQQFRHHGQTRDQAATATVTYDRDHTATQGQERVISFLDDC

SEQ ID NO: 175011 - protein, 111 aa, Glycine max
  Coding DNA Sequence Number=SeqID_83326
MTRARAKKAQEALEHMVTILRNSPNSCGDPPGLSNLVVCGAYSIFYLPCFSVRFYISAFFSLCLQPDFLRCMGLFGACITTYGAFHAILVHCFVNIEWPIEKIVAATFLLV

SEQ ID NO: 175012 - protein, 39 aa, Glycine max
  Coding DNA Sequence Number=SeqID_83327
MVRKGQHKWAEVFVSKGENKRSRHQRLFQENVRKAKKDK

SEQ ID NO: 175013 - protein, 96 aa, Glycine max
  Coding DNA Sequence Number=SeqID_83328
  Gene Ontology: Mol. function=protein binding; Cellular component =endoplasmic reticulum; Biological process=vesicle-mediated transport
  Homolog annotation: Hit_ID=A9NRG6; Match level="QueryCoverage=88%, HitCoverage=45%, E-value=4e-35, Identity=85%"; Hit description =Putative uncharacterized protein
  Pfam annotation: Domain name=TRAPP_Bet3; Domain location=23-95; Score= -25.1; E_value=0.00028; Accession=PF04051.7; Description=Transport protein particle (TRAPP) component, Bet3
MPPVAPRSGDAIFANVERVNAELFTLTYGAIVRQLLTDLEEAEEVNKQLDQMGYNIGIRLIDEFLAKSNVSRCNDFRETTDVIAKDLADECSKAAG

SEQ ID NO: 175014 - protein, 70 aa, Glycine max
  Coding DNA Sequence Number=SeqID_83329
MVSEICENSRSTMRSNFLLIGITIIPPILPCVETSRFEEQYLLETKGRAFLDLKKEKNMLVNSVDEGRPK

SEQ ID NO: 175015 - protein, 66 aa, Glycine max
  Coding DNA Sequence Number=SeqID_83330
MTLRLADMHSSSFFQILPRTQPRSVALSGWLAKPTDWLSEKITPIVIDNMSFKITSHKNLHKGLQQ

SEQ ID NO: 175016 - protein, 62 aa, Glycine max
  Coding DNA Sequence Number=SeqID_83331
  Subcellular localization annotation: CTP_CleavageSite=8; ConfidenceScore=5.31e-01
MWNRHMLKGALKQSVFTPKAYTPKSASRPLPSDSDPHSGSHHNTRRALTRCPYRVLTLTRRP

SEQ ID NO: 175017 - protein, 63 aa, Glycine max
  Coding DNA Sequence Number=SeqID_83332
MSMGVEVVVWFAVECLGSGTVVFWCGGDWCWVEEEKEEGLFMQRGNSNANEDYWVGKRRTKTN

SEQ ID NO: 175018 - protein, 68 aa, Glycine max
  Coding DNA Sequence Number=SeqID_83333
MVITPDDDKGDDKKLKDQSKNNSSESRIIQDFKIRIKNKSQESRFKVQDLQNQDQDSRFKNQEKTQSR

SEQ ID NO: 175019 - protein, 76 aa, Glycine max
  Coding DNA Sequence Number=SeqID_83334
MAFKENEPRGARPTRPEAEEIVLAQASWLLAWAIGTLKYCKNDPFAFHPGLVSGSNKQASKHKECMNESSIFKQKH

SEQ ID NO: 175020 - protein, 205 aa, Glycine max
  Coding DNA Sequence Number=SeqID_83335
NVEEETGNFVGRVLWRKSTEMGAFRVSIDYDQDDRESLGWQQSNLVVDIATHTIPEEVIRKSTKGLSCTHMASQWGRVEFCQKQGNGLSSQSEILAADESCVVSHGLNDLGHELLQALVIREDDEGVSQKERIAPIVKPEASVSRKNGMVKSGGGLWEEESSVVLPWSRTRGPRPPPKQYGLSIGVWFWQTCIWTHADGMTLGIT

SEQ ID NO: 175021 - protein, 57 aa, Glycine max
  Coding DNA Sequence Number=SeqID_83336
MDEPRHAVEICSDIAERLERHLSLGVVMPGSSSHDVIQECIKMARSVTQDQLVYVRS

SEQ ID NO: 175022 - protein, 89 aa, Glycine max
  Coding DNA Sequence Number=SeqID_83337
  Subcellular localization annotation: CTP_CleavageSite=41; ConfidenceScore=5.20e-01
MDSNTNADNGRRKSCLPRQCRRRGTPPPSKCLEYSTPTAVQSQNTDSRRGGRRRSLQGERDADEAFLRPATTWKKNHEEEGQHGREGER

SEQ ID NO: 175023 - protein, 109 aa, Glycine max
  Coding DNA Sequence Number=SeqID_83338
PPVLRMCAMPFDPQAKPVSSIAVQDDAAVRDRVAVVVANSNANTGRDDNQTACVAPCVISRGAIVDDNSGILTWTSSSAASLGTSSSSWCLLIDEEDGIGICSFGRMPS

SEQ ID NO: 175024 - protein, 239 aa, Glycine max
  Coding DNA Sequence Number=SeqID_83339
GQGLGKALIEKLIRTLLQRDIGNITLFAYSQGLWCAATSMCNIIGQKKLIWECCVSGVLSIGMLPRVCAAQKDLIWEDIQTVKEQWRQFKFDLTSKWALAADNDSIDDTICENYDISKEKWAILCQNCKDPYCQMCEKKAQAIQKQNSALHVLSRGGYEYLENKLIEEKKKKQLEEATKSRSIYTFIDPPSPIKQHVKWKMARTKKTRQMTSEVVKEIADKIVKSFPIANCNYLCLLFD

SEQ ID NO: 175025 - protein, 75 aa, Glycine max
  Coding DNA Sequence Number=SeqID_83340
  Subcellular localization annotation: CTP_CleavageSite=27; ConfidenceScore=5.14e-01
MTSAKRKMHSRFMYPFESTSQRSEPTKSTRRWEEWLATQGKVSLTVSFLLTMTRTTNPFSSKVRRRRWGRNVFSA

SEQ ID NO: 175026 - protein, 30 aa, Glycine max
  Coding DNA Sequence Number=SeqID_83341
MTRHFWMDKAWRAKERTNLTVVGLTAGLKV

SEQ ID NO: 175027 - protein, 146 aa, Glycine max
  Coding DNA Sequence Number=SeqID_83342
MADMLLKCGICIRDDSGALVLAKISLLEGSPPTKEAEGVAPSMAPSCTFMDHGTQITKSHYMSIDYPTVVLELWPETHKGHDQALEDERPGSINETEWTKIQKRVVSVIRLVLAPEIKHNVLKEMELYQLKLEKGGELHDHINKFN

SEQ ID NO: 175028 - protein, 165 aa, Glycine max
  Coding DNA Sequence Number=SeqID_83343
  Homolog annotation: Hit_ID=A5BU22; Match level="QueryCoverage=61%, HitCoverage=16%, E-value=5e-07, Identity=33%"; Hit description =Putative uncharacterized protein
MTRGNPSDLQPFDPEIDRTFHRLVRHHFIPFDHSEHSITGESVHSVIGDFEHPDLEHYNFEHSDSEHSDFAHSENMAQPPPHERTLREMAAPDFTYESLCIQYPDEDVPYVLKTGLIHLLPKFHGLADVQEDHIFLKAFPHSLEGVAKDWLYYLAPRSITSWDDL

SEQ ID NO: 175029 - protein, 204 aa, Glycine max
  Coding DNA Sequence Number=SeqID_83344
MTEVVGLEEVEGLQDVVALCSRVQRRLPPAAHHAEDGYVQWTWEGVVNLRLGKLVGNYSRFHPMLLCGRSRIPNKLKLGHCYIIVVTDGLDNPLFHVQMAGWQSGSSKSKGMDKLKRQRMAEWKAMEKLKSFYTGSVTTRAYIQSPSDLRSLRFLFQPCKNPFTSKDPQGMYPPLFSLNNLVDVPSTKIDPQEMYSLLFSVKPK

SEQ ID NO: 175030 - protein, 113 aa, Glycine max
  Coding DNA Sequence Number=SeqID_83345
MDDALLLLWSWLKSNDKDCTVHFNQWATNLTLVGVGGILNRHILRQHNIPISPKIARQHDFGKILVESGFEKAIGFVLDGCPTSTSTLLHHCFPLYYELKALTSTTNQKSSKP

SEQ ID NO: 175031 - protein, 201 aa, Glycine max
  Coding DNA Sequence Number=SeqID_83346
  Gene Ontology: Mol. function=oxidoreductase activity; Biological process=response to red or far red light
  Homolog annotation: Hit_ID=Q4W8C1; Match level="QueryCoverage=54%, HitCoverage=37%, E-value=4e-29, Identity=57%"; Hit description =Gibberellin 2-oxidase
  Pfam annotation: Domain name=2OG-FeII_Oxy; Domain location=48-141; Score=12.5; E_value=0.0091; Accession=PF03171.11; Description=2OG -Fe(II) oxygenase superfamily
MVGAVNSTLSAYIEAVRELACEILELIAEGLGVPDTWIFSRFIRDVDSDSVLRLNHYPPIINKDNNKDTSQQFTKVGFGEHSDPQIITILRSNEVGGLQISLQMNVGDVLETVMLDFLSDSNGASSLSVPNKDIYAELLKKAKKLNKLKEKDLGFSKFLESYNMKIEQTEYEEIRDWKSLWEYDSGLQQIWSIGGIGWATE

SEQ ID NO: 175032 - protein, 130 aa, Glycine max
  Coding DNA Sequence Number=SeqID_83347
MEAGQILVMEGTKLGILNGGRTSESYISSLSSILFISRCGQQNSTISNMGSFSQGNWCWGLKWRRNLFDYEQHIAMAFMEAIIDIQIQPHMQDIMVWKADPSGVYSTKSAYRLLMTSNQIPEANILKTIC

SEQ ID NO: 175033 - protein, 249 aa, Glycine max
  Coding DNA Sequence Number=SeqID_83348
  Subcellular localization annotation: CTP_CleavageSite=49; ConfidenceScore=5.59e-01
MSSGGADPPRPPSHQSNGKGKTAKKRRYMVRLLPPRDILPSSTPSPSSVSMLVRPLDVAPTPSPPPIEARLTPSDVNAHGSSLVLASTPSPSSVDARGLSLIPTFTPSPSPTVVNMPTDVIMIILRFHPSKVAAKVVTLSIRQQFDPAEEQRLRSRCWVVAAGPKHKGRLYGTGDLAHTYKCGNDIFMKHTKGSSCHTEDAAEINRLKEELCQSKGEMHVFQSVVLQFLLPEARNIIHQQQQPHQQHQD

SEQ ID NO: 175034 - protein, 141 aa, Glycine max
  Coding DNA Sequence Number=SeqID_83349
  Homolog annotation: Hit_ID=Q9LIN9; Match level="QueryCoverage=69%, HitCoverage=19%, E-value=2e-10, Identity=39%"; Hit description =Similarity to the auxin-independent growth promoter
MVELRHSSSLGSRASNSPMKCDTGDSSPLIPDNHLADDDEHDQHSSKDRDRHMCSFFTDNFRVSPHNSRIFLVFTFLLLLVGLVSIFTIFNNLVSPHLSGCIFRFTTKSLGSDMHFRFGGEERGATSVVERWGRKPRLKMK

SEQ ID NO: 175035 - protein, 235 aa, Glycine max
  Coding DNA Sequence Number=SeqID_83350
  Homolog annotation: Hit_ID=A7R3V7; Match level="QueryCoverage=50%, HitCoverage=34%, E-value=3e-29, Identity=54%"; Hit description =Chromosome undetermined scaffold_574, whole genome shotgun sequence
MDHFPFCTVATQIIILRNPRFYLDGQLKVFLWTLTWAKEGMTMQYLDVSLQEHLPVLYPEVVLSVERFTIMFERIQELLILGGQTLTALRDKIFCSTNQVMHKVGQHDPSSYFLIEDVLCPDLRDPSTIDLTRPILDWLRDSKEEAQKKWEYIITEELQKKQKVLGDMVPTTITKKYNDREYPNKMIFLDFSLLHEDTSPSLSSIMRFMYDACCMGTTNHVILNPSSKLRLLPSS

SEQ ID NO: 175036 - protein, 27 aa, Glycine max
  Coding DNA Sequence Number=SeqID_83351
MDDNDREGDEFKMQMEFCGAEGVLPRD

SEQ ID NO: 175037 - protein, 427 aa, Glycine max
  Coding DNA Sequence Number=SeqID_83352
  Gene Ontology: Mol. function=cation transmembrane transporter activity; Cellular component=integral to membrane; Biological process=cation transport
  Homolog annotation: Hit_ID=A5AN75; Match level="QueryCoverage=88%, HitCoverage=70%, E-value=2e-79, Identity=43%"; Hit description =Putative uncharacterized protein
  Pfam annotation: Domain name=CD47; Domain location=234-384; Score= -41.2; E_value=0.087; Accession=PF04549.5; Description=CD47 integrin associated protein
  Pfam annotation: Domain name=TrkH; Domain location=214-427; Score= -122.8; E_value=0.027; Accession=PF02386.7; Description=Cation transport protein
  Pfam module annotation: Pfam domain module=CD47::TrkH; Domain location=234-384::214-427
MMKNFAYYFSQKQQHQRFCRFFPHSLGFLVRFLAFHVHPFFIQLCYFVILSLLGYLGLKASKPRTPLRPNDLDLFYTSVSASTVSSMVAVEMEVFSNSQLILLTLLMFVGGEVFTSMLDLVFARYKFTRSVQNKVSTNHSYLTRTRLPPVDDTSGLDQIFFSSNPFLSTKKPSINANQIELGLVSIHHSESENHKPSDSNNTNVPKGTVVSFNDSDRLKYNCLSYLTYLVLGYLVVVQFVGFSSVSLYITLVPSARQVLKNKGIKIATFSLFTIVSTFASCGFIPTNENMMVFKKNSGLLLLVLPHILLGNTLYPPCLRLVIMVLERITKREEYSHLLKNFKDVGYDHMLSALHCCLLVATVLGFNLIQFVMLCSMEWNTKIMEGLNVYEKVVASLFQVTNARHAGESVFDLSSISSVILVLFVVMM

SEQ ID NO: 175038 - protein, 70 aa, Glycine max
  Coding DNA Sequence Number=SeqID_83353
MFKTPCDGDMTKSKGKDPLEGHGGPMTRARARKAKEALQQVMSILFEYKPKFQGEKSKVVSCIMAQMEED

SEQ ID NO: 175039 - protein, 157 aa, Glycine max
  Coding DNA Sequence Number=SeqID_83354
MLCCGIRGFYKDCQIIHPELIQTFWRDTEFKTFYAILSIVFGKKVTLSVENITQVTYWKREGSRKIIAQQQAPFAPKKEKVDKAIPSGKEPIIVAVVLRKMKVIATRANPTIFEKEWTLPYPSQGSSSNDVFSDATISQDHRPSSPPWQCPPHLLST

SEQ ID NO: 175040 - protein, 71 aa, Glycine max
  Coding DNA Sequence Number=SeqID_83355
  Homolog annotation: Hit_ID=A7PM46; Match level="QueryCoverage=70%, HitCoverage=3%, E-value=1e-10, Identity=64%"; Hit description =Chromosome chr14 scaffold_21, whole genome shotgun sequence
MSLCLLPRWGAMDAEAYPEASKSVLQILWDVVTYGQGRQWGKARISALEAVAQYEKSSESSQGKKSYRKQD

SEQ ID NO: 175041 - protein, 74 aa, Glycine max
  Coding DNA Sequence Number=SeqID_83356
  Homolog annotation: Hit_ID=A7QDW6; Match level="QueryCoverage=79%, HitCoverage=26%, E-value=3e-11, Identity=41%"; Hit description =Chromosome chr4 scaffold_83, whole genome shotgun sequence
MEEEHATKVPLPDAFLQFLETNGLDPSIYTAIDSTPRYIRAYREGKIYGIDAAFGAVVMALNTWGSCSRPVCYS

SEQ ID NO: 175042 - protein, 91 aa, Glycine max
  Coding DNA Sequence Number=SeqID_83357
MAKKHGAFVFELMPLEEFCFRFRTSSYSGNWKPNVSKAAREAAKKSLEKATERVRCLEDDLAKSRTNRKGRERDLKLWHSREEIVQFACTR

SEQ ID NO: 175043 - protein, 239 aa, Glycine max
  Coding DNA Sequence Number=SeqID_83358
  Gene Ontology: Mol. function=diphosphate-fructose-6-phosphate 1 -phosphotransferase activity; Cellular component=6-phosphofructokinase complex; Biological process=glycolysis
  Homolog annotation: Hit_ID=Q9ZST3; Match level="QueryCoverage=36%, HitCoverage=15%, E-value=1e-39, Identity=89%"; Hit description =Pyrophosphate-dependent phosphofructokinase beta subunit
MPVCVSSSAPSKVLDPEVAVNKEEYQVFEELGRGRFGTVFHCFQHRGLRLHQNGGLGGWWRGGGGCRQGGDRKEVAAGEEVIVIVVGEEVAECVDLVKKKEMDGLRTKMPVALAEGDREAVSEPVRATVGSFGAERFPRAAYLAEGSTLYGFRGGPAGIKKCKYVELTSDYIYPYRNQGGFDMIRSGRDKIETPEQFKQAEETVQKLDLEGLVVIGGDDSNTNACLLAEHFNFGIILFL

SEQ ID NO: 175044 - protein, 348 aa, Glycine max
  Coding DNA Sequence Number=SeqID_83359
MVMMKHFINFLFNLMFLEVKVAIQVLMGYRERHKAEGGKKQQHAIPLQNKIKIPKGHNIEVHGEIVLVDGNRHISAHLITTKFTPISHHDAKWLSGLGPKIQKVDHVILDEVVGTTPIDEDHDVMPINGTINVQSGGGRMIRVRSEGPMSTGLSLSFVIRRKNFTLHLWLSLGESEEGEVIVKGNGGEGNNIKLPWGRHRMRVRSASPKPGRKSFVIGSAIELEKLRNFKDPGHGIRTIKPQDIKFQMWRGVEVRNDLLNFGVEGALGSGEGTLVLGELSDSLFKVGDCLGTCVINHGREAMKAPKMIATKLKDNELISHELEARRLPLEMQKENDLLNIILCFFHSF

SEQ ID NO: 175045 - protein, 38 aa, Glycine max
  Coding DNA Sequence Number=SeqID_83360
MGELFQAQEKETSGPMAADGGVGMDDEGMSSVLASSLP

SEQ ID NO: 175046 - protein, 73 aa, Glycine max
  Coding DNA Sequence Number=SeqID_83361
  Gene Ontology: Mol. function=binding; Cellular component=CCR4-NOT complex; Biological process=regulation of transcription from RNA polymerase II promoter
  Homolog annotation: Hit_ID=Q9LT41; Match level="QueryCoverage=93%, HitCoverage=22%, E-value=5e-13, Identity=59%"; Hit description=RCD1
MVYVVTGYIEINIIFKAHIPLYLYPFLNTTSKSRLFEYLRLTTLGVIGALVKVQPPCTNKFTSSSQEIVDAYG

SEQ ID NO: 175047 - protein, 312 aa, Glycine max
  Coding DNA Sequence Number=SeqID_83362
  Gene Ontology: Mol. function=nucleoside-triphosphatase activity; Cellular component=intrinsic to membrane; Biological process=innate immune response
  Homolog annotation: Hit_ID=A7PQ07; Match level="QueryCoverage=95%, HitCoverage=25%, E-value=6e-63, Identity=43%"; Hit description =Chromosome chr18 scaffold_24, whole genome shotgun sequence
  Pfam annotation: Domain name=TIR; Domain location=19-152; Score =168.6; E_value=1.7e-47; Accession=PF01582.11; Description=TIR domain
MACIRIQRGSSSHTKNFDVFVSFRGLDTRNSFTDHLFAALQRKGIFAFRDNQNINKGELLEPELLQAIEGSHVFIVVFSKDYASSTWCLKELRKIFDGVEETGRSVLPIFYDVTPSEVRKQSGKFGKAFAEHEERFKDELEMVKKWREALKAIGNRSGWDVQNKPEHEEIEKIVEEVMNLLGHNQIHSQIWSFSGDLVDMDSRVKQLEELLDLSTNDVVRVVGIWGMSGVGKTTLVTALFGKISPQYDARCFIDDLNKKCGNFGAISAQKQLLSLALHQGNMEIHNLSHGTMLIRTRLCHLKTLIVLDNVDQ

SEQ ID NO: 175048 - protein, 81 aa, Glycine max
  Coding DNA Sequence Number=SeqID_83363
  Gene Ontology: Mol. function=transmembrane receptor activity; Cellular component=intrinsic to membrane; Biological process=innate immune response
  Homolog annotation: Hit_ID=A5AJV7; Match level="QueryCoverage=92%, HitCoverage=16%, E-value=6e-15, Identity=54%"; Hit description =Putative uncharacterized protein
VPGKHVLPIFYDGDPSEVGKQTGDYGKAFTKHEERFKDDGEKMEEVKRWRRALTQVANLSGWDMMNNSLAVVIVSVVITEA

SEQ ID NO: 175049 - protein, 245 aa, Glycine max
  Coding DNA Sequence Number=SeqID_83364
MNAYFNQKFVCVNKTPFCEDKTNCPCKIKFLFKKAKLDLDQFKSFGYEDLAISTKSLLDYGCLESVLIPPPDRFEGFNPSINEAINLIQTEMMDYIVIKITTYPSNFLAQNYPCHVMKLLPEDHRNFPCLFNDEYESWDVQGNTQYQYSLMRAQIQGETHDTKLFQPSYNGKFFIPFSVDHNNKLVQFFQKEKKDKEIYEASGCHGQQTSHFPSTDLSMEDLSDIFYSGNIQDEEDVTITKSTKS

SEQ ID NO: 175050 - protein, 155 aa, Glycine max
  Coding DNA Sequence Number=SeqID_83365
MDLFPVMDDQNWIRVGYFAVFVAHDDPKNNYGNSWVPDYCHHIAFGVRNVQHRGCASGMHDPDTMEFGSINSFNQDTKNDVTLSKKGNRNEEKERILKQAQPNSGAKRAEGAKGGVKHEGAETVTRAKLATRPVRDPTEAQAKPAGSAGRAIRTR

SEQ ID NO: 175051 - protein, 262 aa, Glycine max
  Coding DNA Sequence Number=SeqID_83366
  Gene Ontology: Mol. function=metal ion binding; Cellular component =integral to membrane; Biological process=cell redox homeostasis
  Homolog annotation: Hit_ID=A7PJL9; Match level="QueryCoverage=60%, HitCoverage=76%, E-value=7e-29, Identity=44%"; Hit description =Chromosome chr12 scaffold_18, whole genome shotgun sequence
  Pfam annotation: Domain name=PHD; Domain location=170-214; Score=5.4; E_value=0.0031; Accession=PF00628.20; Description=PHD-finger
  Pfam annotation: Domain name=zf-C3HC4; Domain location=171-211; Score= 48.7; E_value=2e-11; Accession=PF00097.16; Description=Zinc finger, C3HC4 type (RING finger)
  Pfam module annotation: Pfam domain module=PHD::zf-C3HC4; Domain location=170-214::171-211
MSRNMNNFTHLLGPWQTDFRSNDGHTFNHRESNEVPVFYRSHSTHVTDDRSSGVLARQRFSDFRNPLGFHSIPNFPAPPPRRQQIHVHNEDMRRLREIFLQPPQRSTFQINTQAPPPVEISKSTALSKLKKVVHDPPPKRYARRVSLYYRNNVAKPWKEKEKEKDEDGKSCAICLEDFEPSEEVMLTPCNHMFHEDCIVPWLTSKGQCPVCRFVIFEIERGNQSSFNNNDIANLEPSNIINREFLSILRAMEEDFQLSSMTY

SEQ ID NO: 175052 - protein, 53 aa, Glycine max
  Coding DNA Sequence Number=SeqID_83367
MGGDYGSNVFQGYFDDAKESRVKQSFKQRFKNQDSRKIKIKIQDSIFKNQEKY

SEQ ID NO: 175053 - protein, 58 aa, Glycine max
  Coding DNA Sequence Number=SeqID_83368
MAFEERQHITTISRYKQDNKKENEWNELMKLTFNIESYKSITLTLLFTSRTVNSNSLP

SEQ ID NO: 175054 - protein, 65 aa, Glycine max
  Coding DNA Sequence Number=SeqID_83369
MGVIKTKNIERKGRARAWNAARIALRRAVEVGFGPSQVRLARHLALSAFRSCAAGLACVSVGSRA

SEQ ID NO: 175055 - protein, 143 aa, Glycine max
  Coding DNA Sequence Number=SeqID_83370
  Gene Ontology: Mol. function=transferase activity, transferring hexosyl groups; Biological process=carbohydrate biosynthetic process
  Homolog annotation: Hit_ID=A3AW87; Match level="QueryCoverage=38%, HitCoverage=13%, E-value=8e-16, Identity=67%"; Hit description =Putative uncharacterized protein
MAWANKRGDSKNAGFMRMLVVVLLVLLSGFWCVSGVKEGKRNAYAMMMYVGTPRDYEFYIAIRVLLKSLATLNAEVDLVVIASLDVPPRWIRALTTFQPYGKLVSARAVSVLQAIQHGKALVRVAISEDFLIIEYILPEILKL

SEQ ID NO: 175056 - protein, 286 aa, Glycine max
  Coding DNA Sequence Number=SeqID_83371
  Gene Ontology: Mol. function=secondary active sulfate transmembrane transporter activity; Cellular component=integral to membrane; Biological process=sulfate transport
  Homolog annotation: Hit_ID=A7Q5S9; Match level="QueryCoverage=23%, HitCoverage=9%, E-value=2e-27, Identity=79%"; Hit description =Chromosome chr14 scaffold_54, whole genome shotgun sequence
AVPRNRLRMSLSGIFVNSGKIIRTVFETRLCRTYFYNGSQNSKDLEADIPCATSMLLQYHRAVGYPVVVVSCVVRGVGRVNDASTGKSFYGPGGPYAMFAGKDTSRALAKMSKNDDDIPPSLDDLSDKAIDVLNDWENKFQAKYLGISYANLAPPVYVVLGSSMDLAVGHVSIASLVLGSMLTEEVSPSEQPHHFLQLGLTSTFFAGIFQAALGILRTELDGSSETEMMVYPPFEFSDVSPPSIITEGTHGGPWRKKMSDLDGTVDEKDFPWWCLDSVLNNRLPSF

SEQ ID NO: 175057 - protein, 92 aa, Glycine max
  Coding DNA Sequence Number=SeqID_83372
MDPSQLVGLESLLIQFMQPGFSQPDLSLALIGKRDSIANKGMYSEEIDANQDIATTGLSTAKKGANQVEKEVQAIVNTKRKISKPAYLKDYV

SEQ ID NO: 175058 - protein, 246 aa, Glycine max
  Coding DNA Sequence Number=SeqID_83373
  Subcellular localization annotation: CTP_CleavageSite=43; ConfidenceScore=5.15e-01
MASQAAQDISDIIVSKWTRYKNRRHKVALFPMVMTTYSTLSLRGSQFAPPIEVDIQVLGERVNTKGSNTETAVNPSREEHVAPVKPNTIGFYVQGDNCIDLVALGKIYDEGSTIHCMAYADDVDRVNVEKVFDSDTKVLLPTSEIQHVRQALDKFIAWPTYLMKLVSHEDSHITTKKVAKPAQRSNNVVADDPLMELIRSVFMDEWSSTLGHGSMYRFLEPQSIHNAKDRRAECQHYIETWFKESQ

SEQ ID NO: 175059 - protein, 84 aa, Glycine max
  Coding DNA Sequence Number=SeqID_83374
  Homolog annotation: Hit_ID=A5BDQ4; Match level="QueryCoverage=90%, HitCoverage=13%, E-value=4e-11, Identity=37%"; Hit description =Putative uncharacterized protein
MELSLVTSTRRLHLYFQSHLIKVKTNHPIRQVLQKPELDGRMLQSKSSSSDRGDWWMLYVVGASNPNGSGTGITLEGPGDISLK

SEQ ID NO: 175060 - protein, 70 aa, Glycine max
  Coding DNA Sequence Number=SeqID_83375
MAASMVPPVLLARQPGTANVVGETAAYVEGAASEAGETPPRWICFFCWRYSIVCRLLQLYIYRVACMVKK

SEQ ID NO: 175061 - protein, 91 aa, Glycine max
  Coding DNA Sequence Number=SeqID_83376
MQNSAVGLVSQEPMAGLATLACPANSTGGAGVSQELMARSPRQQVSRPCHWRHAPGMPAKPPSHHLQWRHPPSRHCRWRNTHLAIADGGIL

SEQ ID NO: 175062 - protein, 72 aa, Glycine max
  Coding DNA Sequence Number=SeqID_83377
MGSIFKDVKPNQIIVRNSPKKKKFHEGYTKWKRNIKLRGFEGVIACVQTLEGMILNFDSDEQKQIEKKVMHE

SEQ ID NO: 175063 - protein, 32 aa, Glycine max
  Coding DNA Sequence Number=SeqID_83378
MGHEDEEEDDDNNNTNNNDDDDDDNCDYQNLK

SEQ ID NO: 175064 - protein, 182 aa, Glycine max
  Coding DNA Sequence Number=SeqID_83379
GVSSLSSFSIPLPFIFQEAKESIDEEDPRPTSSNGAYIIKSSLTTKFMYADTEGARSSTKGTDAKTTINPSRKEHVAHMMPNMGLYVKGHCEVEDLDIQGKEWRALCYGKTCIRPSLVQKDALGSALLPFAGNNDSGDSGSDNNGNGGGNGESGDDRVRRKKGERESDNPMLLLCNLTPTSG

SEQ ID NO: 175065 - protein, 126 aa, Glycine max
  Coding DNA Sequence Number=SeqID_83380
MAREHCLIFFFSRLMFIMASLDGQASLLETSCIFVLKGVAEKSMAILETVHKKNGQASIHDVRARVQAHDLLLDELRQMYEEQPEFLEEVSSLQLSYTLSHGLPGTYTEDAVLNAYPKCETVPCED

SEQ ID NO: 175066 - protein, 62 aa, Glycine max
  Coding DNA Sequence Number=SeqID_83381
MTLLGDLTNWKWCRGEFLGKARERGPVRVGEFVVESGVATEEAKDEDSQAGQERKREVKRKS

SEQ ID NO: 175067 - protein, 293 aa, Glycine max
  Coding DNA Sequence Number=SeqID_83382
  Homolog annotation: Hit_ID=A5C169; Match level="QueryCoverage=70%, HitCoverage=20%, E-value=3e-11, Identity=26%"; Hit description =Putative uncharacterized protein
  Subcellular localization annotation: CTP_CleavageSite=24; ConfidenceScore=5.80e-01
MAESSKKIKGSSSSAMASRTQRPVATRVSPTSIPPSLSSSTLFSSDEQRIRYSSLFSSRQIFYPKYLDLEFFDGQTFDCYQMFQNTSLIPFMSLKLPYYPKLVQVFYSNLKIQDGTLISEVHGIPMIIDESLFFSLTQLPSQGAPFEGTIVDDWKFDYSNHDARRMVCIDQGDMTDRLLAGSLTFDCRIMHYIIVRILMPRSSNLAQAFEEDLILMWAFLTGRPIDWAHLIHYHMHKALRSSAPLPYPQLVTLFLRHFEIPLNSFGYRKDMDGKWLKKDAQPPQDECTPSALP

SEQ ID NO: 175068 - protein, 104 aa, Glycine max
  Coding DNA Sequence Number=SeqID_83383
MGVIPFCRARKTYIIPNFDVENKLRKRIIGTTQQARQRYKKALIPNRSGFGDTKLRAPHPIYRVCPSQSSTNLLSECEIEVISGCKYVAKIWVECGRKMDQIQK

SEQ ID NO: 175069 - protein, 45 aa, Glycine max
  Coding DNA Sequence Number=SeqID_83384
MENDELRSEDSEEEEVEMSDQLSSTHDNTLCMLICPVPGNSHISS

SEQ ID NO: 175070 - protein, 95 aa, Glycine max
  Coding DNA Sequence Number=SeqID_83385
MVKGVVTVVFWKISGRTVLPEVTKGHPEEHFFQKSSGTPSSGNFPKEVVLPENFRKKGTFGCPLNIPKELSGRATSSGKFPEELLLPKVYVFEIL

SEQ ID NO: 175071 - protein, 78 aa, Glycine max
  Coding DNA Sequence Number=SeqID_83386
MTTSNSMMFMNMENQAIKESHFHILKPLVANFQKIKSTQILIRIEGVLRTRVTSTLSRVINMVMDVIGGREYHSEKYA

SEQ ID NO: 175072 - protein, 91 aa, Glycine max
  Coding DNA Sequence Number=SeqID_83387
MAKGMEMVMKKKRKRRRTTKAAIPKLGAAGQTIVEAKLHDESRLIQRCFDDNKDDDKGDDKKLKGQSKNKFKMFKIESRTLQDSRGKLKNT

SEQ ID NO: 175073 - protein, 142 aa, Glycine max
  Coding DNA Sequence Number=SeqID_83388
MGGVNQLCQLRFGKNILQRMGRENSEGDSQFTGYAIRLNGYFSYNNLVDTFRAPKESTGDEESPNGVGNYCGYVEEGEGIRLGQVGVFGYGYKGKHEAPSSGTVTNATPIEGRLHGWRFFHTKKIKGDSKCMGNYERLKCME

SEQ ID NO: 175074 - protein, 351 aa, Glycine max
  Coding DNA Sequence Number=SeqID_83389
  Gene Ontology: Mol. function=oxidoreductase activity; Cellular component=extracellular region; Biological process=response to oxidative stress
  Homolog annotation: Hit_ID=Q18PR1; Match level="QueryCoverage=88%, HitCoverage=97%, E-value=1e-135, Identity=77%"; Hit description =Peroxidase
  Pfam annotation: Domain name=peroxidase; Domain location=43-283; Score=471.8; E_value=8.5e-139; Accession=PF00141.14; Description =Peroxidase
  Subcellular localization annotation: CTP_CleavageSite=44; ConfidenceScore=5.41e-01
MANSLNNHLFVVVSILSLLAFSSNAQLSPTFYAKTCPNLQTIVRSAMRQAVAKEARIGASILRLFFHDCFVNGCDGSILLDDTATFTGEKNAGPNRNSARGFEVIDTIKTNVEASCNATVSCADILALATRDGVVLLGGPSWSVPLGRRDARTASQSAANSQIPGPSSDLSTLTSMFAAKGLTSSDLTVLSGGHTIGQAQCQFFRNRIYNETNIDTNFATTRKANCPATGGNTNLAPLDTLTPNRFDNNYFSDLVNGRGLLHSDQVLFNGGSQDALVRTYSGNNAAFFRDFAAAMVKLGNISPLTGSSGEIRRNCRLVMAIITRVSAGGSSSDVLEVMTHERLVYCKVMVI

SEQ ID NO: 175075 - protein, 104 aa, Glycine max
  Coding DNA Sequence Number=SeqID_83390
MKNRDETFERTDPLLECGQQNKKKAWNGSRKCRKTVLWWSSDFPIIGDQRVDRTCLTGSCEEVMLESVSRILTSKLAGVNRDSENAPDLGVISEKTGDGRPWRL

SEQ ID NO: 175076 - protein, 85 aa, Glycine max
  Coding DNA Sequence Number=SeqID_83391
MTRGNPGDLKPFDPKIDRTFHRLVRHSVHPDHSVYFEHFEYFVAGDSEYSDFEHSTTNFHTENMAQPPPRERNLREMAAPDFTYE

SEQ ID NO: 175077 - protein, 110 aa, Glycine max
  Coding DNA Sequence Number=SeqID_83392
MGMDTILFGIHSTNMKVFRDTPAMAPPSVFWLRKFLLIGVEFKLLHECRSKLHDESRLIQRSFDDNKGDDKKLKDQEQLHDNKDDDLKNQRMSSRCSRLNQEHFKVQEEI

SEQ ID NO: 175078 - protein, 106 aa, Glycine max
  Coding DNA Sequence Number=SeqID_83393
  Subcellular localization annotation: CTP_CleavageSite=50; ConfidenceScore=5.12e-01
MLKLFRLMKLKMIVKVRVRGMLMLMVRDRVKMRFRVMVRCRGFMVSVRVRCKEISPNNWEFDVATIEFGDEDGETDQPDTSLGSEDEGVEKEKFQRFRMPKDDADV

SEQ ID NO: 175079 - protein, 71 aa, Glycine max
  Coding DNA Sequence Number=SeqID_83394
  Homolog annotation: Hit_ID=Q00M75; Match level="QueryCoverage=43%, HitCoverage=5%, E-value=3e-08, Identity=93%"; Hit description=PPR -repeat containing protein
MGFGLRASPGAVVKLYLGDLLVMGSNPETASLHMQGQGCVQYPSPIPSHSEEPLGNGITILFSNKNVILCV

SEQ ID NO: 175080 - protein, 95 aa, Glycine max
  Coding DNA Sequence Number=SeqID_83395
  Gene Ontology: Mol. function=carbon-nitrogen ligase activity, with glutamine as amido-N-donor
  Homolog annotation: Hit_ID=Q4FCX5; Match level="QueryCoverage=96%, HitCoverage=15%, E-value=1e-27, Identity=65%"; Hit description=N -acylethanolamine amidohydrolase
MTKSPPCLPTLSSNDNSNALGSLRIGKYTPWFNDVHSTEISYKCDEALNLLSKAHGCEMIEIIILELLEMRTTHVVSIGSECLCSLNPGCEDWYV

SEQ ID NO: 175081 - protein, 349 aa, Glycine max
  Coding DNA Sequence Number=SeqID_83396
MSASTINQYGYTSTIDQSIQAKSIRGGDTGQCVKADVGLKRGMVFWRGAKRTFGGVFLAVQGESSFDCLEKSWPGSDESVPEHPLKPTESGSIEIHPNGSWPSNRGTSSLTDNRGGEGGWFVAGVVEVKPVVMCWYETNVRKKKKSLGSRSRSLLGPSRAFLSSCTFIVAGAFLSSYSFATAGLNQTCASYEEPSSITWWSSSDEVGAYVLYKPLEDREWSKRIESIFPGSELPSLFNNQRQGRKTVSEMGSPQKPNFTCYIPGVLNEDPITDESDHLWLCALSATEESGKASISRSRAKRKISALSAAVVFSQAQRTTGVKLKSTYSAHHSAYFGNRALEEARGATFA

SEQ ID NO: 175082 - protein, 100 aa, Glycine max
  Coding DNA Sequence Number=SeqID_83397
MVVLGNGDISSASSSSASSSSSVSESECDVPPLEGDLLMVRRLMGSVYKDRDETQKENIVHTRVTQGSQVRLPRKENTPSRHQCLFDENVRKTKNQVYKL

SEQ ID NO: 175083 - protein, 67 aa, Glycine max
  Coding DNA Sequence Number=SeqID_83398
MSGGCCRCSFSYFFDSCFHFGSCCSSSQYLNEFRPLEAERFKALRIQWAQCHTLISSGDYNLMIYNH

SEQ ID NO: 175084 - protein, 64 aa, Glycine max
  Coding DNA Sequence Number=SeqID_83399
MKVYNTVCRNVPFCGRVKARLTGALSKGGKMRGVATNVYLWKTSEKPKETGQNENSKFGSCIYA

SEQ ID NO: 175085 - protein, 91 aa, Glycine max
  Coding DNA Sequence Number=SeqID_83400
MSNWSSLKMLEHQEKCIIMMMHLNQIMKNLLDERMNQQHSQMQLKMIDDALLCNMKYKLLKTMIHGPCVLFRQIKRPWDVNGSTRSDTILR

SEQ ID NO: 175086 - protein, 35 aa, Glycine max
  Coding DNA Sequence Number=SeqID_83401
MAITGHKQWSQGLMGEREKRKVVCDTRSASGKKLL

SEQ ID NO: 175087 - protein, 90 aa, Glycine max
  Coding DNA Sequence Number=SeqID_83402
MVPPANNGVETEQSEKKQNTYLALMSDSNGGCSTSRQKQTPTTVMNGEDGNKEMAITGHKQWSQGLMGEREKRKVVCDTRSVSGKKLLSK

SEQ ID NO: 175088 - protein, 102 aa, Glycine max
  Coding DNA Sequence Number=SeqID_83403
MHDSIMFEEVDMNVENEKDVGVKVEHIDCSDAFNTSQKLSFSIQGLCEAKVTIIEEMETISKRFEELDVCGKDSIEYIIDVKADGNCGYHGIVALWGMGEES

SEQ ID NO: 175089 - protein, 91 aa, Glycine max
  Coding DNA Sequence Number=SeqID_83404
MSTFKDVVEVSTLLECVLSKTVLTSATSLKVGIQRRCLPQQRLRMPTFKDVAKNLLFLVVRESYMLVRVSHHRGVELIRTKRLGNLEILLL

SEQ ID NO: 175090 - protein, 124 aa, Glycine max
  Coding DNA Sequence Number=SeqID_83405
  Subcellular localization annotation: CTP_CleavageSite=53; ConfidenceScore=5.26e-01
MYPPLFSLNNLVDVSSTRTDPQEMYPLLFSVTTTQVDVPSTCTTKDVPSNVLRQSSQAEREESKEFSDCVVLNSLTREKGDTKEFRRLVLRFFGKGRRETQKEFRQIVLGEFVLAKGEGNEKDE

SEQ ID NO: 175091 - protein, 103 aa, Glycine max
  Coding DNA Sequence Number=SeqID_83406
MSQHISVTVVDSQTLADDGHCAQRTPSCLPKSKAPMLGGLPSRQKGSTECGYYVMHWMSTVILGSFRNNWEAYFNDPRPLEPERLKALRIQWAQYYLRVRDQT

SEQ ID NO: 175092 - protein, 233 aa, Glycine max
  Coding DNA Sequence Number=SeqID_83407
  Gene Ontology: Mol. function=catalytic activity
  Homolog annotation: Hit_ID=A7NSS1; Match level="QueryCoverage=17%, HitCoverage=8%, E-value=2e-10, Identity=79%"; Hit description =Chromosome chr18 scaffold_1, whole genome shotgun sequence
MKRFGGPYRVGSSVGVGEKSCLCEIAEIKGFLVLDMKFDSITFAFWSKSSMDVEPRRIRLLSNRYTTNTLLDTAATIQILKPRTFLATFYPKPMMSATSAAAWDRLKKHYASRSHTPIMSLKESLDSITKLIIGLKGLGPAFHEFSASIQECDSPLFAKLFHKLVDRDFSPTRGISHASSTHGQINPHSHNSSTCADPSNNNTQWGNVSHSVPAWQYCGRCDHTAETCYKLHG

SEQ ID NO: 175093 - protein, 110 aa, Glycine max
  Coding DNA Sequence Number=SeqID_83408
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=Q8GEG0; Match level="QueryCoverage=55%, HitCoverage=48%, E-value=1e-25, Identity=93%"; Hit description =Putative uncharacterized protein
MKPKPLGLWALCESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 175094 - protein, 283 aa, Glycine max
  Coding DNA Sequence Number=SeqID_83409
  Gene Ontology: Mol. function=binding; Cellular component=endoplasmic reticulum
  Homolog annotation: Hit_ID=Q14K82; Match level="QueryCoverage=32%, HitCoverage=55%, E-value=4e-20, Identity=49%"; Hit description =Putative uncharacterized protein
MGHRMLKFTAIQLVDNEDVKLKPSSSTQPKVPEFTAKSSLPNKELNPFSEDEDEVLHNQPQEEDDEEEARLASLITTIASEAEAATVAALSRLKWHSDDEDDDDAKHEANTVQEVKKAKQKKPKKPKVTVAEAASRINVDDLEAFLAEIILSASYESQQDIILMRFADYFSRTFSSGIYKISTDWINHRSYEALGSFVLWSLDNILADLASHQGVKKAIQQSSLKSLRWTSLSNNMRMGYYFMCPMRQYENALGFKDGKDMPSRLRGKSLDVGCASLDKSIAV

SEQ ID NO: 175095 - protein, 176 aa, Glycine max
  Coding DNA Sequence Number=SeqID_83410
  Homolog annotation: Hit_ID=A7PD42; Match level="QueryCoverage=63%, HitCoverage=20%, E-value=2e-16, Identity=40%"; Hit description =Chromosome chr17 scaffold_12, whole genome shotgun sequence
TPKTFDWTSRLGIATTIAEALSFLHQELCHHAIVRGNLKSSNILLNKNMEPCISEYGVMGMDDQRGSLFASPIDSGALDIFKEDVYGFGVILLELLTVFDKSLISEYASDERMSERTPQFTLEIPSLTLLSALPVWFVLLGLDTLSTKAHVASVLNSIICLVAFEIALQILTPLTW

SEQ ID NO: 175096 - protein, 15 aa, Glycine max
  Coding DNA Sequence Number=SeqID_83411
MDGKGLVDGCQDYIP

SEQ ID NO: 175097 - protein, 153 aa, Glycine max
  Coding DNA Sequence Number=SeqID_83412
  Homolog annotation: Hit_ID=A5BSR3; Match level="QueryCoverage=78%, HitCoverage=38%, E-value=4e-07, Identity=29%"; Hit description =Putative uncharacterized protein
MDHMKKTGQMTSEAAKEIAEKIDSLEEQALQGSLVAHGCQDVLTAVIGRPEHPGCVCAVGASVTIKQYFRLAPRTSRTSSSMAPKDLEQLTQQIKDQLDESLTKKMTRQLMLSFSKMQSQGLALPPKPEVGPSATRVSTKESCVDPSRNDLDT

SEQ ID NO: 175098 - protein, 87 aa, Glycine max
  Coding DNA Sequence Number=SeqID_83413
MTRGNPGDLQPFDPEIDRTFLRLVRHSVHPDHSVHFEHFEHFEYSVASDFEYSDFEHSAINFHTENMAQPPPRERTLREMAAPEFHL

SEQ ID NO: 175099 - protein, 656 aa, Glycine max
  Coding DNA Sequence Number=SeqID_83414
MERDLMEPIFIVVERDYWVERLRFYSRANLEGERGCAVLREFVLCRGSLSNIWGSSLDKQRVTSLLSPQVWMSVVRCPRQYISPPSSEPACRQKRLSSAEGVCPVSRVVGCGNLNECKRLQDDVPGQALEPRQVLSGLMSSFLFDYAIGLGDSDSKGLIEQPIIDREVISIGGSSSEDTRRGAFDSESSSSERALPSAPTGEPVPVTVILPPCAYEGVRRGNGGRDSRTSPHVLDLILPFTTFQCALLEHLNVAPSQLHTKNWAMIQAFESLCPFFNIQPSVSDYCFKVLAIGVMIDGMPLMFNKDRESCFPFYWQSDPIKFKSYDEDLLTFVERVDKAILEQLSASLDARAILALPLASDPLTVLDSGIVPPSIVAPSVGEVGQPVGKVGPVAVVAEVTPSAPSSVLAKRMMDDVARSSSRKKSKAHLSLHALRLAVGLMASVGCFSTMQDMPSAPQEVTPAIVEVTVPATQADFVMAPSSTVATPLLSVGVATTGASTVLLPFSTTPVASPFVVLAMVASPFLSSHPLVSLDHLYTSSDTDSLMLLILPKFFSKGVCQFKRSMDAEAVRLNHQLSFKAEKKDLGGKVESMEAEKDGFSKVIDDLEVRLKDSKSKLQVGKEKETSMELEDLDLGLFDPFKDVKDDVLLDEEDIAA

SEQ ID NO: 175100 - protein, 107 aa, Glycine max
  Coding DNA Sequence Number=SeqID_83415
MAYMWNMVHISIIYCCRLVPGRAQISTDNHRHQTIRFYDVDIKVQAHDNHQTQTHDQMEAQDLIQGIGGPMTRARAKKAQEALEHMVTILRSVQMQGEAQHLEAHKG

SEQ ID NO: 175101 - protein, 140 aa, Glycine max
  Coding DNA Sequence Number=SeqID_83416
MLLHPPAVLQNRAHFKLARRDDILGSRVCKMHLCLASRKHFFMHSSISPMVDVGVLILTEVFSNQTPLLKKRFYQVKIKSLEVSRLRELGQLMGQLQRQAFRKAYSKIWDLTTAEVPVEAIASLTQYYDQPLRCFTFEDF

SEQ ID NO: 175102 - protein, 154 aa, Glycine max
  Coding DNA Sequence Number=SeqID_83417
MFPLEKKPAVNPLNVLLSLLEASGVLEPEGHPPSDFLLDSPGNQNSRAQSLPGFTINSPQISARLHQSDFAPYVSGLYNAQWNALVLLHDKHMLHLGHILDEMEVKGPWLGSWLPLTYGVDTGVSQHRTLELARIPCIVSFSQNPCPCWCFGSS

SEQ ID NO: 175103 - protein, 124 aa, Glycine max
  Coding DNA Sequence Number=SeqID_83418
  Subcellular localization annotation: CTP_CleavageSite=35; ConfidenceScore=5.27e-01
MACPLACVPKEPSRTSTSIRSASLASTHQSNTIKRANPSESSNNHSQNCPMCGLYNAQWNAPVLLHDKHMLHLGHILDEMEVKGPWLGSWLPLTYGVDTGAGFVADWVVGNEKGRYRQSKEIIE

SEQ ID NO: 175104 - protein, 185 aa, Glycine max
  Coding DNA Sequence Number=SeqID_83419
  Gene Ontology: Mol. function=aspartic-type endopeptidase activity; Biological process=RNA-dependent DNA replication
  Homolog annotation: Hit_ID=Q69F85; Match level="QueryCoverage=75%, HitCoverage=8%, E-value=6e-13, Identity=30%"; Hit description=Gag -pol polyprotein
  Pfam annotation: Domain name=Retrotrans_gag; Domain location=47-129; Score=15.2; E_value=0.0018; Accession=PF03732.8; Description =Retrotransposon gag protein
MEADILFRWKPLNLERYDETINKFKRASGCLPNIGEPLHQRSAILCRVFLTSLKGETLTWHGGLPPRSIDSFDTLIKLFSAKYTTNRSHRMTSAASEKKFIDRFESTVVQIRNLNLEVALHSMLIALCPNKFANRVDPENIKKINTGTKKQTKEKQKTEADKDNSNNGVSDLLHQNRNPPSTLEV

SEQ ID NO: 175105 - protein, 1148 aa, Glycine max
  Coding DNA Sequence Number=SeqID_83420
  Gene Ontology: Mol. function=nucleotide binding; Cellular component =cytoplasm; Biological process=defense response
  Homolog annotation: Hit_ID=A5BH36; Match level="QueryCoverage=78%, HitCoverage=53%, E-value=9e-86, Identity=28%"; Hit description =Putative uncharacterized protein
  Pfam annotation: Domain name=ABC_tran; Domain location=168-300; Score= -60.0; E_value=0.063; Accession=PF00005.18; Description=ABC transporter
  Pfam annotation: Domain name=LRR_1; Domain location=585-605; Score =4.7; E_value=42; Accession=PF00560.24; Description=Leucine Rich Repeat
  Pfam annotation: Domain name=LRR_1; Domain location=607-628; Score =10.9; E_value=3; Accession=PF00560.24; Description=Leucine Rich Repeat
  Pfam annotation: Domain name=LRR_1; Domain location=630-653; Score =3.9; E_value=59; Accession=PF00560.24; Description=Leucine Rich Repeat
  Pfam annotation: Domain name=LRR_1; Domain location=788-811; Score =4.7; E_value=42; Accession=PF00560.24; Description=Leucine Rich Repeat
  Pfam annotation: Domain name=LRR_1; Domain location=815-838; Score =7.8; E_value=11; Accession=PF00560.24; Description=Leucine Rich Repeat
  Pfam annotation: Domain name=LRR_1; Domain location=840-864; Score =5.9; E_value=25; Accession=PF00560.24; Description=Leucine Rich Repeat
  Pfam annotation: Domain name=LRR_1; Domain location=902-926; Score =3.9; E_value=58; Accession=PF00560.24; Description=Leucine Rich Repeat
  Pfam annotation: Domain name=NB-ARC; Domain location=136-430; Score =122.5; E_value=1.3e-33; Accession=PF00931.13; Description=NB-ARC domain
  Pfam module annotation: Pfam domain module=ABC_tran::LRR_1::LRR _1::LRR_1::LRR_1::LRR_1::LRR_1::LRR_1::NB-ARC; Domain location=168 -300::585-605::607-628::630-653::788-811::815-838::840-864::902 -926::136-430
MEDSVLSIRAKIVEYIVGPILHHAKYLCCFNNFAVNLPNAKRELELTLEQVKLRVREATIRIEKIEPTVEEWLEEVEKVLAEVQILEGRVLKVTKSSFIRQCRYFLAKEMVRKIGQMNQLKCNKLEPFSRSINLPDMKYYSSKDFVLSNSTESTYNKLLETLKDKNVSIIGLVGIEGSGRTTLANEVGKKAEKLKLFEKVVMTTVSQNLNIISIQEQIADKLGFKLEEESEESRAKTLSQSLREGTTLLILDDVWEKLNFEDVGIPLNENNKSCVILLTTQSREICTSMQCQSIIELNRLTNEESWILFKLYANITDDSADALKSVAKNIVDECEGFLISIVTLGSTLKKKSLGDWKSALKRLQDSKPLVITKGLKIPHVCLQLSYDNLTDELTKSLLLLCSIFPKDHEIDLEDLFRFGRGLGLTKTSETMEKSRREIEIAVNILKDSCLLLKVSNKERVKMHDMVRDVALLMASERGQAMLASTAMDLRMLVEDETLKDKRAISLWDLKNGQLPNDNQLNCPTLEILLLHSPKAGFEVSNLCLERLKVLKILSFLTCGYTWKLPQFSPSQYILSLPQSIESLKNLQTLCLRGYKLGDISILESLQALEILDLRGSYLEELPNGIVELKKLKLLDLYNCWIEKNNAYEVVGRLQLEELYFHLFSYKEDIPHNVSFSRLQRYVIVLDHRPYSFHLKTEIMEEHRPSRALYINGLNASTQRFISLPIMDLFLRAEYLHLKHLKGGYKNLIPSMDQQGMNQLIALVLEYSLDIEYLFDSTMITTKDVFLSKLVTLRLNGMHGLQEVFHDQFSLCSLENLQELIIENCAQLYSISFPRYSNLCSIKVLRIYNCPVLTSLFMPSIVKTLVLLEVLKISECHKLKYIIEEVKEGTINRQNHASMTLPKLSIIDIEGCERLKYILPVCFLGELVSLQRMSIRKCSELMYVFGNEKEHDLSAYQHQSTYHCLYPNLLNLDTFKLDSLPNLVDFWPDYYRPRLLNLKEGRCTECPGLSNSARKVVIYLNLRQDITATDKVGKVSSHRTQQDTTIGKTIRRLKGILDRAEMTSSTQESIAPSSSNNAYEDIARAQQQVAEAQRDASIARQETTVVSHLLEQMMEKLAVNEQIGLQKRAHEHVGLQRGTQQEPGAESKV

SEQ ID NO: 175106 - protein, 110 aa, Glycine max
  Coding DNA Sequence Number=SeqID_83421
MMTKVMKKSSKIKGDDKKLKGQSKNEFKMFKMESRTIQDSRGKVEEHFKIQEEKLKNTSRFKRKVEFKNQDSRIKLQESRSRFKIQEPREDLIKITVIDYNVLVIDYQCL

SEQ ID NO: 175107 - protein, 75 aa, Glycine max
  Coding DNA Sequence Number=SeqID_83422
MKEAEEGVGHSVLREIGEKSRKRRRKKRKMRLKRYRIATIIDFYIVLHSDLDTVYAPLGVLFVALRTFISFFYLQ

SEQ ID NO: 175108 - protein, 87 aa, Glycine max
  Coding DNA Sequence Number=SeqID_83423
MDDFSEDEDQRSLIISITKMMTKAMTRVLANQRPKHLPVSSLVEEAYFKTAQLFPIKGRQTRAMINSGSLYSKVVSEAMNNGQQELK

SEQ ID NO: 175109 - protein, 375 aa, Glycine max
  Coding DNA Sequence Number=SeqID_83424
MALKESIDKSAKQVSSIVTSYDKSQCILEKDVKDDVFLDEEDIAAEEKATEEEAGEEEQDDENGVFDGVGSRTLVIMGFTSRWRTDQGIIRPRFWRDSPRVDYGFDEPEGFTKGGPWVMRTLWRNDMFWRDSPIVDLRFDEPIGLTKGGPWVLQALWRNNLLRLGLATLGRWVERFMVEALYCIFLLLRACLLVDDSPTLAVIMAFVPCVNRHVESSAQGPEDDSVGCLCLTVGLRMFDRGEEVFDAQPCYEVFIGLRFELCIVVNDNGVREAILAYEVFPGEFLHLIGCNFSQWSCLDPFGEVVDGQTVEIVRIGAWNICKLLALSASLSEIKGVNPECRPVVVDVHHLGCKGAFPGVGLHSRLMATPLELADS

SEQ ID NO: 175110 - protein, 227 aa, Glycine max
  Coding DNA Sequence Number=SeqID_83425
  Gene Ontology: Mol. function=transcription regulator activity; Cellular component=nucleus; Biological process=regulation of transcription
  Homolog annotation: Hit_ID=A7P102; Match level="QueryCoverage=77%, HitCoverage=63%, E-value=8e-46, Identity=59%"; Hit description =Chromosome chr19 scaffold_4, whole genome shotgun sequence
  Pfam annotation: Domain name=HLH; Domain location=43-118; Score=6.9; E_value=0.029; Accession=PF00010.17; Description=Helix-loop-helix DNA-binding domain
MEGVAPIEEKKKLTVDIDGSLGDSDGLKESGSKKRVRSESCAASSSKACREKLRRDRLNDKYTVYFQIPTTSPLRHVPYMMDMIRFVELGSILEPGRPAKTDKTAILIDAVRMVTQLRGEAQKLKDTNQGLQEKIKDLKAEKNELRDQKQRLKAEKEKLEQQLKSLNGQPSFMPPPAAIPAAFAVQGQAHGNKLVPFISYPGVAMWQFMPPAAVDTSQDHVLRPPVA

SEQ ID NO: 175111 - protein, 222 aa, Glycine max
  Coding DNA Sequence Number=SeqID_83426
  Gene Ontology: Mol. function=ATP binding; Cellular component =intrinsic to membrane; Biological process=defense response
  Homolog annotation: Hit_ID=Q850J3; Match level="QueryCoverage=45%, HitCoverage=45%, E-value=1e-24, Identity=59%"; Hit description=NBS -like putative resistance protein
MGPIYLVGISKIKVRVVEEATTICREIEEIVQNILKILGPKFSSLPNDHLVWMESRVEVLVKLLELELFNVVRVVRISGMCGIGKTTLDCALYERISHHYDFCCFIDDVRKIYQDSGALCIRCTKQLLSQFLNEENLEICNVYEGTCLVWSSLRNARTLIVIDHVDKVGQLMMFTGRRKTLLRECLGGGSRVTPWQLIEVMGSTLFGGNVSQWRSALARLRK

SEQ ID NO: 175112 - protein, 397 aa, Glycine max
  Coding DNA Sequence Number=SeqID_83427
MARRWWTVPRIRQWKHRTAEAWHKRNTNEDIFVISLKLLGALAIILGAPSNTLNFAAVATAPSSSSFFISPSLRATIVHAACPATSDSYQDSRIRLLLRPQWRRPTTFTRRQREATLVVEDVHHMDYADDEVHEQPEEVVVDDVATDAEGFSGGPHDISVLQDYVYDVVVKIEGLVAAIGLSPLITCLLNTSDWGLMSAFMERQHKETNSFHLSIGERQELRQYNVMGHVFDYPGCKTYIGANVMQHRLYNGWGIRTDERKGVKERKGRNGGKGEENSLRKSSQTLGPLSASFLAQHRLDYALSELLSLTPVARLAWVSPIALSASWALSETLDWALLLSGSYAWGAATLVHMYDNLNDASKSTPDNLQDISHFYIVGSISTFHLLVLMLLLRFMMS

SEQ ID NO: 175113 - protein, 188 aa, Glycine max
  Coding DNA Sequence Number=SeqID_83428
MPPFYHEQWAPHYPEFARFDYDGASYQIRLRQYRGKLFFTVGLKQLRNHLNIYELVTINFMACEHKWIFNLHFTPLMEQQACSRPLPAFRMHVWTIELTQALLGDPEPLRLPPIAAIHLPSCGFHMTILRKFGPPLQWPIVPVSPSFHGKYVAQPWYRFLAEDDFVHGDELLFYYRPREDIWEMVIRK

SEQ ID NO: 175114 - protein, 63 aa, Glycine max
  Coding DNA Sequence Number=SeqID_83429
MAILATVTRSFVFWLGTIVDGDETATATMTKICYCGAAAAGVRSCFSFKGEHWGFVEEHLGSY

SEQ ID NO: 175115 - protein, 1195 aa, Glycine max
  Coding DNA Sequence Number=SeqID_83430
  Gene Ontology: Mol. function=aspartic-type endopeptidase activity; Cellular component=cellulose and pectin-containing cell wall; Biological process=proteolysis
  Homolog annotation: Hit_ID=Q9LT49; Match level="QueryCoverage=63%, HitCoverage=87%, E-value=0.0, Identity=50%"; Hit description =Arabidopsis thaliana genomic DNA, chromosome 3, P1 clone: MOE17
  Subcellular localization annotation: CTP_CleavageSite=31; ConfidenceScore=5.16e-01
MAKLSFKMNMTKFEKFLSFSFLFLRDHLLSRAAAFNNSCILCVFVGTDLRWAPTPPPSWASATATIFRHTVLAKPTNIVGFSQGLLSLTVQLATLSPKLGNLLSYCLVSHSFDKERLRKPSPLILGSYDDPGERVEFVYISMLWNPKHSYFYCVGLTEISVGKRTIPTPEMLRRVDRRGDDDVVVDSETTFTMLPESLYNLVVAEFSRRVGRVHKRASEIADGMTIQIDTVNLLLETRGSASRQGGATWTPPMASITIHNLLLYTTNESWEVVNLKEAREFSSNKKYIYVFKKLEWESLSIDLLPHPDMFTDATLGRSQEGANLRDEDGAKRVLFGGERFIEGISGEAYITIQRTELNSPFGLEVQLHVTEAVCPALSEPGLRALLRFITGLYVCLNRGNVDFKAQQRSTEAAGRSLVSIVVDHIFLCIKDAARSFCPPIYPLGEQQWLSIVGTPLICLHSIQIVPSPLPPSFASQTVIDCQPLMEESCLTISSFLADGIVVNPGDILPDFSVKSFIFTLKGLDLTVPLDKTQLDNSETNMDNKIKTSFAGARLQIENLFFLDSPSLKLKILNLEKDPACFCLWEDQPIDASQKKWTAGVSQLTLSLEASTGKLGHQNSLGWTAGLWRCVNLRDASIEVAMVTADGNPLLKVPPPGGIVRVGIACEQYLSNTSVEQLFFVLDLYAYFGRVSEKIEIAGKKKQLKDVRNKSFSGKLMDKIPSDTSVTLTLKNLQLQFLEPSSVNAEGMPLAQFVGDDLSFSATHRTLGGAIVVSSTLNWERVVIDCVDSKEPLACEKDSYFSTGENVPSISDVGYPKLRPVFWVHNKKELLNGNAHSYPFLDISVVHVVPFCIVDMESHTLNVSAVVSGVRLGGGVNYFEALLHRFGILGPDGGPGKCLSKGLENLQTGPLAKLFKATPLISDNSENGEGRDTSFPNLKNPDIVDVTIELKDWLFALEGAQEMAERWWFSVHEDVKREERQKITITQNTTISGGTGYGKDTHPSFFKFDAVSLSVVAPEKGAAHGGAKWPQSFGSNGNREAKIGTSDTNLEDKELNISVGVQGLQIMKPHTQKDIPMSLITVNGVKEFTEKIGGTDLEVSLILSEDNEHELVNWEVENLKFFIRQPVVCDEDFTIQNEAVVTKEEVQHLTFLCKSEIDSAGRITAGVLRLFKLEGSVGQSAIDQLGNLGMLPNFLM

SEQ ID NO: 175116 - protein, 153 aa, Glycine max
  Coding DNA Sequence Number=SeqID_83431
YRKAGEEVGKWNSVGVTGTVPERFLSETSKNFSKDWLKRGIELLKELKLKRRLWKQSREVNAVEIGPEKLLWKKSNEVVVIEEEAFEIEETVENETDHFEAIAFHALPRAEAEAAREGQEVKLVFDIGGGGGRIFSRRHWEKESDIGKRRRAK

SEQ ID NO: 175117 - protein, 166 aa, Glycine max
  Coding DNA Sequence Number=SeqID_83432
  Gene Ontology: Cellular component=nucleus; Biological process=cell division
  Homolog annotation: Hit_ID=Q39880; Match level="QueryCoverage=63%, HitCoverage=50%, E-value=6e-15, Identity=64%"; Hit description =Mitotic cyclin b1-type
MEREKSCYQQETNTILLDSMVARTDKNMGGEGRKRRVRQDIGNLVTKQGHGNGINELSCSTIGQCTSRNIKEQVVIQKPSTEVNNGAVLATDGVDVDINAKMRSILVDWLIEVHRKFELMPETLYLILNNVCLQSTNTFDVIKESITGSMAASGSVAVELAEKLKI

SEQ ID NO: 175118 - protein, 78 aa, Glycine max
  Coding DNA Sequence Number=SeqID_83433
MPALLRVCEARLTGALSKGEKCAESPPTFICGKRRKNRRKSVIKNIPSSGVVFTFEEGRQKPGSCSYAPSIEEEIRPT

SEQ ID NO: 175119 - protein, 97 aa, Glycine max
  Coding DNA Sequence Number=SeqID_83434
EKLATQLAQASYVASSRSNRLLEEYSGRPKWACMSQNITNCLTMGAKYLEVVKRELHPNNGWSPDEIRGAEFVSACLPTQGAESISARLSTEVVVPE

SEQ ID NO: 175120 - protein, 159 aa, Glycine max
  Coding DNA Sequence Number=SeqID_83435
MGAKYLEVVKRGSHPNNGWSPDEIRISPYTGAILLKCKPSRINQTLYFMLKGYTLLDGVPQDATMIGTCGDGSRSAYDIGIGVNSVGFLFGKFLLRLVFVLELGFALGLGCGVLIHGVVRGLWGAWPCGCCGHDEGISLFFLCSTCPKPPIARTCRSSM

SEQ ID NO: 175121 - protein, 248 aa, Glycine max
  Coding DNA Sequence Number=SeqID_83436
MRGAPSEETIAPFIARGGYHKRLKSRTQGITWLQKLKCLNGEEEKVHEESEEVQALKAKLEKTRVMKEKLRVAVTRVRKKCDELKDINMTAAEALQQETKKARKEEWSRNKLRGALLGNNNELKLRMAERDKSRMESMTLEDKLKNYQRSKRGLKEQLSKTEENMFIIIDQYKEKVNLAASHRQMLEDEHEKLSALRVEREAREGVIEILHKKAMKWMDRFTLTLNESQELPRLFAKAKVVADTCSSQ

SEQ ID NO: 175122 - protein, 95 aa, Glycine max
  Coding DNA Sequence Number=SeqID_83437
MASRNENVSTVADCDEGVEFKGKNNAVTISDDKDIDGMFDIYNRHQCLSGFQLLVQYEQQLSSTANVETIVQSQQIHETPYTDYHTQTYHQGPSS

SEQ ID NO: 175123 - protein, 522 aa, Glycine max
  Coding DNA Sequence Number=SeqID_83438
  Homolog annotation: Hit_ID=Q2HUJ3; Match level="QueryCoverage=40%, HitCoverage=48%, E-value=1e-14, Identity=27%"; Hit description =Putative uncharacterized protein
  Subcellular localization annotation: CTP_CleavageSite=35; ConfidenceScore=5.34e-01
MKLFVNQPKFHRGGGRAAKPSTDLLNRPKISLRVPAGSEQKSHQVPTSTRLKSFVEVVKQSNDETNGSLHSIPGKGLRVDNDEPISIQTSLEKLKWLDNVWVGGLKNKGMFDRVDMEVQGAFGLELKTAYWGDDKIIIYDMDGDTANQLIHDEQQHGGTPFYSFQRWTPAMEPSHRLTWVCIWGVPLTAWDAENFARFVSAYGDLVELDAMTEERSRVDIARVLIHTEHKPVIDGTVAIVVDGTHFLLKLREEFGCQRGNRSWMERLERLLPSPFSTEVAGSDDKGHMHGVRNFTSALEGLTPGIGGQHGEPTSPRPSQQQQLLREEDVGDKAKGASDHVWAKGGDPLDNNLEALLGVKLGSNEGDSAMCMGNKSSHILGLGGIGPNTTRSKTTSPLKVYVRKKAVTPAIHMGRAINSPDQHGIQADSRKLDIDENGRHTQSPAAQGTSLEKPRLAHSPISSNSFKKGLCENEEALQRDIIRDLGLSFAEINTCKDHIMADGTHSSIISTPTGVMGKKPIEP

SEQ ID NO: 175124 - protein, 140 aa, Glycine max
  Coding DNA Sequence Number=SeqID_83439
MINLWLSECYFAKPRPSEPCSLSQLVSSSQVALSEHYSSLEAWNRYIDNILSWNILPERNVQLYHTEFEEFKVELERRNLHKHLTNLQEGSIDVAVVKEFYANLYNPGDQLMMNDSGMEKEEREETPLQGEDESRRSSPP

SEQ ID NO: 175125 - protein, 210 aa, Glycine max
  Coding DNA Sequence Number=SeqID_83440
MVRIKGLCRTLGKLTKVHELPRELVTDDVCADTQGFSGGFHDTLVLTNYDYHVTSTIWVGECWIYEHFPTIASCVADEDYDERKPHACRWKFGKALLCAVDYIAWFYMISHPFMSPTQPGDPSRHPLVVHDDTFIVVDPPQQPVNAAVMPKPPKPILALADVDMPRHAVDACQRIAKRLEHLINMRMVTSGTKAYTLIEECLRIARDVTE

SEQ ID NO: 175126 - protein, 108 aa, Glycine max
  Coding DNA Sequence Number=SeqID_83441
RGYIYLGCNTENKIGYISCGSVQVEGTSTWLFKENKGGILQGYCKSQELVVAWGLDVGTVFSLNLEDATSVLSELTLAQHFCTAHPSSRVFYALSQRMSRLADGSLSA

SEQ ID NO: 175127 - protein, 58 aa, Glycine max
  Coding DNA Sequence Number=SeqID_83442
MVQLKPLAIHYPSSIWSLGLRMTQLYCSIWSDFLDALRIHMQSVSFLPTPRAVAFFAL

SEQ ID NO: 175128 - protein, 329 aa, Glycine max
  Coding DNA Sequence Number=SeqID_83443
MDRHIDVALVKEFYSNLYDPEDKSPKQVRVRGRLIKFDAASLNAFLETPPVIQPGEQYLSYSIFCKSHTDPQELASKLCIPGRGFVLNAEGAPWKLLRKDLMTLAQTWSVLSYSNLAPTSHTSDLNMDRARLVYGLVMKMDMDLGFLISHQISQMAQSNSSRLGTREARARGSEGPSSDAPPALASSAPAPSRLQPLLLQHHHFLLLILIHQLPLLHHHHSSANALWSPFLCCRASTVAYACMDEFMAQVAWPRVQPSPLGGGEASAAQEHQPKPEVAHEATPEATPQVSHATSPIVEETPQPAQDAHSSPHGEPAPAQDEPTATQDDW

SEQ ID NO: 175129 - protein, 373 aa, Glycine max
  Coding DNA Sequence Number=SeqID_83444
MASKKRKAPSTPTQGRFDRSRFTSLEAWERYTDIVVPRKLLPEWNVVVYYIEFDEFKEELERKHWDEKLTDFFYSSIDIAIVKEFYANLYDPEDKSPKQVRVRGHLVKFDEDTLNIFLKTPVVLEEGENLCTYSRFALLRPDPQELAVKLCIPRRGFELNANGQPLKILRKNITSLAQTWSMDMNLGYLISHQISLIAQHDTSRLGFPALITTLCKARGVQSDSRSLENLSPAINLAYIKKNCWNLDDPIVTFRGPRKARGKRSEALTTSAPPETPAPSSSIAPLPPTQTPIIPPTSTQIPFPIPISEGPSDFIFTPKIMDEFYAQVAWLGAQPSPSGGGGASAAQEPVPEEPVAAAEGEDELTPQEEETSID

SEQ ID NO: 175130 - protein, 113 aa, Glycine max
  Coding DNA Sequence Number=SeqID_83445
MERAHLHYSKIFICPLCFGDDNKYICRSKLHDESRLIQRSFDDDKGDDKKLKDQEHFMITKMMISKNQDSRFKLSRIKNQDSRFKFQESRFKVQVPRIKIKIQDSRFKNQEKT

SEQ ID NO: 175131 - protein, 45 aa, Glycine max
  Coding DNA Sequence Number=SeqID_83446
MRQKKVVVTYKSDQGVQGAQEEEHRRDRPKRKSIPLAYLKDYIRY

SEQ ID NO: 175132 - protein, 91 aa, Glycine max
  Coding DNA Sequence Number=SeqID_83447
MFDVVLEIDFRLDEEGLTEDLCRNIPFCGRARRGSRVDKSGALAPTYPPSKRKSYLRSSFLRVNQAILFTWKVNILRRWTLKMIHLLGKKN

SEQ ID NO: 175133 - protein, 33 aa, Glycine max
  Coding DNA Sequence Number=SeqID_83448
MKKVKPTMKGVRVVDIGFYFVPMRKVKLTTKVR

SEQ ID NO: 175134 - protein, 55 aa, Glycine max
  Coding DNA Sequence Number=SeqID_83449
MVDQTKSIQNLKTTAALSALISRLARELDIDALPDSSVALSALKLRLAVDAHLAH

SEQ ID NO: 175135 - protein, 129 aa, Glycine max
  Coding DNA Sequence Number=SeqID_83450
MQQEQADILIARFPDPSYGVKMGFVFYRNREPSWKIPLRSKGSSQCGVATENNGSLWWLIVAMGEGESSWDVRNGFGRKKEEEMVFFLSYTKAKAENAQVRNGLGHGNVAHTPDIFSKIPTVRSWKIVL

SEQ ID NO: 175136 - protein, 168 aa, Glycine max
  Coding DNA Sequence Number=SeqID_83451
  Gene Ontology: Mol. function=motor activity; Cellular component=cell projection
  Homolog annotation: Hit_ID=UPI00006A2D9E; Match level="QueryCoverage =98%, HitCoverage=85%, E-value=1e-16, Identity=17%"; Hit description =UPI00006A2D9E related cluster
GLHVLAFRGLHVLAFRGLHVLAIRGLHALTFRGLHVLTFKGLHVLTFRGLHALTFGGPHVLTFRGLHTLSFRGLHALAFRGLHVLAIRGLPALAFRGQHVLLFRGLHVLTFRGLDVITFRGLHALAFRGLHALAFRGLHVLTFRGLHALAFRGLHALAFRGLHALAFR

SEQ ID NO: 175137 - protein, 162 aa, Glycine max
  Coding DNA Sequence Number=SeqID_83452
MTNLWLSECYLAKPSVARAKHCSSGLSAIRCGMHKAKPALLAKPLFEIKMASRKRKSTTSRLVAQYTDNILDWNILSERNVKLYHTEFDEFKVELERRNLHKCLANLQNGSIDVALVKEFYARLYTIEEQAPKQAPNDNEITKPGISTKAAPLAASKALSPK

SEQ ID NO: 175138 - protein, 203 aa, Glycine max
  Coding DNA Sequence Number=SeqID_83453
  Gene Ontology: Biological process=transposition, DNA-mediated
  Homolog annotation: Hit_ID=Q1J7G7; Match level="QueryCoverage=25%, HitCoverage=71%, E-value=4e-11, Identity=71%"; Hit description =Transposase
VLQWLLFLSAVPPVQLLTGWCVTAKAPPDISAGKCSGHAARNHHTRRAYAPLQGASHSPFRLRNCWEGRSGFPSHDVVKRRPVNCNTTHYRANWSSTAVAAALELVDPPGCRNSIHYVQPAKGGARYQLLFPLVRVNFELGVIMVIAVSFGKPVVPAALMNRPTRGERRFAYWALAECILAYYVGTDEGVSEVLHVAEKKGCT

SEQ ID NO: 175139 - protein, 82 aa, Glycine max
  Coding DNA Sequence Number=SeqID_83454
  Gene Ontology: Mol. function=chlorophyll binding; Cellular component =photosystem; Biological process=photosynthetic electron transport
  Homolog annotation: Hit_ID=Q95DZ4; Match level="QueryCoverage=34%, HitCoverage=12%, E-value=1e-08, Identity=100%"; Hit description =Photosystem II CP47 protein
MVLELYSEMFFAGIDPDLDAQVEFGAFQKLGDPTTKKQGCPKAIYKAYPVKLTSKPDIEMAIRVAVSIIRILKFQDHNRSIG

SEQ ID NO: 175140 - protein, 125 aa, Glycine max
  Coding DNA Sequence Number=SeqID_83455
MYIMYGPKYIMKHSQQNTISKETKPPTTLIPKKIPKLQNSLRVRLYHGFSLKACSELQNKERETRLKRAIKGINSRKHQQESSQGYCASNQWGKTHQMIKMMDGSNSHKGKLITFKLSFQNYHDM

SEQ ID NO: 175141 - protein, 21 aa, Glycine max
  Coding DNA Sequence Number=SeqID_83456
MELASIVDWTTYTFFSFCRSQ

SEQ ID NO: 175142 - protein, 195 aa, Glycine max
  Coding DNA Sequence Number=SeqID_83457
MGWRRLPDLARHPAVALARRATAPGARHAAAARHAHVQPGVPVGDFQPQGAAVLWRVPAAVHRSGAQPVHAVRDHGRHLRGHRVPGGIRAGPPGAPRAALAGARRPALQQGVRGIVRGDGSGVAGVLNVARQCQRHNAKARLQGAGLFNSGGLGRNRTTDTRIFNPLLYQLSYQANEVRNYTQFFGLVPAASKKV

SEQ ID NO: 175143 - protein, 79 aa, Glycine max
  Coding DNA Sequence Number=SeqID_83458
MAEEFVNDFVHQNGITVIIHNPPKGDGEKKTKIWIILVVVVGLICLGIHIFLVWRFKRKPKESKGGRRSQWLWHGAEGG

SEQ ID NO: 175144 - protein, 169 aa, Glycine max
  Coding DNA Sequence Number=SeqID_83459
MNSVITVLYFNGRVYEDNDGVIFEGSKKAIQIKRGISFNALKKKIGDKENILPCKFVMTKTLKRCWKVLNNKTKYDDDDDYFVSNSYVEESLDEDDNVDSISDTDDEVTNIPQPVHNELKIHFRMMLCIITISTGVILMRRTFTVWRYRRPLILAKNYMLAWNLIVKMQ

SEQ ID NO: 175145 - protein, 99 aa, Glycine max
  Coding DNA Sequence Number=SeqID_83460
  Subcellular localization annotation: CTP_CleavageSite=67; ConfidenceScore=5.06e-01
MVSYGGELLLDSSSRKSGVSNHLSSFFIPLPLIFKKQRTPLMKMIQGLQAPYGASSPFLSTHLLLPSSSYPWPPIVELNSSLGIRARHSVMPFIIQSFV

SEQ ID NO: 175146 - protein, 243 aa, Glycine max
  Coding DNA Sequence Number=SeqID_83461
  Gene Ontology: Cellular component=integral to membrane
  Homolog annotation: Hit_ID=A4WE90; Match level="QueryCoverage=54%, HitCoverage=70%, E-value=5e-66, Identity=93%"; Hit description =Putative uncharacterized protein
  Pfam annotation: Domain name=DUF167; Domain location=154-230; Score =127.6; E_value=3.6e-35; Accession=PF02594.7; Description =Uncharacterized ACR, YggU family COG1872
  Pfam annotation: Domain name=YGGT; Domain location=1-66; Score=60.9; E_value=4.4e-15; Accession=PF02325.8; Description=YGGT family
  Pfam annotation: Domain name=YGGT; Domain location=76-162; Score =56.4; E_value=9.6e-14; Accession=PF02325.8; Description=YGGT family
  Pfam module annotation: Pfam domain module=DUF167::YGGT::YGGT; Domain location=154-230::1-66::76-162
MALLLRVWMQWARCDFYNPFSQFVVKITQPVVGPLRRIIPAMGPIDSASLLVAFILSVIKAIVLFMVITFQPIIWIAAVLILIKTIGLLIFWVLLVMAIMSWVSQGRSPVEYALIQLAEPLLRPIRNLLPSMGVHGRYAAAGAVDGAMSAVSTCADGLVLRLYIQPKASRDTIVGLHGDELKVAITAPPVDGQANAHLTKYLAKQFRVAKSQVLIEKGELGRHKQVKIIHPQQIPPAVAALAD

SEQ ID NO: 175147 - protein, 97 aa, Glycine max
  Coding DNA Sequence Number=SeqID_83462
MKSMMEFLVDICRSWPTTSARRQQGAVPVAEDDPVVAADELMVVADAGADVHPSGADVHPPGADTGAEAAADEPEGFPGGPTNPSVFIEYAEHVAAS

SEQ ID NO: 175148 - protein, 61 aa, Glycine max
  Coding DNA Sequence Number=SeqID_83463
MGVKYLEAVKRRLYATKQWSPNEIRIDYPFERGGNSCNFILSFANLFGNSLRVYVLFDLVT

SEQ ID NO: 175149 - protein, 171 aa, Glycine max
  Coding DNA Sequence Number=SeqID_83464
IIPRAPDNIKSINGSKETPKIAIRITDLWFVGTPNRSEQAKMVIIDSHGDAIHVVCKQDQLKSWKADLMENCTYVMHNFKVMKNDDIIGVVDEVVFHHVGSKSTRVVFKLKDLWASKLLINEAVFEIQEFRERFVGHGLGPVSGSSQLSSKDAFLSKAEAKTISKINNISE

SEQ ID NO: 175150 - protein, 201 aa, Glycine max
  Coding DNA Sequence Number=SeqID_83465
MAPTKLASKRSRKDKAAEGTSSTPEYDSHRYRSAEHQQRFEAIKGWSFLRERRVQLRDDEYTDFQEEVVRWRWASLVTPMAKFNPDIVLEFYANAWPTEEGVRDLRSWVRGQWIPFDADALSQFLGYPLVLEEGQECEYGQRRNRSDGFDEEAIAQLLCIPGQDFARTAAGRRGADHAHQHDQPDSDLDDFAAQQHPAQRS

SEQ ID NO: 175151 - protein, 176 aa, Glycine max
  Coding DNA Sequence Number=SeqID_83466
  Gene Ontology: Mol. function=magnesium ion binding; Cellular component=integral to membrane; Biological process=transport
  Homolog annotation: Hit_ID=Q2NUU2; Match level="QueryCoverage=99%, HitCoverage=59%, E-value=3e-73, Identity=80%"; Hit description =Putative transport protein
  Pfam annotation: Domain name=CBS; Domain location=19-156; Score=3.4; E_value=0.02; Accession=PF00571.19; Description=CBS domain
  Pfam annotation: Domain name=CorC_HlyC; Domain location=88-166; Score= 107.4; E_value=4.5e-29; Accession=PF03471.8; Description=Transporter associated domain
  Pfam module annotation: Pfam domain module=CBS::CorC_HlyC; Domain location=19-156::88-166
MAKDLLPFMSSSAEPFSMEKVLRPVVVVPESKRVDRMLKEFRSQRYHMAIVIDEFGGVSGLVTIEDILELIVGEIEDEYDDEEDRDIRQLNRHTYTVRALTPIEDFNEVFGSDFSDDEVDTIGGLVMQGFGHLPARGESIDIEGYQFKVAMADSRRIIQVHVKIPEDSPQPQLEDE

SEQ ID NO: 175152 - protein, 172 aa, Glycine max
  Coding DNA Sequence Number=SeqID_83467
  Gene Ontology: Mol. function=protein serine/threonine kinase activity; Cellular component=integral to membrane; Biological process=recognition or rejection of self pollen
  Homolog annotation: Hit_ID=A7P186; Match level="QueryCoverage=100%, HitCoverage=21%, E-value=4e-47, Identity=52%"; Hit description =Chromosome chr19 scaffold_4, whole genome shotgun sequence
MARAFGGDQIEGNTNRVVGTYGYMAPEYAVDGLFSIKSDVFSFGILLLEIICGNKNRALCHRNQTLNLVGYAWTLWKEKNALQLIDSSIKDLCAIPEALRCIHVSLLCLQQYPEDRPTMTSVIQMLGSEMELIEPKEPGFFPRRISDEEKFSSNLNHKTSNDELTITSLTGR

SEQ ID NO: 175153 - protein, 92 aa, Glycine max
  Coding DNA Sequence Number=SeqID_83468
  Homolog annotation: Hit_ID=A5AJD6; Match level="QueryCoverage=50%, HitCoverage=7%, E-value=3e-07, Identity=54%"; Hit description =Putative uncharacterized protein
MGWRIFRLDVKLAILNGYLEKDVYVEQPMSFFVIGKKRRSLSLSKIIGRPVRVTMFCENAPTIWDQHRLKGALKPSDPQGLHSEESVRTSPS

SEQ ID NO: 175154 - protein, 35 aa, Glycine max
  Coding DNA Sequence Number=SeqID_83469
MRRDWKSKLKLRSLNQYEVHGYAKRPPGLKFPVKV

SEQ ID NO: 175155 - protein, 41 aa, Glycine max
  Coding DNA Sequence Number=SeqID_83470
MFGRAWPFRTPIKPGVVTLWPQFGSNKARSMCDCILLGAQS

SEQ ID NO: 175156 - protein, 120 aa, Glycine max
  Coding DNA Sequence Number=SeqID_83471
  Subcellular localization annotation: CTP_CleavageSite=33; ConfidenceScore=5.02e-01
MKTILQRRHHHGHQRCRDGQNPNFSKRIKGWVSKVMVMVLISTMEGETKRRMTTTVKTRIMKTILLIISSTREKSTKRNTNSRGNCAERELSHLAQIVTLSAKNGLPLNEISSLNEICIL

SEQ ID NO: 175157 - protein, 97 aa, Glycine max
  Coding DNA Sequence Number=SeqID_83472
MSVKNLVGRLGVHDKTNHTLVRKPVRVTLFCENAPTIRDQHRLKRALKPSVFTPKAYTPKSPPGPLPPDSGPTQKHFSTQTLSMNCTKHTTPQLFSK

SEQ ID NO: 175158 - protein, 71 aa, Glycine max
  Coding DNA Sequence Number=SeqID_83473
  Homolog annotation: Hit_ID=A2Q169; Match level="QueryCoverage=98%, HitCoverage=16%, E-value=6e-07, Identity=35%"; Hit description=Zinc finger, CCHC-type
MKEFKTTIAQALKTNKGVEIRNLERNLLAFRFLSVNDKEAVIKGCPRNFDRRLIVLNDLMRNQNPNKVDLS

SEQ ID NO: 175159 - protein, 265 aa, Glycine max
  Coding DNA Sequence Number=SeqID_83474
  Homolog annotation: Hit_ID=A2Q6G3; Match level="QueryCoverage=46%, HitCoverage=8%, E-value=7e-35, Identity=60%"; Hit description=TIR; AAA ATPase
MATSDGGGCLLPGDSYPDWLTFNTEGSSVTFEIPQVKGRNLKKMMCHVHYSSPENITSDGLKNLLVINHTKAIIQLYKRNALVSFEDEEWQGVLSKIEPGNKVQIVVVFWSKLTVCKTTIYLIYEPMNEKIEHSHAPNKNVMDSSGDENECVVGTISLQVESIYKPTNDIMEHYHASSKNAIVSSSDENACVVRPFSPEVESIDDLRDCFGQWMICFTCRLVATINALNLIAKEWILGEGPLVLGSWFLRESNLSLILMPLILIL

SEQ ID NO: 175160 - protein, 154 aa, Glycine max
  Coding DNA Sequence Number=SeqID_83475
MGPDGCRETRGIGTREMARKPRKLVEMKGKVNLRLNSNRALISMAAQLIHDRVEMECLEGVWETLEGNKRCRFRGTIRLTATSLPIQVIEVSSSEEDPEELPPEPAVDALDFPEDDENPLPDVDSPEDVVSASEADSTEESGPVGTANSGDSSS

SEQ ID NO: 175161 - protein, 250 aa, Glycine max
  Coding DNA Sequence Number=SeqID_83476
MVKDLMPFFSLFKVLENPPGVFKAKHQRISKGAWTFSMQNRGWQVSSYLLSQDILVCIEQDHLRELKMLNIYAFQDWLLGNLLYLWHLLPNGGWGESYLSSQSKGDLYERDGIVLDKSKRDKSRVSNPLMKRALLTTTAEDKMQKYGRSKVGSRVVPYHEDQSEDSVLVSFVSKDLQRNGKESEDSEAAVKSTQSTVVAGRKDEIPSFPTDVAIKSHLHFGELVTVKVQRLGMSLSLTLDAMSFNMIGVN

SEQ ID NO: 175162 - protein, 41 aa, Glycine max
  Coding DNA Sequence Number=SeqID_83477
MSHVNEVIEVEIVSGLQDLRGGVEEVNLANMSLGDVDPPCT

SEQ ID NO: 175163 - protein, 98 aa, Glycine max
  Coding DNA Sequence Number=SeqID_83478
MATNFLTDIERKTIQRNRRDEWVWKEDQSRQYTARSAYNLMRGVEVEGIQDRAFEELWKLKRSQIGAVHFAEIWKRKHGTCFFTAARSSLFCGNHHHG

SEQ ID NO: 175164 - protein, 75 aa, Glycine max
  Coding DNA Sequence Number=SeqID_83479
MACTSRRNFGARPEMKQLRRNDGVKKLRDLEDPFHGIVTVEMQDLELEVGLVMGVGRGWDWWGFREGSRLQLKRV

SEQ ID NO: 175165 - protein, 93 aa, Glycine max
  Coding DNA Sequence Number=SeqID_83480
MGSPEDTSCKRWNDLHATFHLEDKVSLPTAGDDSIPRSRPKKTPTHRPPHLKDYADVLDNILCRKFHYQKRGSLASNTRILEGSNRRCQENMV

SEQ ID NO: 175166 - protein, 50 aa, Glycine max
  Coding DNA Sequence Number=SeqID_83481
MWDRHMLKGALKSGVFTPKAYTPKSPLGPLPLDSDTAHELYNTHDLTLVF

SEQ ID NO: 175167 - protein, 125 aa, Glycine max
  Coding DNA Sequence Number=SeqID_83482
  Subcellular localization annotation: CTP_CleavageSite=45; ConfidenceScore=5.32e-01
MPTSSPQATRLRFPVSLYKSFTSNEPQRTSLLCVQCLHQETIPPLTMNSKGPSSFVFSDYNQEARLTGASSKGGKCAESPPTFICGKRWKNRRKPVMKNISDSGVVFTFEEGISTSHVCPKGQQP

SEQ ID NO: 175168 - protein, 66 aa, Glycine max
  Coding DNA Sequence Number=SeqID_83483
  Homolog annotation: Hit_ID=A5ANP1; Match level="QueryCoverage=86%, HitCoverage=16%, E-value=8e-08, Identity=40%"; Hit description =Putative uncharacterized protein
MASTNFLFPERNSINRPPIFNGEGYHYWKTHTQIFIEAIDLNIWEAIEIGPYVPIIVDGSTTIEKP

SEQ ID NO: 175169 - protein, 158 aa, Glycine max
  Coding DNA Sequence Number=SeqID_83484
EVETSFQFSYVTSTLSRTTIPKYVLNFFLWGLSALPVAGSTWTNGLSAPGGLVDKDHRREALHVCFTADGEVDASEGGGGGEAGGEAMILYTSSKCLCKFESMNKLQNQLEKVESLTQDLEEGLEFLFRHLIKTKGIVRSYGCPINSSADLVATTEGE

SEQ ID NO: 175170 - protein, 75 aa, Glycine max
  Coding DNA Sequence Number=SeqID_83485
QSEEKLEESQGIARDAAIAVGRHVSPLRVKPVMNGCRRGQTFCRDASAAPPCRESSPPAKAPEPPPMTSPSTAMA

SEQ ID NO: 175171 - protein, 239 aa, Glycine max
  Coding DNA Sequence Number=SeqID_83486
  Gene Ontology: Mol. function=protein serine/threonine kinase activity; Cellular component=integral to membrane; Biological process=recognition or rejection of self pollen
  Homolog annotation: Hit_ID=A7P183; Match level="QueryCoverage=99%, HitCoverage=30%, E-value=7e-57, Identity=44%"; Hit description =Chromosome chr19 scaffold_4, whole genome shotgun sequence
  Pfam annotation: Domain name=B_lectin; Domain location=52-164; Score =122.2; E_value=1.6e-33; Accession=PF01453.15; Description=D-mannose binding lectin
  Pfam annotation: Domain name=S_locus_glycop; Domain location=178-239; Score=-36.8; E_value=0.019; Accession=PF00954.11; Description=S-locus glycoprotein family
  Pfam module annotation: Pfam domain module=B_lectin::S_locus_glycop; Domain location=52-164::178-239
FIAAETSSITLSQSLSYGKTLVSPSGIFELGFCNLGNPNKIYLGIWYKNIPLQNIVWVANGGNPIKDSFSILKLDSSGNLVLTHNNTVVWSTSSPEKAQNPVAELLDSGNLVIRDENEDKEDTYLWQSFDYPSNTMLSGMKVGWDIKRNLSTCLIAWKSDNDPTQGDLSWGITLHPYPDIYMMKGTKKYHRFGPWNGLRFSGMPLMKPNNPIYHYEFVSNQEVVYYRWSVKQTSSISKV

SEQ ID NO: 175172 - protein, 171 aa, Glycine max
  Coding DNA Sequence Number=SeqID_83487
MTLLLSNVLPSDHNSDLPLLSASWCMPSDTDELPRGPGMPPIRHPLDPNNSNRALGFPALIMGLCQSFGVPVTPSKVIRPPITQPFIEKYCTPRQAQGDAHQAADAPPPPRQADPAGSLGMERYLQHLVRQKAANHHGQVQIHECLYRFSLSQQGQGSTPFACPTLEQFGA

SEQ ID NO: 175173 - protein, 130 aa, Glycine max
  Coding DNA Sequence Number=SeqID_83488
RKEKGKERVEINQDEREQIREEERRKILKELRKGKRASYSSHDPSKSLSEKHRDYYEGRHRSHLRPHSHRIEKERKPQEANINLSYFHGKDNVEAYLDWEIRVEQQLKRKPTSNLMALTLIQRKTKVKAS

SEQ ID NO: 175174 - protein, 220 aa, Glycine max
  Coding DNA Sequence Number=SeqID_83489
MTEDIFVFKMCADYRIRRLHMLPDFSQVGVTYLCVCADNPWVSPHATWLFTGPGSRTVCVWITVGYICLPPDSWVRINRCCVCTDNHLGYFHLPPDAWVKINKCCVCMDNHLGYFCLPHDAWVRVNRYCLCTDNHLGISACHLTHGSGSADVVFVRIITWSLNRKKLTSPERAHTTKLVCACQSDLGSPNYEVQITVRRLRMLPNLSQHALLWACEARLT

SEQ ID NO: 175175 - protein, 163 aa, Glycine max
  Coding DNA Sequence Number=SeqID_83490
KLEEAAQFGTADGVIDPPSPIRRHVKWKMVCIKKTGQMTSEAAKEIAEKIASQGSFVPHGRQDVLTAAIGRAEHPSHVCGVGARVTIKQYFGSAPQTQMQSQMQSQGLALPPELMVGPSSPHVITKESYVDPSGNDPETVHKIPLLPGQVKVGVEEVKDAQAP

SEQ ID NO: 175176 - protein, 134 aa, Glycine max
  Coding DNA Sequence Number=SeqID_83491
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=Q8GEG0; Match level="QueryCoverage=43%, HitCoverage=46%, E-value=9e-25, Identity=94%"; Hit description =Putative uncharacterized protein
MSKTNVRRHALEKCRSVKETQKVLNHNFFTRNLKKVESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 175177 - protein, 79 aa, Glycine max
  Coding DNA Sequence Number=SeqID_83492
MTSLTCFHQISSQITIIKHKPSKTTHHISQPHTHENHVRKKSTQPEISKSHTNGDQRLELCWATMVGEKRRRKLRERGE

SEQ ID NO: 175178 - protein, 136 aa, Glycine max
  Coding DNA Sequence Number=SeqID_83493
LKRVVRQFGYIQTIPPPPVTGSLSYEDIDDRWMHLRDHLAPASEICVAHNQEGDEPRHPPAPNVDAYVEPHIPEVPVAADFPRHSVVACEGCEAITERLERVLNLRMVTVGTELYEIMEDCLRIARGDASDGSLRA

SEQ ID NO: 175179 - protein, 187 aa, Glycine max
  Coding DNA Sequence Number=SeqID_83494
  Subcellular localization annotation: CTP_CleavageSite=31; ConfidenceScore=5.10e-01
MAEPSKKRKGSSSWSQWHSETQETLIPSSISSSSLFSSKEQRIQYTNLFSSRSIIDPKFIDMDFFSNESFACIQAFENSNLIPFMSLKLPVYSDLVKAFYSNLEIQEGTLISEVYGIKMVIDQFLFYDLTQLSSEGVPFEGTLIDDWKYEFSVHDARRLVCTNQADMTRRLLAGSLAFESRILHYLI

SEQ ID NO: 175180 - protein, 144 aa, Glycine max
  Coding DNA Sequence Number=SeqID_83495
MASVHSAGFHVLKLCNSSLASGNRLPMLCNRLPEEKTLEIAMAAQLIHDRVEMECLEGVWETLEGNVRCRFWGTIRFTATSLVRPEEPARMLQRTVEWILPTPTPYRLVEPVQVIEVSSSEEDPEEDPEELPPEPVVYAIDFPE

SEQ ID NO: 175181 - protein, 38 aa, Glycine max
  Coding DNA Sequence Number=SeqID_83496
MWTTTGEKLAAQLAQASKVASSRSNNLLEKSSRGPKWA

SEQ ID NO: 175182 - protein, 138 aa, Glycine max
  Coding DNA Sequence Number=SeqID_83497
MKALPSDANKKRKEVVLEPGDDPEHLRTNVSKKEGMMRIMKLAKYRLKAQVEKDGGLSGEGQSPQVEKDEGSSNPCGVYPDLSSFTGSGVYPDLSSLTGSGVYPDLSSFTGSGVYHDLSSFTGSGVIQTFVACIKRSA

SEQ ID NO: 175183 - protein, 226 aa, Glycine max; identical to SEQ ID NO: 170500
  Coding DNA Sequence Number=SeqID_83498
  Pfam annotation: Domain name=G-patch; Domain location=1-42; Score =22.5; E_value=0.00036; Accession=PF01585.14; Description=G-patch domain

SEQ ID NO: 175184 - protein, 370 aa, Glycine max
  Coding DNA Sequence Number=SeqID_83499
  Gene Ontology: Mol. function=succinylglutamate-semialdehyde dehydrogenase activity; Cellular component=cytoplasm; Biological process=arginine catabolic process to glutamate
  Homolog annotation: Hit_ID=A8GFQ3; Match level="QueryCoverage=41%, HitCoverage=31%, E-value=2e-77, Identity=94%"; Hit description=N -succinylglutamate 5-semialdehyde dehydrogenase
  Pfam annotation: Domain name=Aldedh; Domain location=2-284; Score= -191.5; E_value=3.2e-06; Accession=PF00171.13; Description=Aldehyde dehydrogenase family
MIGKVGISLQAYQTRTGFSQTAMADGASVLRHRPHGVLAVFGPYNFPGHLPNGHIVPALLAGNCVVFKPSELTPLTAEETLKLWLQAGLPDGVINLVQGGRETGEALAASADIDGLLFTGSAGTGYHLHRQLAGQPEKILALEMGGNNALIVDGGGRRRLYRTFGPGGGRTARRPLGCRTAAVHGRGGVGSRGGKHAERAAALAGAGRQIAAEHAPAGTGQFAAQPGHRRSDRRGRRTGRRVFRPLDHHRALPRFRRSATARQPDALRPVGGAGIAAARAVRALAAGSARRHRQLEQAADRGVQRGAIRWRGGLRQPSPKRLLCGGLLRLADGFAGKRKPVAAGDALAGLVVPLIVCGGAMAPPQAIPRG

SEQ ID NO: 175185 - protein, 369 aa, Glycine max
  Coding DNA Sequence Number=SeqID_83500
  Gene Ontology: Mol. function=motor activity; Cellular component=cell projection
  Homolog annotation: Hit_ID=UPI00016621D1; Match level="QueryCoverage =94%, HitCoverage=41%, E-value=2e-20, Identity=34%"; Hit description =UPI00016621D1 related cluster
RGLHVLAFGGLHALAFRGLHVLAIRGLHVLAFRGLHVLTFRGLHTLICRGLCVRPLRGLHALAFRGLHTLIFRGLYVLPLRGQHVIAFIGLHALAFRGLHVLAFRGLHILTFRGLHTLIFRGLHVLTFRGGLHVLIVRGLHAFTFVGLHALTFRGLHVLAIRGSCTFTFKGLPVLTSRGLHVLASRGLHVLAFRGLHVLAIRGLHVLAFRGLHVLTFRGLHSLTFVGLHALTFRGLHVLAFRGSCTFTFRGLHVLASKGLHVLAFRGLHVLAIRGLHVLTFRGLRVLTFRGLRVLTFRGLRVLTFRGLRVLTFRGLHVLTFRGLHVLTFRGLHTLIFRGLYVFPLKGLLVLAFRGLHTPSPLEGYASSL

SEQ ID NO: 175186 - protein, 142 aa, Glycine max
  Coding DNA Sequence Number=SeqID_83501
  Subcellular localization annotation: CTP_CleavageSite=42; ConfidenceScore=5.67e-01
MAEQAKQVFYVTKATPPASPPPPSPPLAVVSVSLPTQKWTCKATRLQSLATRPPGAKRPVVNIDPTTGKADGPHKKKLRTYLGIVTRDKVDVIYETWKEVPTTQKDLIWEDTRAEFEIPEASDSRTKKKILQMSARGGGSLN

SEQ ID NO: 175187 - protein, 164 aa, Glycine max
  Coding DNA Sequence Number=SeqID_83502
MAPTRHPLDPDKSNRALGFPALITGLCQSFGVPVAPTKVIRPPITRAFIEKYCTQRQAQGNAPQAAGAPPPPHQAGPAGSFDMEQYLRHLVRQQAANHRAHSQGFASFSCPTPDQFRAEVAWPGDWPEAQAGEAPPEAPGDGEEAHEDEEMADLLDFLGGSGAT

SEQ ID NO: 175188 - protein, 124 aa, Glycine max
  Coding DNA Sequence Number=SeqID_83503
MEAMKEQMATMMEAMMSVKKIMEANAVAIAATSIVAKVNPTSPSGINQMNHPTSNMVGKDLGSMGGPHYAQSQNKHAFPPCGLPPNYTPSNVAYTSSENVNNSTPILIESRQPQTDHAHVSQPM

SEQ ID NO: 175189 - protein, 58 aa, Glycine max
  Coding DNA Sequence Number=SeqID_83504
MVRKLAKQLAEKSSSTFGANTEQNPKEECKVVMTRGRKVTMEEEKKKEKMVEDDKQQL

SEQ ID NO: 175190 - protein, 124 aa, Glycine max
  Coding DNA Sequence Number=SeqID_83505
MGKRKLELGFEDQKIDFDFFVEDKPALEHNVCLQVMGEGQEVLKIIGNLLYNLNIGVYQPPFECPFTKRLLLAKHIIVHALSHEFQALSAQPWHLRLIISAKLAKVKLCPNQFNLDSTKLQPER

SEQ ID NO: 175191 - protein, 612 aa, Glycine max
  Coding DNA Sequence Number=SeqID_83506
  Gene Ontology: Mol. function=CTP synthase activity; Cellular component=cellular_component; Biological process=pyrimidine nucleotide biosynthetic process
  Homolog annotation: Hit_ID=UPI0000162F30; Match level="QueryCoverage =99%, HitCoverage=99%, E-value=0.0, Identity=61%"; Hit description =CTP synthase, putative / UTP--ammonia ligase, putative
  Pfam annotation: Domain name=CTP_synth_N; Domain location=1-283; Score=450.9; E_value=1.7e-132; Accession=PF06418.5; Description=CTP synthase N-terminus
  Pfam annotation: Domain name=GATase; Domain location=319-554; Score =259.9; E_value=5.3e-75; Accession=PF00117.19; Description=Glutamine amidotransferase class-I
  Pfam annotation: Domain name=Peptidase_C26; Domain location=336-536; Score=-106.3; E_value=0.026; Accession=PF07722.4; Description =Peptidase C26
  Pfam module annotation: Pfam domain module=CTP_synth_N::GATase::Peptid ase_C26; Domain location=1-283::319-554::336-536
MKYVLVTGGVVSGLGKGVTASSIGLLLKACGLRVTAIKIDPYLNTDAGTMSPFEHGEVFVLDDGGESVIDKERRGDYLGKTVQVVPHITDAIQDWIERVAHIPVDGKTSPADVCVIELGGTIGDIESMPFIQALGQFSYRVGAGNFCLVHVSLVPVLNVVGEQKTKPTQHSVRALRGQGLTPHILACRSTMGIQILEYTQGTSIYYDAQKEQKCIPAFTLILTVNIFKFLTFSFFQAENIVTLYDVPNIWHIPLLLRDQKAHEAMFKVLNLHGVTKEPNLEEWTCRAESSDLLHEPVGSYSLSGEIYVPFRFLPLRSKGGVNFNFMAALLHASVDCQKKLVVDWIPASNLESATAKENPDAFKAAWKLLKGADGVLVPGGFGDRGVQGKIIAAKYARENRIPFLGICLGMQIAVIEFARSVLGVQDANSTEFEPHTKSPYIIFMPEGSKTHMGGTMRLGSRRTYFQTKECKSAKLYGCKSFIDERHRHRYEVNPDLVARLENAGLSFTGKDETGQRMEIVELPNHPYFIGAQFHPEFKSRPGKPSPLFLGFIGAACGQLDAVLQRSSIVDNGLSKGVINDISAVKTYRTRTATRTTYRSAEYVYGSCNGLHF

SEQ ID NO: 175192 - protein, 119 aa, Glycine max
  Coding DNA Sequence Number=SeqID_83507
MIHCFSCCLYRKCNDLAEFTSLAERDYQCLLNVSKELTERTCHVEQRAFAKRDTQWLSARKNPEEDEQSGSLSAPLEVIKRTTSTHPLSERGALSQNPLMRTRRFRFVLSARAQTNPPI

SEQ ID NO: 175193 - protein, 152 aa, Glycine max
  Coding DNA Sequence Number=SeqID_83508
  Gene Ontology: Mol. function=RNA-directed DNA polymerase activity
  Homolog annotation: Hit_ID=Q2HSQ4; Match level="QueryCoverage=38%, HitCoverage=64%, E-value=1e-15, Identity=68%"; Hit description=RNA -directed DNA polymerase ; Zinc finger, CCHC-type; Peptidase aspartic, catalytic, putative
MARFFHGLNREIQDIVELHRYASLEDLIHQAIKVDQQLKRKQIYKNSSYGSSTWKDKETFKKKGGSSFKSHDKDLPQKSHFSISDCDLEEVITFSKPKLDLSWGCRWNFKSMVRVCELFMNFPNSFVRQTTSSLSFSTMEGSSILLAWLKLF

SEQ ID NO: 175194 - protein, 105 aa, Glycine max
  Coding DNA Sequence Number=SeqID_83509
  Subcellular localization annotation: CTP_CleavageSite=39; ConfidenceScore=5.13e-01
MKNLVGRLGVYDKTNHTLASQVTLTRLKGALKPGVFTPKAYTPKSPSRPLPPGSGPTQKTFLHTDSIYELYKTHNSSIVFKIVLTRRPLRVLALTRRPKKGLIVV

SEQ ID NO: 175195 - protein, 104 aa, Glycine max
  Coding DNA Sequence Number=SeqID_83510
MVSTLTYLPSLKWRHPNSMTCIKRSAPSKDHINLQEDKGLTVDVLKVEHYEKNVKAGCFDCDGDLCRVKELFKHECAKFNKTISLGFQDPKKGKIVRGDNEQAI

SEQ ID NO: 175196 - protein, 67 aa, Glycine max
  Coding DNA Sequence Number=SeqID_83511
MAKSSFSFNSRNGNIPIGDYEPDSILGGLVFLVGIVCSLGDELMLVICHLDLFLYTLLSAQPLEAKP

SEQ ID NO: 175197 - protein, 54 aa, Glycine max
  Coding DNA Sequence Number=SeqID_83512
MTSPIAREVYGVVGFGLRLGGSMVVYAASGGGIVLLILSLLTSIKKKGIDSKFT

SEQ ID NO: 175198 - protein, 141 aa, Glycine max
  Coding DNA Sequence Number=SeqID_83513
MMLVGVAVDSLLLAGYITLLQCWIYEHFSSVTKCMVDPDYDETIAGCTTQTILHQQVRYVLCQVPEPPTTLTHARSDVDQTRHAVDACHAIAERLERLLNLRIVTVGTETHEVMEQCIKIARGVIEDHIVYVRSRRRRRTD

SEQ ID NO: 175199 - protein, 56 aa, Glycine max
  Coding DNA Sequence Number=SeqID_83514
MARTRGLGRVIGRVIGRDRQDDHDATDVPERRRPTASAHRQRVHQMTQDVPDMTED

SEQ ID NO: 175200 - protein, 335 aa, Glycine max
  Coding DNA Sequence Number=SeqID_83515
  Gene Ontology: Cellular component=outer membrane
  Homolog annotation: Hit_ID=A7Q3L8; Match level="QueryCoverage=91%, HitCoverage=70%, E-value=1e-106, Identity=59%"; Hit description =Chromosome chr13 scaffold_48, whole genome shotgun sequence
  Pfam annotation: Domain name=Bac_surface_Ag; Domain location=25-334; Score=-15.3; E_value=0.00021; Accession=PF01103.14; Description =Surface antigen
MELYLIFVLTFFMLGTAEGALKYKNLLGYGDLCDASLAYGANQATEVSVGVYAPRVKGFLTPIVTRISMLSQDWQESSSYKERLLGASLGLISTKHHDLAYTLGWRTLTDLSQMSSRRNSTIRPTKGYVFLSTTHVGGLTLDPRSLRFLRQEFDVRFSVPFGFYNTALNLGISAGAVFPWGNGFKTKPSPLPERFYLGGDFSPVCTLGGPTTLWGFKTRGLGPTEPRRQNRDGSNDDNVDSSGWDFIGGDFAVTAFADLSFDLPIMWLREHGIHGHVFAGSGNAAKLTQNEYTHFSPRKFLESFRMSVGCGVVIPTRLFRLEKLRLTKSWEIEWS

SEQ ID NO: 175201 - protein, 102 aa, Glycine max
  Coding DNA Sequence Number=SeqID_83516
MEAGGHWRKALEEAKTLFGGGTCYQVSSNNRTRKALFDSEIQMADNFLGELSQQQIQPNREDRWSWKHDQSGYYSTKSGYDLIWEAQMGANQNLDFVDIWKL

SEQ ID NO: 175202 - protein, 225 aa, Glycine max
  Coding DNA Sequence Number=SeqID_83517
EEDEEVQALKLELGKARLAKEKFKSAATHIQKECTELQEENAATVRALEQETKRARKEEYGREKFRGALWGSNNELKLRREERDRSKRSLAQHLEATEQSMLAIIGQYKEELNQSVAHEQRLVEDFAQVYAEKEARGRLIDALHQEATMWMDRNFIITKKTPSVATYPSAGGRRVTRGMRVPRKEYARSRHQRLFEENVEKTGKDAIYELLSERLGSCIYARGRY

SEQ ID NO: 175203 - protein, 162 aa, Glycine max
  Coding DNA Sequence Number=SeqID_83518
  Subcellular localization annotation: CTP_CleavageSite=40; ConfidenceScore=5.22e-01
TAVPISPCGSISWSVPSRHKGSAHKTPSGPEGSQQGPGVSSSGYGPLDRARKTPNEPEEGQQGIGVASSNYESLSVLGSACRPQQGHQAPYQSSFHQEVLRPQAGAGRNTTAALGWPVAGNRHTATTSRVHLSSSTKRLERCLRHMADQQATNSKAKDKQKY

SEQ ID NO: 175204 - protein, 101 aa, Glycine max
  Coding DNA Sequence Number=SeqID_83519
MGSNQTPFSKKRFYHVKIKSLEVASLQELGKRMGQLQRQAFRKTYGKIWYLAMIEVFVEAIASLTQYYDQPLRSLGMPARRKEVVYGFWVVPFYGKSSEGG

SEQ ID NO: 175205 - protein, 82 aa, Glycine max
  Coding DNA Sequence Number=SeqID_83520
MDKFDPLNYTSWLIQLPLVCLLKRPALLSVDFQDRSIRDYSSCTLVGCRKQQVVKTKMDTSEPYTGAMRGIVNEPRVNLGAD

SEQ ID NO: 175206 - protein, 153 aa, Glycine max
  Coding DNA Sequence Number=SeqID_83521
ACSELQNKERETRLKRAIKGINSREESRISSHKMSRKTVVGFTCQAFKHLVNEWQGKMVLFGNLVQPPIVNADSPPVLHPSRNQLLLLISDHCEASLFRDYLDGTHPLAVGDRINDSSLQKLGYLLLHYIKNHRVESSLWLLSQPTLRREGDA

SEQ ID NO: 175207 - protein, 139 aa, Glycine max
  Coding DNA Sequence Number=SeqID_83522
MTLLLSNIQPSDHNSDLPLPKCMPPTRHPLDPDKSNRALGFLALITGLCQSFGVLVAPSKVIRPPITRAFIEKYCIARQAQGGDPQAPDAPPPPQADPAGSFDTERYLRHLVRQQAANHQAHVQTHDSLYQLSLSLQSQ

SEQ ID NO: 175208 - protein, 93 aa, Glycine max
  Coding DNA Sequence Number=SeqID_83523
MLREGGREVDTRTEMKRVMRKSMWSWMTCYIRRYELNSKLKEKVQQGGTHPILTTKTGPTDPRRREVIRPAQQQHPHMESQQRPVLVEAKPET

SEQ ID NO: 175209 - protein, 122 aa, Glycine max
  Coding DNA Sequence Number=SeqID_83524
MASRKRKTPSTATPTRFDRSRFTSQEAWERFTNIVVPRKLLPKRNEVVYYTEFDEFKEELERCHWDEELTDFMDDNIDVAIIKEFYANLYDPEDKSPKQVRVRVSEEEHGYSSSDMECSFLL

SEQ ID NO: 175210 - protein, 422 aa, Glycine max
  Coding DNA Sequence Number=SeqID_83525
  Gene Ontology: Mol. function=binding; Cellular component=integral to membrane; Biological process=proteolysis
  Homolog annotation: Hit_ID=A3UZG5; Match level="QueryCoverage=69%, HitCoverage=91%, E-value=6e-70, Identity=47%"; Hit description =Putative uncharacterized protein
  Pfam annotation: Domain name=Sel1; Domain location=107-146; Score =7.5; E_value=2; Accession=PF08238.3; Description=Sel1 repeat
  Pfam annotation: Domain name=Sel1; Domain location=147-182; Score =42.0; E_value=2.1e-09; Accession=PF08238.3; Description=Sel1 repeat
  Pfam annotation: Domain name=Sel1; Domain location=183-218; Score =26.5; E_value=0.0001; Accession=PF08238.3; Description=Sel1 repeat
  Pfam annotation: Domain name=Sel1; Domain location=219-254; Score =45.4; E_value=2.1e-10; Accession=PF08238.3; Description=Sel1 repeat
  Pfam annotation: Domain name=Sel1; Domain location=255-290; Score =53.4; E_value=7.7e-13; Accession=PF08238.3; Description=Sel1 repeat
  Pfam annotation: Domain name=Sel1; Domain location=291-326; Score =39.7; E_value=1.1e-08; Accession=PF08238.3; Description=Sel1 repeat
  Pfam annotation: Domain name=Sel1; Domain location=327-362; Score =48.5; E_value=2.3e-11; Accession=PF08238.3; Description=Sel1 repeat
  Pfam annotation: Domain name=Sel1; Domain location=363-398; Score =44.3; E_value=4.2e-10; Accession=PF08238.3; Description=Sel1 repeat
  Pfam annotation: Domain name=Sel1; Domain location=399-421; Score =2.7; E_value=8.3; Accession=PF08238.3; Description=Sel1 repeat
  Pfam module annotation: Pfam domain module=Sel1::Sel1::Sel1::Sel1::Sel 1::Sel1::Sel1::Sel1::Sel1; Domain location=107-146::147-182::183 -218::219-254::255-290::291-326::327-362::363-398::399-421
  Subcellular localization annotation: CTP_CleavageSite=40; ConfidenceScore=5.11e-01
MDRGAARDVPGHGPIAPGLSSTLRMRRKAWNPFRVCGDPRDSGARRGFDFLGSFPPRRGQPTHPAAPAGPPGAMARGAPGAGLMLRAAGGRRARRPGPDVRECARRREGRCASGGMVAPRRRAGGSRRADYALAAQWCEKAAVQGNAEAQTMLGRMYAQGQGVARQEDLAVQWWRRAADQGYAEARYQLGDHFFDAPAPRRDDAQARRWFALAAAQGHAEAQNNLGVMYADGLGGPREVGKAVEWFRKAAEQGLPKAQNNLGAMYFTGSGVPADDKLAVQWWRRAADQGNAAAQDRLGGAYLSGRGVPQDDLHASQWLRKAAEQNHAPAQDTLGTLYEQGRGVPKDESQAVRWYRRAAEQGLDTAQYNLARQYDFGRGVPRDLASARAWYGKAADQGYPRAQFNLAVMYANGDGVAQDDAQA

SEQ ID NO: 175211 - protein, 107 aa, Glycine max
  Coding DNA Sequence Number=SeqID_83526
  Subcellular localization annotation: CTP_CleavageSite=41; ConfidenceScore=5.23e-01
MILHEIRRPNSLKTFPSGVTNCRNLPFGGRATRGSWVRLPRKENARSRHKILFEENVGKTKRCGLRTLCVKGSGVVFTHREGINEALGLNPELGLDLKRTDYFILQN

SEQ ID NO: 175212 - protein, 94 aa, Glycine max
  Coding DNA Sequence Number=SeqID_83527
  Subcellular localization annotation: CTP_CleavageSite=55; ConfidenceScore=5.28e-01
MYPPTAPKPTPFAYQSNKVVPWKYTPPAFGERVATEVDSLSTKVTNITDLSGVTRSGRVFAPPHSAELPSKAKAPMIQEPTDVATPSKEVDPQV

SEQ ID NO: 175213 - protein, 150 aa, Glycine max
  Coding DNA Sequence Number=SeqID_83528
  Gene Ontology: Mol. function=sequence-specific DNA binding; Cellular component=intracellular; Biological process=regulation of transcription, DNA-dependent
  Homolog annotation: Hit_ID=Q93EQ3; Match level="QueryCoverage=100%, HitCoverage=93%, E-value=1e-63, Identity=80%"; Hit description =Putative AsnC-family/Lrp-family transcriptional regulator
  Pfam annotation: Domain name=AsnC_trans_reg; Domain location=65-141; Score=90.6; E_value=4.9e-24; Accession=PF01037.12; Description=AsnC family
  Pfam annotation: Domain name=HTH_11; Domain location=4-51; Score =10.7; E_value=0.016; Accession=PF08279.3; Description=HTH domain
  Pfam annotation: Domain name=Rrf2; Domain location=8-86; Score=-38.0; E_value=0.088; Accession=PF02082.11; Description=Transcriptional regulator
  Pfam module annotation: Pfam domain module=AsnC_trans_reg::HTH _11::Rrf2; Domain location=65-141::4-51::8-86
MDSIDRKILAELQSDGRLSLTELAERVNLSLSPCHRRVRALEQSGAITGYRASLDPAKMGFNFLAIVFATLKEGDRKAVSAFEEAVEEIPQIVLAQRLFGDPDYLMHVVTRDLSAFQKLYDEKLSAMPGVQHLRSTLVMKTVVQDRPFPL

SEQ ID NO: 175214 - protein, 86 aa, Glycine max
  Coding DNA Sequence Number=SeqID_83529
GASTGVDGFLAWLNYAASEQIVLRVHHMRAIGAGLFAITPAGERGMCCKAIKLGNARVFPVTTLGTEGVKSEPDSTLGFLVRDGLT

SEQ ID NO: 175215 - protein, 116 aa, Glycine max
  Coding DNA Sequence Number=SeqID_83530
MDSRTISRFHIDKKVKAKCNSLIGQKNAWDYVIDAWGSLVDCRSEHQFDDYLKKFEIACSPWPMAEYAHWALKRLLQNSLGDLCSVWDAMNNMITLQHTEINASFETSTHVVGHVF

SEQ ID NO: 175216 - protein, 130 aa, Glycine max
  Coding DNA Sequence Number=SeqID_83531
MVLGASNPLVLVKVQHLELERGDDIGIGTTLLGVVVGDTENPPKGFIGVYYQLLALQWHIRAKARSRLDCDGEFHVSPPRSGVIDILIGSVRHIGWRIVERQAIWQEGMLVLNLHIMEAAHTTQIFAYHI

SEQ ID NO: 175217 - protein, 113 aa, Glycine max
  Coding DNA Sequence Number=SeqID_83532
MASKKRKAPSTPTQARFDRCRFTSQEAWERYTDIVVRVRGHLVKFDEDTLNTFLKTPVVLEEGENLCTYSKFALLRPDPQELAAKLCIPGRGFELNADGLALKILRKNMTTLA

SEQ ID NO: 175218 - protein, 105 aa, Glycine max
  Coding DNA Sequence Number=SeqID_83533
  Homolog annotation: Hit_ID=A6FJQ2; Match level="QueryCoverage=36%, HitCoverage=84%, E-value=2e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLDLRVGQVETWMPGWLVRQPSDSLPE

SEQ ID NO: 175219 - protein, 311 aa, Glycine max
  Coding DNA Sequence Number=SeqID_83534
  Gene Ontology: Mol. function=transcription factor activity; Cellular component=cytoplasm; Biological process=regulation of transcription, DNA-dependent
  Homolog annotation: Hit_ID=A7MNY3; Match level="QueryCoverage=97%, HitCoverage=99%, E-value=1e-120, Identity=73%"; Hit description =Putative uncharacterized protein
  Pfam annotation: Domain name=HTH_1; Domain location=14-73; Score =57.4; E_value=5e-14; Accession=PF00126.18; Description=Bacterial regulatory helix-turn-helix protein, lysR family
  Pfam annotation: Domain name=LysR_substrate; Domain location=98-304; Score=78.0; E_value=3e-20; Accession=PF03466.11; Description=LysR substrate binding domain
  Pfam module annotation: Pfam domain module=HTH_1::LysR_substrate; Domain location=14-73::98-304
MMNIMHPALRRLDLNLLLVFDAIYRHSSVRLAADELAMSTSALSHALSRLRVALNDPLFFREGHRMCPSVYATQLAPSIASVLKLLNQELTRQPEFSAADSTERIQIAITDFTALCIFPALMQKLQHEAPGLRFELRYLPHSPALTELLAGEVDLALGFSTAEDIRHHELEEIDWFEDEYVVISHTRRTALTLADYLAARHLVVTPWNEKQGVLDLRLQELGYTRQIALKTPSMLSAPFIVAQSDLLMAIPRYAAEKFLHAAPIAIFPLPFAISPFTVKIYSHKRGGQRGATKWLKTALQSLALAENAGSF

SEQ ID NO: 175220 - protein, 131 aa, Glycine max
  Coding DNA Sequence Number=SeqID_83535
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=39%, HitCoverage=50%, E-value=4e-24, Identity=100%"; Hit description=LacZ protein
MARTFHSDVRFIPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 175221 - protein, 358 aa, Glycine max
  Coding DNA Sequence Number=SeqID_83536
  Gene Ontology: Mol. function=hydrolase activity, acting on glycosyl bonds; Cellular component=extracellular region; Biological process =cell wall organization and biogenesis
  Homolog annotation: Hit_ID=Q84LI7; Match level="QueryCoverage=98%, HitCoverage=74%, E-value=1e-163, Identity=77%"; Hit description =Polygalacturonase-like protein
  Pfam annotation: Domain name=Glyco_hydro_28; Domain location=14-320; Score=7.2; E_value=1.7e-09; Accession=PF00295.8; Description =Glycosyl hydrolases family 28
MNEWPVIKPLPSYGRGRDAPAGRYTSFIFGTNLTDVIVTGDNGTIDGQGAFWWQQFYNKRLNYTRPYLIELMFSDKIQISNLTFLNSPSWNVHPVYSSNIIIKGLTIIAPVPSPNTDGINPDSCTNTRIEDCYIVSGDDCVAVKSGWDEFGIKFGWPTKQLVIRRLTCISPQSAAIALGSEMSGGIQDVRAEDITAIHTESGVRIKTSIGRGGYVKDIYVRRMTMHTMKWAFWMTGNYGSYANNSHYDPKALPEIKGINYRDVVADNVTMAATLEGISNSPFTGICIANVTISMADKANEKPWTCTDIEGITSGVTPKPCNSLLDKGPEKIKTCDFPPEILPIDLLELKKCTYNIKHA

SEQ ID NO: 175222 - protein, 586 aa, Glycine max
  Coding DNA Sequence Number=SeqID_83537
  Gene Ontology: Mol. function=transferase activity, transferring glycosyl groups; Cellular component=integral to membrane; Biological process=metabolic process
  Homolog annotation: Hit_ID=A7PZL5; Match level="QueryCoverage=77%, HitCoverage=98%, E-value=1e-152, Identity=59%"; Hit description =Chromosome chr15 scaffold_40, whole genome shotgun sequence
  Pfam annotation: Domain name=UDPGT; Domain location=132-585; Score= -99.8; E_value=1.4e-05; Accession=PF00201.9; Description=UDP -glucoronosyl and UDP-glucosyl transferase
MLNQDCFHLDFHNPKPFSPENFSISYFVVPIFLDLDLPTDGATCWFFSYKFCYTLNLHKIKKQEKHSKQYTAKQEAKIYVVRQCAYIHGKVQLLIITLIMKLLVQYKQQLALIFLEHMQQAHLGNMAENPIRVTMIPWSAFGHLIPFFKLSIALAKAGVHVSFISTPKNIQRLPKIPSTLSHLVHFVELPLPSLDNDILPEGAEATLDIPFEKHEYLKAAYDKLQDAVKQFVANQLPDWIICDFNPHWVVDIAQEFQVKLILFVIISATGATFIGPPGTRTGPLSPESLTAPPEWVTFPSSVAFRKHEAIHFCAGSYKVSSSGVSDFERIIKLHGASKAVLFRSCYEIEGEYLNAFQKLVEKPVIPIGLLPVERQVVDGCSDTIFEWLDKQASKSVVFVGFGSELKLSKDQVFEIAYGLEESQLPFLWALRKPSWESNDEYSLPVGFIERTSNRGSVCKGWIPQLEILAHSSIGGSLFHSGLGSVIENLQFGHTLVVLPFNIDQPLIARFLVEKGLAIEVKRNEDGSFTRNDIAASLRQAMVLEEGKKIRNNTREAAAIVGNLKLHQDHYVAAFVQFLKNGIWKPI

SEQ ID NO: 175223 - protein, 473 aa, Glycine max
  Coding DNA Sequence Number=SeqID_83538
  Gene Ontology: Mol. function=transferase activity, transferring glycosyl groups; Cellular component=integral to membrane; Biological process=metabolic process
  Homolog annotation: Hit_ID=A7PZL5; Match level="QueryCoverage=95%, HitCoverage=98%, E-value=1e-153, Identity=59%"; Hit description =Chromosome chr15 scaffold_40, whole genome shotgun sequence
  Pfam annotation: Domain name=UDPGT; Domain location=19-472; Score= -92.6; E_value=6.1e-06; Accession=PF00201.9; Description=UDP -glucoronosyl and UDP-glucosyl transferase
MREHMQQAHLGNMAENPIRVTMIPWSAFGHLIPFFKLSIALAKAGVHVSFISTPKNIQRLPKIPSTLSHLVHFVELPLPSLDNDILPEGAEATVDIPFEKHEYLKAALDKLQDAVKQFVANQLPDWIICDFNPHWVVDIAQEFQVKLILFSILSATGTTFIVPPGTRAGHLSPESLTAPPEWVTFPSSVAFRIHEAIHFCAGFDKVNSSGVSDFERVIKIHDASKAVIFRSCYEIEGEYLNAYQKLFEKPMIPIGLLPVERGVVDGCSDNIFEWLDKQASKSVVFVGFGSELKLSKDQVFEIAYGLEESQLPFLWALRKPSWESNDGYSLPVGFIERTSNRGRVCKGWIPQLEILAHSSIGGSLFHSGWGSVIENLQFGNTLVLLPFNIEQPLNARFLVEKRLAIEVKRNEDGSFTRNDIAASLRQAMVLEEGKKIRNNTREAAAIVGNLKLHQDHYVAAFVQFLKNGIRKPI

SEQ ID NO: 175224 - protein, 495 aa, Glycine max
  Coding DNA Sequence Number=SeqID_83539
  Gene Ontology: Mol. function=protein-tyrosine kinase activity; Cellular component=membrane; Biological process=protein amino acid phosphorylation
  Homolog annotation: Hit_ID=A7PZL9; Match level="QueryCoverage=87%, HitCoverage=82%, E-value=1e-144, Identity=59%"; Hit description =Chromosome chr15 scaffold_40, whole genome shotgun sequence
  Pfam annotation: Domain name=MS_channel; Domain location=281-486; Score=103.9; E_value=4.9e-28; Accession=PF00924.9; Description =Mechanosensitive ion channel
  Subcellular localization annotation: CTP_CleavageSite=99; ConfidenceScore=5.28e-01
MAAVRSSSVRRLPSDSLSHPYYKRELQFAKNRFSNLASESLGSSHHFGTRASVSVKPTFSGYCFRSALPFASMSHVLNHRMYSSSVGDKGSRDGGTEVSAGSGATDINTTGDSVVGGDWAERIKDAWKSVAEAASYAGGKVKETSDDLTPFAQQLLDSHPYLDKVVIPVAGTLTATILAWFLLPRILRKFHKYATQGPVSLLPASVSVEPVPYEKSFWGAMEDPVRYLVTFIAFSQIYMTADFDFQWCYGGSNNYNLTISCTSLEGQSLLGLDKEKVLALDKISSIGLFVIGIMALAEACGVAVQSVVTVGGIGGVATAFAAKDILGNVFSGLSMQFSKPFSIGDTIKAGSIEGQVVEMGLTSTSLLSSEKFPVIVPNSFFSSQVIVNKSRAEYLAIITKIPLQTEDLSKIPPISDDVKSMLRSNAKVFLGKDVPYCFLSRIESSYAELTLGYNLKHMRKDELYSAEQDILLQAVQIIKNHGVALGSTWQDTSSK

SEQ ID NO: 175225 - protein, 718 aa, Glycine max
  Coding DNA Sequence Number=SeqID_83540
  Gene Ontology: Mol. function=oxidoreductase activity; Cellular component=integral to membrane; Biological process=electron transport
  Homolog annotation: Hit_ID=Q5XMI8; Match level="QueryCoverage=100%, HitCoverage=100%, E-value=0.0, Identity=68%"; Hit description=Iron reductase
  Pfam annotation: Domain name=FAD_binding_8; Domain location=331-432; Score=121.1; E_value=3.2e-33; Accession=PF08022.3; Description=FAD -binding domain
  Pfam annotation: Domain name=Ferric_reduct; Domain location=180-301; Score=115.2; E_value=1.9e-31; Accession=PF01794.10; Description =Ferric reductase like transmembrane component
  Pfam annotation: Domain name=NAD_binding_6; Domain location=438-702; Score=170.0; E_value=6.4e-48; Accession=PF08030.3; Description =Ferric reductase NAD binding domain
  Pfam module annotation: Pfam domain module=FAD_binding_8::Ferric _reduct::NAD_binding_6; Domain location=331-432::180-301::438-702
MAQETGVKTSPSQEKYGRVQFAIRLLVLVLFLGWIFIWIMSPTNTFRQAWLPRYKAKTNNTTYFGSKGAYLLLYTFPILLIATLGCVYLHIGKKVNDSNTESCNAKKFKATIWKRPVLIKGPLGIVSGTELAFLFMFILLLIWVFATSVHNSFATITPQLAAKDGEKMWEEKLDSVALRLGVVGNICLAFMFFPVARGSCVLPLLGLTSESCIKYHIWLGHIAMLLFTSHGICYIILWAVTDHISMMLEWKKNDISIVAGEISLLSGLFLWITTIPRIRRKVFELFYYTHHLYILFIVFFIFHVGVSYACIMLPGFYLFVVDRYLRFLQSRRQVRLVSARVLPCEAVELNFSKGHGLTYNPTSVMFINVPSISKLQWHPFTVTSNSNLERDKLSVVVKGEGTWTKKLYQMLSTPSTIDRLAVSVEGPYGPASTNYLRHDTLVMVSGGSGITPFISIIRELIYLNTTFKCKTPKVVLICAFKNSSSLSMLDMILPISGTPSDISNMELQIEAYITRDKELKADCPIHPQTIWFKPNPSDTPVHAILGPNSWLWLGAIISSSFIIFLILIGIITRYYIFPIDHNSNKIFSFPLNAFLNMLVICVSIASAASAVFLWNKKHNAKEAKQVQNMEGSTPTASPNSMVCNADRELESLPYQSLIHATNVHYGVRPDLRRMLLEHKESSVGVLASGPKKMQQEVAAICSSGLADNLHFESISFSW

SEQ ID NO: 175226 - protein, 58 aa, Glycine max
  Coding DNA Sequence Number=SeqID_83541
MEDHGDDDTGIMAVIDGPYIAVVVLSAATVAVPEIMASGGILTGAVTSYKASERLAFE

SEQ ID NO: 175227 - protein, 128 aa, Glycine max
  Coding DNA Sequence Number=SeqID_83542
  Subcellular localization annotation: CTP_CleavageSite=62; ConfidenceScore=5.19e-01
MTMQNMQFLQETRASIQSLTNQMGQLATQLNQKQSQNSDKLPSQAFQNPKNVSAISLRSGKQCQGPQPVAPFSSTIEPAKLHSTPEKGESSTGNSDLQKQHIPPLPFPPRAISNKKNGRGGERDLGNI

SEQ ID NO: 175228 - protein, 78 aa, Glycine max
  Coding DNA Sequence Number=SeqID_83543
MARSVFAPCPYLRGLYGRELKGLLVIIPKAVISLLMVSRVPQWSRQLSQPTLRREGDAGLVGASSKKGIRVESPPTFI

SEQ ID NO: 175229 - protein, 115 aa, Glycine max
  Coding DNA Sequence Number=SeqID_83544
  Gene Ontology: Mol. function=galactinol-raffinose galactosyltransferas e activity; Cellular component=cytoplasm; Biological process =oligosaccharide biosynthetic process
  Homolog annotation: Hit_ID=Q9SBZ0; Match level="QueryCoverage=60%, HitCoverage=8%, E-value=4e-23, Identity=77%"; Hit description =Galactinol-raffinose galactosyltransferase
  Subcellular localization annotation: CTP_CleavageSite=44; ConfidenceScore=5.23e-01
MAPPNNPVNSTLGFKSLEKVFDLCDGKFTVRGVPLLSQVPNNVTFSSFSSICEPRDAPPSILQRVIAVSHGCINESANARGEAVCVLGALPLPRSLTRCARSFGCGERYQLTQRR

SEQ ID NO: 175230 - protein, 165 aa, Glycine max
  Coding DNA Sequence Number=SeqID_83545
  Homolog annotation: Hit_ID=UPI0000ECBAF8; Match level="QueryCoverage =24%, HitCoverage=48%, E-value=1e-16, Identity=100%"; Hit description= UPI0000ECBAF8 related cluster
SEQESARGSFQGETPGIFIVLSGFATSDLSVDFCDARQGGGAYGKTPATRPFYADTARRSRTTERSESVSEEAEERPIRKPPLPAPDNNFTQETAMTMITNSSSVPNVAYDDGMQAWHWPSFYNVVTGKTLALPNLIALQHIPLSPAGVIAKRPAPIALPNSCAA

SEQ ID NO: 175231 - protein, 78 aa, Glycine max
  Coding DNA Sequence Number=SeqID_83546
MDWMHELEDDEGHEGIIHRRWFKANLSRIWGRYYQGESGRASTSKPRAKRKISALSAAGAFSKAKLETGAELDFTYSR

SEQ ID NO: 175232 - protein, 143 aa, Glycine max
  Coding DNA Sequence Number=SeqID_83547
MKADMEAMKEQMTTMMEAMMSMRKMMEVNTVTVIAASTATEVDPTHPSGLNQVNRPVLNMVGQGGRALGSMDGPHFVQVQSKHSFPPYMACLPTMHHRKLHTLPMRMSITLLPYSLRVNNPNLVMHESLNPWGRHMKYPETPL

SEQ ID NO: 175233 - protein, 88 aa, Glycine max
  Coding DNA Sequence Number=SeqID_83548
  Subcellular localization annotation: CTP_CleavageSite=75; ConfidenceScore=5.37e-01
MDKAISRICPLDLMMKYVQFQLSLAHQWAKRASTAKCSFNALSTTEESTRASASRTRAKCEIRVLSTTGAFSQARCMTGTKPESTYSR

SEQ ID NO: 175234 - protein, 387 aa, Glycine max
  Coding DNA Sequence Number=SeqID_83549
  Gene Ontology: Mol. function=NAD+ nucleosidase activity; Cellular component=integral to membrane; Biological process=proteolysis
  Homolog annotation: Hit_ID=Q7CL33; Match level="QueryCoverage=47%, HitCoverage=41%, E-value=8e-55, Identity=53%"; Hit description=RhsD protein
  Pfam annotation: Domain name=RHS; Domain location=70-110; Score=53.2; E_value=9e-13; Accession=PF03527.5; Description=RHS protein
HYDALGRRSRKAVRYKGKTEQTTRFLWQGYRLLQEQRDDGSRRSWSYDPASPWSPLAALEQAGDSRSADIYWYHTDLNSAPLEVTDAAGNLCWSGQYDTFGKLQGQTVAGAAKRQGAQYQQPLRYAGQYQDDESGLHYNLFRYYEPEVGRFTTQDPIGLRGGLNLYQYAPNPLMWVDPLGLSVEGVPHGFNSFGQFKQFGEALQAGMSKLGYPGTVSYMQGSSVSGVSFSTGQPFDVGRVSDFDVAISHPELYQKAEQLGIGKGGRTGPIDMGSEMAKKLGIDDTLQKLSKMSGGRPVNAMVFESAAEVKAKGKGTRIPDKLTITDNYIPHSNEWLEEDNKEFSTIIKVSFTNGKNPEKLSRYKFLKNAFNQLDGLSIISDECIEEE

SEQ ID NO: 175235 - protein, 189 aa, Glycine max
  Coding DNA Sequence Number=SeqID_83550
  Homolog annotation: Hit_ID=Q6WAY6; Match level="QueryCoverage=64%, HitCoverage=21%, E-value=1e-11, Identity=30%"; Hit description =Putative uncharacterized protein
MCAKKGKENWEELLVGMVGASVNWFPRWKEGGAGVLCSYEGFPNVPLMGTMSCINYNPILAIRQLGYPMRGAPSEEGIAPFIARGFSEGNAKMLQRVRKTWNTVERKDKELRGISNDVSGGYHKWLKARTQGITWLPKLKISSGEEVEVPEENEEVQALKVELERMRVVKEKFKMKATRVRKECDELRD

SEQ ID NO: 175236 - protein, 468 aa, Glycine max
  Coding DNA Sequence Number=SeqID_83551
MTSSRADGAIEVTQDAPVHGQSRAGQHLQYSGCLFTGLPGAVAKGQHACGEVACVGHVVLRHDAAQVRVVGQGMDEHAAGAEPAWPQVFQYGIAGALAGQQQHQHRPGATATGKAVDHLNGWQLCQLHAQLQCTQAPCLQEGRQAPRGTGTDVLPPLADPVLRNLQRENVTDRFFQVATLQRTAQRIAVHQRQQRWPIAGGQAKQLQTAQQFPAQAGTHLFGGMSGQRGTQLVIAADQQAAFVQAQALAGGQAEESDIATQADTAAADPCTERLRGILDHPGASAARNLAGQLDIGDAPAQVGGQDRQRACVGQALELAGVEVEMAVAGIAQLHAQAQAVHRDRHQRAGIGRQDHGVALGRTLAQRTQRDQQRVCAGTGQLQRRCAELAGQDRAQVATTGQEIAGLHRQASRRWQFAREQAHRRGLTRRFRRGCAGRRLPRGRGRRCRPRSTPHRADGAASAARSGIL

SEQ ID NO: 175237 - protein, 75 aa, Glycine max
  Coding DNA Sequence Number=SeqID_83552
MGEHQQNWKEMANIMMKINKESDEMFNAPYDEVSRSFSIRWKDELEPTWHLLHSSGNMHSITYNQDLATPTLLAG

SEQ ID NO: 175238 - protein, 79 aa, Glycine max
  Coding DNA Sequence Number=SeqID_83553
MDTLEPCAGSCGFGMTDPLDESISCFLIRVNPWVLVPSPPEDFMSSPLEDYTSSPSEDDTFSPSKGHAPSTSEDYTSSP

SEQ ID NO: 175239 - protein, 89 aa, Glycine max
  Coding DNA Sequence Number=SeqID_83554
  Subcellular localization annotation: CTP_CleavageSite=14; ConfidenceScore=5.23e-01
LSSFTGSGIYPDLSSFTGSGVYRDLSSFIGSGVYPDLSSLTGSGVYPDLSSFTGSGVYPDLSSFTGSGIIQTFVACVKRSARDLTIHIK

SEQ ID NO: 175240 - protein, 47 aa, Glycine max
  Coding DNA Sequence Number=SeqID_83555
MEYKQTQIVTMQALSHINTTLDFQGIGKEDWCHPLKNLSQEATGQPP

SEQ ID NO: 175241 - protein, 145 aa, Glycine max
  Coding DNA Sequence Number=SeqID_83556
  Homolog annotation: Hit_ID=A6N1F2; Match level="QueryCoverage=42%, HitCoverage=93%, E-value=2e-12, Identity=59%"; Hit description=Imp biosynthesis protein
CRKVKEVGDLMTGEPTTEAPVNGGRNYNGPKVAKFLVGLGEIDMSVKMRTTCTWTERPYEASLFPGIGFGLFLRSLEPSVRYHSGRARILTLCQDLRAEGQSQAEGSLTARPTRRAGTKVGLSDPTVPSGRAVAQRIKVTLRITG

SEQ ID NO: 175242 - protein, 72 aa, Glycine max
  Coding DNA Sequence Number=SeqID_83557
  Subcellular localization annotation: CTP_CleavageSite=40; ConfidenceScore=5.01e-01
MAFIILKFMHLVHTSEIHAKISCSGSTTGVDGWVSSGVVSSSAGAGAGSSSVIGSWAAKASPLPEEEGWSPS

SEQ ID NO: 175243 - protein, 21 aa, Glycine max
  Coding DNA Sequence Number=SeqID_83558
YEGLDDATSGEGPISQGRCHF

SEQ ID NO: 175244 - protein, 63 aa, Glycine max
  Coding DNA Sequence Number=SeqID_83559
MSSSPDTTTKCPSTTNFSFWWSVEGTTPTEWIHGRPKRQLEVDLSPHLSTASVEGTDHHGTWP

SEQ ID NO: 175245 - protein, 161 aa, Glycine max
  Coding DNA Sequence Number=SeqID_83560
MIRTLTYENRRITRPFRLARFGDDADAGSRQARQGASTGVEGCRGWLNYAASEQIVMRVHHMRCEIPHRCVRRKYRIRRHSPFRLRNCWEGRSVRASSILRQLAKGGCAARRLSWVTPGFSQSRRCKTTASAKLACLQVDSRGSYGTCSINDRFWNSMLMI

SEQ ID NO: 175246 - protein, 152 aa, Glycine max
  Coding DNA Sequence Number=SeqID_83561
MTPTRIQMVPGRKPICAARIAPTSGPAPAMAAKWWPNSTHLLTAIVQFKDLVGNEPAVEAVGDAVAGDGGDHQPDGVDVFAAAERQHGEGEGADQRHQQPDKSGPDVFHETTPWRTEVKIDVVIWNDVLTVEVLPLNCGRSDEKCEAGGVLV

SEQ ID NO: 175247 - protein, 624 aa, Glycine max
  Coding DNA Sequence Number=SeqID_83562
  Gene Ontology: Mol. function=binding
  Homolog annotation: Hit_ID=A1XT91; Match level="QueryCoverage=86%, HitCoverage=69%, E-value=1e-103, Identity=77%"; Hit description =Putative adhesin/hemagglutinin/hemolysin
AACGAARLEVIAAKGEYETGPYNSKVSQQYADAYGQIVNLLNITSVDAQSQQQVKDAMVNYAMVQLGVDKATAEAYIETYDGMKIVAASLTPVLGSAAAKQLGKIVDANLKVVAKGNVDGSKFTDTNQGIRPSQLADFNKPTLINDVVQAKIDKRPDKNYPNGNMGTAHAEIGVIQQAFDKGMTQGREMAMSVAGKEVCNYCLSDVRTMAEKAGLKSLTIYEEATEVGPERLSVEAENGFYLVTLLEYDESGSDVRSIWDQTSSSGENVMILGNYWPKRQLTKDFDLVVRIFKEFFDTGNPVASDNLLAVLSRLVGPQILPLLAGLAEFAPGGLIVVMRTGVNSSVVIASAEAKNAAAGLQPGDRGAAQGATNTAGARPTSDGTGLVSADGTRIYRSPKEKPNTPGPVGEEGINHFDVFICTPEWLCKHHWLPELMRHTLLVRKYDLDEITKTITDYIDQCEGDDWMEIAQKLSRVFAWEFEDYQPYHPGHAEGTTKAGVSEGTLIVRDTDKQQQDVAQLNRDTEHANDGSISPIFNKEKDYVKTVIFCDKPPARTEWSLKISYLLSPISYLLSRVFTARCGLASGERHGRAEADAAVNAILPSGALTAQPLKQRTAQEAGRFS

SEQ ID NO: 175248 - protein, 171 aa, Glycine max
  Coding DNA Sequence Number=SeqID_83563
WAPGQATLARNFSTVGMDPGGPTTSAEVDAGVGVADVEGRSSGLALLAPRIDIVRSSGFQQFFLMAVIRAINPSLEELDWAMEVIWLEMRTPMFMSMLDYERTLHTWDKVVKSFLRILPGWPSAFKMKPRPVSGVCGQSLTLCQHHRCLQECVEAISIDLHYMASDPGLLW

SEQ ID NO: 175249 - protein, 63 aa, Glycine max
  Coding DNA Sequence Number=SeqID_83564
  Subcellular localization annotation: CTP_CleavageSite=35; ConfidenceScore=5.02e-01
MDMKLGSLISGQISLMAHHDSSRLGFPSLITALCKAQGVTSDSLTFESLSPAINLVAYIRANS

SEQ ID NO: 175250 - protein, 60 aa, Glycine max
  Coding DNA Sequence Number=SeqID_83565
MFAYSPFAKLKPRAKRIFVHALSHDSQALSDKPWHLRLILSAKLAKVELSQFQLNLNSAK

SEQ ID NO: 175251 - protein, 90 aa, Glycine max
  Coding DNA Sequence Number=SeqID_83566
MKLAKYRLKAQVEKDESLSGEGQSPRVEKDEGPEAETLSRQLITYQGNPCGVYPDLSSFTGSGVIQTSVACIKRSTPTQVHIIWYQSFGS

SEQ ID NO: 175252 - protein, 388 aa, Glycine max
  Coding DNA Sequence Number=SeqID_83567
  Homolog annotation: Hit_ID=A7NYC2; Match level="QueryCoverage=99%, HitCoverage=90%, E-value=3e-96, Identity=50%"; Hit description =Chromosome chr6 scaffold_3, whole genome shotgun sequence
MSLENESEITHLKKNLKVQMERNVSLEKENKNHRQEVARLKSQIMSLKAHNIERKSMLWKKIQKAMDGNNSDTLQHKAAVKVTMLEKSPPNERVHTNSDLLETPKVKDRSVKVPPPAPSSNPLLPSHKTEKGMKVQPLALPRTAPPPPPTPPKSLVGLKSVRRVPEVIELYRSLTRKDANNDNKISTNGTPAAAFTRNMIEEIENRSTFLSAVESATYADISEVEAFVKWLDGELSSLVDERSVLKHFPHWPEQKTDALREASCNYRNLKSLESEVSSFENNPKEPLAQALKKMQALQDRRACAKLECSRSVNSAERTRESASIRYRSFHIPWEWMLDTGLIGQMKLSSLKLSREFMKRVTKELESNEASKEDNLLVQGVRFAFRVHQ

SEQ ID NO: 175253 - protein, 692 aa, Glycine max
  Coding DNA Sequence Number=SeqID_83568
  Gene Ontology: Mol. function=carbohydrate binding; Cellular component= cellular_component; Biological process=fructose 2,6-bisphosphate metabolic process
  Homolog annotation: Hit_ID=A7NYC1; Match level="QueryCoverage=94%, HitCoverage=86%, E-value=0.0, Identity=66%"; Hit description =Chromosome chr6 scaffold_3, whole genome shotgun sequence
  Pfam annotation: Domain name=6PF2K; Domain location=276-505; Score =171.2; E_value=2.7e-48; Accession=PF01591.9; Description=6 -phosphofructo-2-kinase
  Pfam annotation: Domain name=PGAM; Domain location=507-659; Score =121.5; E_value=2.5e-33; Accession=PF00300.13; Description =Phosphoglycerate mutase family
  Pfam module annotation: Pfam domain module=6PF2K::PGAM; Domain location=276-505::507-659
MELGYGNCVVHDCLTSEIEGVFSFLNNAWISETLDFKFLLKPKDSNTPCFVEEGPSRLLVGGALQEDARLALFRLDSGEVLEYQVFVKADRVSPFDLAASWRAYQDNFRPSSVRWIPDVSINSAPQTGGEAYFIFLVQNGCSVGLELDLEHYVVPTPATAANSAHVYAANMTENPRSLICGSGSSSYPIKEMQVIVPDPSKIFQSSGMVESKSVGTFSPLQKQESQRGLFVDRGVGSPRLVKSSSSNIFSTDLNLDNETKNSMPAAAGAVAAAAVADQMLGPKEDRHLGIILVGLPARGKTFTAAKLTRYLRWLGHNTKHFNVGKYRRLKHGANQGLKSHALQLDSNVYALIPGEHYNAGSSNVRLRHWHEIASKQSADFFRADNPEGVEARNEVAALAFEDMISWMQEGGQVGIFDATNSSKERRNMLMKLAEGRCKVYETVNEGSYIKMIDMVSGHGGQIQVNNISGYLPGRIVFFLDSEIFIFNRVGLGFLDQIKVNTHLTPRPILLTRHGESQDNVRGRIGGDTAISEAGELYSKKLAKFVGKRLKSERAASIWTSTLQRTILTATPIVGFPKIQWRALDEINAGVCDGMTYAEIKKNMPEEYESRKKDKLRYRYPRGESYLDVIQRLEPVIIELERQRAPVVVISHQVAVLRALYAYFADRPLNEIPHIALEKSSLLVNDDEYAEDI

SEQ ID NO: 175254 - protein, 137 aa, Glycine max
  Coding DNA Sequence Number=SeqID_83569
MLILAGHSCKKLLQFLIETEFPWSREAWQETENNTHNNTWSKIFENFHGAENNTHNNTQNTKQAAPMQTKTQNNTQYIISNGKEEQASQEEEDSLTSKTGEEETATARKKSQHRRRRRGRNRQWRGRRRKKKRRQCG

SEQ ID NO: 175255 - protein, 145 aa, Glycine max
  Coding DNA Sequence Number=SeqID_83570
  Gene Ontology: Mol. function=protein transporter activity; Cellular component=clathrin adaptor complex; Biological process=intracellular protein transport
  Homolog annotation: Hit_ID=A7QNL1; Match level="QueryCoverage=85%, HitCoverage=15%, E-value=2e-45, Identity=71%"; Hit description =Chromosome chr2 scaffold_132, whole genome shotgun sequence
MVANVVATLVDDQENSCSPIFEIPSHTLSKLLTALNECTECKAVDGRETEKIVERATPRFQHANCAVVLSVVKLITSTDVVQNLCKKMAPPIVTLLSAEPKIQYVALWNINLIVQRRPTILAHEFNALLQALICGIGYLEQPVLT

SEQ ID NO: 175256 - protein, 107 aa, Glycine max
  Coding DNA Sequence Number=SeqID_83571
MKILPLYKMIVGLQGCVYKIEEWRRAMQEEMQSLHENNTYELVEWRIVMQEEMKSLHENNTYELVNNTYELVEWRIAMQEEMKSLHENNTYELVVEKSHARRYAILA

SEQ ID NO: 175257 - protein, 222 aa, Glycine max
  Coding DNA Sequence Number=SeqID_83572
  Gene Ontology: Mol. function=ATP-dependent DNA helicase activity; Cellular component=nucleus; Biological process=regulation of transcription, DNA-dependent
  Homolog annotation: Hit_ID=A7QNL0; Match level="QueryCoverage=50%, HitCoverage=23%, E-value=3e-30, Identity=45%"; Hit description =Chromosome chr2 scaffold_132, whole genome shotgun sequence
MSSKLDHVRADMLELVAEQKELAAQLHAVESELAKVSTEAQFVPTIKANIEAMRHEIQRGRLRVQQCLAFHLELLNEAEVAAVAEEKETHSFEIDPSHALYMMNPNKFRAFFVDNLFAFTEYAMKLRKPMIYGVTSRVERTKILQAFKTSKDISTIFLSKEMYYSTKRQQFLIDQGYNFKVITSLPPPDEGPNLSYHRLQDQLALLGKVKYVFTSVLPLKTM

SEQ ID NO: 175258 - protein, 60 aa, Glycine max
  Coding DNA Sequence Number=SeqID_83573
  Gene Ontology: Mol. function=pyridoxal phosphate binding; Biological process=amino acid metabolic process
  Homolog annotation: Hit_ID=Q14K67; Match level="QueryCoverage=68%, HitCoverage=47%, E-value=7e-11, Identity=78%"; Hit description =Aldehyde-lyase
MTNILPECSSGGRCLSVEYTDRVKELAKKHGLKLHINGARIFNALVGETVPETDNLSHIH

SEQ ID NO: 175259 - protein, 45 aa, Glycine max
  Coding DNA Sequence Number=SeqID_83574
MEPKSPKDIYKAMTLLGDYIDKEDTSIRIGVIMGLGIAYAGSQNE

SEQ ID NO: 175260 - protein, 37 aa, Glycine max
  Coding DNA Sequence Number=SeqID_83575
MVYMWNYAMKLDVLIIEIKRFRDKKEVAEPEADPERD

SEQ ID NO: 175261 - protein, 127 aa, Glycine max
  Coding DNA Sequence Number=SeqID_83576
MGVGVTIKQYFGPTLKKPCTSTSMTSKDLEHLTQKIKDQLELLLTEKGLVLPPKPEVGPFVAPVNTKGSSIDPSGQDPYTDESDKCGFYVDGIHPRLVALGKVYEGSTIIHNIPLGNHQVKVGVEEV

SEQ ID NO: 175262 - protein, 173 aa, Glycine max
  Coding DNA Sequence Number=SeqID_83577
MVCLCLTCGNGRVDLLHRLIATKVVPEDMSRGSGDLGDVRRGAIAQNQAWLIPTQPGHSQSVRTCDLIRDRVVMECLKGVWETLEGNERCRFRGTIRLTATSLVHPEEPVRTLQQPVEWILPTPTPYRLVESVQVIQVSSSEEDLEEEPEELPPEPAMDALDLPEDDEDPLPE

SEQ ID NO: 175263 - protein, 169 aa, Glycine max
  Coding DNA Sequence Number=SeqID_83578
  Pfam annotation: Domain name=G-patch; Domain location=1-42; Score =25.0; E_value=0.00018; Accession=PF01585.14; Description=G-patch domain
MVAQVMLKQGYEPEMGLGKDGLGNADVVDIRGNPYKYGLGYEPGMPGRRNASSRLRADRAWPGHVSQCFTSAGIMFEEEVATIGEESPQDPSSFVRPCHPDSQYRYEDRFFEDPNREGLIIDFDREVSQTINEEEEEDVLSPELERLIAQEERQMKPHQEETELINLGT

SEQ ID NO: 175264 - protein, 117 aa, Glycine max
  Coding DNA Sequence Number=SeqID_83579
MYSTNNSGWRQELTPYNQYEEERAPDLDSVFAEFMAYHASSTANHNAIQKQEIQCAKVGKLVEEVIQAMSRREENIVEVDSQEESLVNEHDLEEDEEKVQQWKQCLQTRAQQEDNFQ

SEQ ID NO: 175265 - protein, 22 aa, Glycine max
  Coding DNA Sequence Number=SeqID_83580
MDSRNQSRCLGMDASGDRVTID

SEQ ID NO: 175266 - protein, 87 aa, Glycine max
  Coding DNA Sequence Number=SeqID_83581
MGVQIAPKPTWALQKAVASGGSNLARLGELGGKHLPYFAINRGGSEEEKAEALPKRFRNVFREEFCKGFNRSSTFFIRSSSFFDLQR

SEQ ID NO: 175267 - protein, 94 aa, Glycine max
  Coding DNA Sequence Number=SeqID_83582
MARRDKLWSFCALFVIQRWRAPMNMWGQIMVISHLLPSRYDRVRWHAETNYGHSAPCVNREERIRQYQDDVGRSVLIIFKIFAGSAGEEIDRPN

SEQ ID NO: 175268 - protein, 85 aa, Glycine max
  Coding DNA Sequence Number=SeqID_83583
MVDVRQTTSRVTGFAISHETLLRCDDAPGIHLPRPRPVAARPFTKRSCQLRFAPPATPFGRGRACLACRRRWSGLRPDHFSLAIY

SEQ ID NO: 175269 - protein, 394 aa, Glycine max
  Coding DNA Sequence Number=SeqID_83584
MKEFYANLYDPDDKSPKQVRVKGHLVKFDDDTLNTFLKTPVVLEEGENLCTYSRFALLRPDPQELAAKLCIPGRGFELNADGQPLKILRKNMTTLAQTWNILSFSNLIPTSHTSDVTLDKAKLIYGIIMKMDMNLGYLISHQISLIAQHDTSRLGFLALITTLCKARGVQSNSRSLENLSPAINLAYIKKNCWNLDDPTVTFRGPRKARGKRSEVPTTSAPPETPASSSSTTPVPFSTLVIPPTPTQRPLPAPLSVGPSDFIFTPLMLHFMLQSIYRGQSIIMQSLQGLGLPSIMSMEEFDVQVAWPGVQPSPSGGGWASTAQEPAYKEPTAVAADGEDELTPPEPFYFNADAHMVQEEGTSTDQIPEPSPALVPKETQPSTPITELEQPIQDS

SEQ ID NO: 175270 - protein, 107 aa, Glycine max
  Coding DNA Sequence Number=SeqID_83585
YRSPQPDDRAQRVSERGTGKSAQYANRLSPRVGRFSNAAGTTGNSYDHDYEFELGTPVFIVGSIKNWWKTSFEGLYRAAIVSSSSEEVKGIITGQRHDLEERAKGFP

SEQ ID NO: 175271 - protein, 208 aa, Glycine max
  Coding DNA Sequence Number=SeqID_83586
  Subcellular localization annotation: CTP_CleavageSite=25; ConfidenceScore=5.05e-01
MFPLGRDMISINVLSTQSPRMIKVVCRIAGSVLMVNRITFAVLLTIIPLKLACLTMVLLKRFRRLITVNLEYLFSNKIHATLDGQWFCKGEQFASVTLLMDQHLMSLTCHLSPKIFLQLLLNNKRMMAMATPPTSSPQSKNPPEVTSKRTRQSTRLRSLTTRCLDGSRPVVNVNPATGQQIFDPTIKYGLDPKTWAEFAKSHKTPNWQ

SEQ ID NO: 175272 - protein, 213 aa, Glycine max
  Coding DNA Sequence Number=SeqID_83587
MAKFDPEIVLEFYANAWPIEEGVRDMRSWVRGQWIPFDADALNQFLGDPLVLEAGQQCEFSQRRNRADGFDEEAIAQQLCTPRNVLPSDHNSDLPLPKCQLVYAILTRMSGHVAQVITNAIYLFAGMPPTRHPLDPDKSNRALGFPALIMGLCQSFGVPITPSKVIRLPITRAFIEKYCTPRQAQGDAHQAADAPPPTRQADPAGSLGMEHYL

SEQ ID NO: 175273 - protein, 61 aa, Glycine max
  Coding DNA Sequence Number=SeqID_83588
MEIYSCHHQKGGDCRNNDKKLKSQDHFMITKMMTFKNEFKIESRALQGSRGNLISRIKIQE

SEQ ID NO: 175274 - protein, 210 aa, Glycine max
  Coding DNA Sequence Number=SeqID_83589
  Gene Ontology: Mol. function=polyphosphate kinase activity; Cellular component=polyphosphate kinase complex; Biological process =polyphosphate biosynthetic process
  Homolog annotation: Hit_ID=Q8FF70; Match level="QueryCoverage=100%, HitCoverage=30%, E-value=1e-101, Identity=85%"; Hit description =Polyphosphate kinase
  Pfam annotation: Domain name=PP_kinase; Domain location=1-210; Score=- 301.4; E_value=6e-08; Accession=PF02503.8; Description=Polyphosphate kinase
MARNQIFLINERQLSVNQQSWLRNYFKQYLRQHISPILINRETDLVQFLKDDYTYLAVEIIRGDTINYALLEIPSDKVPRFVNLPPETPRRRKPMILLDNILRYCLDDIFKGFFDYDALNAYSMKMTRDAEYDLVHEMESSLMELMSSSLKQRLTAEPVRFVYQRDMPDAMVEMLRDKLSISNYDSMLPGGRYHNFKDFIGFPNVGKANL

SEQ ID NO: 175275 - protein, 441 aa, Glycine max
  Coding DNA Sequence Number=SeqID_83590
  Subcellular localization annotation: CTP_CleavageSite=56; ConfidenceScore=5.08e-01
PGAVADRCADAAGHAVLGSRPAGRQLHQPVYRSLRRSVLVRLDGADRAVPVGSRLRGDAGRRGAGMAGERRRCGRSHAAHLVQVRLRSAVDRRRLYADGTQYAAARAGIDGADDRRPGGDGLRRTVYRSGGDGADHPAEYPRRHRRADRHLYAGDRLDRQLPGGHYRQSDRRGSHRGGGDTGVWPHFRPDWLGSGRMRAGGDRGAGWLVVADAAPGTDGGRPVGRAAAAAGGVQRRPGFQRTAACAGDVAPLASGNATARAACASRPERLRRPLGGRPPGRHRSGGARGALCRLQRRANGGRSAAYRPTPRRSKRNLPAGAQARQRAGGAVGDGGAHRVGRAPAVAAAVGLLTPDQSGHALRSQFPALAGVAAAQPALAALRLGGGAQRRPVRRAGAAAGRTAGGTAAKPVGGGSLIGDRRPDGLFAGAALRLAAALDRVV

SEQ ID NO: 175276 - protein, 225 aa, Glycine max
  Coding DNA Sequence Number=SeqID_83591
  Gene Ontology: Mol. function=two-component response regulator activity; Cellular component=integral to membrane; Biological process=two-component signal transduction system (phosphorelay)
  Homolog annotation: Hit_ID=A8GIC5; Match level="QueryCoverage=98%, HitCoverage=42%, E-value=1e-85, Identity=69%"; Hit description =Transcriptional regulator, CadC
MLDKRYFITADNQLKIQTDFLSSLSAALKQPWPPQLEQRLAQLLPDNGPLLQRFYQAHQLLIHGDADSLTRASAQLSELIKSAPDFHYLLAEKALVDLLRNSYQPFDSQALAQLRADISHLATIPELKNTPIMQQVLAVDALTQGRIDEAHRAIDLGIELQMSWLNYVLLGKVYEMQGQNHLAADSYITAFNLRPGEDTLHWITNGVFQTSLTNVVPYLNNYQRQ

SEQ ID NO: 175277 - protein, 84 aa, Glycine max
  Coding DNA Sequence Number=SeqID_83592
MEIYVSDQLGKNDDKKLKSQDHFMITKMMTFKIEFKIESRTLQGSKENLISRIKIQDSRFKNNQDQDPRLKDSRIKRRLNQDKY

SEQ ID NO: 175278 - protein, 68 aa, Glycine max
  Coding DNA Sequence Number=SeqID_83593
MSRNFTDCLTMGVKFLEAVKRRLHAIKKWSPDEIRREAINSWGSRLDGGGCMNDNQFMGLRIRFEGGG

SEQ ID NO: 175279 - protein, 98 aa, Glycine max
  Coding DNA Sequence Number=SeqID_83594
AVCVLGASGVYTAYGYVGTVRVSVKCFMWQEKKAAPVRQQNTVIQVYSASSLTDSLRSVVRLRERKVWLTNGRRLPYGFAPFCHPGRAAGPILKQDQV

SEQ ID NO: 175280 - protein, 38 aa, Glycine max
  Coding DNA Sequence Number=SeqID_83595
MWTTTGDELATQLAQASKVSSSRSNNLLEEESGRPKWA

SEQ ID NO: 175281 - protein, 25 aa, Glycine max
  Coding DNA Sequence Number=SeqID_83596
MVLVGRYGYEDGEPKIILVEMGFGR

SEQ ID NO: 175282 - protein, 112 aa, Glycine max
  Coding DNA Sequence Number=SeqID_83597
MVYQVGDIASLGTFRRKFTDQVDPLRIKLIRNTHISTFRSTIYPIADNNGGNDMVTALTSTVDGDEAPSMVDGGVALCGSLLNAPRQPPIHGNNGGKLLNEEEEEPLPTTSS

SEQ ID NO: 175283 - protein, 42 aa, Glycine max
  Coding DNA Sequence Number=SeqID_83598
MGEGRVQDSSSNGSGLFDHPHLDCVHLLSSEVNVIKAKPECP

SEQ ID NO: 175284 - protein, 142 aa, Glycine max
  Coding DNA Sequence Number=SeqID_83599
  Gene Ontology: Mol. function=oxidoreductase activity, acting on NADH or NADPH, quinone or similar compound as acceptor; Cellular component=integral to membrane; Biological process=ATP synthesis coupled electron transport
  Homolog annotation: Hit_ID=Q6EM64; Match level="QueryCoverage=84%, HitCoverage=36%, E-value=2e-56, Identity=79%"; Hit description=NADH dehydrogenase subunit B
  Pfam annotation: Domain name=Oxidored_q1; Domain location=23-133; Score=-83.1; E_value=0.0023; Accession=PF00361.11; Description=NADH -Ubiquinoneplastoquinone (complex I)
MAITEFLLFILTATLGGMFLCGANDLITIFVALECFSLCSYLLSGYTKKDVRSNEATTKYLLMGGASSSILVHGFSWLYGSSGGEIELQEIVNGIGFKLSPAPSHQWTPDVYEGVRCYIVGSHPSETTSIIGASVNKRITLR

SEQ ID NO: 175285 - protein, 73 aa, Glycine max
  Coding DNA Sequence Number=SeqID_83600
  Subcellular localization annotation: CTP_CleavageSite=62; ConfidenceScore=5.05e-01
MDRARLVYGLVTNMDMNIRALISVNFRGARKERARPADVPSFSTPPTPSTSTTPTPAPPGPSAQDSQRFESML

SEQ ID NO: 175286 - protein, 185 aa, Glycine max
  Coding DNA Sequence Number=SeqID_83601
MAPRKLASKRSRKDKAAEGASSAPEYGSHRFRSAEHQQRFEAIKGWSFLRERRIQLRDDEYTDFQEEIVRRRWASLVTPMAKFDPDIVLEFYANAWPTEEGVRDIRSWVRGQWIPFDAAALSQFLRYPLVLEEGQECEYGQRRNRADGFDEEAIAQLLCIPGQDFARTAAGRRVRIMRTNMTTLT

SEQ ID NO: 175287 - protein, 192 aa, Glycine max
  Coding DNA Sequence Number=SeqID_83602
  Gene Ontology: Mol. function=chitin binding; Cellular component =extracellular region; Biological process=chitin metabolic process
  Homolog annotation: Hit_ID=UPI00006A17C9; Match level="QueryCoverage =89%, HitCoverage=98%, E-value=5e-13, Identity=28%"; Hit description =UPI00006A17C9 related cluster
  Subcellular localization annotation: CTP_CleavageSite=71; ConfidenceScore=5.07e-01
MLVRMIRTRLFAAGTGENLAPGMHSSCVIASLSGCARTVGPPPNIRGPLKVRTRSPLKARACSPLKFRTCRLSKARECSPMMARTCNPLKVRACSPTKVKAHDPLTARTCSPLKLKVHDPLKARTCSPLKVKARTYSPLEVRACSPLVVRTCSPLKARTCSPLTVGVRACSPLMVRTCSPLKARTCSPLNGE

SEQ ID NO: 175288 - protein, 68 aa, Glycine max
  Coding DNA Sequence Number=SeqID_83603
  Homolog annotation: Hit_ID=A5ADA3; Match level="QueryCoverage=88%, HitCoverage=5%, E-value=5e-21, Identity=75%"; Hit description =Putative uncharacterized protein
MEMTRYDIPVRGKRSLFEIYQRGNVVVLDPAEFEEAEKDDKWINAMKEELKMIEKNDTWKLVEKPQPK

SEQ ID NO: 175289 - protein, 142 aa, Glycine max
  Coding DNA Sequence Number=SeqID_83604
  Subcellular localization annotation: CTP_CleavageSite=53; ConfidenceScore=5.26e-01
MTMQNMQFQQETKASIQNLTNQMGQLATQLNQQQSQNSDKLPSQAVQNPKNVSAISLRSGKQCQGPQLVAPSSSANEPAKLHSIPEKGDDKNLPNNFCAGLGSSSSMDSFASWKINGSGMEKEEREETPLQGEDESRRSSPP

SEQ ID NO: 175290 - protein, 323 aa, Glycine max
  Coding DNA Sequence Number=SeqID_83605
MNIDTDYAFPLTPGFSKEEIELRFWKCLYTSAREAMLHYWVVLPKSLKPAELEPVAFPDISLTNIGRYLTTDDSPYLEVWAAYERCQWEMNASDWLFKKLAMMGEKVLNRRLVGKASENGIFADVLTLKTHASGDDVISRYTVQKDYNRDSGGGNYFLLKASCAERDYPSLANDIYFTVVNWDLLHRSNLAMAELLTSVNLDGESAFRIPVSWNAKVIAENRLIVDHTIDGVNYGVINFYFYSGAVCYSAEDAFEKSTLRFKEHEHSVTLAANELEPIPNDINAALGSILTCTGELYSDEEKMRAFYQSYIFNCSGLWCYVEL

SEQ ID NO: 175291 - protein, 272 aa, Glycine max
  Coding DNA Sequence Number=SeqID_83606
  Gene Ontology: Cellular component=membrane; Biological process =response to toxin
  Homolog annotation: Hit_ID=A1FYD9; Match level="QueryCoverage=26%, HitCoverage=100%, E-value=1e-36, Identity=100%"; Hit description =CsbD-like
  Pfam annotation: Domain name=CsbD; Domain location=73-125; Score =47.6; E_value=4.3e-11; Accession=PF05532.3; Description=CsbD-like
  Pfam annotation: Domain name=Entericidin; Domain location=13-54; Score=66.4; E_value=9.3e-17; Accession=PF08085.2; Description =Entericidin EcnAB family
  Pfam module annotation: Pfam domain module=CsbD::Entericidin; Domain location=73-125::13-54
MKRYSGEPKEKPMKRVVALMLLSMFSVALLAGCNTVAGAGKDVQKAGEKVEDAAKGNVVNHSSSQGFPAMNKDIISGKWSQLKGKAQAKWGDLTNDDFDVAEGNAEYLAGRLQERYGWAKDRAEKEVREFQDSVSKDYPDYKISAPAGPARSGWGRPAARAAGARVNPPGCRVRAGCGRCRSAAAGLGRGCGWRVRSRYRVPTTVRERRGRCPAQGPATCWHSPRCGWHWRRPPLRPSGPVLAGYGADRIRTPAARFLEHGHAHHADVVRAA

SEQ ID NO: 175292 - protein, 92 aa, Glycine max
  Coding DNA Sequence Number=SeqID_83607
MTRGGNPVSLNHNIGFMTVFEGWLFYIGCLATTDVEWVGFYSGSKAETDVEWVGFYIGYQSTDIENERFLHRLSFNRCSMRRFSTSLITKPM

SEQ ID NO: 175293 - protein, 112 aa, Glycine max
  Coding DNA Sequence Number=SeqID_83608
MDTDSEVRNTNTALKRSRVGLSSRRDGRQWTQLAGPMAKYDPEIVMEFYANAWPIEEGGERCEFSERRSQALGFDEEAIGQLLCVLGQDFTRSVTGRRVRIMSTSMTTLTQI

SEQ ID NO: 175294 - protein, 112 aa, Glycine max
  Coding DNA Sequence Number=SeqID_83609
MNNSKKGVRMMNVDIGFPVKPMLISEALEHTKKRDTGHQSVSLENKTGDSTMLKMGDSTKVVIKQDMNGRKHKYGFNNNKRKKTKNKRVVDDETGDKHQLDEVLKRQIETKN

SEQ ID NO: 175295 - protein, 129 aa, Glycine max
  Coding DNA Sequence Number=SeqID_83610
  Subcellular localization annotation: CTP_CleavageSite=50; ConfidenceScore=5.15e-01
SAKVDVSLSKLNALSECHPLSEASTSLADRRNLEGNLSRRHVLNTPSACSASRLSPSRLSMSLALSETSLTCTKRENGAKHDNEELPCYGRQNPQLGILAGGFSIERCIVSLELDRAGLGYRMSGHGVR

SEQ ID NO: 175296 - protein, 108 aa, Glycine max
  Coding DNA Sequence Number=SeqID_83611
MVMHIRPRAHRHHLGKPIRLDHWVWSGIYSIWFASRRPTTVDSQQGQGFIPFVCLTPEQFEAKVAWPGDWLDAQTEEEPAGSPDGADEPQMDEDMNDLLGFLGGSGAT

SEQ ID NO: 175297 - protein, 150 aa, Glycine max
  Coding DNA Sequence Number=SeqID_83612
MSGHSSTRQFPSRKPEGHGRTKSDLLEESSSHIAVTWPSRLKPALIKLLLMWQGGASLAYCPNCEPWPLFFLSEIFFLMSACVDLQPNPNFPRPNPFWARSRTPTSLGPPSLPYQTGEATQRGNLRRQCLLLQKIGKPFPMTPPWLAHMA

SEQ ID NO: 175298 - protein, 148 aa, Glycine max
  Coding DNA Sequence Number=SeqID_83613
MSLDSPSLDDKRRRRRRWSLRVNGLVCPWLTKGADNHKVFHACHLTSWVRMIETVRTDNLLGISARHLTSQVRMTETVCTDNRLGISIRHLTLWFWMTETVCTDNRLGIFVRHLTSRVRMTESAEEDVNLRESMGSLAPIDKGCRRRC

SEQ ID NO: 175299 - protein, 135 aa, Glycine max
  Coding DNA Sequence Number=SeqID_83614
  Subcellular localization annotation: CTP_CleavageSite=38; ConfidenceScore=5.35e-01
MPISPCGSISWSVTSQHRDRTHKTPSGPGKVQQGLGVSSSGYGPLSVLQGARTPPPRQGHVIIGIAPARHPVDPKKSNRVLELSSSNYGSLSVLRSTCHLQQGHQAPLLIELSSKKYCVSRQAQGKTPQQPGDGR

SEQ ID NO: 175300 - protein, 158 aa, Glycine max
  Coding DNA Sequence Number=SeqID_83615
  Homolog annotation: Hit_ID=A5AK77; Match level="QueryCoverage=54%, HitCoverage=10%, E-value=1e-09, Identity=39%"; Hit description =Putative uncharacterized protein
MTRGNLGDLQPFDPEIDRTFHRLVRHSVHPGHSVNFKHFEYFVAGDSEYSDFEHLTTNFHTENMVQPSPHERTLREMAAPDFTYESLCIQYPDEGVPYVIKTGLIHLLPKFHGLAGEDPHKHLKEFHIVCSTMKPPDVQEDHIFQKAFPHSLEGVAKD

SEQ ID NO: 175301 - protein, 82 aa, Glycine max
  Coding DNA Sequence Number=SeqID_83616
MMNFGVDFDLGFYLGFKLLSLILPEFDLGFYLGLGAVKVKVPVLSVAVIVGNIRGTQKVVPLSGTYCSVTDQVDPKVSYGST

SEQ ID NO: 175302 - protein, 379 aa, Glycine max
  Coding DNA Sequence Number=SeqID_83617
  Gene Ontology: Mol. function=aminoacyl-tRNA ligase activity; Cellular component=cytoplasm; Biological process=tRNA aminoacylation for protein translation
  Homolog annotation: Hit_ID=A2Q4Y9; Match level="QueryCoverage=42%, HitCoverage=14%, E-value=2e-70, Identity=80%"; Hit description =Aminoacyl-tRNA synthetase, class Ia
MAFLGETSSQTIVNSTLGFIFPNGSIVHNDSDVCFQASTPVPIRIPNGCDFEVLKTKIHNTLKLTDNQFLDEIYYRKPFTYADGILNLLQATMTPTHDALLYYNGRWNMSRQNEFVGYSFTGKNPKKFDIPSGCTMDELKDLIKQVAPHEITPYGIHETQTSCLHFQTSAPDSFRHLSDMASEGGNKSFTRRDRLLLLINSKVKSQRLLLLRYTIFSPLDGQPRVDHDRASGEGVQPQEYTIIKMELIAPFPEKFKVLEGKKVFLVIATLTAETMYGQTNAWVLPDGKYGAFEINDSEVLVLAHRATLNLAYQNCSRIPEKPSCLLELTGRDLIGLPLKSPLSFSEVIYVLPMLSILMDKGTGVVTSVPSDWLRLYFGK

SEQ ID NO: 175303 - protein, 96 aa, Glycine max
  Coding DNA Sequence Number=SeqID_83618
  Subcellular localization annotation: CTP_CleavageSite=84; ConfidenceScore=5.10e-01
MVMALTSTVDGDEAPSTMDDGVALQRNLLNAPRNLFTTSSSSRQQWWLKKKKNLSRQPPLNGNNGDKWKRRGITAFSLQVLGAPAKMLGAPSNTRG

SEQ ID NO: 175304 - protein, 541 aa, Glycine max
  Coding DNA Sequence Number=SeqID_83619
  Gene Ontology: Cellular component=cytoplasm
  Homolog annotation: Hit_ID=Q9LTZ9; Match level="QueryCoverage=85%, HitCoverage=91%, E-value=1e-165, Identity=60%"; Hit description =Genomic DNA, chromosome 5, TAC clone:K15C23
  Pfam annotation: Domain name=DUF23; Domain location=243-461; Score =78.7; E_value=1.9e-20; Accession=PF01697.18; Description=Domain of unknown function
MAMANKEREKKFFFVGSLVNYAAELKLLLATLFLLCGVATLLQFLPSRFTISSSDLRFCISRVSLTPPPPSTPPPPFTSLSTPPTPLSSTQKHLPNGTIKRVFNPHGSAAYNFITMGAYRGGLNTFAIVGLSSKPLHVYGKPTYVCEWIPDLPSLQNSSKPIITKGLKYLPDWGYGHVYTVVVVNCTFNGTAVNGDNTGGKLVLHASTSGAGDTGFNVTDRIEVLHEAPGALNASLFMSKPKYDYFYCGSSLYGNLNPQRVREWIAYHVRFFGPKSHFVIHDAGGVHEEVLEVLKPWMELGFVTLQDIRDQERFDGYYHNQFMVVNDCLHRYKFMAKWMFFFDVDEYIYVPPKTTIKSVLHSLSEYDQFTIEQMPMSSKICLSEDYGKTYRKWGFEKLVYRDSITGIRRDRKYAVQPRSLYATGVHMSMDLSGKTTHKTEGRIKYFHYHGTISERRETCKILVNTTQVTQNKIPYVMDTTMRDTAGVIKKFELKMIGTRNMGDGRFCAVWFRDKSLMKGVAFRASQKGRVGDMSALSIGIV

SEQ ID NO: 175305 - protein, 103 aa, Glycine max
  Coding DNA Sequence Number=SeqID_83620
MASKAANYNKLPSPIRQAAVTRGGHWWSWVVEKKISLCELVSLSRSGILTKHDNSRSMKFPLGLEFALSATILVEHNSSCAKHNNSHSMQLPLGLELRLACFS

SEQ ID NO: 175306 - protein, 514 aa, Glycine max
  Coding DNA Sequence Number=SeqID_83621
GEACHPARPGEQGYFLQKQQASGGRIWKAQVTNPYGLRIYSFLAFEEVTETHGLRKNTSFRLPPHYGISWIAQACFLLISETSRDFIYCATKDAKYLKAANQRLHVIKLGISELFGADNRKVFMHAPELLGRWIAKGKDAYDHIGLCVSSDFGFPNDEGADNRKPEDADSSRKSADDHIGLYLSLDLGCPNNEGADDHIGLSVSSYLGSPNDEVRRKYSRPEPIDISKKRADDHIRLCVSSDSGSPNDEDYHIGLCLSSNLGSPNDESMDNRKVSHHATGLSSHRIAKNFGSPNDEGSDNRMVSPYTTGLLDYHIGLCLSSNLGSPNDESVDNRKVSHHATGLSSHWMAKDADIFKKGADDHIGLCVSSDLGSLNDDKVSHHATGLSGRWIAKGADNRKVLYLPLDSWVAGQQEDSGSPNDEVLITVRKGADYHIGLCVSSNLGSPNEEHICSLTVNGSSFLGDPTAPSSKGKDGNSYPGSRFMADELRLGLKRLVERPDMMYVMVLVWPAVQG

SEQ ID NO: 175307 - protein, 82 aa, Glycine max
  Coding DNA Sequence Number=SeqID_83622
MAYTHIPDSTSDSPQISASPYQLDFTLYASGSYNAQWNAPGLLHDKHTLRSSRILRKMEVEEPWLGLWLPLNYRVDMGSSLA

SEQ ID NO: 175308 - protein, 72 aa, Glycine max
  Coding DNA Sequence Number=SeqID_83623
MGARDNSFMNKRFTQKSVPNDSCSLTIKVHTTHWVVANDYLHHLPVKQANISTHVPNSCSFSSNYYILIQSM

SEQ ID NO: 175309 - protein, 364 aa, Glycine max
  Coding DNA Sequence Number=SeqID_83624
  Gene Ontology: Mol. function=metallocarboxypeptidase activity; Cellular component=membrane; Biological process=proteolysis
  Homolog annotation: Hit_ID=A6T8T0; Match level="QueryCoverage=100%, HitCoverage=73%, E-value=0.0, Identity=83%"; Hit description =Putative Zn-dependent carboxypeptidase
  Pfam annotation: Domain name=Peptidase_M32; Domain location=1-364; Score=187.5; E_value=3.4e-53; Accession=PF02074.6; Description =Carboxypeptidase Taq (M32) metallopeptidase
RPANDWQGFAENLREVVKLSREEAQIRADAKGSSRYDALLDIFEPDMTSARLDVLFADLKSWLPSLLANVVDKQAQKTLLEPQGPFAINDQRELGLEAMRVLGFDFDGGRLDISAHPFCGGVPEDVRITTRYNENDLLSALFGVIHETGHARYEQNLPRNWLDQPVGLARSTAIHESQSLFFEMQLGRSEAFLNRLLPAVRQRFGDQPAFSAENFIAWNQRVKPGFIRVDADEVSYPAHVILRYEIERALIDGDIEVDDIPALWDEKMQSWLGISTLGNYRDGCMQDIHWTDGGFGYFPSYTLGAMYAAQLMAAARRALPNLAQDIAGGDFNALFDWLRQNIWQHGSRFTTSQLIKNATGEDLN

SEQ ID NO: 175310 - protein, 190 aa, Glycine max
  Coding DNA Sequence Number=SeqID_83625
MSASDHAILRDRVHQPTKKSLLELSSHDALLAQNKLLSKQLEILTETLGKLPTKLSIGQPTHSSVLQRQGYTQGGFSGFQQGPYNQQGQWRSHPSNQFNKDQGGPSNRPIQQGPNIFQRTTKLEETLTQFMQIADKSSNSFMANIEKNPKEDYKAVMTRSKRFVEAEDEDSVVPKKKATKKKGTDDKKDD

SEQ ID NO: 175311 - protein, 246 aa, Glycine max
  Coding DNA Sequence Number=SeqID_83626
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
MVKVGTSYVPINVSFSPKSWPRASRYQQGHQDLFILRSDLPSQWLLFLSAVPPVQLLTGWCVTAKAPPDISAGKCSGRVPFAIQAAQLLGRAIGAGLFAITPAGERGMCCKAIKLGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 175312 - protein, 187 aa, Glycine max
  Coding DNA Sequence Number=SeqID_83627
MAIPGRRCLVLPCCCGWCTGWCCAVYRPPPASTCWRRWANWCRCCCSWCWRCWRLITIASVLTLTARRSTSRCGSRRGGGLCPRALQERCRARHAASGAGRAAGLPAGDVAVAWRGAACGTGADAQSVDGRSDGTPAGSLGRCGDCGWPDYLSVRGLSQLDHYGGGRPVPCRAAGRVSAQHCPAEPP

SEQ ID NO: 175313 - protein, 69 aa, Glycine max
  Coding DNA Sequence Number=SeqID_83628
  Subcellular localization annotation: CTP_CleavageSite=25; ConfidenceScore=5.26e-01
MGPSRGFWAISCLRWKQPSSPGRARVFSKLDCFWRKQPSSPGRAGRQPPPPFSYKLAEGGCSKGPGSPW

SEQ ID NO: 175314 - protein, 105 aa, Glycine max
  Coding DNA Sequence Number=SeqID_83629
  Pfam annotation: Domain name=Ins_element1; Domain location=39-98; Score=-14.6; E_value=0.0032; Accession=PF03811.4; Description =Insertion element protein
RNYYVPIIVSFSPKVGPGLPRINRVTRIYLFCEVIFRHSCPSCSATDGVVRNGKSTAGHQRRQAAQLLGRAIGAGLFAITPAGERGMCCKAIKLGNARVFPVTTL

SEQ ID NO: 175315 - protein, 181 aa, Glycine max
  Coding DNA Sequence Number=SeqID_83630
  Homolog annotation: Hit_ID=Q6UUU1; Match level="QueryCoverage=33%, HitCoverage=40%, E-value=1e-18, Identity=78%"; Hit description =Putative uncharacterized protein
GCFMLNFTPTIDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIRYQAFPPGGSLVRSPVPAFRLPVSFR

SEQ ID NO: 175316 - protein, 122 aa, Glycine max
  Coding DNA Sequence Number=SeqID_83631
MASRKRKSIGTRPTSQYDTRRFSSLDAWTRYTDNVLGRNILPERKVELYHTELDDFKVELERRNFHRRLTNFANGSIDLALVKEFYANLYSSEDRPPKQSRVRGHLVKIDVDSLNIFLETPV

SEQ ID NO: 175317 - protein, 217 aa, Glycine max
  Coding DNA Sequence Number=SeqID_83632
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=23%, HitCoverage=50%, E-value=1e-23, Identity=100%"; Hit description=LacZ protein
  Subcellular localization annotation: CTP_CleavageSite=31; ConfidenceScore=5.63e-01
MGQLATQLNQQQSQNSDKLPSQAVQNPKNVSAISLRSGKQCQGPQPVTPSSSANEPAKLHYTPEKEAAHSSSSIPSKSSFQQKKWKRQRKRSWKHSENPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 175318 - protein, 87 aa, Glycine max
  Coding DNA Sequence Number=SeqID_83633
MGDKEEVQEQMKADMSALKEKMASMMDAILGMRQLMENNAATAAAVSSAAKANPTLLATAHHPIPNVVGRERSTLGHISNPIQGTTE

SEQ ID NO: 175319 - protein, 121 aa, Glycine max
  Coding DNA Sequence Number=SeqID_83634
  Gene Ontology: Mol. function=kanamycin kinase activity; Biological process=response to antibiotic
  Homolog annotation: Hit_ID=P00551; Match level="QueryCoverage=74%, HitCoverage=33%, E-value=6e-48, Identity=98%"; Hit description =Aminoglycoside 3'-phosphotransferase (EC 2.7.1.95) (Kanamycin kinase, type I) ...
  Homolog annotation: Hit description=(Neomycin-kanamycin phosphotransferase type I) (APH(3')I) (APH(3')-I)
MDADLYGYKWARDNVGQSGATIYRLYGKPDAPELFLKHGKGSVANDVTDEMVRLNWLTEFMPLPTIKHFIRTPDDAWLLTTAIPGKTAFQCSCAGCIRFLFVIVLLTAIAYFVSLSAITNE

SEQ ID NO: 175320 - protein, 82 aa, Glycine max
  Coding DNA Sequence Number=SeqID_83635
MDDVCITILFSSFFFLQLPSMKRKNQRKTKWRRKKAKEEEKKEEEKKPKESKDDKESKEESTPPEIVQDTTFTMHGHFKHDF

SEQ ID NO: 175321 - protein, 625 aa, Glycine max
  Coding DNA Sequence Number=SeqID_83636
  Gene Ontology: Mol. function=4 iron, 4 sulfur cluster binding
  Homolog annotation: Hit_ID=Q83JL2; Match level="QueryCoverage=100%, HitCoverage=84%, E-value=0.0, Identity=92%"; Hit description=UPF0313 protein ygiQ
  Pfam annotation: Domain name=Radical_SAM; Domain location=318-524; Score=50.9; E_value=4.3e-12; Accession=PF04055.12; Description =Radical SAM superfamily
  Pfam annotation: Domain name=Radical_SAM_N; Domain location=1-317; Score=757.8; E_value=6.9e-225; Accession=PF08497.1; Description =Radical SAM N-terminal
  Pfam module annotation: Pfam domain module=Radical_SAM::Radical_SAM _N; Domain location=318-524::1-317
MAICGRMLEAQGFRVGIISQPDWNSKEDFMRLGKPNLFFGVTAGNMDSMINRYTADRKLRHDDAYTAGNVAGKRPDRATLVYTQRCKEAWKDVPVILGGIEASLRRTAHYDYWSDTVRRSVLVDSKADMLMFGNGERPLVEVAHRLAMGEAIGDIRDVRNTAIMVKEALPGWSGVDSTRLDTPGKIDPIPHPYGEDLPCADNKPVPPKKAEAKAVVVQPPRPKPWEKTYVLLPSFEKVKGDKVLYAHASRILHHETNPGCARALMQKHGERYIWVNPPAIPLSTEEMDSVFALPYKRVPHPSYGDARIPAYEMIRFSINIMRGCFGGCSFCSITEHEGRIIQSRSEDSIINEIEAIRDTVPGFTGIISDLGGPTANMYMLRCKSPRAEQTCRRLSCVYPDICPHMDTNHEPTINLYRRARDLKGIKKILIASGVRYDIAVEDPRYIKELATHHVGGYLKIAPEHTEEGPLSKMMKPGMGSYDRFKELFDTYSKQAGKEQYLIPYFISAHPGTRDEDMVNLALWLKRHRFRLDQVQNFYPSPLANSTTMYYTGKNPLGKIGYKSEDVVVPKGDKQRRLHKALLRYHDPANWPLIRQALEAMGKKHLIGSRRDCLVPAPTLDEMREA

SEQ ID NO: 175322 - protein, 47 aa, Glycine max
  Coding DNA Sequence Number=SeqID_83637
MAKAPVQVAIPAGVASGCSATATCRMQRGCANDVGVLCDIFMQAFEK

SEQ ID NO: 175323 - protein, 54 aa, Glycine max
  Coding DNA Sequence Number=SeqID_83638
MNTANFGYLSQRALSRASEGEAHGCAFQRRKDARSRHQRLFVENVGKTEGNRSK

SEQ ID NO: 175324 - protein, 69 aa, Glycine max
  Coding DNA Sequence Number=SeqID_83639
MTHNSTMEELINKIQLSPKIMPTSSRQLGSSPESYSLHPATVILLPRTMFAIITDAMWCVPTTKSQEIA

SEQ ID NO: 175325 - protein, 93 aa, Glycine max
  Coding DNA Sequence Number=SeqID_83640
YIKQKGNRNEEKEGVVKQAQPNTGAKRASGAKRAKKTGAKRGVELEDAESVTRAKPQLCAKRAIQQKHRLSLQGALSVRSERAKREVSRLAQI

SEQ ID NO: 175326 - protein, 235 aa, Glycine max
  Coding DNA Sequence Number=SeqID_83641
MAQHDSSKLGFPALITALCKAQGVHSNSLTHERLSRAINLAYIKKNYWNLDDPTVTCRGPRKARGKRFEAPSTSASEAPTPPSSTVPPSSSTQIPVIPPVPLQMPLLASLSTGPSDFIFTPQMLHFMLQSIHRGQSIIMQSLQGLGLPSIMSMEEFETQVTWLGDQPSSFGGGGASAAQEPVTEEPPTPTPAAAEEQTTPDQTPQPSPSSALAPEETQPSTLDHNEDHPQEEQDV

SEQ ID NO: 175327 - protein, 121 aa, Glycine max
  Coding DNA Sequence Number=SeqID_83642
IEDVLVKVKHLIFLVDFVVIDIEEDDDIPLILGRPFMSTASCMDKDPPCQNVYLKVHVMEEKTPEKKEALSANPLWFWNSWKCAKCACCAKPKLLSKALSTACCAKPQMLTGPDNFKLGLA

SEQ ID NO: 175328 - protein, 81 aa, Glycine max
  Coding DNA Sequence Number=SeqID_83643
MTVRICPLDLMMKYVQFQLSLAHQWAKCASTAKHSFNSLSTVEESGSASISRPHAKREINALVFSQAQCTTGAKLKSTYSR

SEQ ID NO: 175329 - protein, 116 aa, Glycine max
  Coding DNA Sequence Number=SeqID_83644
MANKLSELNVEVSEETGAEAGAGKDEAGVDGAAEKPLALSLVGPPKSDRGVIEGSDEGRKIADFEPLAKPILWLSEPSAERNRSWLSAWKILEADELSMMCSARINSLSAPLEPPG

SEQ ID NO: 175330 - protein, 72 aa, Glycine max
  Coding DNA Sequence Number=SeqID_83645
  Homolog annotation: Hit_ID=A5BUI8; Match level="QueryCoverage=70%, HitCoverage=2%, E-value=7e-09, Identity=49%"; Hit description =Putative uncharacterized protein
MSMIKMCSDQVIRRCIPDHEIGSVLQFCHSSAPDGHLGIQRTAHKVLDYESCQVYVMFVFIGALRVNSSLDT

SEQ ID NO: 175331 - protein, 63 aa, Glycine max
  Coding DNA Sequence Number=SeqID_83646
MGVKHFEVVKRRSHANKQWSLDKIRVTDCIICGKVHEPDQCTTTEEITQEIHYMGNQQRQGYT

SEQ ID NO: 175332 - protein, 158 aa, Glycine max
  Coding DNA Sequence Number=SeqID_83647
PIQQSMNPMHEPSRRFTQVHRALDRLNLMVLDDTSNEVYDDDDDPRSYEGAMRSLDYKKWQGPMIRSRAKLLQEEMAMRIKDGLLIKGKEGENHKELNWSTDAILPPRVLDRRLQEDWARAAKEGPGILMNLKLSSGFSRNLLMEASQGSFSRKLLKE

SEQ ID NO: 175333 - protein, 256 aa, Glycine max
  Coding DNA Sequence Number=SeqID_83648
  Gene Ontology: Mol. function=protein binding
  Homolog annotation: Hit_ID=Q2HRJ7; Match level="QueryCoverage=28%, HitCoverage=17%, E-value=2e-24, Identity=69%"; Hit description =Putative uncharacterized protein
  Pfam annotation: Domain name=GRP; Domain location=184-256; Score= -19.9; E_value=0.0082; Accession=PF07172.2; Description=Glycine rich protein family
  Subcellular localization annotation: CTP_CleavageSite=63; ConfidenceScore=5.26e-01
MKGPFAIASSVSSSSSSSSCKNKKSDLRLLIGMLGAPLAPIHVCTMNPFPHLSIKDIPVQYISASGGQRLQNLINNAYATGKVRTIASEFETTCKVFFMLEEGEACSNLYSRIVNIATNKLSSSFFRNLLKEASQGGELSYERASSPSFLSKAYLGGEAPSSMAYSLVDDASSHLFSFVFCYISMLLCLWAGLGLTILMSEAVSECVIRATKLNGQGEEWVCDPHRGAIKGGVKDGGGDDGGGGGFGGGGGCGGGR

SEQ ID NO: 175334 - protein, 72 aa, Glycine max
  Coding DNA Sequence Number=SeqID_83649
MEETNEAGPTLDEDVPIERFAEKGGDFCGKKESLVKALNEAHVAQDISVEGFNGIVNNITANNYLTFAKEEI

SEQ ID NO: 175335 - protein, 77 aa, Glycine max
  Coding DNA Sequence Number=SeqID_83650
  Subcellular localization annotation: CTP_CleavageSite=52; ConfidenceScore=5.04e-01
MECDREALVNDPSLISAIPTSLFQLSSRAKRNLWAQLTSITKRNYNTLSVMRESRRAQESRPHAKRDIRLLPGSAHD

SEQ ID NO: 175336 - protein, 83 aa, Glycine max
  Coding DNA Sequence Number=SeqID_83651
EEKEIDHHGGLLVTMLVNKDKHYDNIVIPPFSNKVVEFKPTLLSLIGSHPFAGMDHEDPYTHLSTFMELCSTMGASEKNVEAV

SEQ ID NO: 175337 - protein, 77 aa, Glycine max
  Coding DNA Sequence Number=SeqID_83652
MRPTHLDDINRSPSMIGKRVVIGLYHFGNRDWKIFPGTTMANWLAMRDGKSSPYVIEIGAKICVCLGEKFPAVFVPK

SEQ ID NO: 175338 - protein, 516 aa, Glycine max
  Coding DNA Sequence Number=SeqID_83653
  Gene Ontology: Mol. function=nitrite reductase [NAD(P)H] activity; Cellular component=membrane; Biological process=nitrate assimilation
  Homolog annotation: Hit_ID=Q1H4J7; Match level="QueryCoverage=94%, HitCoverage=56%, E-value=0.0, Identity=82%"; Hit description =Assimilatory nitrite reductase (NAD(P)H) large subunit
  Pfam annotation: Domain name=Fer2_BFD; Domain location=426-478; Score= 73.0; E_value=1e-18; Accession=PF04324.6; Description=BFD-like [2Fe -2S] binding domain
  Pfam annotation: Domain name=Pyr_redox; Domain location=151-245; Score=79.3; E_value=1.2e-20; Accession=PF00070.18; Description =Pyridine nucleotide-disulphide oxidor
  Pfam annotation: Domain name=Pyr_redox; Domain location=6-114; Score =3.8; E_value=0.0021; Accession=PF00070.18; Description=Pyridine nucleotide-disulphide oxidor
  Pfam annotation: Domain name=Pyr_redox_2; Domain location=6-290; Score=169.8; E_value=7e-48; Accession=PF07992.5; Description =Pyridine nucleotide-disulphide oxidore
  Pfam module annotation: Pfam domain module=Fer2_BFD::Pyr_redox::Pyr _redox::Pyr_redox_2; Domain location=426-478::151-245::6-114::6-290
MTQHTRIVVVGNGMVGHYFMQELVKRHPDLQAANLQVTVLGEEPRPAYDRVHLSSFFSGSSAEDLSLVEPGFYDRPGLELRLNARVSQIDRQQHTVTLTDNTILPYDKLVLATGSVPFVPSVAGRDRDNCFVYRTIEDLEAMTAAGKTAKSGVVVGGGLLGLECAKALKDMGLETHVVEFAPRLMAVQVDEAGGKVLRSKIEELGVHVHTSRNTTAIVDGATARHRMVFFDETWLETDMIVFSAGIRPRDELARESGLAIGARGGIAIDEFSRSSDHNIYAIGECASWNDEMFGLVAPGYDMARTACAHLFGETASTFQGADMSTKLKLMGVDVASVGDAHGKTHGCRSYQYTDEVRNIYKKIVVSEDGKKLLGAVLIGNADEYGTLQQMTVNAMALPENPEFLILPASDGKEKPGLGVDALPDTAVLCSCNNVSKGAIGEAVAAGHCSIGAIKSCTKAGTACGGCVPLVTQVMKAQMDKSRLLANCLENMAKAWAAISANQPLPASWLLAGMTLS

SEQ ID NO: 175339 - protein, 144 aa, Glycine max
  Coding DNA Sequence Number=SeqID_83654
  Gene Ontology: Mol. function=aspartic-type endopeptidase activity; Cellular component=chromatin; Biological process=chromatin assembly or disassembly
  Homolog annotation: Hit_ID=A2Q2C7; Match level="QueryCoverage=68%, HitCoverage=7%, E-value=5e-10, Identity=33%"; Hit description=RNA -directed DNA polymerase (Reverse transcriptase); Chromo; Zinc finger, CCHC-type; ...
  Homolog annotation: Hit description=Peptidase aspartic, active site; Polynucleotidyl transferase, Ribonuclease H fold
  Pfam annotation: Domain name=Chromo; Domain location=48-102; Score =26.6; E_value=9e-05; Accession=PF00385.15; Description='chromo' (CHRromatin Organisation MOdi
MTSGKKNSSETRCKILWTFPGGGEDGRSSLQVQGELPKDLEVTEETDVYPDKVLGSRVIIQGGNEVQQTLIQWKNKALEDVTWEHNEVLCCQFPEFCLEDKALSKEVGVDRNVISEVGPRPRVWRVYTRKKTKGMKDNDVAVNA

SEQ ID NO: 175340 - protein, 74 aa, Glycine max
  Coding DNA Sequence Number=SeqID_83655
MPFCGRARRGSQVRFPKEERCAESPPTFIGGKRRKNRRKPVDKSRDLAPTYPPSKRKSDLRSSFLRVNQAILFT

SEQ ID NO: 175341 - protein, 169 aa, Glycine max
  Coding DNA Sequence Number=SeqID_83656
MGSKIYPKVHENPKAFFINSSPILLEPLAHGSGNWSFPREDCISQLLIMQSLQNMVHQWPVMSIEEFLQKVAWPGVQPSPSGKGEASVAQEPQHAQEDASADISEPSPPEPFIFEADPEPSPQPEPEPSAPVPDLPISQDPPSTPTLDLNEHAKDHSYDDLLDLYFLSF

SEQ ID NO: 175342 - protein, 122 aa, Glycine max
  Coding DNA Sequence Number=SeqID_83657
HTFHRERRVQLREDEYTDFQEEIARRRWMPLVTPMAKFDPEIVLEFYANAWPTERECETCARGKANSMSLARGGTGPTGSMRRPLPSCYAHRGRISPGLQQEGGCGSCAPNVDDTAAQQYLA

SEQ ID NO: 175343 - protein, 136 aa, Glycine max
  Coding DNA Sequence Number=SeqID_83658
MTLLLSNILPSDHNSNLPLPKCQLVYAILARMSVHVAQLIADAIYLFAGMPPTRHPLDPDKSNRALGFPALITGLFQSFGVSVAPNQFRAEVAWPRDWPEAQTGEAPAKAPGDGEEARMDEEMTDLLDFLGGSGAT

SEQ ID NO: 175344 - protein, 121 aa, Glycine max
  Coding DNA Sequence Number=SeqID_83659
MVIFHHGDVTEEKGEENVPWIRSLERMLQWRKRKKEKDKGGKGREKLNFELCLTRLFVEAMPFKVILMMPKNQELSKFQRFKNQVSRIKIQDSRIKFQESRFKNHQDQDSRIKRRLNQDKY

SEQ ID NO: 175345 - protein, 77 aa, Glycine max
  Coding DNA Sequence Number=SeqID_83660
GFGPIQIVEAKLHDESRLIQRCFDDNKDDDKGDDKKLKGQSKNEFKMFKIESRTFQDSRGKLISRIKDQAFKNQEKT

SEQ ID NO: 175346 - protein, 87 aa, Glycine max
  Coding DNA Sequence Number=SeqID_83661
AQSIIVRSVPEDEPRRERVYGRAVGDDADEFTSVTDRLGAEFRVQERALLVSADREQKIQSKPEWALALNLNLLAGTIDLNPITLPS

SEQ ID NO: 175347 - protein, 198 aa, Glycine max
  Coding DNA Sequence Number=SeqID_83662
MTLTYKNRRITRPFRLARFGDDADAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPSILTLFRSPMNCVFVHVSSTFEFGAMRSDCLLQFSILNPFSEPMNCVFVHASSTF

SEQ ID NO: 175348 - protein, 482 aa, Glycine max
  Coding DNA Sequence Number=SeqID_83663
SGPWHADGQQRPQGGLPQRHPHHDDQRGRRDLEPSVHRLRQFACGGRRNGGNPPHVHARVPQPAGCDHPVRAAGSRDHPARGRQVPDAARRPVARAPRRSRVHHGPARAPGQGRLRPADGRQADAAPDPGHHPARAGRRAAVRQAGQRWQDWKQQGRLRPPLSCPGSAAAAARFALEPLGIDQLDARDLAAAATGVQSASALAAQLVSLLAVGPEAEAGGQHGRRAAVAEMHDIVVFAGAKQDVLVGAGANDLLFAGQWYALRRRGVGGMGGRRQQGGGRQGQGDEQGREVHGGAGGGDPDWIGSQDAAAAANANLPQAGLTDVTVRSVTMTFGASGGDRTESLLAPLVAAILDDECDRFMRNVQSLLECAAHVWDLALHGQIQWVECVHAGADQAGLAEPSAVRALAGVAAAGDGLRVQDDQVGHARSAFCEERVESRVPARCRISDKDENRTISVPRIFFRARQRASSEAGPVGVAHCAD

SEQ ID NO: 175349 - protein, 109 aa, Glycine max
  Coding DNA Sequence Number=SeqID_83664
IMPARLSVDPEKSNRVLGFPALIMGLCQFYGVPVTPSKVIKPPTNRAFIKKYCAPRQAQGETPQQPGDGRQQATNAPPPPPKPLSSSTKAGALPMTCGRPVGNQVQSQR

SEQ ID NO: 175350 - protein, 144 aa, Glycine max
  Coding DNA Sequence Number=SeqID_83665
MTVRLRDNSNCDILITVWEDYAIQLHDAIDKNLLLQEPLVVMLTLGKIKDATEIHEFRQSLSVPFYSGGIIHDKDGSQSQSSQSNVVEKILQNAQVVSIGEINNLRQLTKSSLMLYGVMTIVLTVQPHLIHQKVAQLAVLAIPV

SEQ ID NO: 175351 - protein, 172 aa, Glycine max
  Coding DNA Sequence Number=SeqID_83666
  Gene Ontology: Mol. function=protein dimerization activity
  Homolog annotation: Hit_ID=A3BRV8; Match level="QueryCoverage=35%, HitCoverage=9%, E-value=8e-10, Identity=47%"; Hit description =Putative uncharacterized protein
  Pfam annotation: Domain name=zf-C2HC_plant; Domain location=99-156; Score=8.7; E_value=0.0039; Accession=PF07567.3; Description=Protein of unknown function, DUF1544
MGYMPFKLLDLPIGASSRRCKFKKTRTGHPCEYDSGATRCPLLLLSSDTVEQIALLRLLLAVLASASIAAKCRVRFLPRAEMSASSPSQAKEQDDDTKPLWIYVTKIKSVGGGGNYEIKCNICDFTFNGSYTRVRAHLLKMTGNGVRVCQKVTIVKLIDLKKIDNEVTLRVE

SEQ ID NO: 175352 - protein, 81 aa, Glycine max
  Coding DNA Sequence Number=SeqID_83667
MTMITNSSSVPKGFYKDSGNLKRVAWGLDVGTAPLELVGLGSSSSMDSFASWKMNGSKMEKEEREETPLQGEDESRRSSPP

SEQ ID NO: 175353 - protein, 84 aa, Glycine max
  Coding DNA Sequence Number=SeqID_83668
MANLATSLSFFTFKLLALASGSSVGNIAIYWGQNGNEGTLVRHVPQENRLQRTFKLSVFTAKAYTPKSLSGFLPPDSGPTQKIF

SEQ ID NO: 175354 - protein, 52 aa, Glycine max
  Coding DNA Sequence Number=SeqID_83669
MVLNLGDHGSKEAICLLKCHLSSLSHSIEMEKEEREETPLQGEDESRRSSPP

SEQ ID NO: 175355 - protein, 202 aa, Glycine max
  Coding DNA Sequence Number=SeqID_83670
  Homolog annotation: Hit_ID=A6H5N3; Match level="QueryCoverage=24%, HitCoverage=71%, E-value=3e-10, Identity=73%"; Hit description =Putative uncharacterized protein
LADAYSPDTVMASSPGKEVHDPPSVADHPLGPATDHRLGKLLPHQLANQTRAPPRADSSFCSSAYGVLAAVSSCCSPPKGRIELSMRFLVALLIASLFVDKADSEFSSIPRHNLYPGASYSTGVRSQKYSPPTPRARTDNFHHVKRPAPIALPTVAQPEWRMGPPCSGALSAAGVVVTRSVTATLASADVRRCFCRYAPPRQ

SEQ ID NO: 175356 - protein, 47 aa, Glycine max
  Coding DNA Sequence Number=SeqID_83671
MWTTTGEKLAAQLAQASKVASSRSNSLLEESSGGPKWAWLLFAPPFY

SEQ ID NO: 175357 - protein, 99 aa, Glycine max
  Coding DNA Sequence Number=SeqID_83672
  Gene Ontology: Mol. function=peptidase activity; Biological process =DNA integration
  Homolog annotation: Hit_ID=A5B612; Match level="QueryCoverage=70%, HitCoverage=24%, E-value=1e-13, Identity=41%"; Hit description =Putative uncharacterized protein
MASSNFLFPKGNSMNRPPIFNGVGYHYWKTHMQIFIEAIDLNIWEAIEIGPYIPTMVEGNATIEKPREQWDEEERKMAWMNMLEYQTARMQKKCGIPYK

SEQ ID NO: 175358 - protein, 96 aa, Glycine max
  Coding DNA Sequence Number=SeqID_83673
  Homolog annotation: Hit_ID=A7QS05; Match level="QueryCoverage=32%, HitCoverage=1%, E-value=2e-08, Identity=87%"; Hit description =Chromosome undetermined scaffold_155, whole genome shotgun sequence
MEMIALLIFDECHHAQVKSNHAYAVIMKVFYGYRARIRNHGHSCFLRETCRASCINESANARGEAVCVLGALPLPRSLTRCARSFGCGERYQLTQR

SEQ ID NO: 175359 - protein, 243 aa, Glycine max
  Coding DNA Sequence Number=SeqID_83674
  Gene Ontology: Mol. function=transporter activity; Cellular component= cell outer membrane; Biological process=transport
  Homolog annotation: Hit_ID=A5FJU2; Match level="QueryCoverage=98%, HitCoverage=25%, E-value=2e-65, Identity=53%"; Hit description=TonB -dependent receptor, plug precursor
  Pfam annotation: Domain name=Plug; Domain location=46-169; Score =84.9; E_value=2.6e-22; Accession=PF07715.6; Description=TonB -dependent Receptor Plug Domain
MRHFKNRSIIASATLISTFYFAQSDTLKSKKIDEVVLLGSRGSGRSLTDTPVPVDVINISKILKQSPVNNISQALNYIVPSFSSTSHTVNDGTDFVDPAQLRGLGPDQVLVLLNGKRRHQSSLINVTLTPGRGSVGTDLNAIPAFALDKIEVLRDGASAQYGSDAIAGVVNLGLKKRLGLSGQLFLGGYASPVTNNFSGGLDGETISLDLNYGFKLGKQGFFNITTSTQYRDPYSRAGLPKMG

SEQ ID NO: 175360 - protein, 196 aa, Glycine max
  Coding DNA Sequence Number=SeqID_83675
MGDLEEVQEQMKADMSALKEQMTSMMGIKQLMESNAATAAAVSSAAEADPTFPTTTHHAIPNMVGRERNTSGHISNPHPGYNRGTYPYGLPPNYTPPVILEGEPPRHPDEDHREQAQGDVDSYSPFPAKGQAPNALPQPNITGEPRNHPTQPMFLSTGGPPRAAKGKGKLDLIEERLRAVEGFRDYPFIDMTDLCL

SEQ ID NO: 175361 - protein, 55 aa, Glycine max
  Coding DNA Sequence Number=SeqID_83676
  Homolog annotation: Hit_ID=A6FJQ2; Match level="QueryCoverage=69%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARACLRS

SEQ ID NO: 175362 - protein, 78 aa, Glycine max
  Coding DNA Sequence Number=SeqID_83677
MHYIIVQILLPRSSNLAQALEEDLILMWAFLTDRQINWAHLVRYPMHKALQTNAPLPYPQKQDLPPLIPDKRTPSPPP

SEQ ID NO: 175363 - protein, 108 aa, Glycine max
  Coding DNA Sequence Number=SeqID_83678
MGSNFNGKPSAKPMDFQLVPTVKEFEEILGCPLGGRKPYHHLVGVPRKCWRKGQRPWKIKANGLSFIDILALLIFGVVLFPNIEGLVDLAVIDAFLAFHHGKESPVGH

SEQ ID NO: 175364 - protein, 178 aa, Glycine max
  Coding DNA Sequence Number=SeqID_83679
  Gene Ontology: Mol. function=beta-lactamase activity; Cellular component=plasma membrane; Biological process=beta-lactam antibiotic catabolic process
  Homolog annotation: Hit_ID=P62593; Match level="QueryCoverage=96%, HitCoverage=94%, E-value=1e-60, Identity=98%"; Hit description=Beta -lactamase TEM precursor
MSIQHFRVALIPFFAAFCLPVFAHPETLVKVKDAEDQLGARVGYIELDLNSGKILESFRPEERFPMMSTFKVLLCGAVLSRIDAGQEQLGRRIHYSQNDLVEYSPVTEKHLTDGMTDHFCARPFRLAGLLLINLEPGERGSRGIIAALGPDGKLSRIVVIYTTGSQATMDERIDRSLR

SEQ ID NO: 175365 - protein, 468 aa, Glycine max
  Coding DNA Sequence Number=SeqID_83680
  Gene Ontology: Mol. function=phosphogluconate dehydrogenase (decarboxylating) activity; Cellular component=nucleus; Biological process=pentose-phosphate shunt
  Homolog annotation: Hit_ID=A8GBV6; Match level="QueryCoverage=60%, HitCoverage=93%, E-value=1e-97, Identity=67%"; Hit description=2 -hydroxy-3-oxopropionate reductase
  Pfam annotation: Domain name=3HCDH_N; Domain location=128-268; Score=- 83.3; E_value=0.0039; Accession=PF02737.9; Description=3-hydroxyacyl -CoA dehydrogenase, NAD binding domain
  Pfam annotation: Domain name=ADH_zinc_N; Domain location=124-256; Score=-12.1; E_value=0.0078; Accession=PF00107.17; Description=Zinc -binding dehydrogenase
  Pfam annotation: Domain name=AlaDh_PNT_C; Domain location=104-245; Score=-52.5; E_value=0.018; Accession=PF01262.12; Description =Alanine dehydrogenasePNT, C-terminal domain
  Pfam annotation: Domain name=DAO; Domain location=128-341; Score= -60.3; E_value=0.096; Accession=PF01266.15; Description=FAD dependent oxidoreductase
  Pfam annotation: Domain name=NAD_binding_2; Domain location=126-289; Score=201.4; E_value=2.1e-57; Accession=PF03446.6; Description=NAD binding domain of 6-phosphogluconate dehydrogenase
  Pfam annotation: Domain name=PDH; Domain location=131-375; Score= -125.3; E_value=0.1; Accession=PF02153.8; Description=Prephenate dehydrogenase
  Pfam annotation: Domain name=ThiF; Domain location=125-262; Score= -52.3; E_value=0.056; Accession=PF00899.12; Description=ThiF family
  Pfam module annotation: Pfam domain module=3HCDH_N::ADH_zinc_N::AlaDh_ PNT_C::DAO::NAD_binding_2::PDH::ThiF; Domain location=128-268::124 -256::104-245::128-341::126-289::131-375::125-262
VGHHRQIVTFTDLLRQRQRGGAGIQINTAIGGNLPRRQPADGDFLPAEHPLFGLVRRFARHPLGRLHAARDRLHRALFLQLLQIAADRHMRHPQPFGQLGNADDAAFGYQRKNLLMAFYSMTHPGNYAVCVIGLGAMGMGAARSCLRAGLTTYGADLNPQALAALQQAGAKHASTSARDFAAELDAVLLLVVNAAQVKQILFGEQGLAPKLKPGTAVMVSSTISADDAKQIEQRLLDYGLPMLDAPVSGGAAKAEEGQMTVMAAGADATFERLQPVLDAIAGKVYRIGEAIGLGATVKIIHQLLAGVHIAAGAEAMALAARAGIPLDVMYDVVTHAAGNSWMFENRMRHVVDGDYAPKSAVDIFVKDLGLVADTAKALHFPLPLASTAFTMFTAASNAGYGKEDDRGNLMLLGVIADDFTGATDIASFLVQNGLPTVQLNGVPQDETPVSAHAAVIILKSRSCPAEQA

SEQ ID NO: 175366 - protein, 177 aa, Glycine max
  Coding DNA Sequence Number=SeqID_83681
MRGAPSEEGIAPFIARGFSDLNAKMLQRVRKAWNAVQRNDKELRGSNNGVIGGFQVRKRLKSLSNNKLKLRRAERDESRLESMILEDKLKYKEKLNLAASREQRLEDNHAKVSVMQWEREVRERVTNSLHREAMMWMDRFAFTLNGSQELPRLLAKAKAMADVYSAPEEVHGLFDYC

SEQ ID NO: 175367 - protein, 249 aa, Glycine max
  Coding DNA Sequence Number=SeqID_83682
  Homolog annotation: Hit_ID=A5ATL8; Match level="QueryCoverage=21%, HitCoverage=42%, E-value=1e-17, Identity=84%"; Hit description =Putative uncharacterized protein
  Subcellular localization annotation: CTP_CleavageSite=76; ConfidenceScore=5.48e-01
SANSVPAAAVRQRMQALSGMIGRKASVGGFLSSPSNPKAQPWTGGGNYQAGVRYPSSPSRKRWILGAVRIDPCNAVANALSIPPGEYRRTLPGLDMTRILLKERGAFGNADTGGAWLSSARATAGDKPEEGEDDVKSSCPLMPWATHVLQWTGQRIAIPRGHTAVNSFPGLVHTARHTMGAGHARSRYLNRKEGDAEGRASDWSEVVTRKERDGVSLAFGIAGPGGRPARRAISSVVERAPDNCVVVPG

SEQ ID NO: 175368 - protein, 151 aa, Glycine max
  Coding DNA Sequence Number=SeqID_83683
MSLKLPYFPELVKVFYNNLKIQDGVLYSEVHNIPIVVDQSLFYSLTKLPNQGVPFEGTLVDDWKFDYSSHDACRMVYNDQTDMTDRLLVGSFTFDCCIMHYIIVCIFLPRSSNLAQSSEEDLILLWALQTGRQINWAHLVWYRMHKALRAN

SEQ ID NO: 175369 - protein, 153 aa, Glycine max
  Coding DNA Sequence Number=SeqID_83684
MMGYAPSSFADLVFAGERIEVGLKRGKFDHPSLMNAKNRANEEDENEGETLVVTVIPTRPNFPSSQQCHYSANNNPSHYPPPNHPQRPSPNQPQDLLAARPMPNTTFSTNQNPNQEMNFTMKKLVEFTPILVSYVELLPYLLDNSMVAITPTK

SEQ ID NO: 175370 - protein, 87 aa, Glycine max
  Coding DNA Sequence Number=SeqID_83685
MKTITSSFEGMSNQPAPRWVEPKSHVQTGAYECEYYVMHWMWCIVTGGLKDDWNKWFSDGSPLDVEAITTLRQKWATFFLSIRKSGC

SEQ ID NO: 175371 - protein, 506 aa, Glycine max
  Coding DNA Sequence Number=SeqID_83686
  Gene Ontology: Mol. function=hydrolase activity, hydrolyzing O -glycosyl compounds; Biological process=carbohydrate metabolic process
  Homolog annotation: Hit_ID=Q2HU62; Match level="QueryCoverage=100%, HitCoverage=93%, E-value=1e-166, Identity=50%"; Hit description =Glycoside hydrolase, clan GH-D; Ricin B-related lectin
MPPRGWNSYDSFNWIISEEEYLQNVNIVSQQLLAHGYQYAVVDYLWYRSLKGDKNSLGFDVIDKWGRMLPDPERWPSSRGGRGFTDVGNKVHRTGLKFGIHLMAGISTQAFNNNTPILDTQTGQPYMESGRVWKARDIGIPSRPCKWMSNGFMAINTKTGAGKAFLRSIYELYASWGVDFVKLDCVFGDNLDLGEITSVSEILNGLNKPIALSLSPGVSATPQMAKMVSNLVNTYRVTGDDWDEWSAILAHFNIARDFAASNLIGGKGLKGKSWPDLDMLPFGWLTDPGAHEGPYRFTRLTQDEQRTQFPHITRLNDVKTKRHNVTKVQFTYSLGLTECTDPKAYGWSSEKYYQDLERICYKSPKHDQEEPFCVHKRELPTASSKQTSIQSEQIWKLKSNGTLVNGHSGMCATVEHVLAEGYPNRIRSWIATGRKGETYVAFFNLSNEKTTISASIIDLAIVYPGRRKFILCSGNEMWSGRTIRTNNMFSAEVPGHGCALFVLQCS

SEQ ID NO: 175372 - protein, 383 aa, Glycine max
  Coding DNA Sequence Number=SeqID_83687
  Gene Ontology: Mol. function=metal ion binding; Cellular component =cytoplasm; Biological process=red or far red light signaling pathway
  Homolog annotation: Hit_ID=P93471; Match level="QueryCoverage=100%, HitCoverage=77%, E-value=1e-124, Identity=85%"; Hit description=E3 ubiquitin-protein ligase COP1
  Pfam annotation: Domain name=WD40; Domain location=154-192; Score =10.9; E_value=1.4; Accession=PF00400.23; Description=WD domain, G -beta repeat
  Pfam annotation: Domain name=WD40; Domain location=196-235; Score =21.1; E_value=0.0041; Accession=PF00400.23; Description=WD domain, G- beta repeat
  Pfam annotation: Domain name=WD40; Domain location=247-284; Score =35.0; E_value=2.7e-07; Accession=PF00400.23; Description=WD domain, G-beta repeat
  Pfam annotation: Domain name=WD40; Domain location=288-326; Score =9.3; E_value=2.2; Accession=PF00400.23; Description=WD domain, G -beta repeat
  Pfam annotation: Domain name=WD40; Domain location=342-380; Score =2.4; E_value=16; Accession=PF00400.23; Description=WD domain, G-beta repeat
  Pfam module annotation: Pfam domain module=WD40::WD40::WD40::WD40::WD4 0; Domain location=154-192::196-235::247-284::288-326::342-380
MEQEEAERNMQILLDFLHCLRKQKVDELKEVQTDLQFIKEDINAVEKHRMDLYRARDRYSVKLRMLDDSGGRKSWHSSMDKNNSGLISSPLNLRGGLSSGSHTKKNDGKSQISSHGHGVQRRDAITGSDSQYINQSGLSLVRKKRVVNEPTDAHCPVVEMSTRSKLSCLSWNKYAKNQIASSDYEGIVTVWDVTTRKSLMEYEEHEKRAWSVDFSRTDPSMLVSGSDDCKVGSADHHIHYYDLRNISRPVHVFSGHRKAVSYVKFLSNDELASASTDSTLRLWDVKENLPVRTFKGHANEKNFVGLTVSSEYIACGSETNEVFVYHKEISRPLTCHRFGSPDMDDAEDEAGSYFISAVCWKSDRPTILTANSQGTIKVLVLAA

SEQ ID NO: 175373 - protein, 413 aa, Glycine max
  Coding DNA Sequence Number=SeqID_83688
  Homolog annotation: Hit_ID=A5BAD4; Match level="QueryCoverage=79%, HitCoverage=90%, E-value=1e-79, Identity=50%"; Hit description =Putative uncharacterized protein
  Pfam annotation: Domain name=IQ; Domain location=165-185; Score=24.4; E_value=0.00042; Accession=PF00612.18; Description=IQ calmodulin -binding motif
MSEKLCYACFATASDGYGSKMLNDFKNRLVSELNNSKPVIFKGWKVDKNAFTCELRKLKMGFTGELVRSVFSKNRSDGSHENKVRRNSAKNRRMLSVRSFLCGDEFNSVLAENDSASVKSSEVTVSQSVHEGLLNDEGDTESEETVENVAQNRPSSNSKKSLNEEEAAVLIQSAFRGFLLRRQNGEIKSQTGKDEFNLVTESPDKKSIGTSIDVQTSNSTEVFSVEGELKGICHRIQRRTRTQAIKQKEDWDDSTVSSYVSKMRMQNRMEASTRRERALAYAFSQQRWMATRLPETSSVESHAMKQYDPSNGSHKFTIMTRFFDAAGEEKESCGSNEVPLHFDNYSINSREEKVSFKPHTPKTNFKARRTVSRRKTVPSYQFHEEQPKWGAVIVVVIIAAIVMVIVAVIVVGM

SEQ ID NO: 175374 - protein, 264 aa, Glycine max
  Coding DNA Sequence Number=SeqID_83689
  Gene Ontology: Mol. function=endonuclease activity; Cellular component=chloroplast; Biological process=tRNA processing
  Homolog annotation: Hit_ID=A7PXC1; Match level="QueryCoverage=94%, HitCoverage=63%, E-value=1e-101, Identity=73%"; Hit description =Chromosome chr12 scaffold_36, whole genome shotgun sequence
MAYIGMLNANSILEKGGLPMYVASRGLFNLKPPTVFVPPCIKEDVEKLLDIHRTMGQVELNAEVVALDVGMFHLSFVNDQEISSRNDVQNFILGETYEIRNNLVVRPFKTQHVIPSQGYVVYSIRKKLRKQYAHLNGKQIEKLKKSGVEITDMILSPEVAFTGDTTSDFMLDPCNADALRAKILITEATFLDDSFSIDHARQHGHTHLFEIIANAQWIRNKAVLLTHFSPRYTIEDIRQAASKLQSRLSAKVVPLTEGFKSMYS

SEQ ID NO: 175375 - protein, 169 aa, Glycine max
  Coding DNA Sequence Number=SeqID_83690
  Gene Ontology: Mol. function=protein tyrosine/serine/threonine phosphatase activity; Biological process=protein amino acid dephosphorylation
  Homolog annotation: Hit_ID=A7PXB9; Match level="QueryCoverage=66%, HitCoverage=41%, E-value=3e-57, Identity=90%"; Hit description =Chromosome chr12 scaffold_36, whole genome shotgun sequence
MRKRERENPCGVCGHYHKYEEGEVCSICGHRIPVGSEKTSIQVSAFPSVVLPEFLYLGSYDNASRSELLKTQGISRILNTVPSCQNLYKNSFTYHCLPDDKTLPFDEAIQFLVVKGMICASISAAMTATRNVIQRLHKEWDLPMTHCDGAIMPQMRAIDYSVIDMLCAA

SEQ ID NO: 175376 - protein, 403 aa, Glycine max
  Coding DNA Sequence Number=SeqID_83691
  Homolog annotation: Hit_ID=A7Q7N8; Match level="QueryCoverage=98%, HitCoverage=68%, E-value=1e-114, Identity=53%"; Hit description =Chromosome undetermined scaffold_60, whole genome shotgun sequence
  Pfam annotation: Domain name=mTERF; Domain location=59-378; Score= -27.5; E_value=2.6e-06; Accession=PF02536.5; Description=mTERF
MGKFFKEAKEIFGYASGVLLSKLEAYENLGLRKSTVVKLVVCCPLLLVGDVNFEFVSVLDWLKRIGIESDWMVNYLSCSRTYSWKRMLDAMLFLHKVGYSEEQMHNLFRENPKLLLEGFGRKVYLVFGRLLKVGVEMNVVYSYFVEYPNILLNKCANDMLRVIDFLGAIGMGKDDITHILSKYMHLLITRSLKGHKTVCQELKVGKADLYQIIKDDPLKLISLASKQEQKGNGKVDSHDPRNYLEKTTFLLKLGYIENSEEMAKALKMFRGRGDQLQERFDCLVEAGLDYNSVIEMIKRAPMILSQNKAVIQKKIDFLKNVLDYPLEGLVGFPTYFCHDLDKIVERLSMYAWLKERNAVNPTLTLSTIIASNDKRFVKYFVNVHPQGSAIWKGLKRLSNKDKN

SEQ ID NO: 175377 - protein, 107 aa, Glycine max
  Coding DNA Sequence Number=SeqID_83692
  Gene Ontology: Mol. function=nucleic acid binding; Cellular component= nucleus; Biological process=regulation of transcription
  Homolog annotation: Hit_ID=A2Q2U3; Match level="QueryCoverage=100%, HitCoverage=22%, E-value=1e-51, Identity=91%"; Hit description=CENP -B protein; Homeodomain-like
  Pfam annotation: Domain name=DDE; Domain location=1-106; Score=-13.5; E_value=1.4e-05; Accession=PF03184.10; Description=DDE superfamily endonuclease
MTSVLFDEYVRSFNQMMYGRRVLLMVDNCPAHPRNIEGLRNVELFFLPPNMTSKIQPCDAGIIRAFKMHYHRRFCRKILEGYKVGQSDPGKINVLDAINSAIPAWMI

SEQ ID NO: 175378 - protein, 142 aa, Glycine max; identical to SEQ ID NO: 110718
  Coding DNA Sequence Number=SeqID_83693
  Homolog annotation: Hit_ID=A2Q2U3; Match level="QueryCoverage=95%, HitCoverage=28%, E-value=3e-64, Identity=91%"; Hit description=CENP -B protein; Homeodomain-like
  Pfam annotation: Domain name=CenpB-DNA-bind; Domain location=77-131; Score=46.8; E_value=7.5e-11; Accession=PF09091.2; Description =Centromere binding protein B, DNA bind

SEQ ID NO: 175379 - protein, 298 aa, Glycine max
  Coding DNA Sequence Number=SeqID_83694
  Gene Ontology: Mol. function=nicotinate-nucleotide diphosphorylase (carboxylating) activity; Cellular component=cytoplasm; Biological process=pyridine nucleotide biosynthetic process
  Homolog annotation: Hit_ID=A7MIF4; Match level="QueryCoverage=99%, HitCoverage=100%, E-value=1e-101, Identity=65%"; Hit description =Putative uncharacterized protein
  Pfam annotation: Domain name=QRPTase_C; Domain location=130-294; Score=306.3; E_value=5.7e-89; Accession=PF01729.10; Description =Quinolinate phosphoribosyl transferase, C-t
  Pfam annotation: Domain name=QRPTase_N; Domain location=44-128; Score= 116.1; E_value=1e-31; Accession=PF02749.7; Description=Quinolinate phosphoribosyl transferase, N-terminal domain
  Pfam module annotation: Pfam domain module=QRPTase_C::QRPTase_N; Domain location=130-294::44-128
MVSRRYNPEHRRQELLKRIQLDIPETVARALQEDLGGDVDADRDITAQLLPQAAQAVARVITREAGVFCGKRWVEEVFIQLGNNVSITWHVEDGQPLVADQLLFELRGPARLLLTAERTALNFVQTLSGVATAVNRYVALLSGSNTQLLDTRKTLPGLRTALKYAVLCGGGQNHRLGLSDAFLIKENHIIASGSVSKAVEKALWLHPDVPVEVEVESLSELQLALASGADIIMLDNFTLAMMQQAVTLTAKRALLEVSGNVTETTLPQIAATGVDYVSVGALTKHVQALDLSMRFREV

SEQ ID NO: 175380 - protein, 126 aa, Glycine max
  Coding DNA Sequence Number=SeqID_83695
MGTNQTGKRFYQVKIKGLDITSIKELGRLMGPLQMQASRKTYGKILDLTIAEISPEAIASLTQYYDQPLRCFTCGQGSGERIGPREANSKRHSGPTTEVLRKQGDGYGESRGVGLVYGCISIANLW

SEQ ID NO: 175381 - protein, 82 aa, Glycine max
  Coding DNA Sequence Number=SeqID_83696
MLVRMIRTRLLVTLRAKSYLGMHSSWPMASCCNQYSVSQFFVFNDHSISISAIGLSAYPPLSAASACLAQRRIWQSISIKAT

SEQ ID NO: 175382 - protein, 132 aa, Glycine max
  Coding DNA Sequence Number=SeqID_83697
  Homolog annotation: Hit_ID=Q9SJS1; Match level="QueryCoverage=56%, HitCoverage=10%, E-value=5e-07, Identity=38%"; Hit description =Putative Athila retroelement ORF1 protein
MEATLRRNRAERRRKLLQDRTTASILEEETHFFDSLSPDSPSSRESANQHSEAVTMADEHDQRTTLEDYSSGSVPQFFTSISHPEVQAHNITYPHSFIHLIQGNLFQGLPNEDPYAHLATFIEICNTVKIAS

SEQ ID NO: 175383 - protein, 138 aa, Glycine max
  Coding DNA Sequence Number=SeqID_83698
MVGYTPSSFADLVFVDERIEVGLKRRKFNHPAWTNKKTGANEEGENEGETHVATVIPTWPNFPPAQQCHYSANIISSHYPPPSHPQRSSLNQPQSLSTALPMMNTTFSTNQNTNQEMNFAAKKPVEFTTIPVSYAIKW

SEQ ID NO: 175384 - protein, 50 aa, Glycine max
  Coding DNA Sequence Number=SeqID_83699
MDGEELPSSVNSKVLRDGCKWRIGSRPTDRRPFPGAGQAEDVAARQPSIL

SEQ ID NO: 175385 - protein, 320 aa, Glycine max
  Coding DNA Sequence Number=SeqID_83700
  Gene Ontology: Mol. function=metal ion binding; Cellular component =integral to membrane; Biological process=metal ion transport
  Homolog annotation: Hit_ID=A4WDB5; Match level="QueryCoverage=82%, HitCoverage=80%, E-value=1e-107, Identity=73%"; Hit description=High- affinity nickel-transporter precursor
  Pfam annotation: Domain name=NicO; Domain location=16-263; Score =257.9; E_value=2.2e-74; Accession=PF03824.7; Description=High -affinity nickel-transport protein
MSGLLKAVAENPTKAGGSLLAFSFLYGVLHALGPGHGKIVITTWLATHPSKLKSSIGLTLASSLLQGGVAIGLVVVVLSLLQLPARQLHMSSFWLEKGSYALVGVLGLILCWRALKRLRALLKKPTFKSFTPHHVHDAHCGCGHQHLPTQEQLQSGDDWRARLMIVLSMGMRPCSGAIMVLLFSKVIGVFGWGMLSALAMAAGTSLTISSLALLVHSFRQLAVKLSGSKTPVLWRQIGWTTLALAGGVILLVAAVTMWMSAVPRIAQLITHVCQHGFNNAWVTCNDVAGRHIVMAAGEITHDRASFTCDQLARCKIPWLQ

SEQ ID NO: 175386 - protein, 267 aa, Glycine max
  Coding DNA Sequence Number=SeqID_83701
  Homolog annotation: Hit_ID=Q1BMR7; Match level="QueryCoverage=25%, HitCoverage=21%, E-value=5e-07, Identity=50%"; Hit description =Binding-protein-dependent transport systems inner membrane component precursor
HAVGGGVRPGDRRGVGGVAQPLGGSPRHDAGGVGDLVPGLCARYAADAGVLGRTGVAADGGRRQLATLHSAFGHPGGGGGGGDGAFHPRFVRRGAAGRLHAHRARQGRAGKRGGDETRPAQRDDPGGDHDGAAVRLPARRFDRGGEGVQLAGIGAVAGGLGGDARLPGDPGRGAAVLAGIHPDQPAALAAQRRTEGDAAYRPQCGTHAVGRVLAAFSPPAGGAGRRSVGAAADCGGAAGALSGTVRCGKLFRLRSAERGAFADALAG

SEQ ID NO: 175387 - protein, 354 aa, Glycine max
  Coding DNA Sequence Number=SeqID_83702
  Gene Ontology: Mol. function=oxidoreductase activity; Biological process=hydrogen peroxide catabolic process
  Homolog annotation: Hit_ID=A4WG57; Match level="QueryCoverage=100%, HitCoverage=48%, E-value=1e-135, Identity=69%"; Hit description =Peroxidase/catalase
  Pfam annotation: Domain name=peroxidase; Domain location=29-354; Score=317.7; E_value=2.1e-92; Accession=PF00141.14; Description =Peroxidase
MLVTDLTLRFDPEFEKISRRFLNDPQAFNEAFARAWFKLTHRDMGPKARYLGPEVPKEDLLWQDPLPQATHQPTPDDITDLKAKIAASGLSVSQLVSAAWASASTFRGGDKRGGANGARLALAPQNGWAVNASVSRDVLPVLQKIQQESGKASLADVIVLAGSVGIEQAAAAAGVAVQVPFTPGRVDARQDQTDVESFNVLQPLADGFRNYRRVQGGSSTETLLLDKAQQLTLSAPELTVLLGGLRVLGTNFDGSAYGVFTDRVGVLSNDFFINLLDMRTAWRATDESAELFEGRDRQSGEVKYSATRADLVFGSNAILRALAEVYASSDAKQKFVNDFVAAWTKVMNLDRFDL

SEQ ID NO: 175388 - protein, 74 aa, Glycine max
  Coding DNA Sequence Number=SeqID_83703
  Homolog annotation: Hit_ID=A6FJQ2; Match level="QueryCoverage=51%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARVFPVTTFALKGLDDTPQPKSKAGA

SEQ ID NO: 175389 - protein, 237 aa, Glycine max
  Coding DNA Sequence Number=SeqID_83704
  Gene Ontology: Biological process=intein-mediated protein splicing
  Homolog annotation: Hit_ID=A8GCR3; Match level="QueryCoverage=53%, HitCoverage=21%, E-value=2e-65, Identity=96%"; Hit description =Putative uncharacterized protein
MARVAEQKGKNELALHLLGELDSAAQSITLTQWTPALLFEVKSRRLRLLRMKATRSETDKSRLQPEMDQLLAGLIALDPASSAVFMDDLTLRYYDAEMRYLLEAGEEFARAHPEQAAMLNLDKAGARDPYVERLFEGFAFLMGRLREKLDDDLPELTEGLVSLLWPHYLRTIPSMSVVEFTPDWREMKEPMRIVKGFEVNSRPIGEKGTRCPHIRMKRKPLIAPDGFMSRSSNISRR

SEQ ID NO: 175390 - protein, 152 aa, Glycine max
  Coding DNA Sequence Number=SeqID_83705
MTLLLSNILPSDRNADLPLRKYQFGSHPQDTQWTRKSPTGPWGFQLWLRASVGPTGRPFPPASSCRRGIGKDCACKTPSGLEEGQQDLGVASSKYGSLSVLGSACRPQQGHQAPLPIELSSRSTAPSGRRRAKHHSSLGMAGSGQQTHRHHL

SEQ ID NO: 175391 - protein, 411 aa, Glycine max
  Coding DNA Sequence Number=SeqID_83706
  Gene Ontology: Mol. function=S-adenosylmethionine-dependent methyltransferase activity; Biological process=tRNA modification
  Homolog annotation: Hit_ID=A4WBM8; Match level="QueryCoverage=45%, HitCoverage=57%, E-value=1e-90, Identity=87%"; Hit description=tRNA (mo5U34)-methyltransferase
  Pfam annotation: Domain name=Methyltransf_9; Domain location=1-189; Score=334.2; E_value=2.3e-97; Accession=PF08003.2; Description =Protein of unknown function (DUF1698)
GYHMWRMIGAGAQLVVGIDPMQLFLCQFEAVRKLLGDDRRAHLLPLGIEQLPALQAFDTVFSMGVLYHRRSPLDHLLQLKNQLVSDGELVLETLVIEGDENAVLVPGERYAQMRNVYFIPSAAALKNWLEKCGFVDVRIADYAITSVEEQRRTDWMTSESLAEFLDPHDSSKTIEGYPAPLRAVLRAPQRHRSAGRDKLRQESDVKDPDFGIEQVTGQATRKAGQIALFPLLPLLPAGHRAARVKQQSDAEIQQVHGTDAFQQPCAAAERSTSAVSKPGVSVSRNSIRDGASIVRRRTIPVLIFVGRTQMPLNGAFGKHFGLMQIAQRAIAHLVPQLALIHRSQSADRRGRGAVQPQFAPLIIVAVSIFTARAGGCHHQPLRIPAPGILAVGQFIAAARNTFFQPEVFIVA

SEQ ID NO: 175392 - protein, 128 aa, Glycine max
  Coding DNA Sequence Number=SeqID_83707
MVEEFEEILGCPLGGRKQYLFSGFYPSLARISKIVKISAQELDRGKQVENRVVGVPRKCLEAKARTLASQDEWAPFMDVMALLIFGVVLFPNVDGLVDLAAIDAFHAFHDHKESSVVTILVDLYDTFN

SEQ ID NO: 175393 - protein, 92 aa, Glycine max
  Coding DNA Sequence Number=SeqID_83708
MPSKIILMMPKNQELSKFQRIRSQKASTIKFSRFKIQEQSSFKNQDSRTIKIKIQESREDSIKTTQEFFTKSFTKEFYSLIIDYQKVVIDYQ

SEQ ID NO: 175394 - protein, 100 aa, Glycine max
  Coding DNA Sequence Number=SeqID_83709
MEAKCLKKKGKYGEGTNAKVKVKKRLSFELQNVAVGLSSTVGLSTYSPLSIALARLAQRRIWLSVPSARLSLRLVLSPISLTRAKREGGAKRNVAISEPI

SEQ ID NO: 175395 - protein, 121 aa, Glycine max
  Coding DNA Sequence Number=SeqID_83710
  Subcellular localization annotation: CTP_CleavageSite=53; ConfidenceScore=5.26e-01
MVTPPRSPPQSDGNMEPLPKKTRQSTHLRRLTLRSLDQPRPTVTVDPATGRASDSEKQKFHSFLGVVAQEKILIVHNNWKNVPETLKDMAWGDILAKFDIPEAEKAKKKVMSTVATRWRQI

SEQ ID NO: 175396 - protein, 63 aa, Glycine max
  Coding DNA Sequence Number=SeqID_83711
MDVGTGSGRTSINQSLILVSRIVMRIMKLAKYRLKAQVEKDKAPEWRRMKAQVEKDEGSSGDG

SEQ ID NO: 175397 - protein, 102 aa, Glycine max
  Coding DNA Sequence Number=SeqID_83712
  Homolog annotation: Hit_ID=A7UQU7; Match level="QueryCoverage=100%, HitCoverage=17%, E-value=7e-09, Identity=35%"; Hit description=IMP dehydrogenase/GMP reductase, putative
MTLLVSWVFVHLPSVGYSEPEDYVVEDLVATRWKPLRGTTHALLVRKRLDDLQMNVVVWCPYKKHRSVRPFAQQTLFSGFIRRETDVRPYCPERVLWQFGHV

SEQ ID NO: 175398 - protein, 86 aa, Glycine max
  Coding DNA Sequence Number=SeqID_83713
MTRGNPGDLQSFDPEIDRTFHRLVRHSVHLGHSMHFEHSVEGDSEYSDFENSTTNFYIENIAQPPPCERTLREMAAPDFTYESLCI

SEQ ID NO: 175399 - protein, 117 aa, Glycine max
  Coding DNA Sequence Number=SeqID_83714
MAASDHAILHDRTHVPTKRNLLELSSQDALLAQNKLLAKQLESLTETLSKLPTQLQVTQPSHSIVMQVGGCSICGGAHESSCCIPLDDDAKEVNYKGNQHKPMQVDFQFTSKVPILI

SEQ ID NO: 175400 - protein, 208 aa, Glycine max
  Coding DNA Sequence Number=SeqID_83715
MDRARLVYGLVMRMDMDVGSFISGQISQMAQSNSSRLGFPALITALCIARGIVPDSLTFESLSPAINLAYIRKNCWNPDDPTITFPGTYKTQARGPDVSAPSSSAPLVLAAPAPPTPLPAPFGTSAQSSNAMVSMLQSLHHGLCLMMQSIHNLAQHQPIISMEDFMAQVAWSEVQPSPLRGGEAPTAQEPQSDLEATPEAKADAEETP

SEQ ID NO: 175401 - protein, 489 aa, Glycine max
  Coding DNA Sequence Number=SeqID_83716
  Homolog annotation: Hit_ID=A7UQU7; Match level="QueryCoverage=61%, HitCoverage=66%, E-value=8e-29, Identity=26%"; Hit description=IMP dehydrogenase/GMP reductase, putative
  Pfam annotation: Domain name=DUF1723; Domain location=134-183; Score =43.6; E_value=7.1e-10; Accession=PF08330.1; Description=Protein of unknown function (DUF1723)
MEIGVLLGAPSIIVGAPSNLSERRPTASARRQREVAAVVEDAPHVDDAAEEVFQHVEEAVNDVEGFPGGPCDTSVLTTYADHVAIIIWNEDERPELKLSSHGRKVQKFGRPVAEIEGLVSTTGLRSLVACSLDTGDRGLIFAFVESWHKKTSSFHLLVGEVTITLDDVASLLHLSIIGAFHSFNTLHVDEAVLLLVELLKVTGDEARAEAVQCHGAYLHLLGCTIFANKSATHAHVVFLDAFRDLSQNGSYAWGDAALMHIVWIYENFPSIPEAFTKSDYDEKSPRVCRWTSTKASTKALLASTYHKRLDRLKTADVCWMPYERMVRQFGYVQMIPPHCAGLRLCFKDIDDRWIHFSDYLAPVGPICVVPGQCAHDYMEWFYIISHPFMRPGDPPRHSSVMQDGTYMEPDMSEIAVAATSMEEAPAQAPSDVEQPRHAMEDCQAIAERLERLLNLRIMTEGTEAHDVMQDCIRIAKGVTVDGNVYVRSR

SEQ ID NO: 175402 - protein, 177 aa, Glycine max
  Coding DNA Sequence Number=SeqID_83717
MEGRRKRRCTLSGASSFIMEGDQKFESSKPPAMLTIPVKTQTAIHIGDLLCNPLTRLHEAQPPELLRSKACNPQSMELASLTGGSQSAAHVTIPSGDLVTACMYRQCQWRFAQGHQTRHWFWQFGSCMHAFHPVAMHGEEKSNRKREDEKSEWVRITPTINPSVVKMEAGEILYIQG

SEQ ID NO: 175403 - protein, 482 aa, Glycine max
  Coding DNA Sequence Number=SeqID_83718
  Gene Ontology: Mol. function=metal ion binding; Cellular component =nucleus; Biological process=regulation of transcription, DNA -dependent
  Homolog annotation: Hit_ID=A7P2C9; Match level="QueryCoverage=57%, HitCoverage=91%, E-value=2e-85, Identity=59%"; Hit description =Chromosome chr1 scaffold_5, whole genome shotgun sequence
  Pfam annotation: Domain name=SBP; Domain location=180-258; Score =186.3; E_value=7.8e-53; Accession=PF03110.5; Description=SBP domain
MESWSYVPEEKGYLFSDEMEFSLDAFMRSRKALVEWDNKSNFVERDGFNSDREVVKSMEFVDLGFPDLLQKSFHGSLPLETSSYELDSNNSSKRGNSSTHVIALDSSMGEEESNSKHLSSLVESKTQDSSLIDLKLGRLADCKGASSDKVEKEGFTLTSIHPTTLSKRARTSSLPAQAPVCQVYGCNMDLSSSKDYHKRHKVCDAHSKTAKVIVNGIEQRFCQQCSRFHLLVEFDDGKRSCRRRLAGHNERRRKPQFDYMTGKQHKILQSYQGTKYLGSSLQNKPMFPFQDIFQSSILFPGKHAQISQSGRVKLEEDSIYSSQLTAPITLDQESSSCALSLLSDQSQYLSHHAACNPLTSHRVFSGICIPNRDGQISETPLRISSADKHAPNESFPCNTTSKEVIKNRSAATFSNTGHALRVHHGDDICQPSELLDVKHHFSSEHAATVDLFQLSSHLQRVEQQRNSVLVKWENEDYCFPTV

SEQ ID NO: 175404 - protein, 385 aa, Glycine max
  Coding DNA Sequence Number=SeqID_83719
  Gene Ontology: Mol. function=endonuclease activity
  Homolog annotation: Hit_ID=Q2HUP4; Match level="QueryCoverage=30%, HitCoverage=40%, E-value=1e-36, Identity=64%"; Hit description =Endonuclease/exonuclease/phosphatase
MAANQNSTSATPTFHLISQKLDDSNFLLWRQQVEPVIKSHKLQRFVMNPQIPMRFLTEADYPILPREHLDVILEGRPEEYSPMISVIKSNFEPLPIGEVEMLLLVHEALPLRITSFRKIGPIILEIAVEVTVVVAEIVVVVMQTFSAKFAINLVTQQQCIITAMILSIFQGNSSNTFGSEQNQGTNSNKDSQPSAMLVNSENQNPNSTTWIPDFGASFHGSFAILSRSQARIKGEGCVRLSTANQRAVWLEYSVKRARAAASPPGCSEKRIRFGTWNIGTLTGKSMEIVDVMVRRKINFMCLQETKWTGEKAKELDNSGFKLWYTGKIRSRNGVGIIVDKEWKKDVVDVRRVGDRIIVLKLVVGQDTFNVISGYAPQVGLAEHFK

SEQ ID NO: 175405 - protein, 174 aa, Glycine max
  Coding DNA Sequence Number=SeqID_83720
  Gene Ontology: Mol. function=metal ion binding; Cellular component =nucleus; Biological process=multicellular organismal development
  Homolog annotation: Hit_ID=A7P2D0; Match level="QueryCoverage=94%, HitCoverage=81%, E-value=5e-61, Identity=73%"; Hit description =Chromosome chr1 scaffold_5, whole genome shotgun sequence
  Pfam annotation: Domain name=YABBY; Domain location=9-162; Score =190.6; E_value=3.8e-54; Accession=PF04690.4; Description=YABBY protein
MNHEDKLTMDLVPPSEHLCYVRCNFCNTVLAVGIPCKRLLDTVTVKCGHCSNLSFLSTRPPSSQNQSIDHTTLSLQGFYSNAKKGQASSSSSSPTTSNESVSPKAASFVVKPPEKKHRLPSAYNRFMKEEIQRIKAANPEIPHREAFSAAAKNWARFIPNSPTSSVSATKVNAD

SEQ ID NO: 175406 - protein, 291 aa, Glycine max
  Coding DNA Sequence Number=SeqID_83721
  Homolog annotation: Hit_ID=A9PHX3; Match level="QueryCoverage=52%, HitCoverage=30%, E-value=3e-40, Identity=59%"; Hit description =Putative uncharacterized protein
MLAPSQSFFMPSLTRATVKGVHRHCQSCPTLPLKPPEKKVPHTIENTRKLDKIICKPDDDERIDIQLGMAIDSTKATLVVKCRLACEMVKCWQQAQDNIMNLPLDNGWGEKHCLFVKWKYVEAKLYEWRSIFWSKDYLKQIMEMKAATYYYHGLILDEGNTEKSHGMVVVALQAANEYFKEIFEQLSIIAALISLQGSKRSRTGVTESLSIATNISVQDAYMSDFGSMEVNNPAIIGVGNEPIRSYWNWDDDDRGMEMDIQAILSEFGVLVTSSKMMFCLLERYLNIYTTI

SEQ ID NO: 175407 - protein, 72 aa, Glycine max
  Coding DNA Sequence Number=SeqID_83722
MVENTHSARALEEVEDRAAARLETHLIKLAGNIQKALGYSLKDSLQELVKNMQEHNATYTSSGPIPHGQLWH

SEQ ID NO: 175408 - protein, 217 aa, Glycine max
  Coding DNA Sequence Number=SeqID_83723
  Gene Ontology: Mol. function=metal ion binding; Cellular component =plasma membrane; Biological process=cytokinin metabolic process
  Homolog annotation: Hit_ID=A7PM08; Match level="QueryCoverage=35%, HitCoverage=16%, E-value=7e-31, Identity=83%"; Hit description =Chromosome chr14 scaffold_21, whole genome shotgun sequence
  Subcellular localization annotation: CTP_CleavageSite=10; ConfidenceScore=5.48e-01
MQINLNVIFRSNSGSKRSTSVPPTIADETRSGASTNPKRSRFGDTKLRAPHPIYSVCLSQSLTNLLSERGLENRDLTSTKGKLLMEKTTAFNGLPCLVCFLQAHPKLDEIEREKWVFKGCLNVQRSDKVTEALACAGLESSNLIVGVDFTKSNEWTGKNSFNRQSLHHIGSGLNPYEQAISIIGKSLAAFDKDNLIPYFGFGDGISLNKFNLWSALF

SEQ ID NO: 175409 - protein, 144 aa, Glycine max
  Coding DNA Sequence Number=SeqID_83724
  Homolog annotation: Hit_ID=A7Q9A6; Match level="QueryCoverage=46%, HitCoverage=9%, E-value=6e-13, Identity=64%"; Hit description =Chromosome chr19 scaffold_66, whole genome shotgun sequence
TLGCELENGEFVPPEKPVMMSRRSEIENGEIAGERWKKGEAERGGVCFWKMEKGGATVRLVSNFLILQDRLVAKIRQSATESPNPKPKVGEIDTSPPFQSVKDAVSLFGEGAFSGEKPIFKKAKPYSAEETLDSVNSAYLLSLS

SEQ ID NO: 175410 - protein, 140 aa, Glycine max
  Coding DNA Sequence Number=SeqID_83725
  Gene Ontology: Mol. function=hydrolase activity, acting on acid anhydrides, catalyzing transmembrane movement of substances; Cellular component=integral to membrane; Biological process =metabolic process
  Homolog annotation: Hit_ID=Q43002; Match level="QueryCoverage=75%, HitCoverage=11%, E-value=9e-49, Identity=89%"; Hit description =Plasma membrane H+-ATPase
  Pfam annotation: Domain name=E1-E2_ATPase; Domain location=16-140; Score=-15.7; E_value=9.7e-08; Accession=PF00122.11; Description=E1 -E2 ATPase
MTWLAPKAKFAFGRNLFFLFAFIVSFLMSVFVKVLRDDARLLEGDPLKIDQSVLTGESLPVKKGPDDGVYSSSTCKQGEIEVVVIATGVHTFFGKAAHLVDTTNQVGHFQKVLTAIGNFCICSIALGMVVEIIVMYPIQD

SEQ ID NO: 175411 - protein, 145 aa, Glycine max
  Coding DNA Sequence Number=SeqID_83726
MDSSNEKMSGKRKVLGKNNEETRSYFTWDLEMERILADVLRDQRNLGNKGDGEWKRSTLNAVAVVLSTSFIVNVTLDNWHKSAKSFRFKVLQNWDDIVDLCAKDRATSHGAETAMDADEAMSRETNEVEFMGLGANATIDRRTKL

SEQ ID NO: 175412 - protein, 133 aa, Glycine max
  Coding DNA Sequence Number=SeqID_83727
MDATRLHAALGSKAVVGDERGREKPTSERKKSYGEGGGSVLRRRKRCEESVSRLIRQALKSVVFHLLAKPICWHSERHLFKPEIRFCEESLDWDSELCMSRVSRERKVQVSKSFERFCCVKICIDQSLKQEPV

SEQ ID NO: 175413 - protein, 233 aa, Glycine max
  Coding DNA Sequence Number=SeqID_83728
IHEGVLMSEIYGIKMVIDQSLFFDLTKLPSEGVPFEGALIDEWKFDFSVHDARRLVCTNQADMTGRLLADLIVMWAFHKGLQIDWAHLIRYRMHKALRLNAPLPYPHLVTLFLQHFNIPLDSEPYVPIKRSFLIGASVIASFGYIKEHDGSWVKKGARNIGEEGHEGEDSYLLSKILERFNGLQTFVGERFDTLELQVDMRFNEMESRMTKVEEDVSYIRLSFDLPPPPPPSS

SEQ ID NO: 175414 - protein, 69 aa, Glycine max
  Coding DNA Sequence Number=SeqID_83729
MDCHLSWALRIKEVFWQLLPSGWIKLFYGQGSCSMGNFAIKLGVNTVFEAEMLGAINAVEIACNMNWNN

SEQ ID NO: 175415 - protein, 119 aa, Glycine max
  Coding DNA Sequence Number=SeqID_83730
MEKFFKRVAWGDMLEVVIARQTSGVSGMFADLLSLGDMTGQMATPVEVIEISSSPASPTLSLSPPTSDAPTEASWDLIEHVVETTKGEAEWLIEESSKKNSKKDLDEDMRDVSSQESHC

SEQ ID NO: 175416 - protein, 90 aa, Glycine max
  Coding DNA Sequence Number=SeqID_83731
  Gene Ontology: Mol. function=transferase activity
  Homolog annotation: Hit_ID=Q2HUA0; Match level="QueryCoverage=51%, HitCoverage=19%, E-value=1e-13, Identity=86%"; Hit description=UDP-N- acetylglucosamine transferase subunit ALG14, related
MLPPFLILLRMLFMRKTRHRDEDGEQWCLCGHIAEMLNLLAVLQKGRLNPRFYIAAATDNMSLQKAQLLENSLAAEVLFFAMSLEVPFIQ

SEQ ID NO: 175417 - protein, 118 aa, Glycine max
  Coding DNA Sequence Number=SeqID_83732
  Homolog annotation: Hit_ID=A5C6E9; Match level="QueryCoverage=40%, HitCoverage=4%, E-value=3e-09, Identity=58%"; Hit description =Putative uncharacterized protein
  Pfam annotation: Domain name=zf-BED; Domain location=74-118; Score =42.0; E_value=2.1e-09; Accession=PF02892.6; Description=BED zinc finger
MAENMQIEEPSSHQPTSQSSDHPTPLSSHQPTPVESSTGTVEGPNNEPMQQPPSMEVDDHGVSSTKTGGGRLKSIVWNHFGKIKTVDGQDKAQCKYCKKLLGGASKNGTKHLHAHMEK

SEQ ID NO: 175418 - protein, 84 aa, Glycine max
  Coding DNA Sequence Number=SeqID_83733
  Gene Ontology: Mol. function=protein transporter activity; Cellular component=clathrin adaptor complex; Biological process=intracellular protein transport
  Homolog annotation: Hit_ID=A7NT73; Match level="QueryCoverage=46%, HitCoverage=8%, E-value=1e-11, Identity=84%"; Hit description =Chromosome chr18 scaffold_1, whole genome shotgun sequence
MQQQQQPSGPISSFCCKILFFFGLCLKRSQRLEQHAKDFGYVQTTSTEDLKSYVFNEPIVIDAARMPPLGPASILLVVMHDSID

SEQ ID NO: 175419 - protein, 104 aa, Glycine max
  Coding DNA Sequence Number=SeqID_83734
MAVLGWVVNVQDHVVVVPPPVERHRGRWLVWNLVHGQTISTPSSDDKASLSPTFGEAKENGLLCEGPHTPVLLMWTLDENIPLYDNAATPHVYLWQASRFLTYW

SEQ ID NO: 175420 - protein, 120 aa, Glycine max
  Coding DNA Sequence Number=SeqID_83735
MVVPKSENDARISLNYQGTSLESRLPQRKPVPLSVGFQRKTMVVRGGYWWLWVMEKKFGTLEMVLEEGRRRKWRFSKATRKAKSKTLKCFCSRERKRSSHARCLIEDCNGQIVDICPMNL

SEQ ID NO: 175421 - protein, 124 aa, Glycine max
  Coding DNA Sequence Number=SeqID_83736
MSVTKMIITLDDVSCLLHLPVTSKPIDDVLSQFDREAMKILPMTHLGIPIETDVATAAHTSVREVSLVIRRVLVVKVLASQRSLSRKLLKEASQGSFSRKPLNEAAPNHLGKSTLLHPLTVRSS

SEQ ID NO: 175422 - protein, 118 aa, Glycine max
  Coding DNA Sequence Number=SeqID_83737
MTCDHSLVLVRCLAPIIRQFVKFQDMPKNQKNIDAQSHPGPLGPSGIFLQKAVASGGSNPARLGELGGNHLPYFAINRGGSEEESGFSPFGTSLSFEFAWKNCFREENLSRGACETFP

SEQ ID NO: 175423 - protein, 137 aa, Glycine max
  Coding DNA Sequence Number=SeqID_83738
  Gene Ontology: Mol. function=protein serine/threonine kinase activity; Biological process=protein amino acid phosphorylation
  Homolog annotation: Hit_ID=A2Q533; Match level="QueryCoverage=89%, HitCoverage=39%, E-value=1e-12, Identity=35%"; Hit description =Putative uncharacterized protein
MWLSKKYGYVFTWRLLKDRLPTKGNLIRRNVAIQEAVCPLCGQVQEEVGHLLFNCKRTIGLWWKSTRWIQAVGPLPASPASHFAQFCDGFGAEINHSRWCGWWVALTSAIWQHRNLLIFQGNPFDSSKVMEEAMFLV

SEQ ID NO: 175424 - protein, 125 aa, Glycine max
  Coding DNA Sequence Number=SeqID_83739
MAASDHAILRDITHIPTKRSLLKLSSQDAFLAQNKLLAKQLESLTETLSKLPTQLQATQPSHLVVMQVGGCSTCGRAHESGCCIPQDDFAKEVNYTGNQNRQGFHSGGFSGYQQGGNFNQNQGQG

SEQ ID NO: 175425 - protein, 147 aa, Glycine max
  Coding DNA Sequence Number=SeqID_83740
MTWLNIDPSSAWRTLWPRWPGEESSLLLRGEVRLLQPRSRSQSWREWEESKEFSDCVVLNSLTREKGDTKEFRRLVPCSFGKERRETQKKFRRLVLGEFFLAKGEENEKMNSTSFQGLENQKTSESFWFKEEEEVQRDSRLVKDCMK

SEQ ID NO: 175426 - protein, 65 aa, Glycine max
  Coding DNA Sequence Number=SeqID_83741
MNERGKGIEQGVVACGGEMVVHDAVLRGREKLQCCMGEGDGARGQVLSERCLIGGVGLLKVQGKF

SEQ ID NO: 175427 - protein, 505 aa, Glycine max
  Coding DNA Sequence Number=SeqID_83742
  Gene Ontology: Mol. function=2-amino-4-hydroxy-6-hydroxymethyldihydrop teridine diphosphokinase activity; Cellular component=mitochondrion; Biological process=folic acid and derivative biosynthetic process
  Homolog annotation: Hit_ID=O04862; Match level="QueryCoverage=91%, HitCoverage=92%, E-value=0.0, Identity=80%"; Hit description =Dihydropterin pyrophosphokinase /dihydropteroate synthase precursor
  Pfam annotation: Domain name=HPPK; Domain location=31-138; Score =146.9; E_value=5.7e-41; Accession=PF01288.11; Description=7,8 -dihydro-6-hydroxymethylpterin-pyrophosphokinase (HPPK)
  Pfam annotation: Domain name=Pterin_bind; Domain location=203-426; Score=334.9; E_value=1.4e-97; Accession=PF00809.13; Description =Pterin binding enzyme
  Pfam module annotation: Pfam domain module=HPPK::Pterin_bind; Domain location=31-138::203-426
MSPILKYPLGFSSFHTASNSSVEHSQEEEVVIALGSNVGDRLHNFKEALKLMRNSGINITRHACLYETAPAYVTDQPRFIYSAVRAVTKLGPHELLSTLKRIEKDLGRTDGMRSDILTIPHERIWERPFVMAPLMDLLGSAIDSDTVTSWNSFSGHSRGLSGLWEDLGSESLIGEFGKEGMYRVMPVANGLLDWSWRTSVMGILNVTPDSFSDGGHFQSVESAVSQVRLMISEGADMIDIGALSTRPMASRISAEEELGRLIPVLEAVVSMPEVEGKLISVDTFYSEVASEAVSKGAHFINDVSAGKLDSNMFKVMADLNVPYVAMHMRGDPSTMQNSENLKYDNVCEEISSELYSRVREAEMSGIPGWRIMIDPGVGFSKKTEHNLDILMGLPDIREEIASRSLAISHAPMLIGPSRKRFLGEICSRSDAAERDPATIASVTAGVLGGANIVRVHNVKDNLDAVKYLDFCSNNSVSVVLCHVTPTPRSYVEHNNAVKAGTKKHQ

SEQ ID NO: 175428 - protein, 340 aa, Glycine max
  Coding DNA Sequence Number=SeqID_83743
  Gene Ontology: Mol. function=kinase activity; Cellular component =cytoplasm; Biological process=D-ribose metabolic process
  Homolog annotation: Hit_ID=A7P2D8; Match level="QueryCoverage=54%, HitCoverage=42%, E-value=5e-76, Identity=73%"; Hit description =Chromosome chr1 scaffold_5, whole genome shotgun sequence
MAYLSFPQFLSLPRYHMTWSYCCTSFNTVQLGKLGPGCKWGHVAMARKKASLDSSIEEEPSDNESVVEKKTTRSSKIKKTTVRTRKKTKDESPGDTDDASIEGSSAAASDDSKKTRRTRKKGASSSAGLEEKKEVKEEKKVRRRKKTEEEKLIVEDKGSEAEISDQDEPSFLENVEDDSDSGLELIKDDGEDISFTYGWPPLVCCFGAVQHAFVPSGRPANRLINHEIHESMKDALWSPEKFVRAPGGSAGSVAIALATLGGKVAFMGKLADDDYGQAMLYYMNANNVQTRSVRIDSKRATAVSLMKVGKRSRLKMSCVKPCAEDSLTKSELNFDVLKEV

SEQ ID NO: 175429 - protein, 109 aa, Glycine max
  Coding DNA Sequence Number=SeqID_83744
MEALSFASQVLQGKIAEKPQLLSVSGVVVVVVVAAGLGRNVWIRPSKIGMIPPPGIVPVAGEHKLQTVQLLQIVSQKGKGLCGGRQRSINHRVLRQVQTSNSRPAGLPG

SEQ ID NO: 175430 - protein, 28 aa, Glycine max
  Coding DNA Sequence Number=SeqID_83745
MSKRLQEDWAKAAEEGPRILMNLKDSIM

SEQ ID NO: 175431 - protein, 88 aa, Glycine max
  Coding DNA Sequence Number=SeqID_83746
MIVIFVIAAFVATTVNDFVQFMEGLEVFLSQRRNKRWQIRSGLRGNWTTFSLATISCMQIYLNLGKEEQKRRSVCNEGVKRRSKYNRK

SEQ ID NO: 175432 - protein, 404 aa, Glycine max
  Coding DNA Sequence Number=SeqID_83747
  Gene Ontology: Mol. function=RNA-directed DNA polymerase activity; Biological process=RNA-dependent DNA replication
  Homolog annotation: Hit_ID=A5BDJ8; Match level="QueryCoverage=40%, HitCoverage=18%, E-value=1e-13, Identity=31%"; Hit description =Putative uncharacterized protein
MVCKDVELEGRELQVINSARGLLCIWRKGIFEIDPVFSGNGFLGIKGLWKEEDFNFAKRMEEMRNSNNYLTREKDFEEFNMLIRDIDIEDTPMVGRKYNWYRSTEHSKNGLYRFLCQNGGCMNGQWINELDTLDAADGLQEDGLKRRGRLMKEFWKHGKFPKGGNPSFIPLIPKKNNPQGLDDFIPISLIRRVIAKVLSRGGRGFKDKKGISAYCLKWTLRKRLGFYERWITWIRGCLESATMSVQVNGSPTEEFSTRYKMGADEVEISLMQFADDTLFLDNPDHANVLCIDTLFGVGYNLVIIFVIVKYFLSQFRGRRQEIDSRSFDDNKDDDKKLKSQDHFMITKMMTFKNEFKIESRTLQGSRGNLISRIKNQDSRFKNNQDQDSRLKDSRIKRRLNQDKY

SEQ ID NO: 175433 - protein, 144 aa, Glycine max
  Coding DNA Sequence Number=SeqID_83748
  Homolog annotation: Hit_ID=A7PP34; Match level="QueryCoverage=50%, HitCoverage=11%, E-value=7e-11, Identity=41%"; Hit description =Chromosome chr8 scaffold_23, whole genome shotgun sequence
MTHILRRLLITALECDTGSSTRFTTTTRGGGGEQRGDSPRFNAEQEEEVLVLLTLIVANTTKYFEDRIEALRGWLFHEIDPLRVQGMSSELKRYLEERLLLKQYAESDTVVDNEKERNIVLTRINPEIKICEVCQLKSEAKKLN

SEQ ID NO: 175434 - protein, 31 aa, Glycine max
  Coding DNA Sequence Number=SeqID_83749
MDVPRGKTPADCKQYFKKELTTFTETMTYKT

SEQ ID NO: 175435 - protein, 646 aa, Glycine max
  Coding DNA Sequence Number=SeqID_83750
  Homolog annotation: Hit_ID=A7QUR3; Match level="QueryCoverage=93%, HitCoverage=95%, E-value=0.0, Identity=63%"; Hit description =Chromosome chr1 scaffold_180, whole genome shotgun sequence
  Subcellular localization annotation: CTP_CleavageSite=99; ConfidenceScore=5.41e-01
MATPTLIGPPELYNPYPTQTPAPTPTPTPTQPQTVTRTTPIDPFIDQMVVKFNTMSSPPPPNMTLTENMSPTFFTTGNPCLDFFFHVVPDTPPETILQRLELAWALNPLTALKLVCNLRGVRGTGKSDRQSFYPAALWLHRRHPKTLAANVSSLAEFGYFKDLPEILYLLLEGSDARKVQKEAWQNRKRGAHNNKKKNPRTQKMQKVKTKSLAQRVNVEKEKESSEKEIAHVAREEKRVALAKKLVERYAKDPDFRFLHDRVSDYFAECLRKDHEFLKSGLVTKVSLAAKWCPSVDSSFDRHTLLCETIGKRVFPRDEYKEYEGVEEAYYAYRVRDRLRKEVLVPLRKVLELPEVFIGANRWDLIPYNRVASVAMKFYKEKFLKHDKERFEAYLEDVKSGKSTIAAGALLPHQIIGSLNDGDGGDVAELQWKRIVDDLLKKGKMKNCLAVCDVSGSMSGVPMEVSVALGLLVSELCEEPWKGKVVTFSENPQLHLIEGDDLGSKTEFIRNMEWGMNTDFQKVFDLLLEVAVSGNLKPDQMIKRLFVFSDMEFDQASANPWETDYQAITRKFGEKGFGDAVPQIVFWNLRDSKATPVPATQKGVALLSGFSKNLLTLFLDKEGELSPEEAMEAAISGPEYQKLVVLD

SEQ ID NO: 175436 - protein, 698 aa, Glycine max
  Coding DNA Sequence Number=SeqID_83751
  Gene Ontology: Mol. function=heat shock protein binding
  Homolog annotation: Hit_ID=A7PUS3; Match level="QueryCoverage=52%, HitCoverage=80%, E-value=2e-36, Identity=31%"; Hit description =Chromosome chr4 scaffold_32, whole genome shotgun sequence
MEFTVATTTFTKKLSNGSGYGVSGRSAYDGVFATPIKLHTPKFSSQFDDYREIFCAAAGTSIPILELPELNNRKNNDVRYSKFDYSNVFGGLENLGAAAVPFPELVAEPKKKNSFRARSKVKGENQSSREDQTNCSKEIPVASWSSNDTRRINMSYHKVNQGSENGTNGTTHIAQLRAVPAYTQLIEEVNPVKMNRANKSIPVAQDTTCSGSHGNEGKKEAAHSTKSFTGASPDNSKKQSSNNGVKVTSRSDSIDLFFDACEISNGSNGTHYVKVPLSETTEGNSEAMKSMPTKCQASKSSSSEGVAGADSPSYLDDMVDLNSEVAASVAALRKAMDEAQVRMKVAKELMRRKKEGFPDRVKQKSNIELKAERKKEAKVTYKTKKIDTRQTFREMDAFQNASSEVGKSTMRIEQVRPDLGAKETSVAKVAVQKAQKKLKSTQVKYEKEVEQKEANHKGKILELKQAENNKKELYVKNTDKNATDKPEGPDQTIEIVTKYWGLRNNEASVCEELVQETRHRCQEVVDETKLVQETLECGTMDKSLKFNETGEVEDKATSFYELEDYESNLGGQGLITRNGKKVACKPEEDGNKFEGSFELEECKINLRAAQELGEVEKNITQEQKGSEDRVAVSNELEECKINLRAAQELGEVEKNITQEQKGSEDRVAVSNELEECELTEILEPLNNESVHSQHGSDF

SEQ ID NO: 175437 - protein, 110 aa, Glycine max
  Coding DNA Sequence Number=SeqID_83752
MVINLRLAVRELGAAVQHDASSSGENEGFRRVFYDGVDQQSNTTRVRQSHEKGLAMMKTTTMPMRLCTSTTPFWVFVNSRTRSRIPSLPRLARVCAKSDESTPFLILLPI

SEQ ID NO: 175438 - protein, 67 aa, Glycine max
  Coding DNA Sequence Number=SeqID_83753
MGEKKLEENKVEEKKANEEEKKEEEKKPEESKDDKEFKEESVPPEIVLGTTFAIHGHFKHDFRHLLN

SEQ ID NO: 175439 - protein, 110 aa, Glycine max
  Coding DNA Sequence Number=SeqID_83754
MALESLFHMLKDCVRVREVWGELLNGRTITNFNSDVVCDRIETNVNPCRNTQKDWLVIFVITIDYIWLLSQIALSLMQIRELIRETMKLHMIGCYETMLQNLYWFCREDW

SEQ ID NO: 175440 - protein, 144 aa, Glycine max
  Coding DNA Sequence Number=SeqID_83755
  Homolog annotation: Hit_ID=A2Q454; Match level="QueryCoverage=54%, HitCoverage=35%, E-value=7e-20, Identity=59%"; Hit description =Retrotransposon gag protein
  Pfam annotation: Domain name=Retrotrans_gag; Domain location=4-89; Score=18.3; E_value=0.00091; Accession=PF03732.8; Description =Retrotransposon gag protein
MKVSLAQICMENGTIHFFNSLLLDYENLTWEDLKHELLERYEWVSEGSVFEQFTSLRQTGTMEKYIYRFKSLVVQVPRLLDEPLRQNWRVGCVGRVDMRGGGSGFGLVQKTHGTNTGHGVIRGVGFQGGTNGPCPNEKEVEIRN

SEQ ID NO: 175441 - protein, 346 aa, Glycine max
  Coding DNA Sequence Number=SeqID_83756
  Gene Ontology: Mol. function=nucleoside-triphosphatase activity; Cellular component=nucleus; Biological process=mRNA processing
  Homolog annotation: Hit_ID=A7P496; Match level="QueryCoverage=45%, HitCoverage=21%, E-value=2e-64, Identity=78%"; Hit description =Chromosome chr1 scaffold_5, whole genome shotgun sequence
  Pfam annotation: Domain name=HA2; Domain location=1-67; Score=19.3; E_ value=0.0046; Accession=PF04408.14; Description=Helicase associated domain (HA2)
MARLPLDPLYSKALILASQFNCLEEMLITVALLSVESIFYSPRDKLEEARTATKCFSSPVGDHITLINVYRASNDFLEKRSMEMNMAKTEKVYRKWCKENFINSRSLRHARDIHRQIQGHVEQMGLNLSSCGDDMLQFCRCLAASFFINAAVKQPDGTYSGVGFACEKPSFERRPCSQIILEHVADMVWYSVLVDDLETESCFLHFQEIGASPKNIHQPIVDFRVSGHPALSESLGQFVVAVAVAHQSTVVAVGRRSSVSLVHRLLVYCRCAREHRQRLSCASPAPALSFVALETAAGRVAEEEKLGYGWLGAAISNPRRHRYLVAFFQNSVTSFRHGRFLITLQR

SEQ ID NO: 175442 - protein, 63 aa, Glycine max
  Coding DNA Sequence Number=SeqID_83757
  Homolog annotation: Hit_ID=Q8W4E6; Match level="QueryCoverage=93%, HitCoverage=16%, E-value=6e-22, Identity=81%"; Hit description =Putative uncharacterized protein
MAIGNEFLKKIAPTWMNVSLAIKKDPETDQAFGWVLQMYAYAVAFALHGVRNILHKDFMIQVQ

SEQ ID NO: 175443 - protein, 417 aa, Glycine max
  Coding DNA Sequence Number=SeqID_83758
  Gene Ontology: Mol. function=DNA binding; Cellular component =chromatin; Biological process=regulation of transcription, DNA -dependent
  Homolog annotation: Hit_ID=A7QNA4; Match level="QueryCoverage=54%, HitCoverage=62%, E-value=4e-68, Identity=58%"; Hit description =Chromosome chr2 scaffold_132, whole genome shotgun sequence
  Pfam annotation: Domain name=HMG_box; Domain location=159-225; Score =69.3; E_value=1.3e-17; Accession=PF00505.10; Description=HMG (high mobility group) box
  Pfam annotation: Domain name=HMG_box; Domain location=44-111; Score =61.0; E_value=4.1e-15; Accession=PF00505.10; Description=HMG (high mobility group) box
  Pfam module annotation: Pfam domain module=HMG_box::HMG_box; Domain location=159-225::44-111
MTWRLTLAEVRHVLGLLVDFKLEAIAAVKLYKNYIIIKGCSEKKRPSPPYILWMKDQRNEIKKVNPEAGFKEISTMLGVKWKTVTAEEKKPYEGIYHAEKEAYLQVIAKEKHETESMRLLEDEQKQRTAMELLEQYMQFKQEAEKDGKKNKKEKDPLKPKHPMSAYFLFTNDRRAALAAENKNFLEVPKITFEEWKNMTEEQKRPYEEMAKKNKEQYALEMEAYKQKKDEEAGHFMKEEEDHMKGLSVCLRVSSGGVCVCVCDEEETQQGQVSRSCVVYCLGVVIIEILTARFPSQYVSNGKGSRNWLAEMEQLLLIGAACTESNPQQRLDMAEAIRRIMEIKFECDNVKAVKAILRSYEMVFGLRINFGSSQFGDVATYHSARGQREGSRVCLPWEEDARSRHQRLFEENVGKNQK

SEQ ID NO: 175444 - protein, 199 aa, Glycine max
  Coding DNA Sequence Number=SeqID_83759
  Gene Ontology: Mol. function=nutrient reservoir activity; Cellular component=extracellular region; Biological process=metabolic process
  Homolog annotation: Hit_ID=Q9SC38; Match level="QueryCoverage=61%, HitCoverage=68%, E-value=3e-39, Identity=64%"; Hit description =Germin-like protein
  Pfam annotation: Domain name=Cupin_1; Domain location=36-150; Score =64.0; E_value=5.2e-16; Accession=PF00190.13; Description=Cupin
  Pfam annotation: Domain name=Cupin_2; Domain location=64-137; Score =5.1; E_value=0.085; Accession=PF07883.2; Description=Cupin domain
  Pfam module annotation: Pfam domain module=Cupin_1::Cupin_2; Domain location=36-150::64-137
MGQGNKKTYIIHYTYGCYYTMKFYKDLKLVRAEDFFRHVELGKTDNPIGSNVTQVFVDQLSRLNTLGLNAPHTHPRGTEILIVLEGTLYVGFVTSNQDGNHLFNKVLNKGDVFVFPIGLIDFCINVGYGNVAAIGVMITHGNIVARTTVMKIIPNLGSKDVYMVYLPLAHAFEMVAEPTLMAAVPAIVDHIGDGVAKKV

SEQ ID NO: 175445 - protein, 108 aa, Glycine max
  Coding DNA Sequence Number=SeqID_83760
  Homolog annotation: Hit_ID=A7QFU6; Match level="QueryCoverage=88%, HitCoverage=23%, E-value=5e-20, Identity=46%"; Hit description =Chromosome undetermined scaffold_89, whole genome shotgun sequence
MSLNQDPVKRKKAKWSDKNIEIMLKVCIEEEWQLWAKLIGKDTGLGWDGEKKTIAASDEWWEAKIQEDPEVTKFRKQGLKFLPEMEFLFKGTIATGFAAYAPSEDSRQ

SEQ ID NO: 175446 - protein, 84 aa, Glycine max
  Coding DNA Sequence Number=SeqID_83761
MDVLDTNMIEGKIQCSDQTTLLYEESGDELDRKKACYFRNPGAGRAMHNAKQPTATQATTAGQAMAQWSGEADNGTTDVSFEVL

SEQ ID NO: 175447 - protein, 181 aa, Glycine max
  Coding DNA Sequence Number=SeqID_83762
MAPRKLASKRSRKDKAAEGTSSAPEYDSHRFRSAEHQQRFEAIKGWSFLRERRVQLRDDEYTDFQEEIVRRRWASLVTPMAKFDPDIVLKFYAKCLAYKGGCTRYAILGEGSVDPIRCGCSQPVPGISFGAGGGPGVAGFCLDCCWKTGADHAHQHDHVAQLIVDVRYPDRDEHSRGSVNR

SEQ ID NO: 175448 - protein, 77 aa, Glycine max
  Coding DNA Sequence Number=SeqID_83763
MDEIENEIAQNARAKLGFNLFVIARVRYQPVLYDRGVVMQSYPPRALDRRLQEDWAKNAREGPRVLMSLRVDFGPTG

SEQ ID NO: 175449 - protein, 108 aa, Glycine max
  Coding DNA Sequence Number=SeqID_83764
MKAKSREAGNGSTVQMNANDCKRSFCQPDASSIGACRPRIFFINGFLCFLEDEWQRNGERERERRRHFKEKMSLEEAHHHRRPWIRAWRKKEMNEGRGREEHEILCSK

SEQ ID NO: 175450 - protein, 48 aa, Glycine max
  Coding DNA Sequence Number=SeqID_83765
MASIIVPIVEAKLHDDDKGDDKKLKDQSRTIQEFKIRIKKNSRLKKKV

SEQ ID NO: 175451 - protein, 66 aa, Glycine max
  Coding DNA Sequence Number=SeqID_83766
MGAEEEEEKLVLFERGRKRREKMRSLSREGETRVKFRVGADGAPRVGQDPGMGKGTRGFNVNNDDD

SEQ ID NO: 175452 - protein, 358 aa, Glycine max
  Coding DNA Sequence Number=SeqID_83767
  Homolog annotation: Hit_ID=A2Q6B4; Match level="QueryCoverage=50%, HitCoverage=86%, E-value=2e-14, Identity=26%"; Hit description =Ribosomal protein L33; Nucleic acid-binding, OB-fold
  Pfam annotation: Domain name=DUF223; Domain location=40-135; Score= -7.6; E_value=0.015; Accession=PF02721.5; Description=Domain of unknown function DUF223
MARAPDNIKSINGSKEPLKVAVRITDLWFVGTPNRFEQAEMVIIDSHGDTIHVVCKQDQLKSWKADLIENCTYVMHNFKVMKNDDQFRICDHQYKLVFTRVTVLRKSNLEDLPFKKYKFADFTNIIVGLFELKLLVGGLSSCGIKEYKGCFQTQGFEFIDYLNQSENDLPIIIILTHARIKEGQGIQVQSVFTAGDQGSSQVSVGLDLTPIFFCQEIVCVTIGTINRIVTDNHSWYYSACSYCYRKNDVETAAFICACGKHNDQPVLRYRVEVMVTYKEQSTKFFMWDRECTELIGQSANEVNRLKIEFTIKFDYRYSNDLDLINVVVDMLPDAEACSNVHAPILDSDDPSQLESNLF

SEQ ID NO: 175453 - protein, 60 aa, Glycine max
  Coding DNA Sequence Number=SeqID_83768
MVKFGNFFIAGEEEMDEEQWRYDIIMSEEVDMNVENEEDASMKVEHVDCSDAFNTSMMFV

SEQ ID NO: 175454 - protein, 444 aa, Glycine max
  Coding DNA Sequence Number=SeqID_83769
  Gene Ontology: Mol. function=catalytic activity; Cellular component =intracellular; Biological process=regulation of transcription
  Homolog annotation: Hit_ID=A7P776; Match level="QueryCoverage=18%, HitCoverage=19%, E-value=6e-29, Identity=79%"; Hit description =Chromosome chr9 scaffold_7, whole genome shotgun sequence
  Pfam annotation: Domain name=2_5_RNA_ligase; Domain location=170-253; Score=6.4; E_value=0.039; Accession=PF02834.7; Description=2',5' RNA ligase family
  Pfam annotation: Domain name=LIM; Domain location=392-435; Score= -9.5; E_value=0.085; Accession=PF00412.13; Description=LIM domain
  Pfam module annotation: Pfam domain module=2_5_RNA_ligase::LIM; Domain location=170-253::392-435
MTVGGVAIKGERERSLESDQRETAWVLLHAAHAVHQHHPSLQRSDAVLVVAVEAEAEEDAAHRELEGGTIEEEVLLAVGDDVKGESAVRILRGETNAMGLGRGIFAIAIQLTEESSGASGGGGGGGGGIAAASFLEFFFVFNLDFDFNWLSSQHFVTMMLISLSTPISILDLVGESVVYYLGIDKSIFIKPKTFHLTILMLKLWNKERIKTASEVLQSISSKVMEALDNQPLSIRLKGLGCMKGSLAKARVLYAPVEETSSIGKGATRSTRSPISVLQDIEKVDKAIDGRNVYNILEPCYHFPDAATAKENGTLPKSFKQLGVIERHLLVRKRMFGRAWPFRAPVKPGLFTLWPQLAQTSMSHSDEVANSWLNNVAVRKAIHVELGSFHSHGNLVHQLSADGTAYHKACFKCSHCKGTLKSGQNDRVLGIPSSSVNSVNYMPND

SEQ ID NO: 175455 - protein, 328 aa, Glycine max
  Coding DNA Sequence Number=SeqID_83770
MASRKRKSTSSRPQESYDNTKFILEGAWERYAQNVHSRSILPERNIILYVTEYDEFHRELKRQRWHRALTRQPDGHIDVALVKVQGKLIKFDAETLNTFLETQVVLETGEHYITYSRFCHSHPDTQELASRLCISGRGFVLNAEGAPWKLLRKDMMTLTLTWSMLSYSNLASTSHTPDLNMDRARIVYGLVMKMNMDMGSLILGQISQMAQSNSSRLDFPALITALCVARGVVSDSLTFESLSPAINLAYFRKNCWNPDDPMITFLGTCKARARGPSDASTSAPSSSAPPTPAPTALVPTHATPELEPSQPAQDAPSSPYDEPTPAQD

SEQ ID NO: 175456 - protein, 49 aa, Glycine max
  Coding DNA Sequence Number=SeqID_83771
MERYERPQLKLSSHGRQMAKFGRPALEIEGLVAANGLSPLIACSLDTGD

SEQ ID NO: 175457 - protein, 150 aa, Glycine max
  Coding DNA Sequence Number=SeqID_83772
  Gene Ontology: Mol. function=aspartic-type endopeptidase activity; Cellular component=small subunit processome; Biological process=DNA integration
  Homolog annotation: Hit_ID=A5ACK0; Match level="QueryCoverage=92%, HitCoverage=36%, E-value=2e-30, Identity=45%"; Hit description =Putative uncharacterized protein
MASSGPVLSFSGTPTITTAKLNWKNYLSWSASVELWFLGQGHHDHLEKAAEEVPIDKRPEWEKLDYQLCAVLWQSVEPDVLEILRSFKTCCSFWKKAREIFANDIQSLFDATMKVTALKQTNHDMIAHIGKARAAVEELKRFLVADSLEE

SEQ ID NO: 175458 - protein, 275 aa, Glycine max
  Coding DNA Sequence Number=SeqID_83773
  Gene Ontology: Mol. function=serine-type endopeptidase activity; Biological process=proteolysis
  Homolog annotation: Hit_ID=Q9CAA3; Match level="QueryCoverage=100%, HitCoverage=46%, E-value=4e-62, Identity=53%"; Hit description =Putative protease
  Pfam annotation: Domain name=Peptidase_S9_N; Domain location=45-273; Score=-144.7; E_value=0.00027; Accession=PF02897.6; Description =Prolyl oligopeptidase, N-terminal beta-propeller domain
  Subcellular localization annotation: CTP_CleavageSite=56; ConfidenceScore=5.69e-01
MALFRALAHSKNSTLSLTRSCHTVITFTPSSVCRRRSNSPAPPQSPPSPKKVPFTVSVHGKTWQDPYHWMSNTDDPNLLDHLNRENGYADAFMADTVKLRSVLSSEMKARLPPSVSTPPERWGPWLYYQYIPEGKEYPVLCRSLETETGWLKNAVLRYGMTRSKREEILLDWNELAEKYGYVNVGSCRVSPDNNYLAYTLDISGGERFTLQIKDLRSGLIDPQLEVDGAYFVEHHSGLFYILTNAPIPDAEWSGQGYYLVRCRVEDVESAKFQVL

SEQ ID NO: 175459 - protein, 63 aa, Glycine max
  Coding DNA Sequence Number=SeqID_83774
MAPPKEIATIIYHNGHIVDDPVQGSIGAMEKILQNPQLNSAEFYAVTDLIPQPQPSSPQPSCP

SEQ ID NO: 175460 - protein, 39 aa, Glycine max
  Coding DNA Sequence Number=SeqID_83775
MSLSMALRSNGKIVVPGDMSRGSGDLGDVRWGAIAPNQA

SEQ ID NO: 175461 - protein, 129 aa, Glycine max
  Coding DNA Sequence Number=SeqID_83776
MPLSVFVKLLPWSPAEEFFHECQLKKNYGRTFFRGIPQKNFFRESQRKKLHTLQSHTSSSLHFSNSDHAIGVGLIAFFVEMTNKAKGKGKEVAGKGSAAKRKGAFDDDKTGGGRKRNKRGVLQFFLTMN

SEQ ID NO: 175462 - protein, 60 aa, Glycine max
  Coding DNA Sequence Number=SeqID_83777
MGEGYCTQPYPCKCKEAVSGFEPMTNKSPRHNFTAAPGLALFKNFPYPCICKEAVSGAKD

SEQ ID NO: 175463 - protein, 195 aa, Glycine max
  Coding DNA Sequence Number=SeqID_83778
MEKIFFPLLAPYSSLSVHSSFPLYSLYCLCMYVSRRMVVDGCSRGVWFDSGIGWRWDLLGRGRGLSLPSSSAIEVEDEVLPREEPSSARVKVDENVAYRRRCSSAGSSGRRFFRLIQRKNLLHLLPLEPVEEPFTFLSQELAEEHLIPQATFSARGRTCGTFFRRLSILLAEEPAKLLPQATFCCILVFFLENYV

SEQ ID NO: 175464 - protein, 145 aa, Glycine max
  Coding DNA Sequence Number=SeqID_83779
MASRKRKATVSRPQEPYDNTRFISEVAWECYKQNAHSRNIISERNITLYVTEYDEFRRELERHRWHKALTRQPDGRIDVALTWSVLSYSNFAPISHTSNLNMDRGEVSLRSGDEDGHGRGLVHLWTDISDGPVQLLQAWFPYPHH

SEQ ID NO: 175465 - protein, 99 aa, Glycine max
  Coding DNA Sequence Number=SeqID_83780
MELIENMAGSDHAILRDRTHNKLLAKQLESLTETLSKLPTQLQVAQPSHSIVMQVGGCSICGGTHESGCCIPLDDAAKEVNYMGNQNRQGFHSDGFSGY

SEQ ID NO: 175466 - protein, 128 aa, Glycine max
  Coding DNA Sequence Number=SeqID_83781
  Gene Ontology: Mol. function=aspartic-type endopeptidase activity; Biological process=DNA integration
  Homolog annotation: Hit_ID=A5BK37; Match level="QueryCoverage=57%, HitCoverage=15%, E-value=2e-12, Identity=43%"; Hit description =Putative uncharacterized protein
MRRQLKAYNLWEWRMLNHQLWKKIPLLLRIDPIYFKFGYNKGNLGEDSRRVFLRNQRTKQMQVLNMKREYEALKMNEAESIKDFMTKMMKVVNQIRSDCKIVDKLLVVLLERFDPRFLHLKSQRISPR

SEQ ID NO: 175467 - protein, 115 aa, Glycine max
  Coding DNA Sequence Number=SeqID_83782
  Gene Ontology: Mol. function=DNA binding; Biological process =regulation of transcription
  Homolog annotation: Hit_ID=Q0PJE3; Match level="QueryCoverage=47%, HitCoverage=36%, E-value=2e-14, Identity=72%"; Hit description=MYB transcription factor MYB167
MAAELGQQMMELSTLVTRAAHDKSSDFLFLLNLLFLHRPVDLGGCRPRDSATDKGSYEKRPSSFAPKAYEMEGSCSSKINNIKNDTNLMSNSSNKDMFLDSYTTSWQEPCLLSHI

SEQ ID NO: 175468 - protein, 158 aa, Glycine max
  Coding DNA Sequence Number=SeqID_83783
  Pfam annotation: Domain name=Transposase_23; Domain location=61-131; Score=9.2; E_value=0.00012; Accession=PF03017.5; Description =TNP1ENSPM transposase
MAPEELEQLTQQIKDQLEESITEKIHSQGLALPPEPKVCPSASRVGTKGSCVDPSPTDPDTGDSDKCGLYIEENPSRLVALGRVYEGSTVVHNIPLLHGQVKVAVEEVKDAEAPIPVPTDEVILVGQALNTFLAWSKHLVKRLSEQVFYSHYMLLFFN

SEQ ID NO: 175469 - protein, 222 aa, Glycine max
  Coding DNA Sequence Number=SeqID_83784
  Pfam annotation: Domain name=zf-CCHC; Domain location=185-202; Score =9.9; E_value=0.049; Accession=PF00098.14; Description=Zinc knuckle
  Pfam annotation: Domain name=zf-CCHC; Domain location=34-48; Score =12.4; E_value=0.02; Accession=PF00098.14; Description=Zinc knuckle
  Pfam module annotation: Pfam domain module=zf-CCHC::zf-CCHC; Domain location=185-202::34-48
MVKKFGKFLKRSKDRKFSKPSKKIESNKNIFTFFECGKQGHIKSECPIYLRKQLAEKKRKNDRKHKKAYIAWEDNASTSFDSSSEEEVANVCLMADSMDDSSTIEETELQTELSYLKDLFRKMNIGKSDLSHLLNVQNRTINKTGLGYNKKTIFSKKTKFASSKKVNPNKVSKKKNMVHSKPKAKTCHYCMKREHISYKCYVRRFEFPRGVPKSKKLTMVLG

SEQ ID NO: 175470 - protein, 282 aa, Glycine max
  Coding DNA Sequence Number=SeqID_83785
  Homolog annotation: Hit_ID=A7QMM2; Match level="QueryCoverage=45%, HitCoverage=7%, E-value=2e-11, Identity=32%"; Hit description =Chromosome chr19 scaffold_126, whole genome shotgun sequence
MFDCVVREENMSLLSERNEWEVRPRNSIDTIYSFRKENEHQLFILKHENEMMSNAYKQSRQMVNSLSQRLHCLQIAVESGVQERKKQEEYIHMLQVKIELQEQNKCVERLTVELDKNTQFPRRITEETKQKLVNALSEIAAIESNANCVESMFLTFWFANDCSYWIQSINVATLISVTAETMIDAIRSVKSIPRLHRSQLEPRNKGSASSVAEEVLTRVISALVEKGLLTPMASPKNFTTHSHDSACCFLTEIQPWLSTFHLSRGTYFSSQATNDALAATKK

SEQ ID NO: 175471 - protein, 130 aa, Glycine max
  Coding DNA Sequence Number=SeqID_83786
MESLRKPMGSEQCIYSGSRMSSHVEAIGTGNQEGNKEWLVGGGQGWGEGGEQEALVVAGGGGGRVAWRGGAGRVFKVAGRAWDPSATRRTCNGNANERACTQSANQSSNTADASNPEAPSSAAHPDLSHR

SEQ ID NO: 175472 - protein, 74 aa, Glycine max
  Coding DNA Sequence Number=SeqID_83787
MVALGIVGVFTLTYTRREEETVKGFLFGQKRTLKSQVVEFVDLLGKLYDVNLTRSGSFDTGYGDLDDATSSEGR

SEQ ID NO: 175473 - protein, 90 aa, Glycine max
  Coding DNA Sequence Number=SeqID_83788
MKNKQIDGVVSDHPIGKYTLVTKTKDKEGSYKKRLNIATSRIAKNKVAPKYLGMVVRWHAVTGAADVEIESRTRTLNREEESARKIGLAF

SEQ ID NO: 175474 - protein, 201 aa, Glycine max
  Coding DNA Sequence Number=SeqID_83789
MRIFLESVDKRVGDAIVNNPYIPKVVVDGKEVEKDFNSWTPEENMHDQYNVSAKNIFASILNLDKFYCASQCANAKEIWEILEVTREGTTKAKDEEEVDKKKKRLALKTSTSHHEASDEDPLENSDNENLNFLQDHIKVDCPTYLMKQQGGGKKKKKQFKKRRAYIAWDDNDVSSLSDSSEKEEANLSLMVDIDEDETKSN

SEQ ID NO: 175475 - protein, 84 aa, Glycine max
  Coding DNA Sequence Number=SeqID_83790
MKNKKVVVAGVSLSEACALSENHPLSETLNPLSKLGESGGESAKHLHAQCVISSLSESFVFSRAKRAQLAQRKITCSRLAQKWC

SEQ ID NO: 175476 - protein, 483 aa, Glycine max
  Coding DNA Sequence Number=SeqID_83791
  Gene Ontology: Mol. function=amino acid binding; Biological process =metabolic process
  Homolog annotation: Hit_ID=A7P2B7; Match level="QueryCoverage=87%, HitCoverage=97%, E-value=0.0, Identity=80%"; Hit description =Chromosome chr1 scaffold_5, whole genome shotgun sequence
  Pfam annotation: Domain name=ACT; Domain location=127-199; Score =34.7; E_value=3.2e-07; Accession=PF01842.16; Description=ACT domain
  Pfam annotation: Domain name=ACT; Domain location=260-331; Score =19.5; E_value=0.013; Accession=PF01842.16; Description=ACT domain
  Pfam annotation: Domain name=ACT; Domain location=338-404; Score =31.2; E_value=3.9e-06; Accession=PF01842.16; Description=ACT domain
  Pfam annotation: Domain name=ACT; Domain location=39-102; Score=36.0; E_value=1.4e-07; Accession=PF01842.16; Description=ACT domain
  Pfam module annotation: Pfam domain module=ACT::ACT::ACT::ACT; Domain location=127-199::260-331::338-404::39-102
MSEVNMSFSHYMDDEYEKLFRRMNPPRVVIDNEACKNATVIRVDSANKHGILLEVVQILTDLNLIITKAYISSDGGWFMDVFNVTGQDGNKVTDEAILDYIRKSLGPESCVTSPMRSVGVKQTTDHIAIELMGTDRPGLLSEVSAVLTNLKCNIVNAEVWTHNTRAAAVMHVTDEESGSAITDPQRLSIIKELLCNVLGGGNKKRGAKTVVTDEATHTERRLHQMMFADRDYERVNDDDDFDEKQRPNVNVVNWSDKDYSVVTIQCKDRPKLLFDTVCTLTDMQYVVFHANIDAEGPEAYQEYYIKHIDGSPVKSDAERQRVIQCLAAAIQRRVSEGLKLELCTTDRVGLLSDVTRIFRENSLTVTRAEVATKGGKAVNTFYVRGASGFPVDSKTIESIRQTIGNTILKVKGSPEEMKSVPQDSPTRSLFSGLFKGSSLCEGMGEGYCTQPYLCICKEAVSGFEPMTNKSPRHNFTAASGLAL

SEQ ID NO: 175477 - protein, 115 aa, Glycine max
  Coding DNA Sequence Number=SeqID_83792
MDIGEEGQDIVDMIGESMKECDGFDESTYDLGENEDVVGEKALEESTNDFGEDEHGDGKEVLEAEDNVEYIYWFSVYKSKVLKNLKGEKTQQTFFCSREGERKDRGLRIEARKWE

SEQ ID NO: 175478 - protein, 68 aa, Glycine max
  Coding DNA Sequence Number=SeqID_83793
MVTSISEYGWPEKSSLKYPDSCPISTVMASIRSMAVEWRMMKSDWRCHFKEKMSQEQAHHHRKPWIRA

SEQ ID NO: 175479 - protein, 347 aa, Glycine max
  Coding DNA Sequence Number=SeqID_83794
MAPKRSEAVVIPGINTEDEAKNVFPFFLEKFSSWHYDQYALLWGIARQNDVNMRGTIKGKEVVILPTTIVATSSYVEEGLQGQVQPQANENMLKRLEEIYGAPESVSIKVMKEQLKAWKELMMSEKPIRFIELFHRLNYRLMKPAEQEATTWILPSRPPIQKQQDIKVHPNLHTIWYHGFKGYRVLEWQTCNKVWKESENEAGKARSHQDLEEEEYALGVYGDREPVIKEFPPRQNATPNPNKAKFAGMHFLTPMDLQQLMGLICALNVVLPWDCTKIGEMFQTTKIILEALEESLNFQDWELSDHGLALRMKLFTYKEEIKLRQASFHRIQKLNTHLPFMLGSQLM

SEQ ID NO: 175480 - protein, 560 aa, Glycine max
  Coding DNA Sequence Number=SeqID_83795
  Gene Ontology: Mol. function=heat shock protein binding
  Homolog annotation: Hit_ID=A7P2B8; Match level="QueryCoverage=28%, HitCoverage=90%, E-value=7e-48, Identity=60%"; Hit description =Chromosome chr1 scaffold_5, whole genome shotgun sequence
  Pfam annotation: Domain name=DnaJ; Domain location=504-558; Score= -12.8; E_value=0.074; Accession=PF00226.22; Description=DnaJ domain
MGKHVSREHFQPRACSGKKENLKHTVFIDVDDQVDDVDVDVTIIDYEEFMSKLHGSSAPSTDRVCTPQSVISIDDDDSDDESDDAEIPGVVAGGVGELDSDACSSERSSPDPSGMRNSVHVDVDDDSGVCEKVTESDKLKSRKASSANGIGGCRHGIDWGDSESSESDCSDCELMDREQWEKISLKRKRSAFNDQPCYDEHGSSSGLHCNNNVYVDVDEENMTEENAGGPAYSGPTHGEYVKENQSSFSVRGDSQVDNQSSFPVKGDSQVENFFMDSDEKAEWETFKSSLFESTEEMKSLHQSSDIEHGRSTRSKDFSTYTQYNNNYNFCRAVTGVSRSQEACERQFSNTGSTLKSNLFDLNSECASDDEGQVNCDGLASSDQDCGLIASNDQDCGLTASNEKDIINEREKLKETDEYKQAMEEEWASRQRQLQIQAEEAQRLRKRRKAEKRLLDMQRRQKERIEEVRETQKKDEEVMNLKEQLRVEIQKGLNQLEMRCHDMPSLLRGLGIQVHAAYKRALLKFHPDRASKTDVRAQVEAEEKFKLISRWKEKFAMTSCH

SEQ ID NO: 175481 - protein, 132 aa, Glycine max
  Coding DNA Sequence Number=SeqID_83796
  Gene Ontology: Mol. function=nucleic acid binding
  Homolog annotation: Hit_ID=Q2AA51; Match level="QueryCoverage=43%, HitCoverage=18%, E-value=9e-09, Identity=48%"; Hit description =Retrotransposon gag protein
  Pfam annotation: Domain name=Retrotrans_gag; Domain location=14-99; Score=6.9; E_value=0.012; Accession=PF03732.8; Description =Retrotransposon gag protein
MKIVGVPEDAIRLNLLSLSLAGEAKRWLYSFKGNNLQTWEEVVEKFLKKYFPESKTVEGKLLDASTGGKIKLKTPEEAMELIENMATSDHAILRDRAYTPTKKSRLELTSQDAMLAQNKLLAKTLDSYSNSE

SEQ ID NO: 175482 - protein, 147 aa, Glycine max
  Coding DNA Sequence Number=SeqID_83797
MAPPSITIMPLLSAGAANTSTWWPRLILLQLHQFQLQLSCNGCCLPPLLTHIGYRPEQRTLTDFVSSVPCQCYLLKGWQIGVHNSINKRMSLSHPSLIVMQSTRCPKASHISLQMVVVSLQLFEFLLMASLHLRNMCLELLESVIVY

SEQ ID NO: 175483 - protein, 145 aa, Glycine max
  Coding DNA Sequence Number=SeqID_83798
MGCYVLCFTRMLQPYGINIGLKEHSNQVFGIIVVSELRPHTCEDYQWRITILDRKKFEDSIKETLKEMSENIRKIADCVYGQETHVSALNNQNTVLMERLNQEVHHGGSSYGSGSFQSNRSYMATRQAKIDFPRFDGSNLNGWLF

SEQ ID NO: 175484 - protein, 207 aa, Glycine max
  Coding DNA Sequence Number=SeqID_83799
MVVVCKFEQIVDGYNKMQTYRGMLLDPSRNLRNLLGVGGLTMVYSLKLGIKMNLVLLIEDIMLKRRRLVDYKFPYVVLASRFIDYFNVDVSNEIVDFTKASSEITKRHLKKLGMRFADHKWIMAGEPIVGNSEHMDEEVEAKALQEPAHQWSHFESLMIQKMDAMLHLHQEHSAEVHSLLENITTRLENIENRLTLSNLLNPDEDEA

SEQ ID NO: 175485 - protein, 111 aa, Glycine max
  Coding DNA Sequence Number=SeqID_83800
  Subcellular localization annotation: CTP_CleavageSite=13; ConfidenceScore=5.43e-01
MAFPSPPSNASASSSAVKRTRKASCLRSLSTRPPGAERPVVHVDHATGKVDGPHRKKLRTYLGIVARYKVDVTYGNWKEVPTAQRDLIWEDSQEEFEIPQASDSKMKKKLL

SEQ ID NO: 175486 - protein, 250 aa, Glycine max
  Coding DNA Sequence Number=SeqID_83801
MEEKQKKRLEQAAQFGSTKTTVDPPSPIGRHVKWKMACTKKFGKMTSEAAREIANRIEKHSGCARVAGAGVTIKQYFGPALAGSCISVSINLKELHRLRKNITKCNPRDSYYLLSLRLVLLLLVSAQREAAPVPWGRTQTWVNQRIMGCILMTILPACVHWQLVIICPKDDVVAWFCSMHNKSKNYLKGIINSALKGFNDIQGSKSKATAKCILVKYFTDPRPLEPKRLKTICIRCARCYLRVKNETLGV

SEQ ID NO: 175487 - protein, 243 aa, Glycine max
  Coding DNA Sequence Number=SeqID_83802
  Pfam annotation: Domain name=zf-CCHC; Domain location=171-188; Score =26.7; E_value=8.7e-05; Accession=PF00098.14; Description=Zinc knuckle
MASQQNVGEHLPYILWGTSRAYIYLGCYTENKRWYISCGSVQVERTSTWLFKENKGGYIPCGSFLVKDFTRLLEISRTGGCLGTGWNGSPRNMKWNFNVSIKNEETDKRKRSIALKASSSMQEEEEKEESDDEEDFSLSVKKFHKFVKNRRMERPHNFDNGKRSQEGSLTLKCYKCNRPGHIKAHCPTNESWPEKNEKKNHEERRSKKAYIAWDDNDSSDGSEKEINLLSKDYESDENISQED

SEQ ID NO: 175488 - protein, 432 aa, Glycine max
  Coding DNA Sequence Number=SeqID_83803
MDFFSDESFECIQAFHNSNLIPFMSLKLPVYSELVKVFYSNLEIQESTLISEVYGIKMVIDQSLFYDLTQLSSDGVPFEGALDDDWKFDFSVHDACRLVCTNLADMTGRLIASYILCGITRAYIYLGCNTENKRGYISYGSVQVERTSTWLFKENKGGYIPCGSLLVKEFTRLLEISRAGGCLGTGCKFPEDKSLFDLEITKTKRKNKKKKKQTTNKPSCECSSTDYPSTKKPFVIDNMVDREGGGNKPPRRTLDEYAYQQEPKYYNNIVIHPFSNKVVELKPTLLSLISTHPFAGMDDEDPYTQLFTFMELCGTMGASDKDAKAIYLRAFPFSLTGLTNLSMKHGRDSRLCCEVGGTMMSKSPEEAIVIIDSISTNYCQSHHDRRPIQRKGIMELDTQNAFLTQNKFLTQEIKALAKHIGQPPQQFQNVGS

SEQ ID NO: 175489 - protein, 274 aa, Glycine max
  Coding DNA Sequence Number=SeqID_83804
MASRKRKSTASRPITLYDTRYTNNILGRNILPERNVKLYHTEFDEFKVELERCNLHKRLTNLQDGSIDVAVVKEFYPNLYSPEDQAPKQARVRGHLIKIDADRLNEFLQTPVVLEEGESLPTYSRFCRLRTNHQEIEARLCIHRKGFVLNAEGQPWKLLIKDLMTLAQTWSVFSYSNLAPTSHTSDLNMDIARLVYGLVSNMDMNIRALISGQISSIAQSNSSRLGFPALNIALCRARGVISDSMTYESLSPAINLAYIKKNCWNVLIKWPQKS

SEQ ID NO: 175490 - protein, 194 aa, Glycine max
  Coding DNA Sequence Number=SeqID_83805
  Homolog annotation: Hit_ID=UPI0000ECBAF8; Match level="QueryCoverage =21%, HitCoverage=48%, E-value=4e-13, Identity=90%"; Hit description =UPI0000ECBAF8 related cluster
MVLCQTWKSKQLVEGTEQKGIEFFLQDIEAAAILEEPQSSESSSSFPESRESDTTLLEANTMADEQPRRVTLEDYSSSSVPQFFTSIARPEVQAPNITYPHSLIQLMQGNQFHGFPNEDPYAHLATYIEICNIVRIVGLPGMQAWHWPSLFTYVVTGKTLALPNLIALQHIPLSPAGVIAKRPAPIALPNSCAA

SEQ ID NO: 175491 - protein, 69 aa, Glycine max
  Coding DNA Sequence Number=SeqID_83806
MGEEEKKPEENKVEEKKPNEEEKKEEEKKPEESKDDKESKEESAPPEIVLGTTFAIHGHFKHDFRHLLS

SEQ ID NO: 175492 - protein, 182 aa, Glycine max
  Coding DNA Sequence Number=SeqID_83807
THLLLEVASPLSLPFSIPLPFIFQEAKESIDEEDPWPTSSNGAYITFAGGKIKLKTPKEAMELIENMAAKALTETLSKLPQQLQAELRIATDSKAITKEDRWDSTMEDFQTGLKLEESFAKPVQQGAEKSTGPEFQPRGKRKNQKNSQEVSPLNLLARGRRKNQKNSQAVSPLNSSGKREKE

SEQ ID NO: 175493 - protein, 138 aa, Glycine max
  Coding DNA Sequence Number=SeqID_83808
  Gene Ontology: Mol. function=DNA binding; Cellular component =chromosome; Biological process=regulation of transcription, DNA -dependent
  Homolog annotation: Hit_ID=O04235; Match level="QueryCoverage=76%, HitCoverage=23%, E-value=2e-30, Identity=53%"; Hit description=FACT complex subunit SSRP1
  Pfam annotation: Domain name=Rtt106; Domain location=1-117; Score =4.3; E_value=0.00092; Accession=PF08512.3; Description=Histone chaperone Rttp106-like
MEIDYVEFERHVAGGSNMHYFDLSIRLKSEQEHLCCNIQRNEYHNLYEFIRRCLTYCWYKEGSLFEDDDVVDPHLERIKNEAGGDESDEEKPAKKESKKDMPSKASTSKRKSKDDEDGKKKKRLKCTQEDNVWFHVHF

SEQ ID NO: 175494 - protein, 76 aa, Glycine max
  Coding DNA Sequence Number=SeqID_83809
  Subcellular localization annotation: CTP_CleavageSite=52; ConfidenceScore=5.35e-01
MVTYGYNIKSSCTPTFNHGVITTLRNPIGVALVGLGSSSSMDSFASWKMNSSGMEKEEREETPLQGEDESRRSSPP

SEQ ID NO: 175495 - protein, 313 aa, Glycine max
  Coding DNA Sequence Number=SeqID_83810
MGHYRAQKASLKIQNDRDGCEKRSCKYLLHSCVSEGTLGKDLTSKNNWRHPIHPVLNLCGKLRAGNLVQRELRGSDCDVKIGTRSLFLDHTTKLGWGLEPLHAQDHVGTTPGQDMEVHDKLITLDSDGDCFTEVVTVKGLKRQMTRERVEYDLDLSRVSGIRESRFRGTDDGVFAGTRSNGVATDDRGRGGGTTRVGGRAWLREFNPEIKQLKRNSGGNLTIRFTRSSNSERYMETWPGCELTIIGHPLKPGQGAPLHVEGGDGQSIMLGRGMVFEEFVDLKDPTKGFGTIKPGSIEFQAVRGGGGHGWSGIG

SEQ ID NO: 175496 - protein, 170 aa, Glycine max
  Coding DNA Sequence Number=SeqID_83811
MVGFPMEARRTGLQKRKKVSFKALEAKLHHGWEKEGWIHVDLSQHFYVLQFLPPVRRMTLSLKYEGLQLVYFSCGRYGGRQTICLDGPILEVKVDAITIGEKVSKEHVVMELATLLIVAKEGNNDEGVKADLAGMLFVCPNLDHHINDTIIGVLHNHNEASETYPLPDGD

SEQ ID NO: 175497 - protein, 101 aa, Glycine max
  Coding DNA Sequence Number=SeqID_83812
MTEKRIQYRVLTFKCLRVDADSLDAIQLLEDGCSQQHPCNKLVEEDIGDVVGCIAQETWNSAFRDASCVADAMGKQALSINMDYHVFELASDCISMLWELI

SEQ ID NO: 175498 - protein, 327 aa, Glycine max
  Coding DNA Sequence Number=SeqID_83813
MTVQSTQHRVLQDIDLDIPKFARLKGSRENPNSIINVHSREYTRRRPLAALDTNLRALSIGPGTRLTYWIGHMCSHPCTRTKWTKVPVSSLNNSKRQVVGLKGHQIPYHGKHTYMGRWICGYTETTMGMHTLDYLKGKEKKHSSPSPFLDPNRQPSDLLFIINPNHSSVGNQHYPLLIFLSIKAHNSASVTARKLLVALRGAAITNGETIDAVITTGEKGADVAARQGCHQHQLQNRFHVRKPPTAMARHAQAANTNGETCANVECVPPSLPARPTWSSPAIASCETGATRLVRALFARAEPFTGQELQLCKGHMHTMWLADGHMHA

SEQ ID NO: 175499 - protein, 118 aa, Glycine max
  Coding DNA Sequence Number=SeqID_83814
MVIDQSLFYDLTQLSSDGVPFEGTLDNDWKFDFSVHDARRLVCTNQADMTGRLLAGSLALESRILHYLIVRILLPRSSNLAQGTQPNDDEGQLPIEGDSSLLQSILDKFDGLQTYVGE

SEQ ID NO: 175500 - protein, 326 aa, Glycine max
  Coding DNA Sequence Number=SeqID_83815
MVVRSMFDLSLLKVLPTSQGWWVVLTYKATPLMVMRSKHDFDLIKDQRGALGFVEVCTKGRPWVLEECVPRADLGFLMYLYSKGEPWVCRALDQGRVCPGFCQAYGAVSRLTKDGPWILMSLVCNASVVLLHTWHSPWVACTGGVMTANLRFCEPFGGLIRKLSDLGFGHCALACMPLAVGGTHYRHGAYVFLTNWLVLETWWYALAYMSLVVGDMYWRRSSMLMSTCHSSWVGYDPEWAFLVGAKLSRQVESFELNIVVRDNGIWEVIPANDMFPGPRGAQAIKIIGRSAWDVCKLLALFAPHGKVEDVCPECWLVVAGSHHFGG

SEQ ID NO: 175501 - protein, 65 aa, Glycine max
  Coding DNA Sequence Number=SeqID_83816
MEYVVGEVDKELVVLFLLKQGCAIREIRNSGGSRKEKAVASGGSNLARLGKLGGKLLPYFAINRG

SEQ ID NO: 175502 - protein, 285 aa, Glycine max
  Coding DNA Sequence Number=SeqID_83817
  Gene Ontology: Mol. function=phosphotransferase activity, phosphate group as acceptor; Cellular component=cytoplasm; Biological process =nucleobase, nucleoside, nucleotide and nucleic acid metabolic process
  Homolog annotation: Hit_ID=A9PHR2; Match level="QueryCoverage=41%, HitCoverage=58%, E-value=6e-51, Identity=82%"; Hit description =Putative uncharacterized protein
  Pfam annotation: Domain name=ADK; Domain location=2-87; Score=-2.1; E_ value=7.9e-08; Accession=PF00406.13; Description=Adenylate kinase
  Pfam annotation: Domain name=DUF1723; Domain location=224-273; Score =31.7; E_value=2.6e-06; Accession=PF08330.1; Description=Protein of unknown function (DUF1723)
  Pfam module annotation: Pfam domain module=ADK::DUF1723; Domain location=2-87::224-273
MQESGNDKFLIDGFPRNEENRAAFEKVTGIEPAFVLFFECPEEEMERRLLSRNQGREDDNIETIRKRFKVFLESSLPVINYYDAKGKVRKIDAARPIEEVFETVKGIFGPKNEKIMIRTRGVGLVLGRTIEKVMGRRDTSNDDAPNSEGLLHLPPEAPVEEAVTDVEDFENHIALRVWNEEERPELKLSSHGRKMTRFERLAPEIEGLVAASGLNSWIECSLDMGDQRLMFAFVERKHKETSSFHLPVREVTITLGDVASLLHLPIVGAFHSFEQLHVDDAVDML

SEQ ID NO: 175503 - protein, 265 aa, Glycine max
  Coding DNA Sequence Number=SeqID_83818
MSYIDLTKVIKSIGYKAFKCLWYRHPRKALCKGLKPLNYDFNTLQLAEHVTGFDVVEVYVEDGVIDKCDKKLNDFKGDEVVVIDGVEAEPVVEGEVQVEGEVPVEVEVQVEAQVDVEPQVQLDEEGLVEVEVQVEDEAGVVGEMEVVVERMDDIDVGVDKDDDDAGSKKSDEDYVGDEEDHDDSSDCSEVSDTEYSDELDTPPGSEDEGPPKVRLPHFKVPKNDEDVKVEVGLQFQTQTQVTILNFITFTRDDCTFRIISSTSKA

SEQ ID NO: 175504 - protein, 57 aa, Glycine max
  Coding DNA Sequence Number=SeqID_83819
MRNYTLRVKPRKNDEEGEHGDEDEVAGENKVKVRDENEFGVRDENEFGRGGATEVPS

SEQ ID NO: 175505 - protein, 147 aa, Glycine max
  Coding DNA Sequence Number=SeqID_83820
MTVKVSTTTTTKKPISSIIIELGVKEFSRDELPKRGSNIVLITDGRVILIRKTVKNQIQMFKEKHRFANRSEFINLILNIKKIINDGAITEGEISKFVAKLTNTSPKIKCEKYFEEVSKKSNAKNTLKKSLTRKMAKGRKEEKKRKP

SEQ ID NO: 175506 - protein, 82 aa, Glycine max
  Coding DNA Sequence Number=SeqID_83821
MKGQIRALFSTEARAKLEDSASVEGFLSVWGFNGEQWQFVMATGGYYKAQNAQVTNALGNGNVTHTPEVFSKIPTVRCTSVL

SEQ ID NO: 175507 - protein, 173 aa, Glycine max
  Coding DNA Sequence Number=SeqID_83822
  Gene Ontology: Mol. function=oxidoreductase activity, acting on the CH-OH group of donors, NAD or NADP as acceptor; Cellular component =mitochondrion; Biological process=malate metabolic process
  Homolog annotation: Hit_ID=A7PK26; Match level="QueryCoverage=96%, HitCoverage=31%, E-value=6e-59, Identity=63%"; Hit description=Malic enzyme
  Pfam annotation: Domain name=Malic_M; Domain location=39-173; Score= -3.3; E_value=1.1e-10; Accession=PF03949.6; Description=Malic enzyme, NAD binding domain
MGMVTDLGLQQHRLDGDDYLAVVDEFMEAVFTRWPNVIVQGTAGVAIAGLLGAVRAQGRPMIDFPKQKIVVAGAGSAGIGVLNAARKTMARMLGNNEVAFESAKSQFWVVDAQGLITEGRENIDPDALPFARNLKEMDRQGLREGASLVEVVKQVKPDVLLGLSAVGGLFSKE

SEQ ID NO: 175508 - protein, 49 aa, Glycine max
  Coding DNA Sequence Number=SeqID_83823
MGSQGTKGNPSKFKKDYYAFYDKECSRIAEHVYLGSDTMAKSVELLRQH

SEQ ID NO: 175509 - protein, 79 aa, Glycine max
  Coding DNA Sequence Number=SeqID_83824
MIQLVFHYLQVLRQEFEDDVNIRWVIFESAQVEVHWHEVIMSEQSQQDAYSSFRQCHSIEEYEDKKIDGECPVLTKRKK

SEQ ID NO: 175510 - protein, 569 aa, Glycine max
  Coding DNA Sequence Number=SeqID_83825
  Homolog annotation: Hit_ID=A7P2W3; Match level="QueryCoverage=15%, HitCoverage=16%, E-value=3e-17, Identity=52%"; Hit description =Chromosome chr1 scaffold_5, whole genome shotgun sequence
  Pfam annotation: Domain name=RRM_1; Domain location=166-237; Score =17.1; E_value=0.0039; Accession=PF00076.13; Description=RNA recognition motif. (a.k.a. RRM, RB
MLPGRFSFFGGGGDSGAVVDNANSSPSKGGGDELAVVQPTLKLETDRQVYRPGDPVIVTIQISNPANGYSFLMERLGFEIRGIEKLDTQWFATQKLMPGSKQRRGCPWCYVAPVGSVMAVEVTNTFEPSHNFDGKWYSKQSLWNGPPRRRDAGKSNGRDATDVHSFYFTRFPEEMGEKDMWMKFKKWGDVREVFIAKHRNRDGRRYGFVRFKGVKEDVKLLEQQLDSMVIGGLKLHANLPKHGKGRMNDGKPNLEEEGDGIQGKGSRVVEPIPTIADKTNDVRKRSGLSTPMEKAKWLNDAWVGRLKKLSMFDRLEDEIMTVQQGCRKWMILVPFAREVELGLAWIMCWGIPLHAWDVDNISKIAATVEEVVEVEELLRLDRARVLIKIPRKPSIQHTVAALINGEVFTIHLVEETCYYPCRHKCLTGCSLGSFDDVIIGVERTSSSRRLMDKETCVDTVAVLINGEVFTIHLVEETCYYPSTHSITNSQKNAAGIAVSRSQTSSPQTTYVERLSKDRTGGSQDMVEIGNAAGIREEEMNNTVKSGRKGLEERDRSAGFANDTNVESHI

SEQ ID NO: 175511 - protein, 106 aa, Glycine max
  Coding DNA Sequence Number=SeqID_83826
MIITKDDDKGDDKKLKDQSKNNSSESKINHRTTQVNQEEFKTQEESLESRIKIQGSRSQESRFKVQDLKNQDSRFKISRIKIKIQQSREGSIKISMKSFSHKLNST

SEQ ID NO: 175512 - protein, 37 aa, Glycine max
  Coding DNA Sequence Number=SeqID_83827
MEVHHVNVGTFVVEVRNGEEGVSYRSGGCVVENGKLK

SEQ ID NO: 175513 - protein, 58 aa, Glycine max
  Coding DNA Sequence Number=SeqID_83828
MEDIHLHVELVGLGSSSSMESFASLISMAAEWRRKKDDWRRHFKEKMSQEEAHHHRKL

SEQ ID NO: 175514 - protein, 246 aa, Glycine max
  Coding DNA Sequence Number=SeqID_83829
  Homolog annotation: Hit_ID=A1FYS9; Match level="QueryCoverage=22%, HitCoverage=6%, E-value=9e-12, Identity=66%"; Hit description =Putative uncharacterized protein
MATGRLIAINGKPPLRVDREPGQDGQPAQGGQRDDDDENRPLNFSWRSTFPPANTLHRAGSLGGDRLGQTLRRASGRPHRHCRGRTGARVHRHQRAQGGLEHLPAELLRAAEPECGGRHPAQPAVGVPSAGRQGSRTGRAGTRAAQPVAAGRGCGDLAGARCDGTGGTGGAAGDGVQPAGRRTGAAGRAAGHGGRASLRQRGAAHAGRDPAAAARRGAGGIRRAGHPGRVAGGGGGGRHRCGGLAE

SEQ ID NO: 175515 - protein, 35 aa, Glycine max
  Coding DNA Sequence Number=SeqID_83830
MGADQLSFHATFALSALVALSKYDGNASRLARGTC

SEQ ID NO: 175516 - protein, 96 aa, Glycine max
  Coding DNA Sequence Number=SeqID_83831
MAPKKISTKRSRRDVAAEGSNVAPEFDSHRFWSAEHQQRFEAIKGWSFHRERRVQLREGEYTYFQEEIACRHWTSLVTPMAKFDPERRECETCVHG

SEQ ID NO: 175517 - protein, 186 aa, Glycine max
  Coding DNA Sequence Number=SeqID_83832
  Gene Ontology: Mol. function=nucleoside-triphosphatase activity; Cellular component=intracellular; Biological process=transport
  Homolog annotation: Hit_ID=Q7N160; Match level="QueryCoverage=58%, HitCoverage=25%, E-value=2e-10, Identity=33%"; Hit description =Protein transport protein HofB
MVPYKTAVELCAIERGGPAQCQAGERGIPAAKGSRYVANLSVAHSAGNAAAPATTPACATAVSSSSALPTRKKTMDKPDSTLQALCARYQAVILHHDATHLRVAVADAPDPLLLEALQFASQCAVEVECWPAARLEQLLHQPESSAAPREQASAESAIHAVDQILRQAIQRRASDVHFEPQRHGLR

SEQ ID NO: 175518 - protein, 82 aa, Glycine max
  Coding DNA Sequence Number=SeqID_83833
  Subcellular localization annotation: CTP_CleavageSite=48; ConfidenceScore=5.09e-01
MAFFQSYLDYKAQNAQVSNALGNGNVAHTPDSFSKIPTLQTKFREDPTVNEGWATFLPRQLHVASLRSFIKRLPREASSWLL

SEQ ID NO: 175519 - protein, 120 aa, Glycine max
  Coding DNA Sequence Number=SeqID_83834
MPIQGHNISRRSKLNNGSSREILNGHISSHGCPIRGHNISRRSKIEQRKLSTNLNGHNFSHREPIRGHNIETLEIEQRKLSRNSNGHNISLGCPIRGHNYIETLEIEQRKLSRNLNGRNL

SEQ ID NO: 175520 - protein, 63 aa, Glycine max
  Coding DNA Sequence Number=SeqID_83835
MVSRYALNEIAAEYERVAYAGKNPSCCGCVMRATHGLPCAYQGLCEAEVTITEKMKTISKRFK

SEQ ID NO: 175521 - protein, 68 aa, Glycine max
  Coding DNA Sequence Number=SeqID_83836
MYPLLVPQRMYPPMCWDKEFSGGEGKNQKNSQAVSPLNSLGKREERHKRIQAVSLSILLAKGEENEKE

SEQ ID NO: 175522 - protein, 50 aa, Glycine max
  Coding DNA Sequence Number=SeqID_83837
MKDILGGIVGFHITEHQLTVGLTPLIFDSDWKKIEAFVVSKTVIQAFYSF

SEQ ID NO: 175523 - protein, 48 aa, Glycine max
  Coding DNA Sequence Number=SeqID_83838
MAPNYMGHQVYHVLTIAEEPVDLLGGRVGVRHSFGLCQQSREFLTPVQ

SEQ ID NO: 175524 - protein, 287 aa, Glycine max
  Coding DNA Sequence Number=SeqID_83839
QQQATRRQAAFGHLEEAGVVLVTDVLEHADRENRIERFVQFPVVLQADFNRQPRAQLAGKLGLFLRNGHADAADAVALGCELQGFAPATADVQHTLTRAQPQLAAHQVELGFLRGVEIVGIAPVATAVDQALAEHGLVEQARFRASATSRQPCTRSSSAPASGRRGIQDVGIPPTLHVALAEAERALAHDPRSKKRGSCTWISCGWVPPMRTPASCSRPATRSCNPVSPPVPRSHAVNRVPEQLHVPTTCGNSTAAGTSAVWFPSMDLHRENSAVPCSCLYIIACHG

SEQ ID NO: 175525 - protein, 497 aa, Glycine max
  Coding DNA Sequence Number=SeqID_83840
  Subcellular localization annotation: CTP_CleavageSite=49; ConfidenceScore=5.04e-01
TVASAECQSEQPDQQNPLTSSEWQQSPAPSRFQALITSNAHAQVTDAPLIEMRRQRIERRLRRRTVGQASQRLGPAQRCAFACIEEAAFVPRGQGVQLARLDAALAQRGAVHVHAVAAAVELRHAQEHQFHQGRVDRTVMHRLAGGQQALEGLGGQAGVGDAGRGVVGHFRLHGGHVGRLSLPGRRTAIARDNRRQFFRIQHAVHVGDAAIGHFDGGDRVQPIAMEAQDRRLAVDVAQLRRMHRATTCDGPEQAADALGAQQRAYRCGDHAAAVGDQLRVGVQQGLDCFAVAALRGIHEARQQLPVLAGIGIEAWAPGLQALPGPMHQLPAVGFAVADQVGDFAVVVVERLLQQEGGAFLGAELFEQGQEGDRDIVGQRMQLRRAGRRVGLQGDRQWLGQPGADVVHALALGRAQPVQAKPGGGGDQPGFGVADGRRVGAGPAQPGILDHVFGVGAAAEQAVGQGHQARAVGLESGFGVHVGKDAAVAHGVTEGLRG

SEQ ID NO: 175526 - protein, 134 aa, Glycine max
  Coding DNA Sequence Number=SeqID_83841
FPALITGLCQSFGVPVTPSKVIRLLITRAFIEKYCTPRQAQGGDPQAPDAPPPPHQADPAGSFDTECLNLQSHGFAPFPCPTPDQFRAEVAWPGDWPEAQAGEAPAEAPGNADEARMDEEMTNLLDFLGGSGAT

SEQ ID NO: 175527 - protein, 98 aa, Glycine max
  Coding DNA Sequence Number=SeqID_83842
MKLHEFLWESYTTTVMSALPPISLVGIVAWRKTKMFIDPKNANTTTSAEVAETLQYMVSPQGRNTWTIDDLVPYVENITILSKEQERITEAVAHGPAS

SEQ ID NO: 175528 - protein, 326 aa, Glycine max
  Coding DNA Sequence Number=SeqID_83843
  Homolog annotation: Hit_ID=Q2HW90; Match level="QueryCoverage=66%, HitCoverage=52%, E-value=9e-20, Identity=27%"; Hit description =Putative uncharacterized protein
SMEPIASLAQYYDQPLRCFIFGGFQLSPMVEEFEEILGCPLGGRKPYLFSGFYPSLARISKKVQISAQELDRQRQVENGVVGILRKYLEGVLFPNVDGLVDLAAIDVFLAYHNHKESPVVAMLADLYDTFDRRCEESNARIVCCTPALYVGLVSHLFLQKVGPSIRYKERKNRDSIFMRRMSKCSLDGKQGGCINYNLVLAIRQLGYPMRGAPLDESITPFIARGFSDHNARDRELRGSSNGIIGGYHKWLRVRTQGLDWLPNLKTVRDDEVKASEESDEVQALKAELERAWVVEEKFKAAIVSSSSEEVKGIITGQRHDLEGRAK

SEQ ID NO: 175529 - protein, 111 aa, Glycine max
  Coding DNA Sequence Number=SeqID_83844
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=95%, HitCoverage=97%, E-value=5e-20, Identity=48%"; Hit description =Putative uncharacterized protein
MTMITPSWKLTLTKGNKSWYRAPPEGGRPGDPLVLERPPPRWSSNSPYSESYYNSLAVVLQRRDWENPGVTQLNRLAAHPPFASWRNSEEARTDRPSSTVAQPEWRMGRAL

SEQ ID NO: 175530 - protein, 116 aa, Glycine max
  Coding DNA Sequence Number=SeqID_83845
MKLAKYRLKAQVEKDEGPSGEGQSPRVEKDEGPKFLSRFLVEPIIRLIKVILVASTLTYLPSLEVASTLTYLPSLEVASTRTYLPSPEVASTLTYLPSLEVASSKNSTACIKRSAP

SEQ ID NO: 175531 - protein, 306 aa, Glycine max
  Coding DNA Sequence Number=SeqID_83846
  Homolog annotation: Hit_ID=Q6WAY6; Match level="QueryCoverage=75%, HitCoverage=38%, E-value=3e-26, Identity=33%"; Hit description =Putative uncharacterized protein
QGEWVSFIDVWALLVFGIVLFPKVDGLVNLAVIDAFLAYHHSKESPVVAILADAYDTFDQRCKKSGTRIVCCTPVLYGWLAWHLFCHESRPIYPLQGHHMCTEKGKTNWEQLMASMVGASINWFPRWKEGRVGVLSSCEGFSNVPLMGTRGCINYNSILAIRQLGYPMRGAPSEESITPFIAWGFSDPNARIFQRVQKAWSMMQRKDKELRGSSNGIIDIYHKWLKARTQELDWLPKLKTSREEKVETSEESEEETKRARKEEWGRNKFRGALWGSNNELKLWRAKRDQSRVEGMILEDKLKACQR

SEQ ID NO: 175532 - protein, 124 aa, Glycine max
  Coding DNA Sequence Number=SeqID_83847
MGREEPRPMLRKSEVAPLEDDDASCVELKRVGSMAAPMVAANICQYLLQVVSLMMVEFVDGTISQPVITHPLHSAWKRCNNMVISWIIHSVSSSIRQSLLWMDNARDMERSEVQILSRRFIENL

SEQ ID NO: 175533 - protein, 136 aa, Glycine max
  Coding DNA Sequence Number=SeqID_83848
MEKNTNMRLRDLSETKDEEVPQLQRKRKVVARPQALLSPKKDKVVMATPSSKELIFSYIMPRKMKIREIRENLAFLRRTGIHPLHLMNLNNSRVQDKNQEEFKTQEESLETRIKIQGSRSQESRSRFKNEEKTQSR

SEQ ID NO: 175534 - protein, 71 aa, Glycine max
  Coding DNA Sequence Number=SeqID_83849
MTHRSVCKRTQQCSEAELKLIHYVVDGKDEVSPQLEEEEDGHGGDGRGKDEVSITKKSVTKLTIKLTRTLH

SEQ ID NO: 175535 - protein, 137 aa, Glycine max
  Coding DNA Sequence Number=SeqID_83850
MVDFHLIDLPLEGYPYTWSKSLRTPDRVKERLDRALSSGNYLGMLEVRRPVIMEDDNLMLCSTFLKDEFCDALFQMILDKSPGTSSHTCTSIISPSSASLFHMETSPRAKAIFQSMSIQWLPLELNRDYLNSSSHYC

SEQ ID NO: 175536 - protein, 70 aa, Glycine max
  Coding DNA Sequence Number=SeqID_83851
MGFLFFTFRVIRLNKNGTFLATGEGSVGSELGSELVEGERSKVVFVEGVGVEVEDGFADDRGGSSDDGFQ

SEQ ID NO: 175537 - protein, 355 aa, Glycine max
  Coding DNA Sequence Number=SeqID_83852
  Gene Ontology: Mol. function=phospholipase D activity; Cellular component=membrane; Biological process=phosphatidylcholine metabolic process
  Homolog annotation: Hit_ID=A7NVP6; Match level="QueryCoverage=30%, HitCoverage=21%, E-value=1e-47, Identity=76%"; Hit description =Chromosome chr18 scaffold_1, whole genome shotgun sequence
  Pfam annotation: Domain name=APC10; Domain location=231-355; Score= -46.6; E_value=3.9e-05; Accession=PF03256.7; Description=Anaphase -promoting complex, subunit 10 (APC10)
MDEDWVDMSHVGTGHGALTNHGYDFALVKNANRRGSHSIPFVLAFFLFLAWISLSLQRASYSYVPPHSSHTDIRANLVRFGVSEVAKDKRGWIFDPIALALASGISVMSTLALLFSFMQPWHDLHCKIEGRAAYDILTSFEQRWRKATKWSEMGRKLKRVSNWNDDSLIKIERISWILSPSELTPVDDPKLWVSKEDDPENWHVQVFRSIDYGSLKGFPKDVVVAKTQPYIEDNEVMKGRDGDGWEEEKKRRDRKAYTVVGTVGQRKPYTALGIVVGAQRSKLSTLPVNKLIVLYVVFKLDESYTLSKVSIHAGDGFHNLKEIKTVELMKPTGWVYLSLSGADPSMTVRELCGRM

SEQ ID NO: 175538 - protein, 139 aa, Glycine max
  Coding DNA Sequence Number=SeqID_83853
MSFLVHTEDCRDFIRMGPQESIQLCHKLRGTRIVKDNMRSTVEEQVAKFCILLVTMSIIKELLVQPSGRDIPSNIASHSRFHPFFKDAGFMHKLQILTPYRGVRYPLKEYSARGQKIPKELFNRRHASLGNVMRELLAF

SEQ ID NO: 175539 - protein, 250 aa, Glycine max
  Coding DNA Sequence Number=SeqID_83854
MSTDGIIRSEVHGISMIIDQSLFFSLTKLPSQGAPFEGTIVDDWKFDYSSHDTHCMEDLILIWAFLTGRQIDWAHLVRYRMHKALQANAPLPYPQLVTLFLCHFQIPLDDEPLVQVKRSFAIGAGVKDTVPPQDERTPSPPPQRDDSSALMNEVLSKLWSLHTYVGKRFDSLDGRFEGMDTRITHLEEDGLNCHHQKGGDCRSKDFDFDVLMMPYDYDVLMPREHVLLKLRSRQKIQEIQDTSSRRSLVI

SEQ ID NO: 175540 - protein, 83 aa, Glycine max
  Coding DNA Sequence Number=SeqID_83855
MGVQIATRPTWAFQDVPPEGEEQKCSTFLVSEIHLKISEKNCFREENPSQGASVTFPWVISRRFSTVLRRSSFVLRHSSVFNR

SEQ ID NO: 175541 - protein, 301 aa, Glycine max
  Coding DNA Sequence Number=SeqID_83856
  Homolog annotation: Hit_ID=A8GG73; Match level="QueryCoverage=98%, HitCoverage=82%, E-value=1e-161, Identity=92%"; Hit description =Putative uncharacterized protein
  Pfam annotation: Domain name=DUF1305; Domain location=26-301; Score =268.9; E_value=1.1e-77; Accession=PF06996.2; Description=Protein of unknown function (DUF1305)
MIATELAPPQINALYRLPDDFWPRLRSAPYKHDLFQLLRRIDAQGGQPYLLGRAPLPRHEMLRLGQEPSLSFAPSTLAQVAPRANSPLHDVSIFSFGLFGPNGPLPLHLTEYVRERVYHHQDTTLLAFTNLFHHRLTLLFYRAWADAQPTVSLDRPDNRRFDEYLSSLIGIGQPAQQERDSINAHAKHFMAGHLIRHSRDPEGLSKILQQYFKVPVRIVENVPHWLRVEPREQARLKAGRGAPRLGESAFLGIAVRDIQHKFRIELGPMPQQDYDRFLPGADLCRQLRDWVRQYLGIEFNW

SEQ ID NO: 175542 - protein, 203 aa, Glycine max
  Coding DNA Sequence Number=SeqID_83857
MQSQGLAVPPKPLIGPFDPRVSIKGSCVDPSGNDPETGDSDRCGLYIEANPARLVAMGRVYEGSTVVHNTPLLPGQVKTLHTFLAWPTHLVKSLSRQVVVSPSKPPSKLDPEVDDPLYLMTLTISELFLRPYQVRWDATVFGVFNPDFPLYIKHKDLFKIAHGCGFCISLKHVCEWGILIFMDSSSHSPFIGLGNRSLSLKIT

SEQ ID NO: 175543 - protein, 123 aa, Glycine max
  Coding DNA Sequence Number=SeqID_83858
MRQANDVKEALPGRQPSFNFCYLCLFFMHLIIWNLLYNLNFGAYQPSFEWTKFKTSKIFLKINPFAKRLLLAKRIIIHVLSHEFQALSAQPWYLRLIISAKLAKVKLSQNQFELNSAKLQPDR

SEQ ID NO: 175544 - protein, 31 aa, Glycine max
  Coding DNA Sequence Number=SeqID_83859
MTSSNKQTSTNFLGSKDAENIKSDEFRMLSE

SEQ ID NO: 175545 - protein, 234 aa, Glycine max
  Coding DNA Sequence Number=SeqID_83860
  Homolog annotation: Hit_ID=Q949K7; Match level="QueryCoverage=19%, HitCoverage=51%, E-value=7e-09, Identity=62%"; Hit description =Putative gag polyprotein
MASMMDAMLGNETTHGGADSTLLTATHHPIPNMMGGERSTSGHISNPHPGYNRGTYPYGLPPNYTPPAIRDDAGHVPPLILEGEPPRHPDEVHEDHREHAQGDVDSYSPFPTEGPVPNALPQPNITGEPRSHPTQPMFLSVGGPPPAAEGKGKLDLIEERLRAIEGFSDYPFTDMTDLCLVLDVASLQSSRDEKLLMHFFQDSLAGAAFIRYTNLEASRIHTWKDLITAFLRQY

SEQ ID NO: 175546 - protein, 36 aa, Glycine max
  Coding DNA Sequence Number=SeqID_83861
EEVGPADAQGATQGDEDGAKNDGDMAYLLDYFIRGG

SEQ ID NO: 175547 - protein, 246 aa, Glycine max
  Coding DNA Sequence Number=SeqID_83862
  Gene Ontology: Mol. function=carboxyl- or carbamoyltransferase activity; Cellular component=ornithine carbamoyltransferase complex; Biological process=amino acid biosynthetic process
  Homolog annotation: Hit_ID=Q6DA71; Match level="QueryCoverage=99%, HitCoverage=73%, E-value=1e-120, Identity=84%"; Hit description =Ornithine carbamoyltransferase
  Pfam annotation: Domain name=OTCace; Domain location=65-242; Score =322.2; E_value=9.3e-94; Accession=PF00185.15; Description =Aspartateornithine carbamoyltransferase, AspOrn binding domain
  Pfam annotation: Domain name=OTCace_N; Domain location=1-59; Score =7.3; E_value=5.3e-09; Accession=PF02729.12; Description =Aspartateornithine carbamoyltransferase, carbamoyl-P binding domain
  Pfam module annotation: Pfam domain module=OTCace::OTCace_N; Domain location=65-242::1-59
MKDTARVLGRMYDGIQYRGYGQALVETLAEYAGVPVWNGLTTEFHPTQLLADLLTMQEHLPGKALNEMTLVYVGDARNNMGNSMLEAAALVGLDLRLVAPKGCWPEEELVAQCRAAAQHTGGKITLTEEIAEGVQGADFIYTDVWVSMGEAKSVWEERIALLRPYQVNSAMLALTGNPQVKFLHCLPAFHDDQTTLGRQMAEQYGLHDGMEVSNEVFESDHSVVFDQAENRMHTIKAVMVATLSQR

SEQ ID NO: 175548 - protein, 100 aa, Glycine max
  Coding DNA Sequence Number=SeqID_83863
  Subcellular localization annotation: CTP_CleavageSite=66; ConfidenceScore=5.15e-01
MIRPTYQGNPCGVYPDLSSFTRSGIYPDLSSFTGSGVYPDLSSFTRSGVYSDLSSFTGSGVYPDLSSFTGSGVIQTSVACIKRSAPTQVNIKSGFSGIVV

SEQ ID NO: 175549 - protein, 76 aa, Glycine max
  Coding DNA Sequence Number=SeqID_83864
MASVKADGLDDEGMSSVLTLFLDAICKKRIDSASLSHKDFNRRMSIHPHKMNSLSVVGALSEFIWKHMLDKWPQIS

SEQ ID NO: 175550 - protein, 76 aa, Glycine max
  Coding DNA Sequence Number=SeqID_83865
MINDGTYGFGDPTVLWLRMPPDSWDTHFVSKRPFRGNTGSNKDRRESLKVYQSHTGLTFSPWVKVYDKLGFWLKAL

SEQ ID NO: 175551 - protein, 160 aa, Glycine max
  Coding DNA Sequence Number=SeqID_83866
MALKKKHRRVMANLTLLGKMSRIGTTNNYCINTAKVDVSLSELNVLSECHPLSEVSTRLADRKNLEGNMSCRHALSVSLARSASRLSPFRLSVSLALSKSSLTRAKRENGAKREIEELPCSGRLNPQLGILAEGFNIERCIVSLELDRAGLGYRMSGHGV

SEQ ID NO: 175552 - protein, 54 aa, Glycine max
  Coding DNA Sequence Number=SeqID_83867
MEKEKDEWRHYLLPTSAPNRTSSIKRLILIKHHPQIPLVGLNSTRTALRQTYNN

SEQ ID NO: 175553 - protein, 65 aa, Glycine max
  Coding DNA Sequence Number=SeqID_83868
MTCWSRTWLWRCVCCPLPAIPRPLWCFALRLPGDAVLLDESSISRGPDALAGGGRHSVELTETRN

SEQ ID NO: 175554 - protein, 167 aa, Glycine max
  Coding DNA Sequence Number=SeqID_83869
  Homolog annotation: Hit_ID=A6H5N3; Match level="QueryCoverage=29%, HitCoverage=71%, E-value=2e-10, Identity=73%"; Hit description =Putative uncharacterized protein
ALRPIIPDNACILCLTAAAGTELADAYSPDTVIASSPGKEVHDPPSVADHPLGPATDHRLGKLLPHQLANQTRAPPRADSSFCSSAYGVLAAVSSCCSPPKGRIELSMRFLVALLIASLFVDKADSEFSSIPRHNLYPGASYSTGVRSQKYSPPTPRARTDNFHHVK

SEQ ID NO: 175555 - protein, 56 aa, Glycine max
  Coding DNA Sequence Number=SeqID_83870
  Homolog annotation: Hit_ID=A6FJQ2; Match level="QueryCoverage=67%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLDNLAPWDLEI

SEQ ID NO: 175556 - protein, 278 aa, Glycine max
  Coding DNA Sequence Number=SeqID_83871
VCVETIYGGDASVPFPTSEIQYVRDASSTFIAWPIHLVKPITDDSNHNACLPLGRLGEAEVAAEADPLGELMKTLFYVYKSPVEVPWEATQFGLPDVGAKFFITHVDLAEIISADKCLNISILQLWTIKVDQSLYGLLEPQSIHNAKDRREQCQQYIQTWVKESQRQLYLGVYLHQKKPDINIKATINRFYSNIQMMVCGGMSNQPAPRWVEPKSHVQTGAYECGYYVMHWIWCIVTGGLKDDWNKWFSDGSPLDVEAITTLRQKWATFFLSIRKSGC

SEQ ID NO: 175557 - protein, 148 aa, Glycine max
  Coding DNA Sequence Number=SeqID_83872
MGAKHLTRTKEWSHVIERSFAGDLIPIDLEINATCRRRNQERIRNFLQALEVAAIPEEEPQSSEESSSFPIAEHSHLDPSEDYIIAEEPRRITLEDYSSSNVPQFFTSIAQPEVQAQTITYPPPLIQLIQNNLFHGLPNEDPYAHLVM

SEQ ID NO: 175558 - protein, 33 aa, Glycine max
  Coding DNA Sequence Number=SeqID_83873
TDASGDGVTIDRSLPLLGAKQAENVAARQPSIL

SEQ ID NO: 175559 - protein, 178 aa, Glycine max
  Coding DNA Sequence Number=SeqID_83874
MVEREMITMIVDTLPVFYYEKMVWYMSSSFADLVFAGERIKLGLRKGKFDYAASTSAGNRRIGTGGAKKKEGDAHAVQRLNDTGWLTFQEDSPNVWTNPLANHGSSVVNAMEEWKQFTLEALREAGVIDLDGNKGDPSLMHPGGSHDVETCLIAEELLLGLISRGQIEICSAKKEEGE

SEQ ID NO: 175560 - protein, 99 aa, Glycine max
  Coding DNA Sequence Number=SeqID_83875
MECQGDPESEASKQWDSRLSEGTTVIVFNEPSIYIYHFPNFVRSVEPCHWQHDHRSISSSTMFFGLARSPKKCLFPIGCCIRRALLRHYFDTPWWHHPH

SEQ ID NO: 175561 - protein, 126 aa, Glycine max
  Coding DNA Sequence Number=SeqID_83876
MAPKKLSAKRSRRDAAAEGTSAAPEFDSHHFWSAVHQQCFEAIKGWSFHRVRRVQLRDDEYTDFQEEIARRHWTSLATPMAKFNPEVVLEFYANSWPTEEGVRDMRSWVRGSFITWAHSANWMFLI

SEQ ID NO: 175562 - protein, 92 aa, Glycine max
  Coding DNA Sequence Number=SeqID_83877
MATAEALERETKRARKEEWGWNKSKRSLTEQLSRTEENMWTIIDHYKVKLNLAAGLEQKLKDEHAKVSALQVEREARKRVIIIAQRSYEKDG

SEQ ID NO: 175563 - protein, 78 aa, Glycine max
  Coding DNA Sequence Number=SeqID_83878
MKSSTLFALFLLSAIFTSYLPSATAGDLVDTDGLMATLLKMEEHTNYVVVHFDQFRNRRLVVIEVQELQWVVDYVSET

SEQ ID NO: 175564 - protein, 35 aa, Glycine max
  Coding DNA Sequence Number=SeqID_83879
MTGAVCCCGVEQDYANFHSKPEPKKIMEKYEVDPG

SEQ ID NO: 175565 - protein, 129 aa, Glycine max
  Coding DNA Sequence Number=SeqID_83880
MDMLSCSVIRGILHQCRVHCLFNGVEDAIRENATRSDIAQLIAHLNKHSQGSVVKERTWTKEVAVMLKNRTMLCRHNSHKTKMISPLEKLLILYISITFQAEIHASFETPNPLSPRIHAATFKICNAKH

SEQ ID NO: 175566 - protein, 706 aa, Glycine max
  Coding DNA Sequence Number=SeqID_83881
  Gene Ontology: Mol. function=peptidase activity; Cellular component =proteinaceous extracellular matrix; Biological process=proteolysis
  Homolog annotation: Hit_ID=A7PK60; Match level="QueryCoverage=44%, HitCoverage=60%, E-value=1e-119, Identity=67%"; Hit description =Chromosome chr15 scaffold_19, whole genome shotgun sequence
  Pfam annotation: Domain name=MORN; Domain location=412-434; Score =28.0; E_value=3.5e-05; Accession=PF02493.11; Description=MORN repeat
  Pfam annotation: Domain name=MORN; Domain location=435-457; Score =36.2; E_value=1.2e-07; Accession=PF02493.11; Description=MORN repeat
  Pfam annotation: Domain name=MORN; Domain location=458-480; Score =27.4; E_value=5.3e-05; Accession=PF02493.11; Description=MORN repeat
  Pfam annotation: Domain name=MORN; Domain location=481-503; Score =34.7; E_value=3.4e-07; Accession=PF02493.11; Description=MORN repeat
  Pfam annotation: Domain name=MORN; Domain location=504-526; Score =19.9; E_value=0.0098; Accession=PF02493.11; Description=MORN repeat
  Pfam annotation: Domain name=MORN; Domain location=550-569; Score =13.1; E_value=0.25; Accession=PF02493.11; Description=MORN repeat
  Pfam annotation: Domain name=MORN; Domain location=570-592; Score =31.6; E_value=2.8e-06; Accession=PF02493.11; Description=MORN repeat
  Pfam module annotation: Pfam domain module=MORN::MORN::MORN::MORN::MOR N::MORN::MORN; Domain location=412-434::435-457::458-480::481 -503::504-526::550-569::570-592
MEQKNWNLLDEALGLNNNNAKPWPLCGRFVLVEDCVDTSAAFVLHQILKRSFSSHPSSAVVFLAFSHPFSHYDRVLRKLGCNLAAQRDNGRLFFLDMLMLQCPGKANHDGLASVFEQIERVITALHQDKKFISIMIDDISFLEVAANGSSNDVLNLVHYCHTLTSDSEYGCAFIALDHKDIYLNGDRTAVMLEMEFLADILVKAEPLATGLAKDVHGQKKSEVQIGKESVGVSSDFNPQFQKHPYHRHQQFYPQIEIDISPQSPPQPTTPPPPPPPPSLSKQKHIFKPQNAAFFSVSVAAKSAAFRALRRVRRQRALLLLAVPFLYLYFLISRSFLLDLLSAIAFSAALVFSLNLAFPLPLRSVRLKAAKNSASRPAPALPVFWTIGSRPKTEKRAAASGCWVQVFGNGDVYEGEFHRGKCSGSGVYYYSRSGRYEGDWVDGKYDGYGVETWARGSRYRGCYWQGLRHGFGVYRFYTGDVYAGEWSNGQSHGSGVHTCEDGSRYVGEFKWGVKHGLGHYHFSLKDDSIDRNRMSQFCCNSIDSQLGSEKQKLQDKMHGFGIYHFANGHRYEGAWHEGRRQGLGMYTFRNGETQSGHWQNGVLDIPSTRNTTSPVSPVGVYYSKVLNAVQEARRAAEKAYDMAKVDEGVNRAVAASNRAANAARVAAVKAVQKQNYHKKAASLGGYTSLSSFMPTATFAFGIMLSLI

SEQ ID NO: 175567 - protein, 1197 aa, Glycine max
  Coding DNA Sequence Number=SeqID_83882
  Gene Ontology: Mol. function=nucleic acid binding; Cellular component= nucleus; Biological process=regulation of transcription, DNA-dependent
  Homolog annotation: Hit_ID=A7PCH8; Match level="QueryCoverage=50%, HitCoverage=79%, E-value=1e-166, Identity=51%"; Hit description =Chromosome chr2 scaffold_11, whole genome shotgun sequence
  Pfam annotation: Domain name=DEAD; Domain location=605-838; Score= -42.4; E_value=0.061; Accession=PF00270.20; Description=DEADDEAH box helicase
  Pfam annotation: Domain name=Helicase_C; Domain location=1028-1107; Score=65.9; E_value=1.3e-16; Accession=PF00271.22; Description =Helicase conserved C-terminal domain
  Pfam annotation: Domain name=ResIII; Domain location=601-832; Score= -15.6; E_value=0.00099; Accession=PF04851.6; Description=Type III restriction enzyme, res subunit
  Pfam annotation: Domain name=SNF2_N; Domain location=607-987; Score =15.3; E_value=1.2e-09; Accession=PF00176.14; Description=SNF2 family N-terminal domain
  Pfam module annotation: Pfam domain module=DEAD::Helicase _C::ResIII::SNF2_N; Domain location=605-838::1028-1107::601-832::607 -987
MYVADRTRSKRGGVVGSGLIMGEKKKRVHDYHEEIVLEDNEEGASVKVEPGPGASSSSSSSGARALKRERVSEHGFQNLGGRADDPIKISDSEDDDGEEGLSDFEKKRFLGEEEKERKSEEGKGCGGEKKHAVAESGSNDEGYDSLLSSLSESENAVTSDEDFQVDDDGNESHYYSSSDSSSYDDGERGGCRKMVKERVRKVESETESSVVYKRKGERKDIELVEEEEPRIGADCSSATSNKSEIYKEEPGHGAQKHKVKRVESVNADAFGDHSESSDHSMQSEAEALEHMKKRDRDHQNVSLENKAGDSAVVKMSEKNDNVDAGKVGEHKYEFNSNKREKPEKVRVVDDETDDKHELYEVLRMPSRTKNRCLKFFTECFWGENDSVKDDSNQLEEKDDDIDQGQTQPLASRETVLVNWNFTKKELIEKSEFEKELDNLWGEMDMLLRVEEIGSQIDKVGENEENSASQCKHDTIFNEEIGIYCRWCGWIHTEIKYITPPFQSTLLPVRTIELKQFFATYVCSDSIVKLNEIGWYEVLMYVSLLALCITQVDNERSGREALSGGGKTSQFDGVLFNDSVDDSEAVWSHNEGTVWDLIPDIKESLFPHQQEGFEFIWTSLAGTIDLAELKRVDMHTEGGCIISHAPGTGKTKLTMVFLQTYLQLFPKCLPIIIAPANILLTWEDELRKWNLGIPFHNLNNAELSGNEQDINEVDLSGNQRQNKDAIRMVKLCSWYKEKSILLISYHLYERLARGLCEDDGKKEKKNKKMKKGKKRARTREYIETAMGKVLRDYPGLLILDEGHTPRNQRSYIWKVLSESRSQKRVLLSGTPFQNNFLELYNILCLMKPSFPDSIPQELKKFCQSRLRKERKASKYASYEPIYSGNSADEKIKQLKSLMNPFVHVHKGSILQKNLPGLRDCVLVLKPDRLQQETLDIIDSSQNILNFEHKLALVSVHPSLFLNCSLSKKEESVLDKDQLEKLRLNPYVGVKTNFLLELVRLCDAVNEKVLVFSQFIDTLCLIKDQLESAFHWSVGTEVLYMYGKLDQKQKQSLIHSFNDTNSKAKVLLASIKASSEGINLIGASRVVLLDVVWNPSVERQAICRAYRLGQKKVVYTYHLLAQDTPECIKFCKQAEKDRLSELVFSNKNAKSDKLNSCGAALEDAVLDIMVQHEKLKDMFGELLVQPKERDFGDFGPLML

SEQ ID NO: 175568 - protein, 66 aa, Glycine max
  Coding DNA Sequence Number=SeqID_83883
MEKFDKKNFKDNKAKKAYITWKDKDIDSSGDSENEVVNLSLMAKNYDSEEEMNLMTCIKNQSNLPN

SEQ ID NO: 175569 - protein, 73 aa, Glycine max
  Coding DNA Sequence Number=SeqID_83884
MEHTENEYAQPSKGEGVQPSTGEDVQSSGGEDIQSSKGDRLTVLLKMVIIHATLSYLLQISPGTPSECMFCLI

SEQ ID NO: 175570 - protein, 162 aa, Glycine max
  Coding DNA Sequence Number=SeqID_83885
MAPTRHPLDPDKSNRALGFPALITGLCQSFGVPVTPSKVIRPPITQAFIEKYCTQRQVQGDVPQAVDAPPPHQAGPAGLFDTEQYLRHLMSLSLQSQGFTSFPCPTPDQFRAEVAWPGDWPEAQAREAPAGAPAEAPDEADEAHEDEEMTDLLDFLEGSGAA

SEQ ID NO: 175571 - protein, 130 aa, Glycine max
  Coding DNA Sequence Number=SeqID_83886
MTETVCMDNHLGISARHLTSRVRMTKTVCTDNRLGISVRHLTSRVRMTESVEDDTNLRVSTGSTEIVCADNHLGISACHRTSRVMIAKGGAVDKSEAFAPTYPQFVMRNSDLCSSCKKWCETKIVPTGRC

SEQ ID NO: 175572 - protein, 83 aa, Glycine max
  Coding DNA Sequence Number=SeqID_83887
MLKRVVPLSQKHSLILGYGESSITVNQMFVIYLRSNSNDWGGKTARKPHYKRNLKESWASSSKGNNTRKSSLPWIQIENANET

SEQ ID NO: 175573 - protein, 140 aa, Glycine max
  Coding DNA Sequence Number=SeqID_83888
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=60%, HitCoverage=71%, E-value=1e-24, Identity=69%"; Hit description=LacZ protein
  Subcellular localization annotation: CTP_CleavageSite=34; ConfidenceScore=5.13e-01
MKHFTDTLISANIPKTSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 175574 - protein, 238 aa, Glycine max
  Coding DNA Sequence Number=SeqID_83889
  Gene Ontology: Mol. function=motor activity; Cellular component=cell projection
  Homolog annotation: Hit_ID=UPI00016621D1; Match level="QueryCoverage =99%, HitCoverage=42%, E-value=7e-20, Identity=31%"; Hit description =UPI00016621D1 related cluster
FTTSNVQSCQFGMIDLLDESISCFLIRVDPWVLVPIALRGLHALTFRGLHVLTFRGLHILALRGLHALTFRGLHALAFRGLQVLPFKGLHVLTFIGLHALTFRGLHVLAFRGLHALAFRGLHALAIRGLHALTFRGLHILAFKGLHVLTFIGLHALTFRGLHVLAFRGLHALTFRGLHALTFRGLHVLAFRGLHTLAFRGLHVLAFRGLHALAFVGLHALSFIGLHICAFREFKVLRP

SEQ ID NO: 175575 - protein, 83 aa, Glycine max
  Coding DNA Sequence Number=SeqID_83890
MYQQPIAAAAPNKADIDVHHLRHAVDDFVAIADRLDMLLNLRILTEGTKVYTVVEECVGIARCYIGQPIVGHKSKQRWRTNDH

SEQ ID NO: 175576 - protein, 26 aa, Glycine max
  Coding DNA Sequence Number=SeqID_83891
IAPTRYPVDPKKFNMADQQAPYHRDR

SEQ ID NO: 175577 - protein, 160 aa, Glycine max
  Coding DNA Sequence Number=SeqID_83892
  Gene Ontology: Mol. function=chitin binding; Cellular component =extracellular region; Biological process=chitin metabolic process
  Homolog annotation: Hit_ID=UPI00006A17C9; Match level="QueryCoverage =83%, HitCoverage=100%, E-value=5e-11, Identity=37%"; Hit description= UPI00006A17C9 related cluster
  Subcellular localization annotation: CTP_CleavageSite=14; ConfidenceScore=5.29e-01
MVMSVRMIRTRLFAAARVKSCPGMHSGCVTASLSGCARTVGPPPISGGGLGTIKRKLLVRMWSTLKMRTRSPLKVRACSALKARMCSPLEVRACSPLLVRTCSPLKVRACSPSKVRTCSPLKVRACSPMMVRTCSPLKARTCSPLKVRACSPRSRGHVAL

SEQ ID NO: 175578 - protein, 195 aa, Glycine max
  Coding DNA Sequence Number=SeqID_83893
MGDFISRLSFPACLHFSEENTETFSSLTSYLELRRSEFLIGGYVGARASLLSTTPPFVAMTQELVARGDTLRLSAPRHSVTPSVIDEQRPMWSSTPFPEMSAFSDGDFSSLTSYPELRTSEFLIGGYVGARASLLSTTPHHVCYHDPRGGGPDDTWRYLTVIRTLWSSRGGGPDDKQRQNLVILHPCIIQRRRAR

SEQ ID NO: 175579 - protein, 184 aa, Glycine max
  Coding DNA Sequence Number=SeqID_83894
  Homolog annotation: Hit_ID=Q6WAY4; Match level="QueryCoverage=66%, HitCoverage=22%, E-value=6e-10, Identity=33%"; Hit description =Putative uncharacterized protein
MGTNQNGKRFYQVKIKGLDVTNLNELGRLMGPLQRQAFHKVYGKILDLTTMEVFTEAIVSLAQYYDQPLRCFTFGDFQIVPTVEEFEEILGCPLGGRKPYLFSGFLPSLSKIAAVVGDLARELDRMMQTRNGVVSLPHKYLEGKVMQSYPARALDRRLQVDWARDPREGLRVLMSLRVDFEPMG

SEQ ID NO: 175580 - protein, 161 aa, Glycine max
  Coding DNA Sequence Number=SeqID_83895
GQLSYPNFVQGALFIGMRPLFDHLKMFNTHRGGIRKVLRCFGEKPAKNTKMEVLNTHHGGIRKVPGRFRKKTAKNTKVGENLSNMGGALRNLHPEHSKGGRGTVSKMFMTPRLCISTVLGEKTCFRKENPSRGAAVMLPRGFHEKICEDFLPFFVRSSIFN

SEQ ID NO: 175581 - protein, 100 aa, Glycine max
  Coding DNA Sequence Number=SeqID_83896
MLESFKQQQEMSVLELYIEKDVAGGSMFHSANSVTSCENYLSNDDTQPPTNMSNLHLDEDDDDDYYYLVSNSYVEESLDEDDRVDGISDTDHELPEMIPP

SEQ ID NO: 175582 - protein, 223 aa, Glycine max
  Coding DNA Sequence Number=SeqID_83897
  Subcellular localization annotation: CTP_CleavageSite=32; ConfidenceScore=5.57e-01
GSSSTTTITGHRRHRTSGDPSSPIPPSLSSPRSSTLFSFNDQRQRYYSQFCNRTILDPKYLDLEFFDVFYNNLKIQDGVLYSEVHKIPTIVDQSLFYSLTKLPSQGVPFEGTLVDDWKLDYSSHDALKMVYSDHANMTNRFLHFNVPLDDEPFVKVKSSFSIGVGALTSFGYRKDMDGQWVRKHDLPPPIPDERTPSPPPQRDASSSLLTEVLTELRDLRVIV

SEQ ID NO: 175583 - protein, 36 aa, Glycine max
  Coding DNA Sequence Number=SeqID_83898
MNALSAFIPTDESLSLTCQAKRHFASAKCQSAALSA

SEQ ID NO: 175584 - protein, 71 aa, Glycine max
  Coding DNA Sequence Number=SeqID_83899
MDGFIEPMKEHNLEMLGLFVKTHFLVVLPLGLPFKVILDWRYPVPLKQRGKDRNTQFPLQKHYPRENPIDP

SEQ ID NO: 175585 - protein, 156 aa, Glycine max
  Coding DNA Sequence Number=SeqID_83900
MEMHVWLGSFNSGNWQIQQGLNIFQRTTKLEETLTQFMQVGQLAKQIADKSSNSFVASTKNNPKEECKAVMTRSKRFVEAEDEDSVVSKKKATEKKGIDEKKDDMIGEKKEKEGEKEKENEKIEKDEKNKNEERSRSEQAREKKREKVVNEGAGIL

SEQ ID NO: 175586 - protein, 140 aa, Glycine max
  Coding DNA Sequence Number=SeqID_83901
DAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPVTHSDSVVVVMRRKNHFEFE

SEQ ID NO: 175587 - protein, 193 aa, Glycine max
  Coding DNA Sequence Number=SeqID_83902
MAKARITMRYLRMLSDPRVTIADLCVWITIRPEDVDISRKGAEDHIGADNHKVSSYTTRPSSHDIKGETFSQSRPEDADIFGKDNHKVSPHATGPSSHDSKGETFSWSRPEDADIFGKGADDHIDTLKCGRESYQRTGFWLVIKGRGPLQVVGEDGHSHPGSRFMVSWDFGSRLVERLDMIYVRALVWPAVQG

SEQ ID NO: 175588 - protein, 122 aa, Glycine max
  Coding DNA Sequence Number=SeqID_83903
MTRGNTSNLQPFDPEIDRTFHRLARHHFVPFEHPEHFVIGESENSVVGNFEHPNFEHYSFEHSDFEHSENMAQPPPRERTLREMATPDFTYESLCIQYPDEDVPYVLKTGLIHLLPKFHGLA

SEQ ID NO: 175589 - protein, 118 aa, Glycine max
  Coding DNA Sequence Number=SeqID_83904
MIIDVEVWKAVAKLDMSRVQKFEESTNRYNKMQTFRASRFIDYLNVDVYDEIVNFTKASSEITKRHLKKLGMRFVEHDWIMAGEPPAVGNKDQMDEEVEAEVPQEFAHQWSPFESLII

SEQ ID NO: 175590 - protein, 218 aa, Glycine max
  Coding DNA Sequence Number=SeqID_83905
MDMKIEALISGQISTIAQSNSSRLGFLASITALCRAKGVTSDSLTYESLSSAINLAYIKKNCWNVDDLIVNFREARKVRARPADVPSSSAPPTPPTSATPTPPGNIPSAGAFDFSGAGIKMRPDEEAATPERTPHTPEDPSSLGVELSFAQQVVDPPTPVHERLADPSTPIMEMPKDPTMPVLRLSSTPPATQVLHLIDEEDMQDQDTQGTQDQSQEF

SEQ ID NO: 175591 - protein, 66 aa, Glycine max
  Coding DNA Sequence Number=SeqID_83906
MLAQPRGSSGALSQLIPAERIIDNSSASRIFYALSHELLRSADGSLSQRTGLAGGSKSALPPNMPN

SEQ ID NO: 175592 - protein, 52 aa, Glycine max
  Coding DNA Sequence Number=SeqID_83907
MGAKYLEVIKRGSHPNNGWSPEEIRPSNRMVIGDVTSRRRWVKNKFTTIGSH

SEQ ID NO: 175593 - protein, 384 aa, Glycine max
  Coding DNA Sequence Number=SeqID_83908
MASKKRKAPSTLPKSDMTGLGSPLKKLGREELMRRHWDKELTSFDEGSINVAVVKEFYANLYEPEDISPKQVWVRGHLVKFDEDNLNNFLKIPVIVEDGENLCAYSRFALLRPDPQELAAKLCIPGRGFELNTDGLPLKILRKKMTTLTQTCSILSYCNLVPTFHTSDITLERANLIYGIIMKMDMNMGAKEGQGRRSEAPTTSAAPDTSAPSSSTAQAPPSSTPSHTPAISAPFPFQLPTLTSSGPSEGQAIIMQSLQSLGLPSIMSMDEFDTQPSPSRGGGASAAQGLEPEEPVVAIEEPAEGEDELTPPEPFYYDTDVHMAQEEEASTDQMPEPSPAPGPEETLPSVPTIPALEPEPTIQDSSAALVLDLNEDQPQEDQDI

SEQ ID NO: 175594 - protein, 156 aa, Glycine max
  Coding DNA Sequence Number=SeqID_83909
MASSSSVKFSTGVPTGDPCGVFSSSTGVDTGDAYGIASDMKGSGEWPLNPLNHPPSRAKAPGLRRPHLLQKDKARLLARPLSWGANEDGPSDLLALALRVPRKLIVGSSRFQQFFFMYAKLMVWLRDSKVREPEVTHRAMHKAVMKAGNSSLEELD

SEQ ID NO: 175595 - protein, 192 aa, Glycine max
  Coding DNA Sequence Number=SeqID_83910
MLIDVGNALACTCCVCSWGALCTDLPGSLALAFGHDHTSYGVYVMGGGLSPGREHLWALRMITYGRGVVTCTTVWSRQTQHSSLSLIPVMITNLVCGSRMIEAGCRDDEAGRYSSYLALAALAACGDVLQNDKGDFLKVFSRRLGHSTILEAKLWTILFGMNMACDLGYKAIIVETDYVSSLWRISDIMKVN

SEQ ID NO: 175596 - protein, 67 aa, Glycine max
  Coding DNA Sequence Number=SeqID_83911
MNHYMDELQQYILRIVDVAPDGNCAYKEIVVLLGQVLATKWMTIPNMGYVIASRYNTVLFHLSRMQN

SEQ ID NO: 175597 - protein, 76 aa, Glycine max
  Coding DNA Sequence Number=SeqID_83912
MSRGSGDLGDASVAFSFQCAKAVVIRFWALIAMAAQLIHDHVVMEFLEGVWETLEGNERCRFRGTIRLTATSLVHP

SEQ ID NO: 175598 - protein, 140 aa, Glycine max
  Coding DNA Sequence Number=SeqID_83913
MTMGVKPFEAINNSPQMKLGCNSLFTHPYFANYTSIFVFLADFSPKHLGTLRISRRWVLNILKWSNEGRMLTNNGARTKLELMAVEWRWKNDDWRRYFKEKMNQEEAHHHRKPWISLKVGEDERREKERRNTKFCASKEV

SEQ ID NO: 175599 - protein, 323 aa, Glycine max
  Coding DNA Sequence Number=SeqID_83914
MDVMVYEKDLKCLENLVHVGYDSPCDVISETMEGMNELNYASALGGYSIWNLCVAHVDCMGQSILARSGNPEANLKLCHGNTLRVLHDERYIDLLEIKECGLDILFFGKKQNWTGFFEVYEPIYPRLVVDDNSRLYEDWLKAKRLRKKKVQRKFLENKKDDFKSKSMKSFGRIVHWICMHFVLPRVGTFQRPFGVSLDGELVDNDVLSWDAKNVVALKLSPQPAERSPLTKDKVEEEKTPYEQQPISLPVPEGVKAEDVQNHVVPDPSQADLNVEDIADVLAKLRIVDSSLEQGSSKKEEEKKEEPYEIGGEDEPTPSLAQNA

SEQ ID NO: 175600 - protein, 49 aa, Glycine max
  Coding DNA Sequence Number=SeqID_83915
MEAESLSFNKNKPWKERLHRQESALDKKLREEASMEEEDERERESGVED

SEQ ID NO: 175601 - protein, 70 aa, Glycine max
  Coding DNA Sequence Number=SeqID_83916
MVGQLVLDQTAKVWAQVEQPRWVSPMELCSKRTKVCEPWTSCPTITDEGAGVDDEGMSSVLALFLNSICN

SEQ ID NO: 175602 - protein, 158 aa, Glycine max
  Coding DNA Sequence Number=SeqID_83917
  Homolog annotation: Hit_ID=A6FJQ2; Match level="QueryCoverage=24%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTFRETCRASCINESANARGEAVCVLGALPLPRSLTRCARSFGCGERYQLHSKAVIRLSTESGDNAGQQH

SEQ ID NO: 175603 - protein, 83 aa, Glycine max
  Coding DNA Sequence Number=SeqID_83918
MLEIENRCVATYPSAGGRRVTRGMLVPRKEYARSRHQRLVEENVGKTGKDAIYELLSEKVRELYLRTGKALATHTSVPRDGSL

SEQ ID NO: 175604 - protein, 136 aa, Glycine max
  Coding DNA Sequence Number=SeqID_83919
  Homolog annotation: Hit_ID=A6FJQ2; Match level="QueryCoverage=27%, HitCoverage=84%, E-value=3e-11, Identity=92%"; Hit description=50S ribosomal protein L5
MTVKPRTHAAPGDGHSLSMRKEKIPHQAPFAIQAAQLLGRAIGAGLFAITPAGERGMCCKAIKLGNARVASLEVEVAKWRVAARTLWQVDRPKVANATVAFTNIVRANRQLSPKVGGALDKLLHTQSDGDDLFRCC

SEQ ID NO: 175605 - protein, 740 aa, Glycine max
  Coding DNA Sequence Number=SeqID_83920
  Gene Ontology: Mol. function=phosphatidylglycerol-prolipoprotein diacylglyceryl transferase activity; Cellular component=integral to membrane; Biological process=lipoprotein biosynthetic process
  Homolog annotation: Hit_ID=A8GIH8; Match level="QueryCoverage=38%, HitCoverage=99%, E-value=1e-145, Identity=85%"; Hit description =Prolipoprotein diacylglyceryl transferase
  Pfam annotation: Domain name=LGT; Domain location=11-283; Score =513.7; E_value=2.1e-151; Accession=PF01790.9; Description =Prolipoprotein diacylglyceryl transferase
  Pfam annotation: Domain name=Thymidylat_synt; Domain location=247 -516; Score=406.4; E_value=4.4e-119; Accession=PF00303.10; Description=Thymidylate synthase
  Pfam module annotation: Pfam domain module=LGT::Thymidylat_synt; Domain location=11-283::247-516
MTNGYISFPQFDPVIFSIGPVSLHWYGLMYLVGFVFAMWLAVRRANKPGSGWKKEEVENLLYAGFLGVFLGGRIGYVLFYNLPLFLDNPLYLFKVWDGGMSFHGGLIGVIVVMLIFARRTKRTFFQVSDFIAPLIPFGLGAGRLGNFINGELWGRVAPDFKFAMLFPGSRSEDLALAANNPQYQELLNTYGVLPRHPSQLYELCLEGIVLFIILNLFIRKPRPMGSVSGLFLIGYGAFRIIVEFFRQPDAQLGLFEGGISMGQILSIPMILAGVIMMVWAYRRRPQQQTREDGFPLVTTKKVHLRSIIHELLWFLKGDTNIGYLKENKVTIWDEWADENGDLGPVYGKQWRSWGNASGEEIDQISKVIEQLKRDPDSRRIIVSAWNVGELDQMALAPCHAFFQFYVANGKLSCQLYQRSCDIFLGLPFNIASYALLVHMVAQQCDLEVGDFVWTGGDTHLYSNHLEQARLQLTRETRPLPKLVIKRKPASIFDYQFDDFEIEGYDPHPAIKAPAQSAGYEQNPKRRLYAAGTAAGYAYCSCRAFCCGCARTPAGITATSACGCSRAKTAASAPGRSPQKGVSCRRAGCSGHLIAKCASLRWSASRAFTADAMWPGPAVSNWRAQLAAGASSSPPGRASGSASQERRDANSAGRLQSAGDADRHGDWRGADGQRRPLSAAAAGAEPAPAAAGPAATGAAAGCRLAGQSAAPCRLLSRSVQRCGAHAGERRQLCTAALGRKQ

SEQ ID NO: 175606 - protein, 174 aa, Glycine max
  Coding DNA Sequence Number=SeqID_83921
  Gene Ontology: Mol. function=transferase activity, transferring phosphorus-containing groups; Cellular component=cytoplasm; Biological process=phosphoenolpyruvate-dependent sugar phosphotransferase system
  Homolog annotation: Hit_ID=Q5PEN4; Match level="QueryCoverage=94%, HitCoverage=21%, E-value=2e-62, Identity=74%"; Hit description =Phosphoenolpyruvate-protein phosphotransferase
  Pfam annotation: Domain name=GAF; Domain location=1-122; Score=64.0; E_value=5.1e-16; Accession=PF01590.17; Description=GAF domain
METEVCSVYLADHDRRCYYLMATRGLKKPRGRTVTLAFDEGIVGLVGRLAEPINLADAQSHPSFKYIPSVKEERYRSFLGVPIISRRQLLGVLVVQQREHRQFDESEESFLVTLATQMAALLSQSQLGQLFGQFRQTRVKAIAAAPGVAVAPGWVDETQPLLDKCPPPLRSIRR

SEQ ID NO: 175607 - protein, 49 aa, Glycine max
  Coding DNA Sequence Number=SeqID_83922
MNALSAPVRLACSSQLSKFGFPDEHAKRALCAKPECLSVEAELSASMLC

SEQ ID NO: 175608 - protein, 164 aa, Glycine max
  Coding DNA Sequence Number=SeqID_83923
MVRTRGIGRALGHVTDKCVGKGDRDDSDDAPQRRWPTASTWRQRVPVTATHDEPVLPAPDVEADVFSNDPMAPADVEDTGVDIPADTGAQDAEDEHEGFPGGPSDPSVLTQYADHVACSVWTGEECPELKLSSHGRKVHSLGRPVPAIEGLVARTGLSPLIACS

SEQ ID NO: 175609 - protein, 158 aa, Glycine max
  Coding DNA Sequence Number=SeqID_83924
MRQFGYTQTIPALLADSWVSFNDIHDRWMHYSNHMVVAGDKCVVPRQCAIDYMDWFFRILHPFMTPGQPSDPRADGHATQPRVATQDPDTDIRAVMEPTTPSTTARSDVAELRHAMEACHAIAKRLESHLNLGLVTLGTSTHELIEESLRIARSVIED

SEQ ID NO: 175610 - protein, 160 aa, Glycine max
  Coding DNA Sequence Number=SeqID_83925
  Homolog annotation: Hit_ID=Q2HS67; Match level="QueryCoverage=76%, HitCoverage=31%, E-value=3e-14, Identity=39%"; Hit description =Cyclin-like F-box; F-box protein interaction domain
MPGYHLVGSCNGLHCGVSEIPEGYRVCFWNKATRVISRESPTLSFSPGIGRRTMFGFGYDPSSDKYKVVAIALTMLSLDVSQKTEMKVYSAGDSSWRNLKGFPVLWTLPKVGGVYLSGTLNWVVIKGKETIHSEIVHSPLPINCLLESLFGGLESETPIH

SEQ ID NO: 175611 - protein, 69 aa, Glycine max
  Coding DNA Sequence Number=SeqID_83926
LSISQQSQGFAPFACPTPDQFRAEVAWPRDWPEAQAGKAPAEAPGDAEEARMDEEMIDLLGFLGGSGAT

SEQ ID NO: 175612 - protein, 323 aa, Glycine max
  Coding DNA Sequence Number=SeqID_83927
  Gene Ontology: Mol. function=transcription factor activity; Cellular component=intracellular; Biological process=regulation of transcription, DNA-dependent
  Homolog annotation: Hit_ID=A8GKP5; Match level="QueryCoverage=100%, HitCoverage=98%, E-value=1e-160, Identity=87%"; Hit description =Transcriptional regulator, LacI family
  Pfam annotation: Domain name=LacI; Domain location=2-27; Score=45.7; E_value=1.6e-10; Accession=PF00356.12; Description=Bacterial regulatory proteins, lacI fa
  Pfam annotation: Domain name=Peripla_BP_1; Domain location=59-321; Score=27.1; E_value=2.9e-07; Accession=PF00532.12; Description =Periplasmic binding proteins and sugar
  Pfam module annotation: Pfam domain module=LacI::Peripla_BP_1; Domain location=2-27::59-321
MVTLEDVAALAGVSRATVSRVVNGDSNVKAPTREKVERAVAQLGYTPNPAARALASSHSNTLGLVTTSYRGGFFGALMDFVQTEAESHGKQLLVTQGRNSAENEWQPVQRLFSLRCDGVILHVRFLSDDRLRQLAAEQRDFVLLDRLVPGLEDRCVTFDHPLASRMATQQLLDAGHRRIACISGPRERPSSLLRLQGFEEAMQAANIEPVACLEGVYDLESGYRCADRLLQQAARPSAIYCCNEEMAIGALLAINEHRLRVPQDISLICYDSGERAPFVRPALSSVHFPISEMAQYAARRLIDPATPAHRFEPTIVNRDSVVT

SEQ ID NO: 175613 - protein, 77 aa, Glycine max
  Coding DNA Sequence Number=SeqID_83928
MRDPKFISIFMTSLYINLALFRVMSEVWDIGAKFEKDRTLQTSCKLLRNRPQISKPGVGGQALPFLYTTGVFKKGHR

SEQ ID NO: 175614 - protein, 263 aa, Glycine max
  Coding DNA Sequence Number=SeqID_83929
  Gene Ontology: Mol. function=RNA binding; Biological process=positive regulation of transcription, DNA-dependent
  Homolog annotation: Hit_ID=Q6D619; Match level="QueryCoverage=53%, HitCoverage=48%, E-value=9e-48, Identity=66%"; Hit description=Beta -glucoside operon antiterminator
  Pfam annotation: Domain name=CAT_RBD; Domain location=117-162; Score =33.7; E_value=1.4e-07; Accession=PF03123.6; Description=CAT RNA binding domain
  Pfam annotation: Domain name=PRD; Domain location=178-263; Score =49.5; E_value=1.2e-11; Accession=PF00874.11; Description=PRD domain
  Pfam module annotation: Pfam domain module=CAT_RBD::PRD; Domain location=117-162::178-263
RFAVPRRRLRHAGRRNPRYRAGRAGQPERLRQNHWRDQPRRGDERAYSGADQGEKGQRARRQPAGGALQAGMITPCAAQKCDRGGTPRHNRIVTVSPPPLRPQDRNIKYRQNLAPGIAPGRQEETVVMGKGIGFKKKPGDTLDESLIEKVFTHNGGEIAERYKELLSEIPLACVTTADRIITLARERLPGKLHNIVYITLTDHIHFALQRHAEGLDIKNALLWEIKKLYQAEFAVGLEALALIAERLNTALPEDEAGFIALHL

SEQ ID NO: 175615 - protein, 134 aa, Glycine max
  Coding DNA Sequence Number=SeqID_83930
  Subcellular localization annotation: CTP_CleavageSite=15; ConfidenceScore=5.10e-01
MRGYLMVTRTFRRPRANEPVHAQRPTSSSAPSVVLTREAGDMRGYLMVTRTFRQPGANESVDAQRLTSSPAPSIVLTHEGWRVRWQAEITYGHPRLSSIEGNEFDGIRMMLVGRSSAMAKGSVVVGPTLSFSRH

SEQ ID NO: 175616 - protein, 108 aa, Glycine max
  Coding DNA Sequence Number=SeqID_83931
  Subcellular localization annotation: CTP_CleavageSite=26; ConfidenceScore=5.09e-01
TYQGNPCGVYPDLSSFTGSGVYPDLSSFTGSGVYPNLSSFIGSGVYPDLSSFIGSGVYHDLSSFTGSGVIQILRSLYQTIRSYSGSHHLGIRASALDKGSILSYYFSL

SEQ ID NO: 175617 - protein, 194 aa, Glycine max
  Coding DNA Sequence Number=SeqID_83932
MERRNFHKCLINLVDGSIDLALVNEFYANLYSSEDHPQKQSKVRGHLVMIDVDSLNAFLETLVVLAEGETLPAYSKYCRLPTDYREIEGHPGKILRKDLTTLAQVWNVLPYSNLALTSHTSDLIVDRARLIFGLVSRLDMNIGALISGQMTSIAESNTFKLGFLALITALSRSGGVVSDSLTFERLSPDTFCFL

SEQ ID NO: 175618 - protein, 44 aa, Glycine max
  Coding DNA Sequence Number=SeqID_83933
MEAMKEQMTMMIEAMMSMRKMVEVNTTTVGAASITTEVDLIHPS

SEQ ID NO: 175619 - protein, 62 aa, Glycine max
  Coding DNA Sequence Number=SeqID_83934
ILGLRIEEQRLAINSWGSGLDGGGCMNDNQFMGLGIRFVGGGYMNSARQSIRGAPDSMVEDA

SEQ ID NO: 175620 - protein, 56 aa, Glycine max
  Coding DNA Sequence Number=SeqID_83935
MTKTMTSPTRWWTPITSRISSFQYDWFSHVMMMLLFYLKNFDLVLQMNAVHQTIVK

SEQ ID NO: 175621 - protein, 85 aa, Glycine max
  Coding DNA Sequence Number=SeqID_83936
MTNDEERLKIFAKSPTETLRKRLGIGFSSRKQFLSLILSESQIPGGKKEGDACHPARPGELGRFLQKQLPSGGTSWKAQVGLVAI

SEQ ID NO: 175622 - protein, 114 aa, Glycine max
  Coding DNA Sequence Number=SeqID_83937
  Homolog annotation: Hit_ID=Q0KIL1; Match level="QueryCoverage=90%, HitCoverage=11%, E-value=2e-07, Identity=34%"; Hit description =Gag/pol polyprotein, 3'-partial, putative
  Pfam annotation: Domain name=G-patch; Domain location=60-104; Score =32.3; E_value=1.8e-06; Accession=PF01585.14; Description=G-patch domain
MVEGRLVIVFGEEDILVSCPSSMSYAEAVEESLQTTFQSFEVVRNASVESLSMRPRMSDTTMMVARVMLGHGYKPEMGLGQNNDGMASFVEFKENRGRFGLDYRPTRADVRRSA

SEQ ID NO: 175623 - protein, 82 aa, Glycine max
  Coding DNA Sequence Number=SeqID_83938
MEGSKNYLPGKRKKEVVERVFAASEEVDKRYTFSLYKWGRSKEYCPRRFGATHPSHAYLHPVQHLRPTLCLCSQKMVAPLHA

SEQ ID NO: 175624 - protein, 95 aa, Glycine max
  Coding DNA Sequence Number=SeqID_83939
  Homolog annotation: Hit_ID=A7QLI5; Match level="QueryCoverage=45%, HitCoverage=9%, E-value=4e-11, Identity=69%"; Hit description =Chromosome undetermined scaffold_119, whole genome shotgun sequence
MVSQDKLQRLTLQRCRNMSWLSGLRELKPLLHLLLPLSIHWVAGEMTVFVLVDVTTSALCPGESTCSKVIYINGIHQTKIGVMSEDIGRNHQGRP

SEQ ID NO: 175625 - protein, 524 aa, Glycine max
  Coding DNA Sequence Number=SeqID_83940
  Gene Ontology: Mol. function=nucleic acid binding
  Homolog annotation: Hit_ID=A7QLJ1; Match level="QueryCoverage=93%, HitCoverage=96%, E-value=1e-170, Identity=63%"; Hit description =Chromosome undetermined scaffold_119, whole genome shotgun sequence
  Pfam annotation: Domain name=R3H; Domain location=119-180; Score =10.7; E_value=0.028; Accession=PF01424.13; Description=R3H domain
MEGSAEDLGAPESWEVADLDESMNRLNLMVFSNNDSKQPHQRLADYNDDDAPLPPPPSSSCDEVSDDAINQVDQFLREAIQNPRERLSSRSNKLYVLRMIYLAQLIKASNLMNSVLRMEQDVENFIRDPTQQQLEFKQLPTSYLRLAAHRVAQHYSLQSMVLLDNSLPDGSGSRIIVRKTSECKLPVIRLADIPVKLSPENSAVMKVAIKQRPQKWTQILSNANSNSMKNNSSKSVEERKEEYNRARARIFNSSNNDGTVGGKPECESRQQDNSLHSSLVVPRVEDKSASVSDVTSGRGLVESSTNTNRARSRIEKEPVGRYRQNNRVAIFRDREVDRKDPDYDRNYDRTSIPDLMLELGITMNCDFLFLYMQRFDPGFGFNGGSYAIQPMYTAVLNYKTEFPQLGSTHRPHLSAEHQPRPLPQHISGPWAAQSAPAGIGYGHPETMMPPFNPNQVGAHSSSAMYLHSSQYPCQRPGMPFIHHEHVHQPFAQELLELILLFMKRKLRTSSEEMEPKKFVLDLDK

SEQ ID NO: 175626 - protein, 353 aa, Glycine max
  Coding DNA Sequence Number=SeqID_83941
  Gene Ontology: Cellular component=integral to membrane; Biological process=peroxisome organization and biogenesis
  Homolog annotation: Hit_ID=A7P347; Match level="QueryCoverage=94%, HitCoverage=75%, E-value=1e-170, Identity=84%"; Hit description =Chromosome chr1 scaffold_5, whole genome shotgun sequence
  Pfam annotation: Domain name=Aa_trans; Domain location=7-352; Score =283.8; E_value=3.6e-82; Accession=PF01490.9; Description =Transmembrane amino acid transporter protein
MDNGPSRRAKWWYSTFHTVTAMIGAGVLSLPNAMAYLGWGPGILMLLLSWCLTLNTMWQMIQLHECVPGTRFDRYLDLGRHAFGPKLGPWIVLPQQLIVQVGCDIVYMVTGGKCLKKFMEIACTDCTQLKQSYWILIFGAIHFFLSQLPNFNSVAGVSLAAAVMSLSYSTIAWLACLARGRIENVSYAYKRTSNTDLMFRVFNALGQISFAFAGHAVALEIQATIPSTPEKPSRIPMWHGALGAYFINAICYFPVALIGYWAFGQAVDDNVLMALEKPAWLIASANLMVFIHVVGSYQVYAMPVFDLIERMMIRRLNFAPGLALRLVARTAYVGGRHVKTQLIHAITAKHFSV

SEQ ID NO: 175627 - protein, 126 aa, Glycine max
  Coding DNA Sequence Number=SeqID_83942
  Subcellular localization annotation: CTP_CleavageSite=19; ConfidenceScore=5.45e-01
MAFHSANMHNSSFFQILPRAQSRSVALSGWLAKLTGWLSKRVKKRLCFELQNVAVGLNAYPPVPSATLSSRLALSPISLTRAKREGGAKHSVAISEPTLSLSFAELGYNFYIFYNTFYDSFYRAAM

SEQ ID NO: 175628 - protein, 48 aa, Glycine max
  Coding DNA Sequence Number=SeqID_83943
MYDIRGRVEGLSKVCFHFEWEPRASKVASQSQGNGGRVPGSRGSSWAL

SEQ ID NO: 175629 - protein, 139 aa, Glycine max
  Coding DNA Sequence Number=SeqID_83944
  Subcellular localization annotation: CTP_CleavageSite=40; ConfidenceScore=5.68e-01
ASLVVDALVYSTPPALSSSPLGTAAMSSSSSVVVRPSRSRAGQVDDEAGGPQDSVVVRVGVSSCIDSTIDRSRQLGRPPFETRLRLLVGPSSSTKGNGSSRLSVIEAPGRSKEVPVGSSSHGVAAGSTELVVPPSNRGW

SEQ ID NO: 175630 - protein, 233 aa, Glycine max
  Coding DNA Sequence Number=SeqID_83945
  Homolog annotation: Hit_ID=A4WEW2; Match level="QueryCoverage=64%, HitCoverage=21%, E-value=2e-70, Identity=87%"; Hit description=LppC family lipoprotein
MTQEQAQALVINADENVLQGWLDLQQMWFNNRSDPKMLKAGITDWQTRYPQNPGAKMLPTQLVNVQNFKPASTSKIALLLPLNGQAAVFGRTIQQGFEAAKNGTTPVTGSAVPAQAAQAANVSDVVSPSAAETSDLTTAQTPAQGTMQNPVTAPTTPPAATPEPATPDQAPAETQAAPTTAPATAEQPQAQTTQPTAQPAAQPQAVATASANPGAELKIYDTSSQPLDQVLAQ

SEQ ID NO: 175631 - protein, 187 aa, Glycine max
  Coding DNA Sequence Number=SeqID_83946
PGPPPDPGGRLTMRAQPEEEAIAQLLCISMQDFTCAAAKRRVRIMRTNMTTLTQIWMTFLLSNILSSDHNADLLLRKYQLVWITPTRHPVDPEESIRALGFPALVTGLCQYYRVLVPPARSWHRDIGIAPTRYLVDPEESNRALGFPTLVTGLCQSYKVPVPPNKGSHPQDTQWTRRSPTGSWGFQL

SEQ ID NO: 175632 - protein, 40 aa, Glycine max
  Coding DNA Sequence Number=SeqID_83947
MAESTKGWRRMEDRIATDQSSPLPGAGPAENVAARQPSIL

SEQ ID NO: 175633 - protein, 206 aa, Glycine max
  Coding DNA Sequence Number=SeqID_83948
  Gene Ontology: Mol. function=nucleoside-triphosphatase activity; Cellular component=cytoplasm; Biological process=response to DNA damage stimulus
  Homolog annotation: Hit_ID=A1FYE9; Match level="QueryCoverage=100%, HitCoverage=56%, E-value=1e-108, Identity=98%"; Hit description=RecA protein
  Pfam annotation: Domain name=RecA; Domain location=1-206; Score =350.4; E_value=3.1e-102; Accession=PF00154.12; Description=recA bacterial DNA recombination prot
MGGTAAFIDAEHALDPIYAAKLGVNVDDLLLSQPDTGEQALEIADMLVRSGSVDILVIDSVAALTPKAEIEGEMGDQLPGLQARLMSQALRKLTGNIKRSNTLVVFINQLRMKIGVMMPGQSPETTTGGNALKFYASVRLDIRRIGAIKKGDEIIGNQTKIKVVKNKLAPPFKQVITEILYGEGISREGELIDMGVDAKLVEKAGA

SEQ ID NO: 175634 - protein, 47 aa, Glycine max
  Coding DNA Sequence Number=SeqID_83949
MAKMPLPLAECSGVASAISDLAMQGQVVLARSCNMDIAIGAGEIMQL

SEQ ID NO: 175635 - protein, 209 aa, Glycine max
  Coding DNA Sequence Number=SeqID_83950
  Homolog annotation: Hit_ID=Q2HSV3; Match level="QueryCoverage=69%, HitCoverage=23%, E-value=1e-15, Identity=34%"; Hit description=IMP dehydrogenase/GMP reductase, putative
HFLSVADSTADQEYDEDSPRACRWIATKKIVKRIRMPAYRERLDRLQIPNVCWIPYGEHREVRDFHVRSCYSGLLRWGPVAIYYRPERVVRQFGYTQTIPAPPDHIIPAGDVCVVPGQCSSDYMDWFFRISHPFMTPGHTLDPLPHGHAPQPQVVPQAPQTDIPRVPEPGASSTSAEEPRHAVEVCDDIAERLERHLILGVVTPGSSTM

SEQ ID NO: 175636 - protein, 77 aa, Glycine max
  Coding DNA Sequence Number=SeqID_83951
  Subcellular localization annotation: CTP_CleavageSite=62; ConfidenceScore=5.06e-01
MVTSKEMKGQIRVSFSIEIASQVGRFRFGRRVPLSMGLQRRTTMVCGGEWWLWVMEKVLGTLEMALEERKEKKWDIS

SEQ ID NO: 175637 - protein, 89 aa, Glycine max
  Coding DNA Sequence Number=SeqID_83952
MEANAVAVAATRAVAKVNPMPSSGLNQINHPTSAMVGKDLGSTGGPYYVQIQNKHAFPPYGSPPKEDTHGMPHHNLADFEPCLGYATEG

SEQ ID NO: 175638 - protein, 259 aa, Glycine max
  Coding DNA Sequence Number=SeqID_83953
  Gene Ontology: Mol. function=transcription factor activity; Biological process=regulation of transcription, DNA-dependent
  Homolog annotation: Hit_ID=A7FF10; Match level="QueryCoverage=100%, HitCoverage=85%, E-value=1e-124, Identity=88%"; Hit description =Chromosome initiation inhibitor
  Pfam annotation: Domain name=HTH_1; Domain location=6-64; Score=71.7; E_value=2.4e-18; Accession=PF00126.18; Description=Bacterial regulatory helix-turn-helix protein, lysR family
  Pfam annotation: Domain name=LysR_substrate; Domain location=86-259; Score=-5.0; E_value=0.009; Accession=PF03466.11; Description=LysR substrate binding domain
  Pfam module annotation: Pfam domain module=HTH_1::LysR_substrate; Domain location=6-64::86-259
MKRPDYRTLQALDAVIRERGFERAAQKLCITQSAVSQRIKQLENLFGQPLLVRTVPPRPTEQGQKLLALLHQVELLEEEWLGDDNGGTTPLLLSLAVNADSLATWLLPALKDVLADSPVRLNLQVEDETRTQERLRRGEVVGAVSIQPQPLPSCLVDQLGALDYLFCASPEFAARYFPNGVTRSALLKAPAVAFDHLDDMHQAFLQQNFDLSPGSVPCHIVNSSEAFVQLARQGSVCCMIPHLQIERELAQGELVDLTP

SEQ ID NO: 175639 - protein, 159 aa, Glycine max
  Coding DNA Sequence Number=SeqID_83954
  Gene Ontology: Mol. function=aspartic-type endopeptidase activity; Biological process=DNA integration
  Homolog annotation: Hit_ID=A5AUE6; Match level="QueryCoverage=90%, HitCoverage=9%, E-value=6e-19, Identity=34%"; Hit description =Putative uncharacterized protein
MRIIEIGNVRFIEKGEISGSIVPRDVKIKEVRVQVLLACASSKEQHNNEPMIHNEHIVEEPQEVALRRSQEKGDQLFRMTMWYTYMKQKDLSINDNDLISFSQAGCKRVGCKWVLKTKRDFPDKLEHYKVRLIAKGFTQKDDIERRFHWSHERIISGLS

SEQ ID NO: 175640 - protein, 188 aa, Glycine max
  Coding DNA Sequence Number=SeqID_83955
  Gene Ontology: Mol. function=translation elongation factor activity; Cellular component=cytoplasm; Biological process=translational elongation
  Homolog annotation: Hit_ID=Q5PL77; Match level="QueryCoverage=100%, HitCoverage=100%, E-value=1e-102, Identity=97%"; Hit description =Elongation factor P
  Pfam annotation: Domain name=EFP; Domain location=69-123; Score =117.7; E_value=3.5e-32; Accession=PF01132.11; Description=Elongation factor P (EF-P)
  Pfam annotation: Domain name=EFP_N; Domain location=5-62; Score =122.0; E_value=1.8e-33; Accession=PF08207.3; Description=Elongation factor P (EF-P) KOW-like do
  Pfam annotation: Domain name=Elong-fact-P_C; Domain location=131-186; Score=128.7; E_value=1.7e-35; Accession=PF09285.2; Description =Elongation factor P, C-terminal
  Pfam module annotation: Pfam domain module=EFP::EFP_N::Elong-fact-P _C; Domain location=69-123::5-62::131-186
MATYYSNDFRAGLKIMMDGEPYAVEASEFVKPGKGQAFARVKLRRLLTGTRVEKTFKSTDSAEGADVVDMNLTYLYNDGEFWHFMNNETFEQLSADAKAIGDNAKWLLDQAECIVTLWNGQPIAVTPPNFVELEIVETDPGLKGDTAGTGGKPATLSTGAVVKVPLFVQIGEVIKVDTRSGEYVSRVK

SEQ ID NO: 175641 - protein, 291 aa, Glycine max
  Coding DNA Sequence Number=SeqID_83956
TPVVLAEGETLPTYSRYYRLPSDPREIEAALCIPGLGFILNAEGHPGRILRKDLTTLAQVWSVLSYSNLTPTSHTSDLTVDRARLIFGLISRMDMNIGALISGQMTSIAQSNSSILGFPTLITALCRARGVVSDSLTFERLSPVINLADIRKNWARRARPTELPSTSVAPTLASTLATPSVPAQRSILSIEQFLERVASLGPNLLFIGKMKEAAATPERSREVTSDPPTPMVDLSSPQHAADPSTPILKMPEDPTTPVLTLNTSPPATSVLHLTDEEGGQTQDTQDQSQEF

SEQ ID NO: 175642 - protein, 97 aa, Glycine max
  Coding DNA Sequence Number=SeqID_83957
  Homolog annotation: Hit_ID=A5AZG1; Match level="QueryCoverage=56%, HitCoverage=16%, E-value=1e-07, Identity=45%"; Hit description =Putative uncharacterized protein
MPQEVNISLPYFHGKDNVEAYLDWEMKVEQLFVCHHISEERKVPLATFSFVKASFMMKNQAILMIPKAQVIASRLQDQASRIQSKIQDSREEIKKQQ

SEQ ID NO: 175643 - protein, 154 aa, Glycine max
  Coding DNA Sequence Number=SeqID_83958
MAPRKLPSKRSRKDTAAAGTSAAPEFDSHRFRSAEHQQRFEAIKGWSFHRERRVHLRDDEYTDFQEEIARRRWTIAKEGVRDLRSWVRGQWIPFDADALSQFLGYPLVLEEGQECEYSQRRNRADGFDEEAIAQLLCIPDMDDVAAQQHPAQRS

SEQ ID NO: 175644 - protein, 251 aa, Glycine max
  Coding DNA Sequence Number=SeqID_83959
  Gene Ontology: Mol. function=binding
  Homolog annotation: Hit_ID=Q1H3I8; Match level="QueryCoverage=76%, HitCoverage=34%, E-value=2e-47, Identity=50%"; Hit description =Tetratricopeptide TPR_2
  Subcellular localization annotation: CTP_CleavageSite=35; ConfidenceScore=5.64e-01
MTPFINRLLKQEFSMPPTSRFTLKPTAKRRTMLALCMALLTPPAWSASTSPTMTAPTAEFVYKYLLGEVAAQRGEFVLASQLFLDLAKQTRDPLLAERATQAATIARTPQLALPSAELWAELAPDSIPAAQAASQLLIANGNLKKAVPQIQKVLTNDNIRANAFMELNSLFMRVTDKTAVLEAIQQLAKPYPKLPEAHFAISQAAYFAHNESLMEAELKEASKLRPGWEPPAQIRGQMLIEQDPQKGIAYY

SEQ ID NO: 175645 - protein, 334 aa, Glycine max
  Coding DNA Sequence Number=SeqID_83960
  Subcellular localization annotation: CTP_CleavageSite=45; ConfidenceScore=5.45e-01
MNRLAGSDQCKKLRAPFSLQALKQAIGLISSSSRLSPTSSQGPPSSSLVVQVVVATTIIFDPPVPPSPPAQGPPSSTTLAMSAPLAAPPSSTVVSLLSASVETTKTEVSKWRATAQTVWQVEHPKVSNATIALAEVQAPRWTVTRCLEKNELVGKVECTAKEKEELAATVVKFSKTKIKESELKVEKEKGKNKELEEELLMLKKKVIEKHEKGFFKAFRQARFFNKGFELGLFDLFKDVKDDELLDEEEIATGEEDVEEEDDEPMFRLCSLCGLACCRLMSIQCLAFDACRRIMGVVLCVMLVLPYLTDLYEIKNEMTSDHLEFDFKFVEGLTN

SEQ ID NO: 175646 - protein, 168 aa, Glycine max
  Coding DNA Sequence Number=SeqID_83961
  Homolog annotation: Hit_ID=Q2AA09; Match level="QueryCoverage=63%, HitCoverage=43%, E-value=6e-07, Identity=29%"; Hit description =Retrotransposon gag protein
  Pfam annotation: Domain name=Retrotrans_gag; Domain location=6-93; Score=9.0; E_value=0.0072; Accession=PF03732.8; Description =Retrotransposon gag protein
MAEEPRRVTLEDYLSSKAKRWLHLFKRNSLKTWDEVVEKFLKKYFPESKTTEGKAAISSFHQFPDESLSESPYSYQEKLARAFITRCIVGTKQAVVQAIGSIDRNTKLQVVSYVVEHMSLADVFPKKKHHMKSTTWGISQDKISMLGQWRNHPGNQFNKDQGGPSNKP

SEQ ID NO: 175647 - protein, 105 aa, Glycine max
  Coding DNA Sequence Number=SeqID_83962
MSHFQGFFKGSVKTPYYSTQNIRDTKRSSNKLGERLRSQDYLREATKEKIEGLFSTESLRWILRIPLRLKCSSRSGGSGASNGRSCWPPVVMGGGGGGVRDWVVV

SEQ ID NO: 175648 - protein, 479 aa, Glycine max
  Coding DNA Sequence Number=SeqID_83963
  Gene Ontology: Mol. function=metal ion binding
  Homolog annotation: Hit_ID=A7PY65; Match level="QueryCoverage=19%, HitCoverage=11%, E-value=6e-11, Identity=39%"; Hit description =Chromosome chr15 scaffold_37, whole genome shotgun sequence
MHNLLPESLRQALRACVTSTLRSFLSNSEPELCLSELSPRSVEPSAVLPPQEIEIQLGGVRGERVNKLRNRVCGVGDPRLKLPPAVSTETSEENEIGVLFLFLETPSFFSVPTDPYLGFWGLAFAKFGILHYQASLGLDGPPIRWLNVKLKLNSAGMVGIDTQALGACKLCATGFTAESKIFKDDGFGPPPARWKGSCGHYANFSGCNKRTTSFHGRYENDSHICPDVAVTPIVNNHSSRGLDGLVNNHTNYTGQIIKSSNCMDVDIDDDDDAILESCMKVALDFVSPENVGECFRLIEEFRTLPISHAPSEDKVEMITKDDDKGDDKKLKGQSKNEFKIFKIESRTLQDSRGKLISRIKNQDSRDQDFKNQDSRDQDSRIKRRLNQDKCEKEHDGSWVKKGTRHVGEEGRDGEDSSLLSKILDRFDGFQTIVGERFDNLELQVDMRFNEMESRITKVKEDVSYIRSSFDLPPPPPPSS

SEQ ID NO: 175649 - protein, 155 aa, Glycine max
  Coding DNA Sequence Number=SeqID_83964
MDMNIGALISRQISLIAQFNSSRLGFPALIIALCKARGVTSDSLTYESLSPAINLAYIKKNCWNLDDPSVTFPRTQKSRARRFEAPCPSAAPTPLTSGPSTSALPSAPAAPVLPCPPLRAQSLSLTVEGAQQASLAGTPALDLNEEAMDQDPPSP

SEQ ID NO: 175650 - protein, 147 aa, Glycine max
  Coding DNA Sequence Number=SeqID_83965
MAFITFKFMHFILKFRDWYKEYYSMLVINSQFKITLSPGLAEGVVAHPDADSIESSEIIIIGEDEGAASSLEEDGSATGDGGLVGTGSTCAGVWAVKLPQSLTIKSRAPDQATCSRNCSTFLWASGPVDADGGDGVDDEGMSFALAL

SEQ ID NO: 175651 - protein, 95 aa, Glycine max
  Coding DNA Sequence Number=SeqID_83966
MEACLWNFYGGWIFELHGRQRRRREGRHHPLGNKPWKKGLHHQECALDKKLEDDDLMEKKKEWGEHKIEGIKEEEKWNFEVASLRSFLEKTSLRS

SEQ ID NO: 175652 - protein, 261 aa, Glycine max
  Coding DNA Sequence Number=SeqID_83967
  Gene Ontology: Mol. function=nucleobase transmembrane transporter activity; Cellular component=membrane; Biological process=nucleobase, nucleoside, nucleotide and nucleic acid transport
  Homolog annotation: Hit_ID=Q3KB46; Match level="QueryCoverage=91%, HitCoverage=50%, E-value=1e-120, Identity=87%"; Hit description =Permease for cytosine/purines, uracil, thiamine, allantoin
  Pfam annotation: Domain name=Transp_cyt_pur; Domain location=18-261; Score=-141.8; E_value=0.0019; Accession=PF02133.6; Description =Permease for cytosinepurines, uracil, thiamine, allantoin
MPTKESSPPLIEKHTIGYIPPEDRHGKTRDLFTLWFGGNIAPLPIVTGALGVQIFHLNLLWGIVAILVGHLVGGALMALHSAQGPQMGIPQMIQSRAQFGSFGSLLVVAIAGVMYVGFFASNIVLAGQSLHGIAPAVPLPVGIVIGAVGSCVIGIIGYRCIHILNRIGTWVLGIGIMVGFGYIFTHLHTADFLTRGGFSFSGWLATVSLAALWQIAFAPYVSDYSRYLPADVPVAATFWTTYLGGDPLESTCRHASLALAV

SEQ ID NO: 175653 - protein, 126 aa, Glycine max
  Coding DNA Sequence Number=SeqID_83968
  Homolog annotation: Hit_ID=Q5YN48; Match level="QueryCoverage=86%, HitCoverage=64%, E-value=4e-14, Identity=38%"; Hit description =Putative transcriptional regulator
  Pfam annotation: Domain name=DUF24; Domain location=6-87; Score=22.7; E_value=3.6e-07; Accession=PF01638.8; Description=Transcriptional regulator
MDFADLREAFYGVTRFETMRSHTGITKQTLATRLKLMTELGLLSRIPYREEGARERYEYQLTEKSRTLAPVLLALMEWGHRQVLHTAPHLTLVDKATGDPLHIGYVNTHGHEVKPHQVQIVPTPKG

SEQ ID NO: 175654 - protein, 141 aa, Glycine max
  Coding DNA Sequence Number=SeqID_83969
MDLIENMAASGIAILRDRAHIPTKKSLLELTSQDALLAQNKLLSKQLEALTETLRAHESGCVATCPFAGGRRRDSRVRFPKEERCAESPPMFICGKRRKNRRKSVKVKILSSGVVFTFEEGRQKRGSCSYVPPIKEEIRPT

SEQ ID NO: 175655 - protein, 208 aa, Glycine max
  Coding DNA Sequence Number=SeqID_83970
MDCHGHYITEFYICCQMPNTTLILYPGLGTRYETIARVPAQVPDWNHAFADPTLPLMVDIGCGNLNLNDNLFDAFSVSVKDWHRSCISALTCSSLSVVVNNVRQWQIVKRAESWAKDLALDNMYYPKSTYIDGGTFLVCKRDNFFQAVGRIISRALGLSFSIGCHLHFYSTKLVGPIEQPKAVQQEGECFQGQLRPLWSTARQEGLVD

SEQ ID NO: 175656 - protein, 530 aa, Glycine max
  Coding DNA Sequence Number=SeqID_83971
  Gene Ontology: Mol. function=sulfite reductase (NADPH) activity; Cellular component=endoplasmic reticulum membrane; Biological process=electron transport
  Homolog annotation: Hit_ID=Q1GXP1; Match level="QueryCoverage=100%, HitCoverage=90%, E-value=1e-179, Identity=60%"; Hit description =Sulfite reductase (NADPH) alpha subunit
  Pfam annotation: Domain name=FAD_binding_1; Domain location=189-385; Score=147.2; E_value=4.4e-41; Accession=PF00667.11; Description=FAD binding domain
  Pfam annotation: Domain name=Flavodoxin_1; Domain location=29-160; Score=145.5; E_value=1.5e-40; Accession=PF00258.16; Description =Flavodoxin
  Pfam annotation: Domain name=NAD_binding_1; Domain location=417-525; Score=105.5; E_value=1.7e-28; Accession=PF00175.12; Description =Oxidoreductase NAD-binding domain
  Pfam module annotation: Pfam domain module=FAD_binding_1::Flavodoxin _1::NAD_binding_1; Domain location=189-385::29-160::417-525
AGLHSRLLVLEDKQTAPAAGASATTQLHILFGSQTGNAEALAQTAAKAARAKGLVPVVQALGEVDLDVFATMRHVLIVTSTYGEGEMPDNAQLFWQAISASTAPRLEQMHFAVLAIGDTGYDGFCQAGKFIDMRLEQLGAKRVVDRIDCDIDYEEPSSEWIGSAMPQFAASAGSSGTVLESAPEAPVIPGSNKQNPYAAALVTNKRLSGEQSAKDIRHFEFDLSDSGLKYEAGDALGVIPVNDAGLVSLLLSELKADYETPVPGFDRNLGDLLTYQFEISEPSRKLIEWVGQHTTNQELLHVLQHDDKDTLANWLWGKDTLDLLQLELKRNLSVPELVAMLRPLQHRAYSISSSSKAHPNQVHLTIASVRYHSGGRERKGVCSTYLAERVRRGEKPAIFISPNKAFRVPANNNAPLIMVGPGTGIAPFRAFLQERQATGAEGKNWLFFGDQHQEHDYIYADELAGWQQSGLLTHLDLAFSRDQEEKIYVQNRMLEKGAELYAWLQEGAYFYVCGDASRMAKDVDAALYEV

SEQ ID NO: 175657 - protein, 68 aa, Glycine max
  Coding DNA Sequence Number=SeqID_83972
MGTNQNGKRFYQVKIKGLDVTNLKELGRLMGPPQRQAFRKVCGKILDLTAAEVFTEAIVSLPNTMTSR

SEQ ID NO: 175658 - protein, 38 aa, Glycine max
  Coding DNA Sequence Number=SeqID_83973
MNNIKAEWRWKKDDWRRHFKERMSQEEAHHLRKPWIRA

SEQ ID NO: 175659 - protein, 92 aa, Glycine max
  Coding DNA Sequence Number=SeqID_83974
  Subcellular localization annotation: CTP_CleavageSite=58; ConfidenceScore=5.60e-01
MRSSLKARACSPLKVRTCNPLKARVCSPLKGRTCSPLKVRVCSPLMARACSPLRVKIDCSFERGDNSCNLILSFANLSWNSLRVYVLFDLVT

SEQ ID NO: 175660 - protein, 288 aa, Glycine max
  Coding DNA Sequence Number=SeqID_83975
  Gene Ontology: Mol. function=citrate transmembrane transporter activity; Cellular component=integral to membrane; Biological process=citrate transport
  Homolog annotation: Hit_ID=A8GAV5; Match level="QueryCoverage=72%, HitCoverage=49%, E-value=3e-82, Identity=77%"; Hit description =Gluconate transporter
  Pfam annotation: Domain name=Gly_kinase; Domain location=200-288; Score=-241.9; E_value=0.019; Accession=PF02595.6; Description =Glycerate kinase family
MAEELTQHAEGARPGFAAAISAPLVAILLLSLRPIAGIAVDPLIALPAGGLAGALLMGRIRQCNQFMVSGLSRMAPVAIMLLGTGTLAGIIANSALKDVLINGLTHTGLPAWLLAPLSGALMSMATASTTAGTAVASGVFSSTLLELGVSGLAGAAMIHAGATVLDHLPHGSFFHATGGSVNMAVHERLKLLPYETLVGFTIAAISALIALGVADAIERGFRQIYPQAHYVKLPMADGGEGTVESMVAATGGEIVQVTVTGPLGEPVQGFYGLLGDGETAVIEMAAAS

SEQ ID NO: 175661 - protein, 226 aa, Glycine max
  Coding DNA Sequence Number=SeqID_83976
MVPGSPPDIGRRPTVRAHPEREAIAHLLCIPGQDFTRAAAKRRVQIMCTNMTTFTWIWMTLLFSNILPGDHNANLPLQMYRLGSRPQVAQWARRSPIGPWDFQLWLRASVSPTGCPFPPARSCHRDIGIVPTRCPVDPKKSNGALGFPALVAGLCSPTRYSFPPCRWGLCPQDTQWTRRSPTGSWSCQALIMGLCQFYGVPVTSSKGIRPPTNRAFIKKYCIPRQA

SEQ ID NO: 175662 - protein, 264 aa, Glycine max
  Coding DNA Sequence Number=SeqID_83977
MAPRKLSAKISRRDAAAEGTSAAPEFDSHRFRSAEHQQRFEAIKGWSFHRERRVQLRDDEYTDFQEEIARWRWTSLVTPMAKFDPDIVLEFYANAWPTEEGVRDMQSWGRGQWIPFDADALSQFLGDPLVLEEGQECEFSQRRNRADGFDEEAIAQLLCIPGQDFARPAAGRRGRIMRTSMTTLTQMWMTLLLSNVLPSDHNSDLPLPKCQLVYAILTRMSVHVAQLIADDIYLFAGMPPTRHPLDPDKSNRALGFPALITGLC

SEQ ID NO: 175663 - protein, 159 aa, Glycine max
  Coding DNA Sequence Number=SeqID_83978
MEKSDKMNFKEKKEKKGYITWEDNVINYSSDSKKKIISLGIMMKDYENGEEQSRYIDSNFSKHMACIKLEVGSGSYWKLEVGNESYWKLKVENGGWKLEGEVVVIIKKGENVNHEDFDDIKKNLLEKEGDVNHASFDGVEKKSHVCHHQKGGECECMYT

SEQ ID NO: 175664 - protein, 239 aa, Glycine max
  Coding DNA Sequence Number=SeqID_83979
MLGLLLLAAAGSTWLIAGGLFIAGLGAGLASPALASAVSRQIDASRQTAANTLINAGTGAGIIVSPVAGTLLSARRSCRSTGIAGWLARSTAQPRAAAARRGGVLDRMCYASHSRLNEGQASMLWLVSGAAGILGALTGPLARCIGMRQVYWLAQLAMAAPLLLLAALTHFSYWLVPAAALCGAGYVTLSECGPGVAAAFLTLAIGQIGGAILFAQIYSSSAAAALLLFAAIPVALLFL

SEQ ID NO: 175665 - protein, 149 aa, Glycine max
  Coding DNA Sequence Number=SeqID_83980
KTLVRIATPLRLEFIPQVKELLDEGLVRKSLNPCALLVPKIDIIRHQIPKIGGMMNALGGATLICKITRAPNIFMICVHRDSLGRNNQHENTEKGVPMNPKRIKVIPEWPAPPSVLRKKSPEFQEPRDLRSNPFQGGRNDAILPRKGIG

SEQ ID NO: 175666 - protein, 123 aa, Glycine max
  Coding DNA Sequence Number=SeqID_83981
  Subcellular localization annotation: CTP_CleavageSite=47; ConfidenceScore=5.06e-01
MTRTRLFTAARVKSCPGMQSSWAIASFSGCARTIGRLPISGGGPGTVEGNYGPLNRELKSRTLKMRTCSPLKARTCSPLKVRACSPLMVRACSLLTARACSPLKARACSPLKVRVLVAKGPPL

SEQ ID NO: 175667 - protein, 110 aa, Glycine max
  Coding DNA Sequence Number=SeqID_83982
MKSGDMRGYRMVIHTFRQPGANEPVHMQRLTSSYAPFVIQGQRVRWQAEIPYGFYSRRPETFKPDDAQDSSLLGGGRSSSMAWGNVMVVPLYRFQDTEVLLTLLMPFLSF

SEQ ID NO: 175668 - protein, 67 aa, Glycine max
  Coding DNA Sequence Number=SeqID_83983
MEKEFWRNNSSWKIANASSDDGVNEGSNENFVGVDGANSRSGYQGRGGFKGQGFQGRGEYEGFGLTI

SEQ ID NO: 175669 - protein, 209 aa, Glycine max
  Coding DNA Sequence Number=SeqID_83984
  Gene Ontology: Mol. function=cellulose synthase (UDP-forming) activity; Cellular component=membrane; Biological process=cellulose biosynthetic process
  Homolog annotation: Hit_ID=A7PBB7; Match level="QueryCoverage=96%, HitCoverage=21%, E-value=1e-87, Identity=67%"; Hit description =Chromosome chr16 scaffold_10, whole genome shotgun sequence
MAGANGSSCAIPGCDSKVMSDELCADIFPLKTGGGICPGCKEPYQNTELDEVAIDNGHPLLLPPPSGMSKMERRLSMMKSTKSALGTYGYGNAIWPKEGGFGNEKEDDFVQPTELMNKPWRPLTQKLKIPAAVLSPYRLIIFIRLVVLALFLAWRIKHQNTDAVWLWGMFVVCEIWFAFSWLLDQLPKLCPLNRSTDLNVLGDFNSIRS

SEQ ID NO: 175670 - protein, 153 aa, Glycine max
  Coding DNA Sequence Number=SeqID_83985
  Homolog annotation: Hit_ID=Q6WAY6; Match level="QueryCoverage=60%, HitCoverage=16%, E-value=5e-09, Identity=37%"; Hit description =Putative uncharacterized protein
MKEEEPRFLSYVEDFQMFPLMGTRGCINYNPILAIRQLGYPMRGAPSEEGLTPFIARGFNSPNAGVLQGVRKAWEMVQKKDKELRGSSNGAINGYRRWLKAYAQGLDWLPRLRAAKEVEVEALKESEEVQALRTELEKAQAVKEKFKSTAVRI

SEQ ID NO: 175671 - protein, 128 aa, Glycine max
  Coding DNA Sequence Number=SeqID_83986
  Homolog annotation: Hit_ID=A5AMR4; Match level="QueryCoverage=56%, HitCoverage=7%, E-value=6e-11, Identity=45%"; Hit description =Putative uncharacterized protein
MIHGKPPNWRKKGGSDGLALQASNQKIKIADGSFPAIAGKGCVVISPTLILQNVLHVPNLSCNLLSDLNLGRTIGSAKESGGLYLFENEIANRLIDCDRIWKRKVYMRRNKEVEYAQTLLLDKWPQIS

SEQ ID NO: 175672 - protein, 176 aa, Glycine max
  Coding DNA Sequence Number=SeqID_83987
  Subcellular localization annotation: CTP_CleavageSite=61; ConfidenceScore=5.24e-01
MGGYIPCGSLLVKVFIRLKRNLKDRRALDPTKGSSSSTAATTTPHPGALGASPTPIPPSLSSSTLFSSDEQRIRYYSLFQSHQILDPKYLDLEFFDREAFDCYQVFQNTGLIPFMSLKLPHYPKLVRVFYSNLQIQGSTSISEVHGISMVIDESVFFSLTHLPSQGAPFEGTIVDD

SEQ ID NO: 175673 - protein, 48 aa, Glycine max
  Coding DNA Sequence Number=SeqID_83988
MYFKVAEDTVHYGGSLMICLAGPTRALLAATIGNILGYSSSASGKWNK

SEQ ID NO: 175674 - protein, 158 aa, Glycine max
  Coding DNA Sequence Number=SeqID_83989
MDKSLKVKEDERKERERKGDEIYASNEISGLIQNLAHGSKIYPKAHENPSAFSCISGLILVFSIQCPREVGLHHIYSNTCKIDCNNINEIREERMQTQFYTGSATTRAYVQYSSNPLEISTIFVKSITKSEPHRNNPSLVFRNPLQQETHSLLTNLIE

SEQ ID NO: 175675 - protein, 112 aa, Glycine max
  Coding DNA Sequence Number=SeqID_83990
MGVKHLNSAGKILNGCKQTSPDEIRVLSYPNFVRGPLLDDMRLLFGPCRGVYLVKMGVQIATRPTWALQKIPPEGCCFWRKQPCSPGRAGRQASLLFCYNRGGSEKEKGSAP

SEQ ID NO: 175676 - protein, 98 aa, Glycine max
  Coding DNA Sequence Number=SeqID_83991
MVTKRVKKYEKMMTHGQFSIMYEGPKKEILQKGVDWLASVIKGTIFKEEERGHPKPGDVTIGYDPYTIGFPTPVRTPKLLSCWRAGDATSKDVVGVIQ

SEQ ID NO: 175677 - protein, 71 aa, Glycine max
  Coding DNA Sequence Number=SeqID_83992
MINAGMICSLRCHEEMHDAIKEQARGLSTTMHHKNRKTLDEASLLSSESKTQQDHRSTSTPYGSHRPGYRS

SEQ ID NO: 175678 - protein, 274 aa, Glycine max
  Coding DNA Sequence Number=SeqID_83993
  Gene Ontology: Mol. function=protein kinase activity; Cellular component=integral to membrane; Biological process=cell division
  Homolog annotation: Hit_ID=Q6W1F3; Match level="QueryCoverage=98%, HitCoverage=26%, E-value=1e-115, Identity=79%"; Hit description =Acriflavin resistance plasma membrane protein
RARPLGISSQDIAAALQRRNTVTPAGSIDTQGPQVFIRLDGAYDSVQSIADTPIVASGRALKLSDIAEVRRGYQEPASYVIRHDGEPAIMLGVVMQQGWNGLELGKALEERSSRIAQSLPLGITLTKVSDQAVNIDAAVGEFMVKFAMALGVVLFVSLIALGWRVGIVVALAVPLTLAVVFIIMLETGRFFDRITLGALILALGLLVDDAIIAIEVMVVKMEEGMDRIKAAAYAWSHTAAPMLSGTLVTIIGLMPVGFAASAPGEYAGNIFWIV

SEQ ID NO: 175679 - protein, 57 aa, Glycine max
  Coding DNA Sequence Number=SeqID_83994
MNLWFHINKNVKAKCKSSIGQKHAWEYVMDAWGSLIDCPSEQQFAECLQKFQMACSP

SEQ ID NO: 175680 - protein, 85 aa, Glycine max
  Coding DNA Sequence Number=SeqID_83995
MTKLGLCLSSGPPPLDDKRGVRITIRMTKLGLCLSSGPPPLDDKRGADNRKNDQTWSLRAIDTTVSEWQRGADNRKVSPRIMGAE

SEQ ID NO: 175681 - protein, 54 aa, Glycine max
  Coding DNA Sequence Number=SeqID_83996
RPVRITLFARMLQPCGIDIGLKKHSNRVTPKAYTPKSPLGPLPPDSGPTQTKNI

SEQ ID NO: 175682 - protein, 109 aa, Glycine max
  Coding DNA Sequence Number=SeqID_83997
MQSQGLALPLEPEVGPSATRVSTKGSCVDPSGNDPEIGDSDKCGLYIEENPSRLVALGRVYEGSTMVGVEEVKDADAPVPVPTDEVQLVGQTLNTFLAWPTHLMKCVSE

SEQ ID NO: 175683 - protein, 253 aa, Glycine max
  Coding DNA Sequence Number=SeqID_83998
  Gene Ontology: Mol. function=nucleoside-triphosphatase activity; Cellular component=membrane; Biological process=defense response
  Homolog annotation: Hit_ID=A7PBY4; Match level="QueryCoverage=99%, HitCoverage=35%, E-value=2e-34, Identity=36%"; Hit description =Chromosome chr2 scaffold_11, whole genome shotgun sequence
  Pfam annotation: Domain name=LRR_1; Domain location=10-31; Score=6.3; E_value=21; Accession=PF00560.24; Description=Leucine Rich Repeat
  Pfam annotation: Domain name=LRR_1; Domain location=123-145; Score =7.1; E_value=15; Accession=PF00560.24; Description=Leucine Rich Repeat
  Pfam annotation: Domain name=LRR_1; Domain location=196-218; Score =4.6; E_value=42; Accession=PF00560.24; Description=Leucine Rich Repeat
  Pfam module annotation: Pfam domain module=LRR_1::LRR_1::LRR_1; Domain location=10-31::123-145::196-218
LPKSIGKLQNLETLDIRATYVSEMTEEITKLKKLRHLLANSSCSIQWNGIGGMTSLQEVPPVKIDDDGVVIREMSLLEKLRIGTADESEVIDLYLMSPMSTLRKLVLCGTLTRLPNWISQFPNLVQLYLGGSRLTNDALKSLKNMPRLMYLCFAHNAYEGETLHFQCGGFQKLKLLFLAYLDKLKCILIDRGALCSVEKISLADLSQLKTVPSGIQHLEKLKDLIIHSMPTELEQRIAPDGGEDHWIIQDVPH

SEQ ID NO: 175684 - protein, 88 aa, Glycine max
  Coding DNA Sequence Number=SeqID_83999
MATIALLSNYGRWCLALDIQQAGFVADLGVTFVDDWMFLVGRVVALFQDSLKIKPCLKTKCFQDMQGSGNRLPGSVIDYQKTRLRNSY

SEQ ID NO: 175685 - protein, 71 aa, Glycine max
  Coding DNA Sequence Number=SeqID_84000
MASISEVMLKLQKTIEDKATTTASSTVREAELVLQLALNPGLDRNTAMFGRRYEGRFFEDPNNEGLTIDFD

SEQ ID NO: 175686 - protein, 206 aa, Glycine max
  Coding DNA Sequence Number=SeqID_84001
MRKSVEREDPTYECQQVPWRILKSPWPEADILICNRMQQQQLLLRSLTVIANSQLAANKMIIFYKKVEYVLEDCNEVLVKINKFVVNKEGLVCVETLCMPVTKPERFELDAFELDEPEDAGSKCNLILCKRHSSFPFPTECHHTLLIAHCVQRQRESPITYCALCCLEIVETPRMLDVPESQDFDIPIFIEIKSFWNLPKQMKCLI

SEQ ID NO: 175687 - protein, 85 aa, Glycine max
  Coding DNA Sequence Number=SeqID_84002
METTKLVGLPQSCHDCRQEVSQHALLRACKVRLTGVLSKGGKMRGVATNEGISTSHVDKSGSLAPTYPPSKRKSDLRSSSLCVNQ

SEQ ID NO: 175688 - protein, 105 aa, Glycine max
  Coding DNA Sequence Number=SeqID_84003
WAKRASIAKRAEATLSATEESGRASTSRAHTKHEINALSAADFKQRIGTDSRAHRSVYFGKRALEAARGATFAKIPRIHNVGYNVQDILPENTGIAKSIEAAGST

SEQ ID NO: 175689 - protein, 157 aa, Glycine max
  Coding DNA Sequence Number=SeqID_84004
RSVDTRGLAQRRETVDAAPYSFPPMPERQHEMYCTPQTFTQELLQMPPMYSYTHDLQPGYNMTDIFGSSPPSRGTPSFTQSDELSTPNAPLGGPWNVLGNILDMDDLLGVDLRHDFSVEADQVDERVNHRRRNPDRAARNWGRPCGTLSRHHRHSDD

SEQ ID NO: 175690 - protein, 158 aa, Glycine max
  Coding DNA Sequence Number=SeqID_84005
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=74%, HitCoverage=96%, E-value=2e-25, Identity=54%"; Hit description =Putative uncharacterized protein
  Subcellular localization annotation: CTP_CleavageSite=25; ConfidenceScore=5.49e-01
MTMITPSSKLTLTKGNKSWYRAPPRVLPVWALTTSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 175691 - protein, 137 aa, Glycine max
  Coding DNA Sequence Number=SeqID_84006
  Homolog annotation: Hit_ID=Q2K9T8; Match level="QueryCoverage=86%, HitCoverage=96%, E-value=6e-27, Identity=50%"; Hit description =Hypothetical conserved protein
MGVLWGAKLWEERYVRRMWPDEFAFLLDDAEEVDLHIPPVAHEDGSPGKTISRKALKVRISQQDFEKIWPLAEARYRLNGRFAGKAITLIANNPHYQKWHPSDGGSVESVSDSGQKYTTPYVIVHFLLDDVREPVEV

SEQ ID NO: 175692 - protein, 51 aa, Glycine max
  Coding DNA Sequence Number=SeqID_84007
MDPKKIKVIPEWLTPPSVEGKINEFQEPLDLRSNPFQGGGNDAILPPKGIG

SEQ ID NO: 175693 - protein, 86 aa, Glycine max
  Coding DNA Sequence Number=SeqID_84008
MKKSLHQLLNKNPQLRVLAFHGKKAPFTLKKRNQEKLLAYKGVGMSPPPLGISQSLKNSLISLKDENLAPFSALRSLKITLFQASE

SEQ ID NO: 175694 - protein, 62 aa, Glycine max
  Coding DNA Sequence Number=SeqID_84009
MGSSIGVWRTMVRCMGTPMGLPSPPLCSLVDGNAGGGVTGWKGVRRDRGAVGLPGKIRDILD

SEQ ID NO: 175695 - protein, 172 aa, Glycine max
  Coding DNA Sequence Number=SeqID_84010
MDFSSLISLTRKKAYITWEDNVLASSDYYSEEEVVNLCLMTDSKDDSSTIEETEVNYKFEEVLEAFNEMHEEAQKLVVSNNKLRSDLKWHITKLASTQSELDKLRQENEKLVSSYKATGCVYASTSLNMDDYKSMQNEFEKFKKDHYEEHMKLQIELSYLKDLLRKMNKGKK

SEQ ID NO: 175696 - protein, 134 aa, Glycine max
  Coding DNA Sequence Number=SeqID_84011
MDKSLKVGEDEWRERERRSSKFCASNEYRCPKIQGLKNPTFRGYPTYIMEPLSKPLELVHKLPFIVGGNVPLPKGTLKIIPILYRRIPVHPSFPNKESPPIEGIPLKAKGSQWNFSLFANMMANKELFNLHFPI

SEQ ID NO: 175697 - protein, 635 aa, Glycine max
  Coding DNA Sequence Number=SeqID_84012
  Homolog annotation: Hit_ID=Q2HW90; Match level="QueryCoverage=45%, HitCoverage=64%, E-value=1e-18, Identity=26%"; Hit description =Putative uncharacterized protein
MRFYQVKVKSLRTTNLKELGQLMGQLQRQAFRKAYGKIWDLAMVEVSTEAIASLAQPQKASKKWGGWNTEKVFGGKSKNLGRGVFFPNVDGLVDLAAIDIFLAYHNHKEIPVVTMLADLYDTFDRRCEKSNTRIVCCTPALYVWLVSHFFRQEEHLPTGSLDGRKEEPEFFSCGGFPSVPLMGTRGCISYNPILAIRQLLYPMRRAPLEEELAPVISRGFNKTNMETLQKVRKAWEVVQKKDKELRGSNNGPIGGYRKWLKAHVQGLDWLPSLRAAKREEVKTPEEDEEENAELRDINIATTKALEQETKRAHREEHGRNKFRGALWGSNSELKLRREERDQSRVDSLILKDELKVCSKSKRSLSQRLCETETNMLAIITKYQEELNLAAAHEHRVADKYAQVYAEKEARRRVIDSLHQEATMWMDRFALTLNGSQELPRLLAKAKAMADTYSAPEEIHRLLSYSRLMSEVEEVQEQIKADMKAMKEKMATIMEAMMSMKKIMKANAVTVAATSVIAKVNPMPPSGLNQMYHPTLDMVVKDLETNVAYTPNENVNNSTPILIESQQPQSGHVHVSQTVEQTHEIPHHNLADFEPCLGYATERQAVAPPAMAEKGKLDHIEERLKDVEGGEDYAFC

SEQ ID NO: 175698 - protein, 371 aa, Glycine max
  Coding DNA Sequence Number=SeqID_84013
  Homolog annotation: Hit_ID=A5BX53; Match level="QueryCoverage=39%, HitCoverage=39%, E-value=1e-36, Identity=46%"; Hit description =Putative uncharacterized protein
MGCLSGFLFIPTSRSARFFWLRTDQIRCNLSMITFRWFTRAILYANHMLVIFVALLWITPLAGIFINKGNGVVKSGFGNVEKLAGNVGCLLILVALGSGACWGLVPDLDYSRAKMFLHNRYLCLVVLQFLCPPVLALLFLGLSHIDDEDTIALPVVYYNGEVITNEAKNAAPNGKMVSEPHFRFPAVKGNLCIKYTSMDLLINDNVDLGCELNELVVLIDVIGEGYFFINIEMYFEDGKPVPYFGCANSTTKLVNSLDPEFDQANTRGRNNGHQHQPSLRWRVFVDSTMVELKLSESRDLIRIEHIEHSHIRGLGLDSSLESCTILDDMGGGFMNGGLPIGDTVTEGVAVVGRGSRGWRGRSQEEEYNEAK

SEQ ID NO: 175699 - protein, 62 aa, Glycine max
  Coding DNA Sequence Number=SeqID_84014
MGWLEYRGNVWKQKQESWQPIYMTPSTEDVKTAVQGLFAILRPSTYGWFRTFSAKRLDMLAR

SEQ ID NO: 175700 - protein, 212 aa, Glycine max
  Coding DNA Sequence Number=SeqID_84015
MENFLNDYMVFVNNNPTYTTLVFVYPPPTTEIKAFYLPYWPSHNTLAALCAQFQQGGSNEMAPALRAHIPQSQRSCACHPFQEELHQQHRAKTCKFEKFLMDQSMPDLLSHICIVHNYPLPSYTFHDTLEHDGMKVFRYVGMLQMPNFGPLVSLSNYACNIFDVKEEIPADLIWKSLKAEVDKSNNAGSGLEMKVALLRGRLKQLGSNRENI

SEQ ID NO: 175701 - protein, 145 aa, Glycine max
  Coding DNA Sequence Number=SeqID_84016
  Subcellular localization annotation: CTP_CleavageSite=70; ConfidenceScore=5.53e-01
KSKPRRFRIVSVTFSVRNLAKVSTVLRRSSFVLHRSSIFNGLPSLGADVWGANTFPVRKYNSRTFHLKVRRSRLFRFFRRFPQINVGGDSARIPFVEHASRESRVALPPKGISPPLATRSNARQRTRGCVVEAHEEEGSSGDERG

SEQ ID NO: 175702 - protein, 105 aa, Glycine max
  Coding DNA Sequence Number=SeqID_84017
  Homolog annotation: Hit_ID=Q6WAY4; Match level="QueryCoverage=93%, HitCoverage=17%, E-value=1e-10, Identity=36%"; Hit description =Putative uncharacterized protein
MEVVVSLTQYYDQPLRCFTFGDFQLVPTVEEFKEILGCPLGGRKPYLFFGFLPSLSKIAIVVRDSARELDREKQTQNSVVGLPRKYLEGKARDMANQEEWVPFMD

SEQ ID NO: 175703 - protein, 169 aa, Glycine max
  Coding DNA Sequence Number=SeqID_84018
MEGRKRGGSLLRWGLPKRVVDRDEELVPHEGSTDGREPLAFPCERFRRAKSQDCTKSPQGVEKPDKEELRGIRNGIIGGYHEWLRVHTRGLDWLSKLKIINEENFEAPEEDEEVQALKSELGKARLAKENFKSAATNIRKECAELREENATTAKALEQETKRARKEEHG

SEQ ID NO: 175704 - protein, 143 aa, Glycine max
  Coding DNA Sequence Number=SeqID_84019
MHKALRLNALLPYPHLVTIFLQHFNIPLDSEPYVPIKRSFLIGAAVIASFGYRKEHDGSWVKKGAQPFDEEGNLPVGEDYSLLQRILDRFDGLQTFVGERFDALELQVDMRFDEMDSRITKVEGDVSYICTCFDLPPPPPPSS

SEQ ID NO: 175705 - protein, 141 aa, Glycine max
  Coding DNA Sequence Number=SeqID_84020
MTQELVARGDTLPLSAPRHSVIPSVIDEQRPMWSSAPFPEMSASSGGDFFKSHKLSRTTDKIWSFCTFCHPKAAGPMTCKDKIWSFCTFMSSRGGGPDDMQRQNLVIPHPFAIQTQSCPMARRDKIWSFCTLFVIQRRRAR

SEQ ID NO: 175706 - protein, 308 aa, Glycine max
  Coding DNA Sequence Number=SeqID_84021
  Gene Ontology: Mol. function=signal transducer activity; Cellular component=membrane; Biological process=signal transduction
  Homolog annotation: Hit_ID=Q93ET6; Match level="QueryCoverage=71%, HitCoverage=39%, E-value=1e-55, Identity=53%"; Hit description =Putative methyl-accepting chemotaxis protein I
  Subcellular localization annotation: CTP_CleavageSite=81; ConfidenceScore=5.04e-01
MARRVTQIFLSCDAADNRTSGSGAIYCAMPFNCASQVTMNGDPAVSARFCRVRNFAHRHRPILALRGDPMLSLKNMKVGVRLGIAFGLVVALLVVIGITSIMKINNIKSGITSIVEDRYVKVRLGFDVRDGVNDQIKYLRGIVIDTTRPQFNVQRFQQLADATARTNAAMKKIEAIQITAVGKKKIASLLAASQQFEQQKNEVLDLVRAGKADDASYYVLKKITAVQNAYLDLAVAFADSQSSQLQQEGAGIIDDGTTAIEVTLVFSALAILAAVVMGWLLTRSIVHPLNEADDHRQQSGCRRSQQTH

SEQ ID NO: 175707 - protein, 104 aa, Glycine max
  Coding DNA Sequence Number=SeqID_84022
  Subcellular localization annotation: CTP_CleavageSite=21; ConfidenceScore=5.17e-01
MRGYRMVIHTFLQPGANKPIDAQRLTSSSAPFVNQEASEPVDMQRLTSSSAPLSSRDSESDEMQRYPSGYPYKTISVNPDPRSLGAGGNTPSGYPYTQFCYPDL

SEQ ID NO: 175708 - protein, 71 aa, Glycine max
  Coding DNA Sequence Number=SeqID_84023
MVHLLWISSSGGYIHLVVQREQGKALDLLHKWSLLLLEDQWKWNGEGGKVIGDTTSRRRVKNMLTTIGSYG

SEQ ID NO: 175709 - protein, 52 aa, Glycine max
  Coding DNA Sequence Number=SeqID_84024
VDSRGSPSPFTPPPIYSKIEEELATQLAQASKVASSRSNNLLEEESGRPKWA

SEQ ID NO: 175710 - protein, 56 aa, Glycine max
  Coding DNA Sequence Number=SeqID_84025
GCSPRRANLPHFFRGNITMALYRTLGCLAATFSACPAPGRDDDLSVVTLSSICIRP

SEQ ID NO: 175711 - protein, 60 aa, Glycine max
  Coding DNA Sequence Number=SeqID_84026
  Subcellular localization annotation: CTP_CleavageSite=41; ConfidenceScore=5.28e-01
MMKEVIHDHNSAVPRLHFPSSPSSSAFFSLGKLAQASCLLRAEGISSPRQVGARPGEWLA

SEQ ID NO: 175712 - protein, 54 aa, Glycine max
  Coding DNA Sequence Number=SeqID_84027
MMMSSLLLSLLIMMQIPEPSPAPTHAPNDATPVVEPEQTIQDFLAAPALDLNED

SEQ ID NO: 175713 - protein, 189 aa, Glycine max
  Coding DNA Sequence Number=SeqID_84028
  Homolog annotation: Hit_ID=A1IW39; Match level="QueryCoverage=36%, HitCoverage=98%, E-value=2e-17, Identity=69%"; Hit description =Putative uncharacterized protein ophh-69
MGDKLHRREGNSPDHQLRPLNDRSVIKEMNGAKRSAEAVGCKKESVGERSALEGRTRASSAGRSGSENVGLSNANVGENPMPRKPKGSSARFVHGGVIRGRENASSQSSSTRRYSAEVIHAILPGKARTTFNKWVPVPETDTDHVWPPTPAQCRKVKEVGDLMTGEPTTEAPVNGGRNYNGPKVAKFLV

SEQ ID NO: 175714 - protein, 115 aa, Glycine max
  Coding DNA Sequence Number=SeqID_84029
  Homolog annotation: Hit_ID=A5BP71; Match level="QueryCoverage=65%, HitCoverage=19%, E-value=1e-10, Identity=46%"; Hit description =Putative uncharacterized protein
  Pfam annotation: Domain name=zf-CCHC; Domain location=88-105; Score =17.9; E_value=0.003; Accession=PF00098.14; Description=Zinc knuckle
MIVIVNAEACGYVSMNYYQYIDVVYTNEHILKAYSAQWWPIGNEAAIPPSDDAWTLIPDPTTIRAKGWPKSTRIRNEMDWVEPSEHRTKCSRCGAEGHNRRRCPMQFERGSFSNR

SEQ ID NO: 175715 - protein, 39 aa, Glycine max
  Coding DNA Sequence Number=SeqID_84030
MKHLKTYQGNPCGVYPDLSSFTGSGVIQISVACIKRSAS

SEQ ID NO: 175716 - protein, 120 aa, Glycine max
  Coding DNA Sequence Number=SeqID_84031
EENFVEVEAYEESLVEEHDSREKDKEKSEKRTQQQWEKCSQVEIQQESILRVNTPPHQLIGKEERHEEPYKSLSAILSWITSTSLTMIWKAFFGYMSFMESLAKRRKCKEDVFYVTFMPP

SEQ ID NO: 175717 - protein, 240 aa, Glycine max
  Coding DNA Sequence Number=SeqID_84032
  Gene Ontology: Mol. function=serine-type peptidase activity; Cellular component=integral to membrane; Biological process=proteolysis
  Homolog annotation: Hit_ID=A9PAC0; Match level="QueryCoverage=74%, HitCoverage=97%, E-value=1e-41, Identity=48%"; Hit description =Putative uncharacterized protein
  Pfam annotation: Domain name=Peptidase_S24; Domain location=99-172; Score=30.4; E_value=6.7e-06; Accession=PF00717.14; Description =Peptidase family S24
MGSALDAVIECFLIWGLLELRRGLEETFQNAWDSLCARALVFFSTKDNSIWDLYLQMKTAVMILRNLEALEHIIKAGWRISKFFCFVHVTQTYLIAPAVIYGPSMLPTIDLKTAVFLMEKISPWFGKVACGDIVVLRNPQDPRRFMTKRVVGLEGDSITYISNPETYELEGDSFTHISSLDNSDKSKTILVPKGAVWVEGDNKYNSNYSRKFGPVPYDLIDGKMFWRITPLKKFGPFWNK

SEQ ID NO: 175718 - protein, 38 aa, Glycine max
  Coding DNA Sequence Number=SeqID_84033
MVMEKKGRRRRKGLNGARACVRKAEIKLIDTVDLEGGP

SEQ ID NO: 175719 - protein, 215 aa, Glycine max
  Coding DNA Sequence Number=SeqID_84034
  Homolog annotation: Hit_ID=Q9XGX0; Match level="QueryCoverage=50%, HitCoverage=32%, E-value=7e-23, Identity=51%"; Hit description =Putative zinc finger protein SHI
  Pfam annotation: Domain name=DUF702; Domain location=68-188; Score =83.9; E_value=5.1e-22; Accession=PF05142.3; Description=Domain of unknown function (DUF702)
MQANTSNLLDIYVKSTKGEDEDHQLIGQGPPPQPRPLFCQDHYSALGVGPSKTISDDQSWLRSKFMLRRAAGGGISCQNCGNQAKKDCPHMWCRTCCKSRGFDCQTHVKSTWVPASRLRERLQQLFALQQTLEPPFSGGGKTLTLRGRREKGLLTYLRARAAVAGERVEVSAKEASVAVGVSVLVEPAALGLLQSPQFHPCFCSLFEVEGCRACG

SEQ ID NO: 175720 - protein, 93 aa, Glycine max
  Coding DNA Sequence Number=SeqID_84035
MEGNQGFLRARVRPRAYFVNVKGTELSKKSCIMEIVHLYVEHPGAEAEVIFHLLSCLDDDDMLMIHLVITLQVITMKIIRGSYFVECGSEPAI

SEQ ID NO: 175721 - protein, 46 aa, Glycine max
  Coding DNA Sequence Number=SeqID_84036
MELYFSCGGALQRFGKAPRFWTNVDPHNVLVDGVGVMRGRNLGNSI

SEQ ID NO: 175722 - protein, 293 aa, Glycine max
  Coding DNA Sequence Number=SeqID_84037
  Gene Ontology: Mol. function=protein binding; Cellular component=GPI -anchor transamidase complex; Biological process=regulation of protein metabolic process
  Homolog annotation: Hit_ID=A7PU42; Match level="QueryCoverage=96%, HitCoverage=65%, E-value=2e-70, Identity=53%"; Hit description =Chromosome chr7 scaffold_31, whole genome shotgun sequence
  Pfam annotation: Domain name=Gpi16; Domain location=1-293; Score= -115.0; E_value=5.6e-11; Accession=PF04113.5; Description=Gpi16 subunit, GPI transamidase component
MELSFTQGRWNYDRWGGFDSISSCNAKLPGVELWAVLDFPRPSIYRSFYHSQRLHLTMSTDHSDGSRSGINLEQTVTVVLQPNEQKAGTEDFRRNAGFELSVTPKRVHAEMETSSSILYEYPIKEYMETEQFDLGLTWKHPIAWSSPHAPLYASRFSMGSGNERGAIAISLKSIQGLVAINNVIERCKLQANVLQIVPWYVKVYYHTLQLVVDERPQALTDFVERMRVSPSEDKVSPGVMEMVLQFPCEMKSAVLSIVFDKGFLHIDEYPPDVNQGFDIPSAIISFPDFHASL

SEQ ID NO: 175723 - protein, 108 aa, Glycine max
  Coding DNA Sequence Number=SeqID_84038
MKRSFLIGATVIASFGYCKEHDGSWVKKGAQPIDEEGHLPVGEDSSLLQRILDRFDGLQTYVGERFDPLELQVDMRFDEMDSRITTVEGDVTYIRTCFDLPPPPPPSS

SEQ ID NO: 175724 - protein, 146 aa, Glycine max
  Coding DNA Sequence Number=SeqID_84039
  Homolog annotation: Hit_ID=A5BSR3; Match level="QueryCoverage=45%, HitCoverage=21%, E-value=6e-10, Identity=48%"; Hit description =Putative uncharacterized protein
DVRKKAQAIQKQNTAPHVLSRGGYDYLEQKLLAKKTKKKLEEAAQSGSVDGVIDPPSPIRCRVKWKMARTKKTGEMTTEAAKEITAKIDSLEEEATQGSFVPHGHQDVLIAVIGRPEHPGRVRAAGAGVTIKQYFGSAPQLFLAAS

SEQ ID NO: 175725 - protein, 100 aa, Glycine max
  Coding DNA Sequence Number=SeqID_84040
  Subcellular localization annotation: CTP_CleavageSite=55; ConfidenceScore=5.24e-01
MGKNKGRQSHLAAKQIMVKGTTSGSGKVLVKKTGTSSAKTDDVAHQVFDNLSQCSVESESSPEVSCTLGDNDSTTDDDSSHSCGSKSSPQLDDNKAPTPW

SEQ ID NO: 175726 - protein, 134 aa, Glycine max
  Coding DNA Sequence Number=SeqID_84041
MEPYGLRNHPFFGFRNITEPHGLCNNASFRFSACYGTSRIVQQCSILTSGTLWNFTYRATMGAKYLESAKQRLHAIKQWSPDEIRWHLQSSFFLLHSAAIDLQEAKDSIDEEDSRPTSSTWSYITNYGIKSRKL

SEQ ID NO: 175727 - protein, 83 aa, Glycine max
  Coding DNA Sequence Number=SeqID_84042
  Subcellular localization annotation: CTP_CleavageSite=44; ConfidenceScore=5.50e-01
MKKILGLQAPMELTSGDVSSTSRTSQSLTDSSHDSSSRSAARVVRSADGSLSRQISLAWLNEQIKISTSQTCLTNLKLKGNDY

SEQ ID NO: 175728 - protein, 321 aa, Glycine max
  Coding DNA Sequence Number=SeqID_84043
  Gene Ontology: Mol. function=transporter activity; Cellular component= cell outer membrane; Biological process=transport
  Homolog annotation: Hit_ID=A6T4D2; Match level="QueryCoverage=59%, HitCoverage=28%, E-value=4e-76, Identity=72%"; Hit description=TonB -dependent receptor
  Pfam annotation: Domain name=NikR_C; Domain location=267-321; Score =67.1; E_value=6e-17; Accession=PF08753.2; Description=NikR C terminal nickel binding domain
  Pfam annotation: Domain name=RHH_1; Domain location=214-253; Score =37.5; E_value=4.8e-08; Accession=PF01402.12; Description=Ribbon -helix-helix protein, copG family
  Pfam module annotation: Pfam domain module=NikR_C::RHH_1; Domain location=267-321::214-253
GSEVGVRSEWIPGLQSSLAVWQLDIDSELLFVGDAGETEPSRASRRYGVEWNNHYVVNDWLLLDMDLALSKARFTHKDPAGQYIPGAINKVASMGATVTNWGNWFGSVQLRYFGPRPLIEDNSVRSNSTFLTYARLGYRYNPHTTLTLDVFNLFDRKASDIDYYYESQLAGEATPVNDKHFHPVEPRSARLTNDSRPSDMGDYSLTIQRHFMRRITISVEDDLADAFDQLVAVRAYVNRSEAFRDLVRKALDEAVMENADHAQAECVASLSYVYDHHERQLASRVNQLQHDHHDVIITAQHVHLDHDNCMETVILKGKIAE

SEQ ID NO: 175729 - protein, 100 aa, Glycine max
  Coding DNA Sequence Number=SeqID_84044
  Gene Ontology: Mol. function=protein transporter activity; Cellular component=cytoplasm; Biological process=protein transport
  Homolog annotation: Hit_ID=A0HDR6; Match level="QueryCoverage=97%, HitCoverage=73%, E-value=2e-39, Identity=81%"; Hit description =Export-related chaperone CsaA
  Pfam annotation: Domain name=tRNA_bind; Domain location=4-98; Score =59.0; E_value=1.7e-14; Accession=PF01588.11; Description=Putative tRNA binding domain
GSPVGRVISAEVFAEARKPAYKLQIDFGPEIGMRKSSAQITAHYTPENLIGKLVVAVVNFPPKQIGPLMSECLVTGFHDAEGRVTLCVPEHEVPLGTKLL

SEQ ID NO: 175730 - protein, 102 aa, Glycine max
  Coding DNA Sequence Number=SeqID_84045
LCQSFGVPVAPSKAANHRAHVQTHDCLYQLSLSLQSQGFTSFPCPTPDQFRAEVAWPGDWPEARAGEAPAEAQAEAPDEADEAREDEEMTDLLDFLGGSEAR

SEQ ID NO: 175731 - protein, 163 aa, Glycine max
  Coding DNA Sequence Number=SeqID_84046
  Gene Ontology: Mol. function=2-C-methyl-D-erythritol 2,4 -cyclodiphosphate synthase activity; Cellular component=cytoplasm; Biological process=isoprenoid biosynthetic process
  Homolog annotation: Hit_ID=Q6D1B4; Match level="QueryCoverage=96%, HitCoverage=95%, E-value=1e-70, Identity=83%"; Hit description=2-C -methyl-D-erythritol 2,4-cyclodiphosphate synthase
  Pfam annotation: Domain name=YgbB; Domain location=7-163; Score =346.4; E_value=5e-101; Accession=PF02542.7; Description=YgbB family
TIKERIMRIGHGFDVHKFGGEGPLVIGGVRIPYDKGLLAHSDGDVALHAATDALLGAAALGDIGKLFPDTDPAFKGADSRELLREAWKRIRAKGYRLGNLDITIIAQAPKMAPHIPQMRVFLAEDLQCHMDDVNVKATTTEQLGFTGRGEGIACEAVALLIKE

SEQ ID NO: 175732 - protein, 113 aa, Glycine max
  Coding DNA Sequence Number=SeqID_84047
MVSSGGIVAVLREVSLERRCLRMQHKFSAKMGEITRLASKELSNHLEVTFFMGVDFLARLFTPYFIFTSSRGRGTSNVTSLKTFEAFNVASPCWGTSLRGGFLYGLTLIFLGF

SEQ ID NO: 175733 - protein, 148 aa, Glycine max
  Coding DNA Sequence Number=SeqID_84048
  Pfam annotation: Domain name=zf-CCHC; Domain location=78-95; Score =21.9; E_value=0.00074; Accession=PF00098.14; Description=Zinc knuckle
MELQRLNQNEETDKSKRSIALNASSSMQEEEEEEEESNDEEDFSLIVKKFHKFVKNRRIERCHNFNNGKRSQEGSPTLKCYKCYRPGHIKAHCPTNESWPEKNEKKSHEERRSKKAYIAWDDNDSSDGLEKEINLLSKDHESNKNISQ

SEQ ID NO: 175734 - protein, 191 aa, Glycine max
  Coding DNA Sequence Number=SeqID_84049
MSIYVAQLIADAIYIFAGITPTRHPLDPDKSNRALGFPALITGLCQSFDVPVAPSKVIRPPITRAFIEKYCTQRQVQGDAPQAADAPPPHQAGPAGSFDTEQYLRHLVRQQAANHRAHVQTHDCLYQMSLSLQSQGFTSFPCPTPDQFRPEARAGEASAEAPAEAPDEADEAREDEEMTDLLDSLGGSGAT

SEQ ID NO: 175735 - protein, 108 aa, Glycine max
  Coding DNA Sequence Number=SeqID_84050
  Homolog annotation: Hit_ID=A5AZG1; Match level="QueryCoverage=54%, HitCoverage=18%, E-value=3e-08, Identity=42%"; Hit description =Putative uncharacterized protein
MAGVGDNGGVYHQQDGFQRLLLDAMTTQMQRGNRRVNDGSNRIEGQDRIEGEMKIQHAFSYNDYPEEQKVKLAAATFSDYALVWWKKNQREMKREEGREIDTWTEMRM

SEQ ID NO: 175736 - protein, 124 aa, Glycine max
  Coding DNA Sequence Number=SeqID_84051
MRVHCYQASQRPSMTTDSPPLLMFPWTRSPTIATYHSTGGHKRVLYKNVRLKKEEVIILHEIRRPNSLKTVPSGVANCRNLPFGRRAKRRLTGASSKKGKCTESPPTFISGKCQKNRKDVVYEI

SEQ ID NO: 175737 - protein, 52 aa, Glycine max
  Coding DNA Sequence Number=SeqID_84052
MEGFGSSSGTPYGGKGNDHHDRDTLPVFYYEKLVGYTPSTFADLVFTGEKIR

SEQ ID NO: 175738 - protein, 50 aa, Glycine max
  Coding DNA Sequence Number=SeqID_84053
WLRRGNQHIGNDDLRLFRRKLDLMKRHEFVWEPYTPTMMAALGGRVGFYG

SEQ ID NO: 175739 - protein, 88 aa, Glycine max
  Coding DNA Sequence Number=SeqID_84054
MVNPEKDADLALVQMTQAEKKTCPALQWKTLVSPMGLSANKDLHLAQQGALSTTTLLNSTGLASRLTKPNSHNLKNIEIIALSVTGHA

SEQ ID NO: 175740 - protein, 73 aa, Glycine max
  Coding DNA Sequence Number=SeqID_84055
MRNALRLDSMKKPFDNMYEMPPRKLFAKRSRRDAAAEGTSAAPEFDSHRFRSAEHQQHFEAIKGWSFHQERRI

SEQ ID NO: 175741 - protein, 99 aa, Glycine max
  Coding DNA Sequence Number=SeqID_84056
MLWKLGGIDGDPVLRGTRIRATWEYVSSVEGGQLGMVDLCVICGCGESTCTIARSPPSTTYEGVVPEDMSRGSGDLGDVRWGAISQNQALPIPTQPGHS

SEQ ID NO: 175742 - protein, 196 aa, Glycine max
  Coding DNA Sequence Number=SeqID_84057
  Subcellular localization annotation: CTP_CleavageSite=35; ConfidenceScore=5.27e-01
MDMNIGGLISRQITIMAQSNSSLLGFPSLITALCRSRGVGSDALTSYKSLRLGQMLIMQSLQELAHQRLIMSVEQFIEQPEPENDQSYEATVLGAFDVSEGRSEMRSDKVIYPDLVPVPADPPSPMVDPSCLAPEAALPSTPIIIFDDPTVRTPEWIPTPPTTPELQFSDEEGGQITTPPGTPVLHLDDEEQDRDE

SEQ ID NO: 175743 - protein, 192 aa, Glycine max
  Coding DNA Sequence Number=SeqID_84058
MAPKKLAAKRARKATTGEGSSAAPQAEIEFDGHRFRSEEHQHRFEVIKDWSFLKERRVQITEGEYAEFQVEVARRRWTQLTEPMAKYDPEVVMEFYANAWPIEEGVVDKRSWVRGQWIPYDTDVINHFLGHPLVLEEGQRCEYADRRSQFLGFDEEAIAYLRCHPPVHRYCTFETPSGPREVQQGTGISAID

SEQ ID NO: 175744 - protein, 510 aa, Glycine max
  Coding DNA Sequence Number=SeqID_84059
  Subcellular localization annotation: CTP_CleavageSite=59; ConfidenceScore=5.27e-01
MGYKPKQKPLSGFVSALGKNLIKLVRFQHTTDFAKGVAARTICRAECPKVASATISLVEAMSSNHQLSSKVGSVLAKLLLSRVEDVVAKRDELAMKVADLEALLKESKSMLKEFELRVAREREANKELEEGLLIFKKGLDLGLFDPFKDVKDSVLLNEDDIATKEEADEEEQGTEEKDDVAIVIMMISVESLMAQEARPCRSRGRTMVGFLLLCGACPLMFVSNMFDLPLDRGLANQSGASPLRVIMSKYDFQPIEVRKTRGYLGFCKSVYQGVNLRFNEPWIEDVFVSGFDKPVELHRGLPRTDLGFYEPCMCSIVVAHTGGVMLCSCKRVTYHKWHVLETWCRARRFSGVLLHTCHSLWVTHTGDLVARSCIHVTRCGSRDLVLEGGLTKCAPWVACCDPKWAFPIGTNLSRSGILSGFTSDLPYEVITSLIVDGSPTSTRIMAFVRAICESTLRLVKSSMHGPKDDSISYLYLIVGLRMFDRGEFLHLTGRNFPQWSCFYPFGEVVN

SEQ ID NO: 175745 - protein, 138 aa, Glycine max
  Coding DNA Sequence Number=SeqID_84060
MDISFNPFSLFSQDIQVETCQGGHGQSGLLDFRTSALRVAFVKRTRGGTCKTKDFDAQRGDKFVEPLSMDKHCPVSRVVTSTGVRIVGLSSLSSPCAWQVLSRLHLSSCPGWTCIQFSMLGLTYQVRGISIFDNPALF

SEQ ID NO: 175746 - protein, 54 aa, Glycine max
  Coding DNA Sequence Number=SeqID_84061
MEVVVESGNSMVFSLVGVVVSGRHREGVGVGVDEDGGEGECTLEVGEMGTCRDS

SEQ ID NO: 175747 - protein, 187 aa, Glycine max
  Coding DNA Sequence Number=SeqID_84062
MAKFDPDIVLEFYANSWPTEEGVRDMRSWVRVLEEGQKCEFSQRRNRADGFDEEAIAQLLCTPGQDFARTAAGRRVRIMRTSMTTLTQMWMTLLLSNVLPSDHNSDLPLPKCQLVYAILTRMSVHVVQLIADTIYLFVGMPPTRHLLDPDKSNSALGFPALITGLCQARMDEEMMNLLRFLGGSRAT

SEQ ID NO: 175748 - protein, 112 aa, Glycine max
  Coding DNA Sequence Number=SeqID_84063
MWTTTANSKEREVPKGLTLFLFTSPPIYSKIGEKLAAQLAQASSACPGEQEVTETHGLRKSTSFRLPPHYGISWIAQACFLLISEMSRDFIYCATKDAKYLKAANQKLHVIK

SEQ ID NO: 175749 - protein, 234 aa, Glycine max
  Coding DNA Sequence Number=SeqID_84064
  Gene Ontology: Mol. function=heat shock protein binding
  Homolog annotation: Hit_ID=A7PLM4; Match level="QueryCoverage=95%, HitCoverage=32%, E-value=3e-43, Identity=57%"; Hit description =Chromosome chr7 scaffold_20, whole genome shotgun sequence
MELVEWLKWYRLTISNILAEKNMVVGTGYFDVLEKDFYLAIHATYYAKALWTGLKIYKSQATRFKEMEIVEWLKWYRLTISNILAEKKMVVGTGYFDVLERDFYSAIHATYYGPEIHSMELLPKCFEAEERSSYETPEVLHLVSGHDLFGMVCLANKVPEISITNNEKSTSFKFFLSSPCQSIIDLNIHRNVERSNDFETHKGHCSKTSSIVSNAYRHLKLKVYILLQILNSNI

SEQ ID NO: 175750 - protein, 261 aa, Glycine max
  Coding DNA Sequence Number=SeqID_84065
  Homolog annotation: Hit_ID=A7UQU7; Match level="QueryCoverage=50%, HitCoverage=22%, E-value=3e-15, Identity=38%"; Hit description=IMP dehydrogenase/GMP reductase, putative
  Pfam annotation: Domain name=DUF1723; Domain location=167-216; Score =47.5; E_value=4.8e-11; Accession=PF08330.1; Description=Protein of unknown function (DUF1723)
MVRTTGLGQAVEAISSKVILMMPKNQESSKIQKIQESSFKNQDQDSRLKIQETREDSIKALGRAIGKALGRRDASDDDDVPQRCRPTASARRQRQQEHDFLGGPHDASVLKDFENHIALRVWNGEERPELKLSSHGRKMAKFGRPAPEIEGLVVATGLSPLICSLDTDNRGLMFAFVERWHKETSSFHLPVGELTITLDDVAFFELLHVNHAIDMLVELLKVSTAEVRAEMIWCHGSYARLSWLRDLYQMKIEAYEWIVAM

SEQ ID NO: 175751 - protein, 61 aa, Glycine max
  Coding DNA Sequence Number=SeqID_84066
MDWFYMISHPFMSPAQPGDPPRVPLDQQYDTFVELDVYQQLITTVAPNEADVDVHHVRHAV

SEQ ID NO: 175752 - protein, 54 aa, Glycine max
  Coding DNA Sequence Number=SeqID_84067
CWSAWRAGLLWCCTLMQSYPARALGRRLQVDWARDPREGPRILMSLRVDFELMG

SEQ ID NO: 175753 - protein, 162 aa, Glycine max
  Coding DNA Sequence Number=SeqID_84068
MGHPMWYSDARANPPFIIYKPIIICKCYNNLYKKGLAAPFHSYKYQVPLNPQHIPNTQAYEQTRICKTLFEGSNPPLAAMRDTNTLQQLQNRIAKMEQRHVEELRKLKVDHDQLEAHVKRSKGDEHSAHTLPERTQGETHPRRTVNTLDDLSLSHLGKSIQQ

SEQ ID NO: 175754 - protein, 62 aa, Glycine max
  Coding DNA Sequence Number=SeqID_84069
MTDMQSGQQSKPFDVEMGDHLEDMIRDLGQESFQQAHAPMVQEFVDAVVGGLSLVNIKARYG

SEQ ID NO: 175755 - protein, 165 aa, Glycine max
  Coding DNA Sequence Number=SeqID_84070
MDAKHLTRTKEWSHVIKQRNKRCRRLCQPLHAIKAFCLQMQKNVYTDNHSGISAYHRARRLWMIQGCRMTKLGLCLSSGPPPLDDKRVRITVRMTKLGLCLSSGPPPLDDKRVRITVRYLRVSSGPPPLDDTRGQYDKDYGAADKSKALAPTYPPMRNSDLRSSG

SEQ ID NO: 175756 - protein, 81 aa, Glycine max
  Coding DNA Sequence Number=SeqID_84071
MVRQQTANHRGQGQGSPPFVCPTPEQFRAEVAWPGDWPTEEGTEPAGSLGKEEEAHMDEDMTDLLGYLGEGEATQPRSSHL

SEQ ID NO: 175757 - protein, 24 aa, Glycine max
  Coding DNA Sequence Number=SeqID_84072
MPIGGVDIEEEELTDLRSNLLDLE

SEQ ID NO: 175758 - protein, 98 aa, Glycine max
  Coding DNA Sequence Number=SeqID_84073
  Subcellular localization annotation: CTP_CleavageSite=40; ConfidenceScore=5.21e-01
MMEHTNLGIPRSCGSACHQTLGSRGSTGFNKNRRKSLKVYQSHTRQGLTFSPWVKVYDKLGFWLKACRTGSHDICQGLASGSGIKGMSYIISMIHMQQ

SEQ ID NO: 175759 - protein, 377 aa, Glycine max
  Coding DNA Sequence Number=SeqID_84074
  Homolog annotation: Hit_ID=UPI00016621D1; Match level="QueryCoverage =49%, HitCoverage=42%, E-value=8e-10, Identity=27%"; Hit description =UPI00016621D1 related cluster
  Subcellular localization annotation: CTP_CleavageSite=24; ConfidenceScore=5.57e-01
SHLQKTTRPRLQRTTRPPLQRTTRAHHQRATRPRLQRTTRSPLQRATRPRLQRTTHLHLQRTTRSRLQRTIGPRLKRTVHPRLQRTTSSPLRRATRPHLQRTTCAHNQRATRPCLLRTTRRPLQRATCPRLQRTRRPHLQRTTRPPLQRTTQDYTCSPSEGYTPLPFEDYTSSPSESCTPSPSKDYTSSPSLDYTGLRILAFRGLQILDFRGYMSSTSEICTPLPSEGYTPSLSEGCTSPPFEVYTELHVLPFRGLHVLAFSRLHILALRGLHVLAFRGLQVLPFRELHVVAFRRLHVLTIRGLHALAFRGLHVLPFREIHALAFRGLHVLPFRGLHVLLLSGLHVFTFKGLHVLPFRVLHALAFRGLNVLTFGGLH

SEQ ID NO: 175760 - protein, 22 aa, Glycine max
  Coding DNA Sequence Number=SeqID_84075
MVTKGWSFNGGFNGEEEEENDN

SEQ ID NO: 175761 - protein, 216 aa, Glycine max
  Coding DNA Sequence Number=SeqID_84076
  Homolog annotation: Hit_ID=Q6WAY6; Match level="QueryCoverage=57%, HitCoverage=21%, E-value=1e-15, Identity=38%"; Hit description =Putative uncharacterized protein
VRHACPLESHCSCTDKGGANWDQLLASKEGASVNWFPRWKEGRIGVLISCGGFPNVPLMGTRGCISYNPILAIRQLGYPMRGAPLKDELAPVISQGFNKTNVETLQKVRKAWEVLQKKDKELKGSNNGPIGGYHKWLKAHVQGLDWLPSLRTAKREEVEAPEEDEEVQALRAELEQAQTVKEGLVGKNTVGTNSKGLCGAVTTSLSSGERKGTNHE

SEQ ID NO: 175762 - protein, 266 aa, Glycine max
  Coding DNA Sequence Number=SeqID_84077
KDKEHRGSNNRPIGGYRKWLKAHVQGLDWHPSLGTAKREEVEALEEDEEVQALRAELEQAQTVKERFKSAALKIRKENTELRDVNVATTKVLERETKRACREEHGRNKFRGALWGNNSELKLRREERDQSRVDSLILKDELKVCSKSKRNLSQRLCETEANMLAIASEYQEELNLATAHEQKVVDEYARVYAEKEAGGRVIDSLHQEATMWMDRFALTLNGSQELPRLLAKAKAMANTYSALEEIHRLLSYCQHMIDLMAHMIRNR

SEQ ID NO: 175763 - protein, 279 aa, Glycine max
  Coding DNA Sequence Number=SeqID_84078
  Homolog annotation: Hit_ID=Q2HW90; Match level="QueryCoverage=73%, HitCoverage=44%, E-value=3e-21, Identity=33%"; Hit description =Putative uncharacterized protein
MGSSQKPSLKKRFYQVKIKSLEVTSLRELGQLMGQLQRQAFCKAYGKIWDLARVEVSMEPIASLSQYYDQPLRCFTFEDFQLVPTVKEFEEILGCPLGGRKPYLFSGTRVGPCKAKQEWGSRSTKEVFGRKGQRPWQIKANGLSFIDILALLIFGVVLFPNMEGLVDLAAIDAFLAFHHGKESPVVAILAMYDTFDRGCEKSSARIVCCALALYVWLVSHLFLQEGRPVYPLQGLCSCVEKGKANWDQLLASMEGRLLIGSLTRRKEESGFYLHAKDVP

SEQ ID NO: 175764 - protein, 214 aa, Glycine max
  Coding DNA Sequence Number=SeqID_84079
MIIDQSLFFSLTKLPSQGAPFEGTIVDDWKFDYSSHDAHRMVCNDQAEMTDRLLVGSLTFDNGIMHYIIVRILLPGSSNLAQASKEDLILMWVSLPVALRANAPLPYPQLVTLFLRHFQIPLDDEPFVQVKRSFAIGAGVVTSFGYRKDRNGQWLKKDALPPQDERTPSPPPQRDDSALMTEVLSELRGLRTYVGERFDTLDNRFAGMNIRLTA

SEQ ID NO: 175765 - protein, 160 aa, Glycine max
  Coding DNA Sequence Number=SeqID_84080
MSCLAIITPISLCRSVSWCMPPTRHPLNPDKSNRALGFPALITGLCQSFGVPVTPSKVIRPSITRAFIEKYCTPRQAHGDTPQAANAPPPPHQADPAGSLGMERYLRNLVRQQAANHRGQRLARGLGRGELARSPGAAEETRMDEEMTDLLGFLGGSGAT

SEQ ID NO: 175766 - protein, 187 aa, Glycine max
  Coding DNA Sequence Number=SeqID_84081
  Gene Ontology: Mol. function=4 iron, 4 sulfur cluster binding; Cellular component=integral to membrane; Biological process=protein -chromophore linkage
  Homolog annotation: Hit_ID=P56766; Match level="QueryCoverage=77%, HitCoverage=23%, E-value=7e-75, Identity=82%"; Hit description =Photosystem I P700 chlorophyll a apoprotein A1
QAIRQGDSEVAESWFNQAAEYWKQAIALTPGLFVCVVWKEEDSMIIRSPEPEVKILVDRDPIKTSFEEWAKPGHFSRTIAKGPDTTTWIWNLHADAHDFDSHTNDLEEISRKVFSAHFGQLSIIFLWLSGMYFHGARFSNYEAWLSDPTHIRPSAQVIWRASGITSELQLYCTAIGALVFAALMLFA

SEQ ID NO: 175767 - protein, 125 aa, Glycine max
  Coding DNA Sequence Number=SeqID_84082
  Pfam annotation: Domain name=G-patch; Domain location=4-48; Score =12.7; E_value=0.0055; Accession=PF01585.14; Description=G-patch domain
MSDAAMMVARVMLGHGYKPRMVLGQNNDGMASLVEFEENRGKFGLGYRPTRADMRRSALERRNRGMGQQQRPQVKEAHLCYINKSFVSAGWRFDDKSCEGTNSEDPDVDFERVANRAEDEEDEDM

SEQ ID NO: 175768 - protein, 96 aa, Glycine max
  Coding DNA Sequence Number=SeqID_84083
MEKFDKRNFKEKKAYIIWEDNDMNSSSDSENEVINLGLMAKDYESEEKKDHSASTCYIRKNGSSIGKMVWFQKDPYPKLTFKDPRKFGYQNQNKII

SEQ ID NO: 175769 - protein, 214 aa, Glycine max
  Coding DNA Sequence Number=SeqID_84084
  Homolog annotation: Hit_ID=Q6WAY6; Match level="QueryCoverage=94%, HitCoverage=33%, E-value=1e-11, Identity=27%"; Hit description =Putative uncharacterized protein
MVHDILVHEQYPLGGRKPYLFLGFYPSVARVAKVVKISTQELVRVKQNRNGVVGVPRRCLEEKAKALENQGEWASFIDILTLLIFRVVLFPNLEGLVDLAAIDAFLAFHHGKESPVIAILADMYDTFDRRCENSGTSIVCCTPTLYVWLVSHLFCQEGRLVCPLQGHCSCAEKGKANWDQLLASMEGASVNWFPHWKEGRTGILSSCEGFPMFP

SEQ ID NO: 175770 - protein, 106 aa, Glycine max
  Coding DNA Sequence Number=SeqID_84085
MKVQLVRQTLNTFLAWSAHLVKPYPEQDKQVTEGPTKPVAMLNPDIDPLYLMTLTIPQIFLKPLPVSWDASVFWVYNDNFSLYIKHEDLSEIVHGGQFQSIFVIQL

SEQ ID NO: 175771 - protein, 125 aa, Glycine max
  Coding DNA Sequence Number=SeqID_84086
  Homolog annotation: Hit_ID=A2ZL56; Match level="QueryCoverage=32%, HitCoverage=28%, E-value=7e-12, Identity=87%"; Hit description =Putative uncharacterized protein
  Subcellular localization annotation: CTP_CleavageSite=37; ConfidenceScore=5.21e-01
MTPADFTLSTPGANLLSVLPPRRRTGARVEPFISGVTAVERKKRLRSRNIRAGGTDHKWNAKQGGGERLGLGLPIPIGPHKGTGAVERFHIAELKGSTSVRDRSMSRRLVPAALKSTYALFPVHF

SEQ ID NO: 175772 - protein, 67 aa, Glycine max
  Coding DNA Sequence Number=SeqID_84087
MSFCLDVVEAWEDGWGPGVERNEDMGYVEWYLEICRGGQETLGTSGGVLLPKTKLDQSRPNPGIVGQ

SEQ ID NO: 175773 - protein, 383 aa, Glycine max
  Coding DNA Sequence Number=SeqID_84088
  Gene Ontology: Mol. function=transcription regulator activity; Cellular component=nucleus; Biological process=regulation of transcription
  Homolog annotation: Hit_ID=Q2HTQ7; Match level="QueryCoverage=91%, HitCoverage=100%, E-value=1e-128, Identity=65%"; Hit description =Putative uncharacterized protein
  Subcellular localization annotation: CTP_CleavageSite=89; ConfidenceScore=5.20e-01
MQVGTIGNIVSISGPFLTKLSAPYPLLLPLFWTMESGVPFLDCLLQNTLRSICSFPTSSTSSKWVYAVFWRIVPRNFPPPRWEFGGTALDRSKGNKRNWQVWILVWEDGFCDFNECEQGRNGCLNYKFGADVFFKMSHEVYSYGEGLMGKVAADNNHKWVYSDTQNGCESSYIGAWNASMDHQPKTWEFQLNSGIQTIAVIAVREGLVQLGSFNKIAEDLNFVVSIQRKFSYLHSIPGVFSIQRPHLPIQHPCIAKPNLQMMESNEMTLSAYNATNQVTRVNGVHEEKSSFFSMISINLGRNPPPQNGTTTTQGSPLWSAPPSLPNMSCSFGAMLSKLPYVTPSNNPPQVLETNKTNHKVKIEECRFHGAANGDQNKNAGWNP

SEQ ID NO: 175774 - protein, 33 aa, Glycine max
  Coding DNA Sequence Number=SeqID_84089
MLVAKAGPNSGRAGHYGLKPKELKQQPERMLTK

SEQ ID NO: 175775 - protein, 311 aa, Glycine max
  Coding DNA Sequence Number=SeqID_84090
  Gene Ontology: Mol. function=DNA binding; Cellular component=nucleus; Biological process=regulation of transcription
  Homolog annotation: Hit_ID=A7NTZ1; Match level="QueryCoverage=97%, HitCoverage=92%, E-value=3e-57, Identity=44%"; Hit description =Chromosome chr18 scaffold_1, whole genome shotgun sequence
  Pfam annotation: Domain name=NAM; Domain location=9-144; Score=69.8; E_value=9.2e-18; Accession=PF02365.6; Description=No apical meristem (NAM) protein
MEDHAHAALPPGYRFYPSEEVLVGYYLTKKNENREEGFYGSDLIRELDLYDHDPFELPDAAACFSYGYKGRKKHWFCYAKETKRRNRRKVKSGFWLRKGKVRDISDHNGDDVVLGTRTRFVFYVGNSLKNAARTDWILYEYALVDRFLASFVLCRVVNKPPHKNSPSEIGLSCCAEESVVAVVRHVGVQCDGCAESDVVEAKVCDEGFVNRENEIAENPISGEHGDPAAPVSVAQGSQPLSIANFCISNCLKNLFRIRVINTGNQSKCLLQVQERLSKLPSGSALFVGAMTSQQLMLSILEEDFIELDDIA

SEQ ID NO: 175776 - protein, 182 aa, Glycine max
  Coding DNA Sequence Number=SeqID_84091
  Gene Ontology: Mol. function=triacylglycerol lipase activity; Biological process=lipid metabolic process
  Homolog annotation: Hit_ID=A7NTX4; Match level="QueryCoverage=97%, HitCoverage=37%, E-value=7e-46, Identity=53%"; Hit description =Chromosome chr18 scaffold_1, whole genome shotgun sequence
MASSSEELFGLNYLLLKPQEASAVDLGRLLFSSNLKNRRFIECPEEIEAREFRQRWLLFISIVAQKVLVASRNSLKNVGDTLELWLNRLSSNGGLIRLLFNILTGKMITPERSSATFLSVVGYSDTRVDLDKSIKEKDTKYKGFLSMMASKLAYENEEFVSNAVRNHWDMDFLGSHSFWNGT

SEQ ID NO: 175777 - protein, 441 aa, Glycine max
  Coding DNA Sequence Number=SeqID_84092
  Gene Ontology: Mol. function=protein binding
  Homolog annotation: Hit_ID=Q2HU54; Match level="QueryCoverage=76%, HitCoverage=51%, E-value=1e-106, Identity=58%"; Hit description=SAM (And some other nucleotide) binding motif; WW/Rsp5/WWP
MELFALLVVAKEMKGNHAVTLFFFFSYKMVIADSDYNGPLFKVSQVFLWDDDLKFSSSAERWKLDEADANLIDLVTPEDLELTKQLNDLGLPLSFQTNKEKNRPVKCKKKGKLSKHPDTCHNPVDETLYEVTGEEIVSPAKFHDKTSSPLSCISMLGQSESSYREVAMDIDMTQCAYGEGDKSACCTGFASGVYREINNDNLNQVATNDAQDDDFLISNDRVDLKTAPASDTGVSAGSHLKGAGVNYCGTEYDESLIDSECLEVSPIVGKNTDCDTIYSDDGAATCHPHAIESELLPVSSEGIECDRNDVSNNYAEHGDWMAPSGMEHLATGGCTESADSKTLKASEECGTQNSTKPPEETLIEENLEVQQHEEYLTKSGVAVGNFISDITTHGEDQSLNHSDECLARDGKNKIVFTWLKRLQYDVMNQFSLKLKLLRGGF

SEQ ID NO: 175778 - protein, 106 aa, Glycine max
  Coding DNA Sequence Number=SeqID_84093
LEELGPVALRRAVEEREGKESGHYVDGGERGGGEDLTKGGIGNNELDSSSSWVEEYYNLSKEAEQANTRVEAANCEIEIAKECELKTLEKLNDVNREKGISEDGNG

SEQ ID NO: 175779 - protein, 72 aa, Glycine max
  Coding DNA Sequence Number=SeqID_84094
MEACLLLGRVDIFTSIRFRSCQMELVYSALVNPSIRACRLLRRADANHDGVLTIEELDTIVDFALARYKFRK

SEQ ID NO: 175780 - protein, 583 aa, Glycine max
  Coding DNA Sequence Number=SeqID_84095
  Gene Ontology: Mol. function=protein binding; Cellular component =cytosol; Biological process=endoplasmic reticulum organization and biogenesis
  Homolog annotation: Hit_ID=A7NTU8; Match level="QueryCoverage=48%, HitCoverage=78%, E-value=1e-114, Identity=75%"; Hit description =Chromosome chr18 scaffold_1, whole genome shotgun sequence
  Pfam annotation: Domain name=LNS2; Domain location=394-550; Score =331.4; E_value=1.6e-96; Accession=PF08235.4; Description=LNS2 (LipinNed1Smp2)
  Pfam annotation: Domain name=Lipin_N; Domain location=1-109; Score =135.1; E_value=2e-37; Accession=PF04571.5; Description=lipin, N -terminal conserved region
  Pfam module annotation: Pfam domain module=LNS2::Lipin_N; Domain location=394-550::1-109
MQAVGRLGSFISRGVNTVSGTFLPFGGAVDIVVVQQKDGSFKSSPWYVRFGKYHKVFKEEEKEKIEVHVSVNGVEPDFNMYLNRNGEAIFLHHADTQEEEEEEEEEEESTLFGGESETDDITSPSGRRHFKSKSWNFDSPDKSNSDAKVVVGRTKSRRARILGLVSRSLRGEGGDGDVNGVDLRERAEIAAKLLELKWSTNLNFDHKLPCRDRKKTRGDALDNGLPLPPRKMKEEARSCSDQDGISSKPVFNEMLCPASAGCGDVRVHAQEVLHAATLMLPEVAQSEELTKNSDIGRPAIKASELHSQQRDCSHSGRSDAGDVVKTPKFRKSQTINLGRRDLVKKVSANTPTSEQLASLNLKEGRNTITFSFPTVKGKQQVDAHMYLWKWNTRIVISDVDGTITRSDVLGQFMPLVGIDWSQTGVAHLFSDIKGNGYQLLFLSARAISQAYHTRQFLCNLKQDGKLLPDGPVVISPDGLFPSLYREVIRRAPHEFKIACLEDIKALFPPDWNPFYAGFGNRDTDEVSYLKVGIPKGKIFIINPRGEIAVNRRCFDTKSYTSLHSLVNGMFPPTNSSEQIFEVD

SEQ ID NO: 175781 - protein, 254 aa, Glycine max
  Coding DNA Sequence Number=SeqID_84096
  Gene Ontology: Mol. function=glutamate 5-kinase activity; Cellular component=origin recognition complex; Biological process=DNA replication
  Homolog annotation: Hit_ID=A7NTU1; Match level="QueryCoverage=99%, HitCoverage=79%, E-value=2e-90, Identity=59%"; Hit description =Chromosome chr18 scaffold_1, whole genome shotgun sequence
  Pfam annotation: Domain name=ORC2; Domain location=1-253; Score =172.3; E_value=1.2e-48; Accession=PF04084.5; Description=Origin recognition complex subunit 2
MYPEWFFALRNGFGLLMYGFGSKKVLIEDFASTALTEYSVVVINGYLQTINLKQVVIALAEILWEQVKTKQRVSYRDLPKSQQSFNSKSMEDLLTFLDQAEIEAGAFFVCVVIHNIDGSGLRDSETQQYLARLAACAQIRVVASIDHVNAPLFWDKNMAHTQFNWCWYHVPTFAPYKVEGMFYPMILAHGMPISDLYSVCRERFLVSSQITLNSHLTEFKDHELVKIKKHSDGQDCLHIPLTAEALQKVVLEII

SEQ ID NO: 175782 - protein, 362 aa, Glycine max
  Coding DNA Sequence Number=SeqID_84097
  Gene Ontology: Mol. function=hydrolase activity; Cellular component =vacuole; Biological process=lipid catabolic process
  Homolog annotation: Hit_ID=Q9AQT8; Match level="QueryCoverage=98%, HitCoverage=89%, E-value=1e-156, Identity=77%"; Hit description =Patatin-like protein
  Pfam annotation: Domain name=Patatin; Domain location=1-183; Score =192.6; E_value=9.6e-55; Accession=PF01734.13; Description=Patatin -like phospholipase
MQKLDGDHVRLADYFDVIAGTSTGGLVTAMLTAPDENNRPLYAAKDIKDFYLDHTPKIFPQNNNLFSPILKLGRTLFGPQYNGKYLHKLIREKLGDTKLHQTLTNVVIPAFDIKHLQPAIFSSFQLKKRPDLNASLSDICISTSAAPTYLPAHSFETKTHHGVSKFDLIDGGVAANNPALVAMAEVTNRISHEGQCNSLNVKPMQYDRFLVISLGTGSQQKEMKYSADEAAQWGIFSWVTTTNGGTPLIDAFSHASSDMVDFHITSLFQALNSEHNYLRIQDDSLNGDMSSVDLATEKNLNDLVKVGESLLKKPVSKINLQTGVHEPVNSHETNGEALKRFAERLSKQRRFRKSQMSANGNL

SEQ ID NO: 175783 - protein, 342 aa, Glycine max
  Coding DNA Sequence Number=SeqID_84098
  Gene Ontology: Mol. function=serine carboxypeptidase activity; Cellular component=extracellular region; Biological process =proteolysis
  Homolog annotation: Hit_ID=A7NTQ8; Match level="QueryCoverage=96%, HitCoverage=87%, E-value=1e-133, Identity=56%"; Hit description =Chromosome chr18 scaffold_1, whole genome shotgun sequence
  Pfam annotation: Domain name=Peptidase_S10; Domain location=1-334; Score=421.5; E_value=1.2e-123; Accession=PF00450.13; Description =Serine carboxypeptidase
MEMFSVSRPGCSSFGYGAMQELGPFRVNSDGRTLYTNQYAWNNVANVIFLESPAGVGFSYSNTSSDYTKTGDKSTAMDSYTFLLNWLERFPQYKTRDLFITGESYAGHYVPQLADTILTYNKLTNHTVINLKGIAVGNGWIDDNMCGKGMYEYFWTHALNSDETHEGIQRHCDFENGNLTSECSKYQIRGDIEIGTIDIYGIYAPPCDSAATKAGASPATNSDSNYDPCSDDYTNSYLNLAEVQEALHAKASVWYPCSGDTDGRVPITSSRYSINSMKLPVETTWRPWYSSNEVGGYLVGYKGLTLITVRGAGHMVPSYQPQRALTMISFFLRGELPPEFTS

SEQ ID NO: 175784 - protein, 84 aa, Glycine max
  Coding DNA Sequence Number=SeqID_84099
MGILDEEQEREGEQSTVMRSRLVALVGVAHSGDEDEVPVMIEVARWFVVIWRFPLAKDLTGAHGDFRGVIGVILHFSMTEKKQG

SEQ ID NO: 175785 - protein, 294 aa, Glycine max
  Coding DNA Sequence Number=SeqID_84100
  Gene Ontology: Mol. function=receptor activity
  Homolog annotation: Hit_ID=A7NTQ6; Match level="QueryCoverage=98%, HitCoverage=84%, E-value=2e-21, Identity=30%"; Hit description =Chromosome chr18 scaffold_1, whole genome shotgun sequence
  Pfam annotation: Domain name=DUF1645; Domain location=103-280; Score =97.4; E_value=4.5e-26; Accession=PF07816.2; Description=Protein of unknown function (DUF1645)
  Subcellular localization annotation: CTP_CleavageSite=66; ConfidenceScore=5.22e-01
MEVVVQSPSSPTMDNFDFGGNMGSIYQSVPSSPKGFGNYYLSAPASPSRMSELFSEFEYYSSASPSSFEAANIIDDDDDDENKDYSFAFYVNRDQSDKSSRSAEELFHGGKIKPLNEPRSSSKDSSVAEQKRGRERERTSSSTTTLSSSNSGGRRVTRSHSPYRKSWEVEQQQQQQPQPRSSKEESSASVLSSSTSSKGSKRWWLKDFLLFRSASEGRGSSKDALKKYYKKNSNEEVKGSSSFRSSDSSRSRKEPLSAHELHYAMKRQESEDMKKRTFLPYRQGILGRLAGFGI

SEQ ID NO: 175786 - protein, 199 aa, Glycine max
  Coding DNA Sequence Number=SeqID_84101
YVGTGDAEVEVLKLSVWRQKNIIRSIGGRICLINSVLSSLPLSHLSFFKMPKKGDMLAKELLMGLISGGEDLWCKVLKSNYGKESCGKFCRRSYRDSMWWRDSGLTCGENVGLITSVGGKLGMEMPWNSGTIFGEMQDAGMWKGDPTRLYTVKSAYRTLLLKINSHHIEVNSEFVDLIWKQQVSSKARFLCWNIMYGVL

SEQ ID NO: 175787 - protein, 76 aa, Glycine max
  Coding DNA Sequence Number=SeqID_84102
MSWESKDKPSRELALVVISNVVKTEPGVRYGEIEKGTPLDAVPNSSSSLRETVTASPREKFNRDVTVKHSNDGAVV

SEQ ID NO: 175788 - protein, 388 aa, Glycine max
  Coding DNA Sequence Number=SeqID_84103
  Gene Ontology: Mol. function=nucleic acid binding; Cellular component= intracellular; Biological process=regulation of transcription
  Homolog annotation: Hit_ID=A7NU01; Match level="QueryCoverage=67%, HitCoverage=53%, E-value=1e-119, Identity=77%"; Hit description =Chromosome chr18 scaffold_1, whole genome shotgun sequence
  Pfam annotation: Domain name=zf-C2H2; Domain location=162-185; Score =17.3; E_value=0.056; Accession=PF00096.17; Description=Zinc finger, C2H2 type
MSGANEKNMKNSLFLLHNANTIHFNLHSQITLPSIPLTTITTTKPFPHNRHFPRIQCCSNNNNNNSIEIDMVKNSQGIYAPKASKVVVLWDLDNKPPRGPPYDVAISLKTLAARFGDLVDFSAYANRHAFVHLPQWVLQQRRDRKNLDILERKGIITPPEPYTCGVCGRKCKTHLDLKKHFKQLHQRERQKKLNRLKSLKGKKRHRFKERFLRGNHKYDDAARTLVVPKVGYGLAAELRRAGVFVKTVQDKPQAADWALKRQMVHSMSRGIDWLFLVSDDSDFSEMLRRAREADLGTVVVGDWDRALGRHADLWVPWSGVENGEVGDLVPKRRRENSRRREQGEEHGFGLEDDDDDDGEDEELGQEYMLLYDDDDDDEGEEEDGLYIF

SEQ ID NO: 175789 - protein, 494 aa, Glycine max
  Coding DNA Sequence Number=SeqID_84104
  Gene Ontology: Mol. function=drug transporter activity; Cellular component=membrane; Biological process=multidrug transport
  Homolog annotation: Hit_ID=A7NTK1; Match level="QueryCoverage=98%, HitCoverage=98%, E-value=1e-158, Identity=62%"; Hit description =Chromosome chr18 scaffold_1, whole genome shotgun sequence
  Pfam annotation: Domain name=MatE; Domain location=263-426; Score =126.1; E_value=1e-34; Accession=PF01554.9; Description=MatE
  Pfam annotation: Domain name=MatE; Domain location=42-182; Score =58.8; E_value=1.8e-14; Accession=PF01554.9; Description=MatE
  Pfam module annotation: Pfam domain module=MatE::MatE; Domain location=263-426::42-182
MDSPLLENIDNSCSNVEEEKTPNTVVKRFGFESKKLWKIAGPAIVTSICQYSLGALTQTFAGLVGDLDLAAVSVENSVIAGLAFGVMLGMGSALETLCGQAYGAGQIRMLGVYMQRSWVILFITALILLPLYIWSPPILRLAGQTAEISDAAVVSTQFPPSIHWLLSIQKKESGLENGSITGDQKVCCVDDTSVVCIRYKLSNSKVPTGTEESAAAVTLNTSWWVIVIAQLLYIFITKSDGAWSGFTWLAFSDLFGFVKLSLASAVMLCLEFWYLMILVVITGRLENPLIPVDAISICMNINGWDAMIAIGFNAAISVRVSNELGAGDFKAAKFSVWVVSITSVSIGVVVMIGVLLTKDYFPYLFTTSVPVANETTRLSALLAVTVLLNSLQPVLSGVAVGAGWQSLVAYINIVCYYLVGLPAGIILGFKLGLGAELFNLYACVIQGIWSGMIAGIVLQTTILIIVTSIRNWKKEAEEAESRVRKWGGAISYDQ

SEQ ID NO: 175790 - protein, 75 aa, Glycine max
  Coding DNA Sequence Number=SeqID_84105
MQDINACGWWCWVFDAVLVVGGVGCLTQCLWLVVLGGGSDVGLADGGGRWEEGGAEWWLVVAWLFRHSDCPYSLL

SEQ ID NO: 175791 - protein, 672 aa, Glycine max
  Coding DNA Sequence Number=SeqID_84106
  Homolog annotation: Hit_ID=A7NTK6; Match level="QueryCoverage=100%, HitCoverage=66%, E-value=0.0, Identity=70%"; Hit description =Chromosome chr18 scaffold_1, whole genome shotgun sequence
MQSVNNKSLIEELDKLLERLRVPSEYATSLTGGSFDEARMLQNVEACEWLTSALRGLEMPNLDPSYANMRAVKEKRAELEKLKSTFVRRASEFLRNYFASLVDFMISDKSYFSQRGQLKRPDHADLRYKCRTYARLLQHLKSLDKNCLGPLRKAYCSSLNLLLRREAREFANELRASTKASRNPTVWLEGSTGSGQNVNATDTSTVSDAYAKMLTIFIPLLVDESSFFAHFMCFEVPTLVPPGGVVNGNKAGYDDDDDLGIMDIDENDSKSGKNSVELEALNKSLKDLLDGIQEDFYAVVDWAYKIDPLRCISMHGITERYLSGQKADAAGFVRDLLRDLESRISMQFNRFVDEACHQIERNERNVRQMGVLSYIPSSSGTIYSEWAWRMNSMVGGSVMDLRTSFDIMWDFGSNSILQNRHICNPCNSDGAVHPGFYRNITGGNVALQVSIMFATLEKIAQTDPKYADIFLFENYAAFQNSLYDLANIVPTLAKFYHQASEAYEQACTRHISMIIYYQFERLFQFARRIEDLMFTVAPEEMYYEVHERTWTGVSNVDLGDVTSNEAIGTGECPHKGVKMAKIDSFSAWTVKNGSSEDVKIQFIWGMVDKSIAAMYKKLQKNLTSEELLPSLWDKCKKEFLDKYESFAQLVSKIYPTETIPSVAEMRDLLASM

SEQ ID NO: 175792 - protein, 457 aa, Glycine max
  Coding DNA Sequence Number=SeqID_84107
  Gene Ontology: Mol. function=protein binding
  Homolog annotation: Hit_ID=A7NTE2; Match level="QueryCoverage=83%, HitCoverage=98%, E-value=1e-130, Identity=62%"; Hit description =Chromosome chr18 scaffold_1, whole genome shotgun sequence
  Pfam annotation: Domain name=DUF620; Domain location=208-453; Score =535.6; E_value=5.3e-158; Accession=PF04788.3; Description=Protein of unknown function (DUF620)
  Subcellular localization annotation: CTP_CleavageSite=53; ConfidenceScore=5.45e-01
MNDYILTPTAFIHKLTHQSSQNPSLASSVFGIPRPLNSQNPAGCLVGGPQRVVAAVDPPRDGEVPRVLGHVIGGKLCPNYEKVNGLETVLEVPIPEDMWTSIGSTASNRWLNLRALLRAQINSNKTSSSSSSSSSSSSYLVASSNNEFIDLLKLVGCPLIPLQVQSDHTLTRPLKDASSIEASSAKYIVQQYIGAIGGMVAMDSLKSMYAVGQVRMFGSEMRQGGENIKPKGKAEVGGFVLWQKNPDLWHFELIVSGFKVSAGSDGKVAWNQSSSQLSQANQGPPRPLRRFFQGLDPRCTANLFIDAVCVGEKTINNEDCFTLKLETAHNILQALNTSHTEILRHTVRGYFSQRTGLLVKFEDTKLVRMKHAKGNDSVFWETSMESVIEDYRCVDGINIGHGGKTVAILYKYGMAHNHQRKIEETWRIEEVDFNICGLSMDCFLAPSDLKKEQHGVV

SEQ ID NO: 175793 - protein, 334 aa, Glycine max
  Coding DNA Sequence Number=SeqID_84108
  Gene Ontology: Mol. function=transcription regulator activity; Cellular component=cytoplasm; Biological process=regulation of transcription, DNA-dependent
  Homolog annotation: Hit_ID=Q9LN63; Match level="QueryCoverage=100%, HitCoverage=100%, E-value=1e-70, Identity=45%"; Hit description =Protein BRASSINAZOLE-RESISTANT 2
  Pfam annotation: Domain name=DUF822; Domain location=10-188; Score =248.6; E_value=1.4e-71; Accession=PF05687.4; Description=Plant protein of unknown function (DUF822)
MADDGATSAATSRRKPSWRERENNRRRERRRRAIAAKIYSGLRAQGNFNLPKHCDNNEVLKALCAEAGWCVEEDGTTYRKLVISSNKSLLVDMPKTESNFGAQGCKPPLANGAGSSMRNIPFSSSQNPSPLSSSFPSPIPSYQVSPSSSSLPSPFRLDGDKDNVSNLIPYIRNASLSLPPLRISNSAPVTPPLSSPTSRNSKPIPTWESIAKESMASFNYPFFAASAPASPTHRHLYTPLTIPECDESDTSIGESGQWVKFQAFAPSASVFPTSPTFNLVKPVIPHRMPDNSIQVMRTSSEEFGVQVKPWVGEKIHEVALDDLELTLGSGKVRS

SEQ ID NO: 175794 - protein, 578 aa, Glycine max
  Coding DNA Sequence Number=SeqID_84109
  Gene Ontology: Mol. function=1-acylglycerol-3-phosphate O -acyltransferase activity; Cellular component=integral to membrane; Biological process=phospholipid biosynthetic process
  Homolog annotation: Hit_ID=A7NTI7; Match level="QueryCoverage=43%, HitCoverage=64%, E-value=4e-94, Identity=69%"; Hit description =Chromosome chr18 scaffold_1, whole genome shotgun sequence
  Pfam annotation: Domain name=Acyltransferase; Domain location=86-244; Score=52.2; E_value=1.8e-12; Accession=PF01553.12; Description =Acyltransferase
  Pfam annotation: Domain name=Thaumatin; Domain location=247-461; Score=332.2; E_value=9.3e-97; Accession=PF00314.8; Description =Thaumatin family
  Pfam module annotation: Pfam domain module=Acyltransferase::Thaumatin; Domain location=86-244::247-461
MEVCEPVKSENRLKHRPLTPIRFLRGLIGLVVFLSTALMCLVYFVPVAVVGLRLFSIRCSRKTVSFIFGLWLSLWPSLFEKINKTKVVFSGDGVPMKERVLLIANHRTEVDWMYLWDLALRKGRLGCIKYILKSSLMKLPIFGWGFHILEFIAVERKWEIDEQILQQKLSTLKDPQDPLWLALFPEGTDYTDQKSKNSQKFAAEAGLPVLTNVLLPKTKGFHACLEALRASLDAGNVAYATVFTLENHCSYTVWPGTLSGNGAALLGEGGFALAPGSAVQLTAPAGWSGRFWARTGCSFDASGSGKCVTGDCGSGLKCSGGGVPPATLAEFTLGSASNGNKDFYDVSLVDGYNVGMGVRATGGTGDCQYAGCVADVNGVCPAELQVRDGSGAVVACKSACLALNTAEYCCTGDHNTPQTCPPTHYSEIFKNACPTAYSYAYDDASSTCTCSGSDYRNVASATVFTLENHCSYAAWPGTLSGNGGFPLAPDSSVQLTAPAGSGPGAGAPEPVFTVGSAGNGGSNDFYDVSLVDGCNVGVGVRGVLGGLERGVYSYAYDDASSICTCSGSDYVITFCPAH

SEQ ID NO: 175795 - protein, 55 aa, Glycine max
  Coding DNA Sequence Number=SeqID_84110
MISPLLVLIVKVKAVLDYLYGLTLSFVFQIVASVNLAEELKAPKLVAETTWNFEM

SEQ ID NO: 175796 - protein, 402 aa, Glycine max
  Coding DNA Sequence Number=SeqID_84111
  Gene Ontology: Cellular component=integral to membrane
  Homolog annotation: Hit_ID=A7NTI4; Match level="QueryCoverage=93%, HitCoverage=93%, E-value=6e-90, Identity=49%"; Hit description =Chromosome chr18 scaffold_1, whole genome shotgun sequence
  Pfam annotation: Domain name=DUF607; Domain location=153-380; Score =243.5; E_value=4.8e-70; Accession=PF04678.4; Description=Protein of unknown function, DUF607
  Subcellular localization annotation: CTP_CleavageSite=38; ConfidenceScore=5.46e-01
MVLQKLLSKHFFDGVKMRPFERSVVSSPTMQQQVIAPPSMLGVSSADGGFLRRFFLLRQAVYHSSPARFPDFLSLPVGEKLREKLKSINNIAGIGDCCVALAPAPMASDAVFGSGMSVSHARKILRVPQMEKVKAKLRNVSESSVPYSEFLRICVETCENHEQGAEFAKILDESGNVIVLGKAVFLRPEEVFRSAVSGSSTKLQRMMMTWILILVWRNGALAGSLETVSFGWDMWNVAKSIESLIYQSIANPNDPRRKELELMEKQKWMIDEKAKAQVRAELYFGLGFLTVQTLGFMRLTFWELSWDVMEPICFFVTSFGFALAYLFFLKTSTEPTFQGFFHHRFKAKQERLMKTHNFDMSRYNELFKACYTNYHGGAKFESSYPFHYPGETHLTDLRALHR

SEQ ID NO: 175797 - protein, 375 aa, Glycine max
  Coding DNA Sequence Number=SeqID_84112
  Gene Ontology: Cellular component=integral to membrane
  Homolog annotation: Hit_ID=A7NTI4; Match level="QueryCoverage=92%, HitCoverage=93%, E-value=4e-67, Identity=43%"; Hit description =Chromosome chr18 scaffold_1, whole genome shotgun sequence
  Pfam annotation: Domain name=DUF607; Domain location=135-353; Score =215.7; E_value=1.1e-61; Accession=PF04678.4; Description=Protein of unknown function, DUF607
  Subcellular localization annotation: CTP_CleavageSite=18; ConfidenceScore=5.40e-01
MALRKLLSKRFFDRIKTRSFERSVVSSPTMQQQVITPPSMPGASSADGGFLLRFFLLRRAVYHSGPARFPDFLSLPVGEKLREKLKGINNIAGIGDCCVALAPAPMASDAVFGSGIVCQPCEEDFEGATNGEEVFCESALRRVRIMKQGAEFAKILDESGNVIVLGKAVFSGQRRLQRMMMTWILILVWRNGALAGSLETVSFGWDMWNVAKSIESLIYQSIANPNDPRRKELELMEKQKWMIDEKAKAQVRAELYFGLGFLTVQTLGFMRLTFWELSWDVMEPICFFVTSFGFALAYLFFLKTSTEPTFQGFFHHRFKAKQERLMKTHNFDMSRYNELFKACYTNYHGGAKFESSYPFHYLGETHLTDLRALHR

SEQ ID NO: 175798 - protein, 177 aa, Glycine max
  Coding DNA Sequence Number=SeqID_84113
MRKCDGVGRRVGWLNEKFKESEEMMGRGGIGSLRKELEEKVLEKREKGLCSSPSRSPPSPARRRKLSPSLGHRALFPEDPWKSVIDQAKDEASKAGLSEDTIFGAEKAITDGSAEKVAEDALGGGSLDDWVQEACNIANGGSSPFGALKDLPDYNEEDNLPEALELAPKSSPSVTPV

SEQ ID NO: 175799 - protein, 374 aa, Glycine max
  Coding DNA Sequence Number=SeqID_84114
  Gene Ontology: Mol. function=jasmonate O-methyltransferase activity; Cellular component=cytoplasm; Biological process=fatty acid biosynthetic process
  Homolog annotation: Hit_ID=A7NT84; Match level="QueryCoverage=99%, HitCoverage=99%, E-value=1e-122, Identity=61%"; Hit description =Chromosome chr18 scaffold_1, whole genome shotgun sequence
  Pfam annotation: Domain name=Methyltransf_7; Domain location=36-373; Score=544.3; E_value=1.4e-160; Accession=PF03492.6; Description=SAM dependent carboxyl methyltransferase
METLEVLHMNKGAGQTSYAMNSSVQNTIISCAEPARKKALVQILCSSNWPEKMGIADLGCSSGPNALRVISEILDGVYATTCLLNRPAPELVVYLNDLFTNDFNNIFGSLPSFYRKQKQEKGSGFGSYFVSAVPGSFYGRLFPSKSLHFAHSSSSLHWLSRVPSGLENGSGRALNKRKIYLSKSSPKCVLDAYSQQFKNDFSVFLASRSQEMVAGGRMVLSLMGRESMDPTTDHSCYQWELLARSLMSMVSEGLLEEEKVDSFDAPYYAPCLEEMKMEIQKEGSFIVTEHEAYEIDWDAGMELQSDSPTTGTPLTSGERVARSIRAVVESMLESHFGCHIMDELFRRYAQMVEDHLSKTRTKYINLVISLVKQG

SEQ ID NO: 175800 - protein, 688 aa, Glycine max
  Coding DNA Sequence Number=SeqID_84115
  Gene Ontology: Mol. function=transporter activity; Cellular component= intracellular; Biological process=transport
  Homolog annotation: Hit_ID=A5AZ38; Match level="QueryCoverage=97%, HitCoverage=69%, E-value=0.0, Identity=62%"; Hit description =Putative uncharacterized protein
  Pfam annotation: Domain name=CRAL_TRIO; Domain location=242-428; Score=129.0; E_value=1.4e-35; Accession=PF00650.11; Description =CRALTRIO domain
  Pfam annotation: Domain name=CRAL_TRIO_N; Domain location=156-225; Score=49.4; E_value=1.2e-11; Accession=PF03765.6; Description =CRALTRIO, N-terminus
  Pfam module annotation: Pfam domain module=CRAL_TRIO::CRAL_TRIO_N; Domain location=242-428::156-225
VGNEAEYVSFDLRPSDAINIAVRCKVPIQVNKYLAYSDGMRVIESGKLSTQFPGMDGRLFTEMDRPSGQPCSETTEFNLLHNMLKAVVEERYKDAGFSGHDERRERKSDFENSEDDRRTRIGSLKKKAINASSKFRHSLKKKSSRRKSANRSNSVSIEDVRDVKELQAVDAFRQALMLDNLLPPRHDDYHTLLRFLKARKFDIEKAKHMWANMIQWRKEYGTDTIMEDFEFGELNEVLQCYPHGYHGVDKEGRPIYIERLGKVDPNKLMQVTTMERYLRYHVQGFEKTFAVKFPACSIAAKRHIDSSTTILDVHGVGFKNLTKSARELIIRLQKIDGDYYPETLCRMFIINAGPGFKLLWNTVKSFLDPKTTSKINVLGNKFQNRLLEIIDASKLPEFLGGSCTCIDQGGCMRSDKGPWQDPNILKMVLSGEVQCSRQIVTVTNDEGTLIECDKACFPMPIRSSDTSTAESGSEVEDITSPKASGNYTNPRLTPVHEEARLIGRASGFSEYDDYVPMVDKAVDLGWKEKQVATQNSYGSTENFLLSTGKSGGNCAYILAVIVGFFVAIFTFVRSLALRVTKGIQDTKSDSAKNMLPNTTVDSITKEESRPPSPVPRLTKTELISSALKRLGELEEKVDILQSKPNVMPYEKEELLNAAVYRVDALEAELIATKRVDLLSIELLLQFNT

SEQ ID NO: 175801 - protein, 137 aa, Glycine max
  Coding DNA Sequence Number=SeqID_84116
  Gene Ontology: Mol. function=structural constituent of ribosome; Cellular component=ribonucleoprotein complex; Biological process =translation
  Homolog annotation: Hit_ID=Q9ZT04; Match level="QueryCoverage=77%, HitCoverage=79%, E-value=2e-41, Identity=74%"; Hit description=50S ribosomal protein L31
  Pfam annotation: Domain name=Ribosomal_L31; Domain location=42-108; Score=57.7; E_value=3.9e-14; Accession=PF01197.9; Description =Ribosomal protein L31
  Subcellular localization annotation: CTP_CleavageSite=20; ConfidenceScore=5.08e-01
MAQCVTKNTFVQGKPFLPVPAAPTKNALQVRRVVQCGVWCRKKEIHPQFHEEAKVYCNGELVLTTGGTQKEYVVDVWSGNHPFYLGSRSASMVSDDQVEKFRKKFGELKEIMEIPVLKGEIVIPSRRKGVSKGGKKK

SEQ ID NO: 175802 - protein, 162 aa, Glycine max
  Coding DNA Sequence Number=SeqID_84117
  Gene Ontology: Mol. function=DNA binding; Cellular component=nucleus; Biological process=embryonic development ending in seed dormancy
  Homolog annotation: Hit_ID=Q0PJF4; Match level="QueryCoverage=37%, HitCoverage=68%, E-value=4e-25, Identity=95%"; Hit description=MYB transcription factor MYB97
MDLCDKVDDDKIRRRHEGEALCDEVGAKGSGEELAMTSRMPRLLPPPPWPALRDQREGDGHEGGGSATPRQRLEQRAMAVARLQHDRGGVTELVRRRWGRAVGGKTVEEVKRHYEMLVDDLKQIEEGHVPLPNYRNVAATGGSSIRGYSYMEEEQRLKSNPY

SEQ ID NO: 175803 - protein, 366 aa, Glycine max
  Coding DNA Sequence Number=SeqID_84118
  Gene Ontology: Mol. function=metal ion binding
  Homolog annotation: Hit_ID=A7NT69; Match level="QueryCoverage=88%, HitCoverage=74%, E-value=1e-110, Identity=65%"; Hit description =Chromosome chr18 scaffold_1, whole genome shotgun sequence
  Pfam annotation: Domain name=zf-C3HC4; Domain location=202-260; Score= 15.9; E_value=0.0014; Accession=PF00097.16; Description=Zinc finger, C3HC4 type (RING finger)
MVPDIVIDIQFRCSLLCTLVPWVAVSLFGIDFCFFFLYVLIADLSVSSNFSTVVKNPAESSIPNLSFSIPSVFSTPTADPLPNHNYHHLPNSTPTRWAHRSPAHPLLRQISDSRIMGLKSPDNSISEGRPSFVLSTCSNEMAAGSICGSSDGWSMRTFSELVASSQRERWSFDSECFGSGRHKISGSSSRFSYSPSMELQSCGACSKLLTERSTWSNQKFIANSDLSVVAVLVCGHSYHAECLEAMTSEADRYDPACPICMVGDKNLSKLLSRKGLRAESEMKAKNHKISRNRVVDSYLDGGFDVFDRQKDIDLRGKVSKMEPSCSARSSFGKPFLRRHFSLGSKWSRSLSENDSARKKGFWARYR

SEQ ID NO: 175804 - protein, 362 aa, Glycine max
  Coding DNA Sequence Number=SeqID_84119
  Gene Ontology: Mol. function=catalytic activity; Biological process =cellular metabolic process
  Homolog annotation: Hit_ID=A7NT68; Match level="QueryCoverage=91%, HitCoverage=84%, E-value=4e-95, Identity=54%"; Hit description =Chromosome chr18 scaffold_1, whole genome shotgun sequence
  Pfam annotation: Domain name=Epimerase; Domain location=33-277; Score= -45.3; E_value=0.00086; Accession=PF01370.12; Description=NAD dependent epimerasedehydratase family
MEIALSLPLERCHVHVGTSFGSITPTLSEKRSMFILGMGFFGQSLARKLHNQGWVVSGTCTTHVKKKELQEMGFNVHLFDANHPDVDVLQVMKNYSHILVSVPPLVGIGDPMLRHEELLRSSLTDGDLRLSKTRFAPLQAMSTAALTYFSNAFRFKYDDRDTFCLAGVYGDCDGELVDEDYPTNPESGLAKLRLASEEGWSNLAHNLGISPLLFRLGGIYGPGRSAVDTIIKQKPMSEGQKRRKNRKYTSRIHVDDICQALMATVLAPPPREVYNIVDDDPAPREEVFEYAMKLVEKKWPGLKLQSVEQKQKEWPNAKNPRGEKRVCNARMKRELGVQLLYPDYKSGLKSIIHQIQTPFQSH

SEQ ID NO: 175805 - protein, 70 aa, Glycine max
  Coding DNA Sequence Number=SeqID_84120
MGMSGSPKKGGHNYKQKTIINLPKGGSHCSWWLERRMVHCTRERTRLKIQSTRDGVLKVVLLTSSSFIKI

SEQ ID NO: 175806 - protein, 131 aa, Glycine max
  Coding DNA Sequence Number=SeqID_84121
  Gene Ontology: Mol. function=transferase activity, transferring phosphorus-containing groups; Biological process=tRNA splicing
  Homolog annotation: Hit_ID=A7PYF1; Match level="QueryCoverage=81%, HitCoverage=47%, E-value=2e-34, Identity=72%"; Hit description =Chromosome chr15 scaffold_37, whole genome shotgun sequence
  Pfam annotation: Domain name=PTS_2-RNA; Domain location=31-131; Score= 19.8; E_value=8.3e-08; Accession=PF01885.7; Description=RNA 2' -phosphotransferase, Tpt1  KptA family
MGEVSTGRGKAFDMRNDRERTRGRGGGSGSGKDKIDSLGRLLTRILRHMASELNLNMRSDGYVKVNDLLKLNLKTFANIPLKLHTIDDIREAVRKDNKQRFSLLEENGELLIRANQGHTVKMSLMKNSTSD

SEQ ID NO: 175807 - protein, 368 aa, Glycine max
  Coding DNA Sequence Number=SeqID_84122
MESVSTGPRDLSHWTPKTMSAPAIGSTYRSTAQVMLRYQVPLDEVLRTAAIHEDDNLVADDRAQQEPGQGPLYYPQQHPLRRKQEKNPRGTTVASMAISSDDRRFRVGGGRGGSECGDSEGSRAGEGIGRGGSECGDSEGSRAGEGIGRGGDIVSTASPPRDKRDWLPEPALVGAMPAPRDGFRADGALLSQLEESACRVVVMVRSEASLEDLDEHRIRSELTITGHPLELGKCSAIHVERNNGKSILFWGCMVLEILIDLEHPLERVSAIKAVERQGRKTKKQLIKFLSHRLDCFSEGHLVIGELENCGFEVIRGPRGTGGVGHGDESTKMIGKASTSFEDQFLLEEGNLEDKKISQAKTELVIAVP

SEQ ID NO: 175808 - protein, 1876 aa, Glycine max
  Coding DNA Sequence Number=SeqID_84123
  Gene Ontology: Mol. function=oxidoreductase activity; Cellular component=nucleus; Biological process=electron transport
  Homolog annotation: Hit_ID=A7NT09; Match level="QueryCoverage=68%, HitCoverage=98%, E-value=0.0, Identity=64%"; Hit description =Chromosome chr18 scaffold_1, whole genome shotgun sequence
  Pfam annotation: Domain name=Amino_oxidase; Domain location=836-1307; Score=332.8; E_value=6.3e-97; Accession=PF01593.15; Description =Flavin containing amine oxidoreductase
  Pfam annotation: Domain name=DAO; Domain location=828-1287; Score= -34.5; E_value=0.002; Accession=PF01266.15; Description=FAD dependent oxidoreductase
  Pfam annotation: Domain name=Pyr_redox; Domain location=828-907; Score=-4.8; E_value=0.013; Accession=PF00070.18; Description =Pyridine nucleotide-disulphide oxidor
  Pfam annotation: Domain name=Pyr_redox_2; Domain location=828-1117; Score=-44.4; E_value=0.044; Accession=PF07992.5; Description =Pyridine nucleotide-disulphide oxidore
  Pfam annotation: Domain name=SWIRM; Domain location=593-676; Score =34.8; E_value=3.2e-07; Accession=PF04433.8; Description=SWIRM domain
  Pfam module annotation: Pfam domain module=Amino_oxidase::DAO::Pyr _redox::Pyr_redox_2::SWIRM; Domain location=836-1307::828-1287::828 -907::828-1117::593-676
MEGENIRSGTKKKRSKKEIGFDSDDDEPIGSMFKLKRSKKKGSGGGSSDAAVVREKEDLGGMDDNDTLASFRKRLKGPKRDQGSGVTRGGAIPALHVSDEDLVALGPKGKDEKGVAPVPLVWGDEDMQMQDCTDQQHMEDLLPVIFNKAQSSSSRKSRSQGSRQKKGIQNVDSEGFVEAVDSGVESRSGSASGSKLVGGNVESVELLPQASERVVASVVDDQKCGDDCFQEEAVKGHCDLDIPDGPSQSNNVCHGDMQQLSCVQVEDISCHSDQKVGLQESALSDALKNLSTTSHDEIVDTISLSKVGEGERGFTEAGESENRLTVEPAKVCNSASEPDVSTFAGKENVLTSCHTEPLIKSAETILNENNNMVARKVFQESSWNGALDLSGCHMEVDGGGKSETEFVSDRNFCDYSSLDTKAEVQDFVSGFSPKRNNVTVSGSLSSMVSNEANEAELTAHSNHPEKPLEGCNIPKDSTASILKCSSVLDPIQSDGSSLQSSIPDENGNSAEYRAPVSDFADNEGKISSIPRAVRKTKMRKHGDMTYEGDADWEILIDDQALNESQVMTDGDRTLRSRLKHDSSLNTGEDSENVAVVAVSAGLKARKAGPIEKIKFKEVLKRKGGLKEYLDCRNQILSLWNRDVTRILPLAECGVSDTHSEDGSPRSSLIREGYINVGIASQKENVGSNARHCYKLVKEKGFEESLAASMADSEDGVSFLVGQTKMSDTSNEINNGLTKDGDDLTLEAAEGMRHANEMKTDLSNMTQQVERKKNDYQGNDSSVPSSNFPDCRLISLVAKEKSNDSTCIKSALDARVGYHLQSDLDPRKRVIVIGAGPAGLTAARHLERQGFSVFVLEARSRIGGRVFTDHLSLSVPVDLGASIITGVEADVATERRPDPSSLICAQLGLELTVLNSDCPLYDIVTGQKVPADMDEALEAEYNSLIDDMVLVVAQKGEQAMRMSLEDGLEYALKIRRMARSESSEETEQNNSADSPFDSKKDSTLEKKLGEEILSPQERRVMDWHFAHLEYGCAALLKDVSLPYWNQDDVYGGFGGAHCMIKGGYSSVVESLGEGLTVHLNHVVTNVSYGIKEPGQSNKVKVSTENGNEFFGDAVLVTVPLGCLKAETIQFSPPLPQWKCSSVQRLGYGVLNKVVLEFPSVFWDDAVDYFGATAEERSSRGHCFMFWNVRRTVGAPVLIALVVGKAAIDGQSLSSSDHVNHALKVLRKLFGEDSVPDPVAYVVTDWGRDPFSYGSYSYVAVGASGEDYDIIGRPVDNCLFFAGEATCKEHPDTVGGAMMSGLREAVRMIDILSSGNDYIAEVEALEAARGQLDTERDEVRDIIKRLDALELSNIMYKNSLDGAHILTREALLREMFFNTKTTAGRLHVAKQLLTLPVGNLKSFAGSKEGLAILNSWILDSMGKDGTQLLRHCLRLLVRVSTDLLAVRLSGMGKTVKEKVCVHTSRDIRAIASQLVNVWLEVFRKGKASNGGLKISRQTSAVDLSKRKSVKDSALGKPPLGTYHGTIENKGGLLNPTSAGSNSPSTAHVKKLHSKQGRQPAAYDSRHEVSSSRSKGSIDTVVAEKEDNLCTISEEEQAAIAAAEAARAKALAAAEAYASAEARCNTLLQLPKIPSFHKFARREQPSQNDECDSRKRWPGGVYGRQDCISEIDSRNCRVRDWSVDFSAACVNLDNSRMPVDNLSQRSHSNEIASHLNFREHSGESVAGDSSIYTKAWIDTAGGIAIKDHHAIERWQSQAAAADSYFSNPSIDLKDEEDSNACSKLPSWKRDGIANESSISQVTVNKEAQKGHSRGADHIKQAVVDYVASLLMPLYKARKLDKDGYKAIMKKSETKVMEQATDAEKAMTVREFLDFKRKNK

SEQ ID NO: 175809 - protein, 119 aa, Glycine max
  Coding DNA Sequence Number=SeqID_84124
  Subcellular localization annotation: CTP_CleavageSite=79; ConfidenceScore=5.72e-01
MKPLPSFNQHVKPSGPYISFPTTSLITPSSSNASISSFALTLTFTKLAHTIGNLNDVVNFKKRGEDYCNNEASVEKRVKDAMVEKGKPLILELMWVLGMINFSLVEIGSSIKRVKRFKE

SEQ ID NO: 175810 - protein, 932 aa, Glycine max
  Coding DNA Sequence Number=SeqID_84125
  Gene Ontology: Mol. function=protein dimerization activity; Cellular component=nucleus; Biological process=regulation of transcription, DNA-dependent
  Homolog annotation: Hit_ID=Q8GT89; Match level="QueryCoverage=99%, HitCoverage=98%, E-value=0.0, Identity=64%"; Hit description =Hypothetical transcription factor
  Pfam annotation: Domain name=AUX_IAA; Domain location=767-918; Score=- 70.6; E_value=0.00021; Accession=PF02309.7; Description=AUXIAA family
  Pfam annotation: Domain name=Auxin_resp; Domain location=276-359; Score=197.6; E_value=3e-56; Accession=PF06507.4; Description=Auxin response factor
  Pfam annotation: Domain name=B3; Domain location=149-254; Score =120.7; E_value=4.4e-33; Accession=PF02362.12; Description=B3 DNA binding domain
  Pfam module annotation: Pfam domain module=AUX_IAA::Auxin_resp::B3; Domain location=767-918::276-359::149-254
MASVEEKIKTGGVGGGMVVGGQTLVAEMKLLKEMQEHSGVRKTLNSELWHACAGPLVSLPQVGSLVFYFPQGHSEQVAASTRRTATSQIPNYPNLPSQLLCQVQNATLHADKETDEIYAQMTLQPLNSEREVFPISDFGLKHSKHPSEFFCKTLTASDTSTHGGFSVPRRAAEKLFPPLDYTIQPPTQELVVRDLHDNTWTFRHIYRGQPKRHLLTTGWSLFVGSKRLRAGDSVLFIRDEKSQLRVGVRRVNRQQTTLPSSVLSADSMHIGVLAAAAHAAANRSPFTIFYNPRACPSEFVIPLAKYRKSVFGTQVSVGMRFGMMFETEESGKRRYMGTIVGISDVDPLRWPGSKWRNIQVEWDEPGCGDKQNRVSVWEIETPESLFIFPSLTSGLKRPLPSGLLENEWGTLLTRPFIRVPENGTMELSNSIPNLYSEHMMKMLFKPQLINNNGAFLSAMQQESAATRGPLQEMKTTLAAENQMLLKNLHPQSIPDQPNALNMQSLLKNDQPEKFHPLAKIDNHLPSGIVIDKPKLECEVLPDRVIDYPSMEGCNNEKVAVNPVNQQGLATQLPFHNQNQSPLLPQSSPWPMQPLIESSMPHPQMIGMAQADSAMVNGLFPQLDIDEWLAYASSQPFAGQNRPTGPFSDLQEHNSLQPQVVNPPLPSMNNEVWDHYVKNFKFLSQADQLTSICQPGMYGLNGVPSSNNLRDLSAESNNQSEICVNVDASNSVGTTMVDPSTSSTILDEFCTMKDGEFQNPQDCMVGNLSSSQDVQSQITSASLAESHAYPLRDIPDNSGGTSSSHVDFDESSFLQNNSWQQVPAPIRTYTKVQKAGSVGRSIDVTTFKNYEELIRAIECMFGLDGLLNDTKGSGWKLVYVDYESDVLLVGDDPWEEFVGCVRCIRILSPSEVQQMSEEGMKLLNSGALQGMNV

SEQ ID NO: 175811 - protein, 72 aa, Glycine max
  Coding DNA Sequence Number=SeqID_84126
MSLQSNGTFDRIERIDMRSQRDCLIDNTDNIVATTTTMLIRFEKSPPSNRSIALMEERSRVRLYESKRAMQH

SEQ ID NO: 175812 - protein, 648 aa, Glycine max
  Coding DNA Sequence Number=SeqID_84127
  Gene Ontology: Mol. function=RNA-directed DNA polymerase activity; Cellular component=exocyst; Biological process=exocytosis
  Homolog annotation: Hit_ID=Q9FGH9; Match level="QueryCoverage=51%, HitCoverage=65%, E-value=4e-51, Identity=35%"; Hit description =Leucine zipper protein
  Pfam annotation: Domain name=Exo70; Domain location=159-641; Score= -22.3; E_value=3.2e-10; Accession=PF03081.6; Description=Exo70 exocyst complex subunit
MLIIKIRSWLLEPKVWSFVCFVSSVVGLLCYALSTSFNHLFGKWTWWKTLLYIVFSFIVCLAVLFAKAWERSTSTWLEAHMAFLILFFTSVYSFFFDKEVKGKPDAYSLFSCAAFAIMSLSMSRLSHFGFEVDLLYFFSGVLTIQLMKIKIWLVVVGGSFSYSLILLRSTLGASPTRIEYRGLQLRDDLVIEIDSQGTSHSTSQLHPDVMIITQQDAHVPLEFPVNSLSQQGNSFSDNNIMERFMGCIEALKKENENLMDTISKHVSKYLKANVVNEDQIHVCEIDADDNLVVDALLSSGIIINDLRETVRLMVAAGLKVECCRAYRSCRRKFLRKSVSNFWLRMQDLNVEEDIDKLMIEIQCWIKVLNVAVMILFPNERTLCDRVFEGSISSVEKYHVSLGNDALWGDKSLNILMNLVYFSYADKEQATVTPVGGGVHQITHCVLDYMNRIDWQKPLSLFVEVDRIIIMKLLETCLEANSKIYNNPTLGYIFIMNNWRQIELAATQPQLNPIFGDYGFKKSTTKVQQNLELYQRSSWNKIVDILKVDIDEVEPNVAAEVMKDKLHSFNEHLDEICNVQSAWFVFDEQLREQLIKSIENMVLPAYGNFLGRLQDFLGKHAYEYIKYGMFDVQYRLNNNLFLVWEKELE

SEQ ID NO: 175813 - protein, 73 aa, Glycine max
  Coding DNA Sequence Number=SeqID_84128
  Homolog annotation: Hit_ID=A7P4R5; Match level="QueryCoverage=91%, HitCoverage=10%, E-value=4e-10, Identity=41%"; Hit description =Chromosome chr4 scaffold_6, whole genome shotgun sequence
  Pfam annotation: Domain name=PPR; Domain location=28-62; Score=29.7; E_value=1e-05; Accession=PF01535.11; Description=PPR repeat
MIWGFRKASMAKSAHKVFDKRCYESNMVTFNTLIHEFCKRGDMEGARRVFDRLVESQSCKPDVVSFTLANREV

SEQ ID NO: 175814 - protein, 626 aa, Glycine max
  Coding DNA Sequence Number=SeqID_84129
  Gene Ontology: Mol. function=transferase activity; Cellular component= chloroplast; Biological process=glycolysis
  Homolog annotation: Hit_ID=A7NSW0; Match level="QueryCoverage=74%, HitCoverage=94%, E-value=0.0, Identity=75%"; Hit description =Chromosome chr18 scaffold_1, whole genome shotgun sequence
  Pfam annotation: Domain name=Clat_adaptor_s; Domain location=486-626; Score=212.7; E_value=8.4e-61; Accession=PF01217.11; Description =Clathrin adaptor complex small chain
  Pfam annotation: Domain name=Hexokinase_1; Domain location=40-245; Score=230.8; E_value=3.2e-66; Accession=PF00349.12; Description =Hexokinase
  Pfam annotation: Domain name=Hexokinase_2; Domain location=247-494; Score=268.6; E_value=1.3e-77; Accession=PF03727.7; Description =Hexokinase
  Pfam module annotation: Pfam domain module=Clat_adaptor_s::Hexokinase_ 1::Hexokinase_2; Domain location=486-626::40-245::247-494
  Subcellular localization annotation: CTP_CleavageSite=27; ConfidenceScore=5.48e-01
MSVTVAADTTSAAVGSCLSRSRRRCLTVALRSKVSVTPTRILTKLKHECATPLPLLQQVANNMSSDMRAGLAAEAGPGPGLPMIPSYVENLPTGNEKGLFYALDLGGTNFRVLRVQLGGKDERVIATEFDQVSIPHQLMFATSQELFDFIASGLAKFASKEDGRFHISPGKKGEIGFTFSFPVKQASIDSGILIKWTKGFAVSGTAGRDVVACLNEAMERQGIDMRVSALVNDTVATLAGAEYWDNDVVVAVILGTGTNACYVEQISAIPKLQGHVSSSGKMIISTEWGAFSNGLPLTKIDREMDAASINPGEQIFEKTISGMYLGEIVRRVLLEMAEEGGLFGKSVPQKLSTPFILGTPDLCAMQQDSSGDLHAVGSLLYDKAGVESNLSERKTVLEVCETIVKRGGSLAGAGIVGILQKMEEDQRGLVFGNGKRSVVAIDGGLYENYPQYRAYLQDSVTELLGTEKSNNVVIEHTKDGSGIGAALLAASNSMQGKTRLAKYYVPLEDSEKHKVEYEVHRLVVNRDPKYTNFVEFRTHKIIYRRYAGLFFSLCVDITDNELAYLECIHLFVEILDHFFSNVCELDLVFNFHKVYLILDEFILAGELQETSKKAIIERMGELEKLE

SEQ ID NO: 175815 - protein, 55 aa, Glycine max
  Coding DNA Sequence Number=SeqID_84130
MLPLATTGTKTEFTPFHHSATYCMLNMPELLDIIEQEEEVNTLLKLLDEYPWLTF

SEQ ID NO: 175816 - protein, 593 aa, Glycine max
  Coding DNA Sequence Number=SeqID_84131
  Gene Ontology: Mol. function=receptor activity; Cellular component =mitochondrion; Biological process=protein amino acid phosphorylation
  Homolog annotation: Hit_ID=A7NSU5; Match level="QueryCoverage=100%, HitCoverage=98%, E-value=1e-159, Identity=52%"; Hit description =Chromosome chr18 scaffold_1, whole genome shotgun sequence
  Pfam annotation: Domain name=DUF668; Domain location=339-424; Score =142.8; E_value=9.9e-40; Accession=PF05003.3; Description=Protein of unknown function (DUF668)
MGSVCSAGKAEKNKNKEVEGKALGKKLKKLKSIAKGKEDSYSISRTGRKQKKLNSGLSGEFKLSTPSRKEGKESSQRGSFWGRAGERAVEVLDTLGSGVPKLSNSNGFGSGMAPRGNKISILAFEVANTINKGAILFQSVSEENIQFLKKEILQSEGVQQLVSTDTKELIGLVEADKREEFNVFSREVVRFGNICKDPQWHNLERYFSRLHLDILDNRQPRVEAEMTMQELTTLAQNTAELYHELTSLERFEQDYQHKLKEMESLNLPLNGDSLTAFQIEIKHQRKLVRSLKKKSLWSRNLVEIVEKLVEIVTHIDQAILEFLGDHGATAVKHCNGSERLGEAGLSLHYANIINQINMIASRPTVLPPNIRDTLYHGLPNNIKSALPSRMQSIDAMKELSITQVKAEMDKTLQWLNPFATNTTKAHQGFGWVGEWANTCNEFGENMARESNLIRLQTLYYAEKQKMDFYIIELLTHLHYLVTFVRYRHNTMRPMPTRTSPRRLDFQSNMLQFISLDSINKPLGSKLSQEDKRLLEEVTMRKRSPGVSKSENLEVTKKRSAKVWHHSNSVGSSPVTREGLEHQRSNVLDIIDGL

SEQ ID NO: 175817 - protein, 151 aa, Glycine max
  Coding DNA Sequence Number=SeqID_84132
MEHKFHQSKIVAKAVAFSIKQQFGQAWPTWGAIPKLEELGRSVYVDEVFHQTHLRKDTGQFVDDRSRQTHEEFEARLSQASSDAASSVSESQLTLLDLIEEQRLKSQCWVAVVGPKHKGHLCGTGDLAYTYKCGGNDSFMQHTQGSTKALS

SEQ ID NO: 175818 - protein, 43 aa, Glycine max
  Coding DNA Sequence Number=SeqID_84133
MKIQGHMELHYDECVESDQGVSTNPKRRKVSKKEAQSFKNLWI

SEQ ID NO: 175819 - protein, 122 aa, Glycine max
  Coding DNA Sequence Number=SeqID_84134
MMMEAIMSMRKMMKVNIVTTIAASTATKRDSIHPSGFNQESCLVSDVSKSSFLSYGFHPNYTSPTVVHAPDENIDNSTPLFIENQQPQPDHTHAHVSQPMGETHEAPQDHTLTSFRVYMGYT

SEQ ID NO: 175820 - protein, 174 aa, Glycine max
  Coding DNA Sequence Number=SeqID_84135
MDQLKRLSIPSEMLRFSNHASYPRLGHPTRKISMQQGQADILIGRFPDPNYGVKMGFILYRNREPSWKILLRSKGSSRCGVATENNDSLWWLMVVVGDGESAWDIRNGFGRKKEEEMVFFLSYTKAKAENAQVRNGLGHGNFPYTPDISQRSQRSDRGQMSCEAADTISRRDNG

SEQ ID NO: 175821 - protein, 116 aa, Glycine max
  Coding DNA Sequence Number=SeqID_84136
MWTIGLSAPGGLVAKDHSRVALRVRFKVDGDADASAGGGGGGGEAGGVAMMHALLGSFNSGNWSDSKVLAEKNSHSWVFRANPIEYVYRWAETTNQATVRRFCRGKDKTEDPGRSN

SEQ ID NO: 175822 - protein, 62 aa, Glycine max
  Coding DNA Sequence Number=SeqID_84137
MMTKAMTKSSKFNQRTTQNNSRVQDKNQEEFKTQEESLESTIKIQGSRSQESRSRFKNQEKA

SEQ ID NO: 175823 - protein, 105 aa, Glycine max
  Coding DNA Sequence Number=SeqID_84138
MYTTTITHIRLQCSRHWQMVVILPKENVVVWFFSLHNRPNNYLKGIINSALKGLDDTPQPKSKAGARWIVIKLTFNLISKFHYVFSVIDKKEALSVAITSCTGCP

SEQ ID NO: 175824 - protein, 129 aa, Glycine max
  Coding DNA Sequence Number=SeqID_84139
MWCYEWKKSEALRVERLNLDSVLGRIDGDPVLRETRIWATWEYVSSVGGGQQGMGETSCFYSLTTEWYLEICRGGQETLGTRAPGSQQIKGTKTTKQGGLCGGWPVGCNRLPGLKRGQEARTASGDRYQ

SEQ ID NO: 175825 - protein, 121 aa, Glycine max
  Coding DNA Sequence Number=SeqID_84140
MNWVLLIEDIMLKSHRLVGYEFPHVVLVLRFIYYFNVDVSNEIVDFTKTFSEITERHLKKLGMRFVDHEWIMVGEPVAGNIDRMEEDAEAEAPQEPAHQWSPFESLMIKKMDDMLHLYEEH

SEQ ID NO: 175826 - protein, 165 aa, Glycine max
  Coding DNA Sequence Number=SeqID_84141
  Gene Ontology: Mol. function=nucleic acid binding
  Homolog annotation: Hit_ID=A5CA23; Match level="QueryCoverage=69%, HitCoverage=42%, E-value=8e-12, Identity=36%"; Hit description =Putative uncharacterized protein
MQDNASTSSDSSSEEEVSNVSLMADSMDDSSTIEEIEMITNLCKLFENLKKDHCEERMKLQTMLSYLKDIFRKMNKGKSDLSHLLNVQKHTIDKIDLGYNKQTTFSKKTKFASSKKLDNGYSMHMMGDKSRLTDFVSKEGGYVTFGDNNKGRIMGEGNIGNQHKT

SEQ ID NO: 175827 - protein, 122 aa, Glycine max
  Coding DNA Sequence Number=SeqID_84142
MASNIINNRDNGGTTLEISSMEIKLEEPLAQFMQVSTSNKKSTESTIKNLEVQVGQLAKQLADRSSSSFTANTEKNPKKECKAVMTRSRMTIQGDDSEARKKMEEHKQQLALKPALEPVSDL

SEQ ID NO: 175828 - protein, 67 aa, Glycine max
  Coding DNA Sequence Number=SeqID_84143
ETLVNVAMSASQFGGECAYCNSLAVEESEYAFMDVVESDSLEIGSTNVDSDSFEMELDMDDEMTTLS

SEQ ID NO: 175829 - protein, 27 aa, Glycine max
  Coding DNA Sequence Number=SeqID_84144
MDKSLKVGEDEWREKERKSKKFCALNE

SEQ ID NO: 175830 - protein, 140 aa, Glycine max
  Coding DNA Sequence Number=SeqID_84145
  Gene Ontology: Mol. function=helicase activity
  Homolog annotation: Hit_ID=A2Q378; Match level="QueryCoverage=57%, HitCoverage=5%, E-value=6e-18, Identity=49%"; Hit description =Putative uncharacterized protein
MVHDDNEIVLHANTPNDEIKEYLDCRYISPCESAWRIFGFPIHGRKPSVERLQFHLLGQHSVLYQDHDDIDDMLSNPSISESKFIAWMNTNQVFVEGTMNKPEEVWEKTWHWLSEDIVYSHRRSSNTPGLHIDDSNLMNL

SEQ ID NO: 175831 - protein, 119 aa, Glycine max
  Coding DNA Sequence Number=SeqID_84146
KTTKVRPGFVLNQNREASLEDSTSVEGFLSVWGFNGEQTEEKEMVVFPRLYEKQRLKHSSASARGKGRVPHTPDVILKIATEKFQEYPTVNKGKGALLLRQFQIASLRSFIKRLPREAS

SEQ ID NO: 175832 - protein, 40 aa, Glycine max
  Coding DNA Sequence Number=SeqID_84147
MEVGSGSYWKLEVGNESYWKMKVENGGWKLEGEKLLCIVS

SEQ ID NO: 175833 - protein, 129 aa, Glycine max
  Coding DNA Sequence Number=SeqID_84148
MSHHSSSVNGEGPSHKDPLSRILDELSSLKLWKEKLERKEKGKERAEINQDEREQIKEEERRKILKELRKEKHATYSSHDSCKSLSEELCDYYEERHRSHLRHHSHRREKERKPQEATLTSHTSMGRTM

SEQ ID NO: 175834 - protein, 29 aa, Glycine max
  Coding DNA Sequence Number=SeqID_84149
MVQGLNQGLHHPGLEKFEQLAIHVMGMVG

SEQ ID NO: 175835 - protein, 341 aa, Glycine max
  Coding DNA Sequence Number=SeqID_84150
  Gene Ontology: Mol. function=signal transducer activity; Cellular component=membrane; Biological process=signal transduction
  Homolog annotation: Hit_ID=Q6D251; Match level="QueryCoverage=99%, HitCoverage=73%, E-value=3e-59, Identity=38%"; Hit description =Methyl-accepting chemotaxis protein
  Pfam annotation: Domain name=BRE1; Domain location=220-311; Score= -8.7; E_value=0.069; Accession=PF08647.2; Description=BRE1 E3 ubiquitin ligase
  Pfam annotation: Domain name=HAMP; Domain location=45-115; Score =42.5; E_value=1.5e-09; Accession=PF00672.16; Description=HAMP domain
  Pfam annotation: Domain name=MCPsignal; Domain location=146-307; Score=114.8; E_value=2.6e-31; Accession=PF00015.12; Description =Methyl-accepting chemotaxis protein (MCP) signaling domain
  Pfam module annotation: Pfam domain module=BRE1::HAMP::MCPsignal; Domain location=220-311::45-115::146-307
RQNGIGAAIRQLVTNYQQQLMLNISIGDELRATNLSTFHEVLWTTITGVIATVIIFGLFALFTVLRIRRSLSDVGKVMMRASENLDLTLSADESRRDEVGTMAHSFNQLMRSVASSLSAVRSASHSVGSASVEIAAGNEDLSARTEQQAASLEQTAASMTELSETVRQTADNTRQASQLAANASSLSEKSGIAFQTNILALNAAVEAARAGEHGKGFAVVAGEASDVSSNMQVMNDAIHQVSELMSEIPAAAVEQSQGISQVQQAVNQMDDVTQQNAALVEQASAASQSLQEQAQTLNQLVTRFVLAESGATPVIKPTPASHKAPQPGRLALASDADWQSF

SEQ ID NO: 175836 - protein, 174 aa, Glycine max
  Coding DNA Sequence Number=SeqID_84151
  Homolog annotation: Hit_ID=A0TVD7; Match level="QueryCoverage=60%, HitCoverage=13%, E-value=1e-08, Identity=32%"; Hit description =Putative uncharacterized protein
MSRRRIDVLHAHFRRFRAGGGFKQPAFVVDAANQVAHRIHRFTLGELNDFIQPVGKALQMLQPAPGKRLFQPHIKAGVKQAFVAQIGPLTQLLQRRGADLATRRVYDAQKRAVIFRIGQHAQIGQQIFDFRPREERRAAGDAIRNTVLHQQLFKHARLMVTAINTPRNLCTGFY

SEQ ID NO: 175837 - protein, 164 aa, Glycine max
  Coding DNA Sequence Number=SeqID_84152
MPPTRHPLDPDKSNRALRFPALITGPCQSFGVPVTPSKVIRPLITQAFIEKYCTPRQAQGDAPQAADALPPPHQADPAGSLGMERYLQHLVRQQAANHRGQVQIHECLYQLSLNQFRLEVAWPRDWPEAQAGEAPVGAPGDAEEARMDEEMTDLLGFLGGSGAT

SEQ ID NO: 175838 - protein, 47 aa, Glycine max
  Coding DNA Sequence Number=SeqID_84153
TYQGNPCGVYPDLSSFIGSGVYPDLSSFTGSGVNQKLYSLYQAIRAP

SEQ ID NO: 175839 - protein, 72 aa, Glycine max
  Coding DNA Sequence Number=SeqID_84154
MYNPVATYPSAGGRRGDRRCVFHGRKMRDVATNVYSRKTSEKPEKGVSLAPTYSSIVIRKSDLRSSLKMNVG

SEQ ID NO: 175840 - protein, 72 aa, Glycine max
  Coding DNA Sequence Number=SeqID_84155
MAYGRPYLHMRYLTTLGTFGSGPSMFIPHMAKGKRELRLRRLLGGVCGVSANFWHRLHVFVKSRACALSVGQ

SEQ ID NO: 175841 - protein, 183 aa, Glycine max
  Coding DNA Sequence Number=SeqID_84156
MAPRKLASKRSRKDKAAEGTSSAPEYDSHRFRSAVHQQRFEAIKGWSFLRERRVQLRDDEYTDFQEEIGRRRWVPLVTPMAKFDPEIVLEFYANAWPTEEGVHDMRSWVRGQWIPFDADAIGQLLGYPLVLEEGQECEYGQRRNRILPGTAAGRQCESCAPNMTTLTSDMDDFAAQQHPAHRS

SEQ ID NO: 175842 - protein, 209 aa, Glycine max
  Coding DNA Sequence Number=SeqID_84157
  Homolog annotation: Hit_ID=Q3BKI1; Match level="QueryCoverage=79%, HitCoverage=71%, E-value=6e-64, Identity=68%"; Hit description =Putative uncharacterized protein
MSAFSLPIPPGCLTTVPSQAYGTLRYHAHTCIHSFGVWLEPRYGFGPPVRVTVPSTCSWLDHLVSGLMHRTERPVQTRFRCAYTYRLKLARYTKSLTHYTKGTVSLPSSGCFSPFPHGTGSLSVMHEYLGLDRGRPMFRQDFTCPALLKDFCYSTCTGLSPTSVEFSNSFHFIHKSHWPGPRSLATTSGVSFDVLSSGYLDVSVPQVRF

SEQ ID NO: 175843 - protein, 97 aa, Glycine max
  Coding DNA Sequence Number=SeqID_84158
  Gene Ontology: Mol. function=nucleic acid binding
  Homolog annotation: Hit_ID=A5AY93; Match level="QueryCoverage=95%, HitCoverage=18%, E-value=4e-11, Identity=38%"; Hit description =Putative uncharacterized protein
MTIEESIHVTFDETNITSLRKEFLDDIANSLEDTQNEEKNLKRKRDEENEDVQDDIVQENDDLPKEWKTSRNHPLDNIIGDISKAVTTRHSLKDLCK

SEQ ID NO: 175844 - protein, 156 aa, Glycine max
  Coding DNA Sequence Number=SeqID_84159
  Homolog annotation: Hit_ID=Q3SKR4; Match level="QueryCoverage=83%, HitCoverage=92%, E-value=2e-23, Identity=46%"; Hit description =Putative uncharacterized protein precursor
MKSIAYRAKGFMLPVAIFLLVTLAALVGYAMRLSMLAQMGTIQDVQGANAYLASRAGVEWAAFQVLAPGSNAMQSCPASPTTLTINSFSVVVTCSQNVSKDKGNTQDIGIYTITSTASVGTAATQDYIERQIKVTLSRCLYLDPSAPVGTAAEECN

SEQ ID NO: 175845 - protein, 50 aa, Glycine max
  Coding DNA Sequence Number=SeqID_84160
MTVRALASRPRAKCEISALSTTGVFSQAQRTIGAKLESGAKRNIANLEPI

SEQ ID NO: 175846 - protein, 127 aa, Glycine max
  Coding DNA Sequence Number=SeqID_84161
  Subcellular localization annotation: CTP_CleavageSite=53; ConfidenceScore=5.46e-01
MNESLMRHTSKFHFSPSFIPSISCSPLLSFFSSIEASSPSFLSKDHLGGEAPSSMAYSLMDGTSSHLYSFVFRCISMDCISHQLSQPMGGQHEAHRCVFQGRKAHGVATNVYSRKTSEKPEHVVYEL

SEQ ID NO: 175847 - protein, 169 aa, Glycine max
  Coding DNA Sequence Number=SeqID_84162
  Homolog annotation: Hit_ID=UPI00006A2D9E; Match level="QueryCoverage =60%, HitCoverage=81%, E-value=7e-09, Identity=18%"; Hit description =UPI00006A2D9E related cluster
IHALTFRGLHVLTFRGLHALAIRGLHVHTFRGLHALAFRGLHILTFRGLHALTFRGLHILTFRGLHALAFRGLHALAFKGRYVLNFRGLHTLAFRGLCVLTFRASNFLLSVPGPPPDLGGGPTMQVQPEEEAHAHQHDHSYTDMDDGSHPQRHPVDPEKSNRALGFLAL

SEQ ID NO: 175848 - protein, 114 aa, Glycine max
  Coding DNA Sequence Number=SeqID_84163
MTTVKGRCSIRRTITRLVDKTFNQGQITLTPHKHQKRNSVSYPNFVRGPSVVGMRPSFDHFEGVQIATGPTWAFQEVLQKAGSNLARLGELGGKIFNRSSSFFIRSLSFFGIKP

SEQ ID NO: 175849 - protein, 127 aa, Glycine max
  Coding DNA Sequence Number=SeqID_84164
MRDKDIEFIHIISIVTVVYSNSINLKILMSHWRHLTTTFKLLQASYIVSLNDIKIHERFSSSNLSQPASIRFAPYVSGSYNAQWNAPKLLYDKHMLHSSYILEKMEVEDSLLGLWLPLHYWVDMGES

SEQ ID NO: 175850 - protein, 96 aa, Glycine max
  Coding DNA Sequence Number=SeqID_84165
MTNKRNDEGSDPREPAKPHPTADGITQVMSMDEGSLVQALAVYQASLDDKFDVDPSDDASDRGAKPIEELIKLQLEHKPDNVRSSVGTSPAMSTNA

SEQ ID NO: 175851 - protein, 66 aa, Glycine max
  Coding DNA Sequence Number=SeqID_84166
MKIGAPLLLGYCTKSYGIGQLYDDECSSSQMANDFRIQQIHYQGKDQTQVFHSSYQTMHLPGKVLT

SEQ ID NO: 175852 - protein, 444 aa, Glycine max
  Coding DNA Sequence Number=SeqID_84167
  Homolog annotation: Hit_ID=Q7G508; Match level="QueryCoverage=9%, HitCoverage=6%, E-value=8e-07, Identity=62%"; Hit description =Retrotransposon protein, putative, Ty1-copia subclass
MAPNRIKTATILGINNKEEAKNTFLADSFILGRWELRNIMKQASEAPSIEKKVIISLATIVVASRCVEEGLAFDKDLEKRITYKALDIMLYGGPCPVTNNKKVNLPKVIFYYWMQAFKDKFNPKHIEKKVKKEPNEEPQSVVEEHMLKLDEDAKLVSLAGNVSAEIPDDDILESLKTLSVEEQRKSPEKATMMEIDGKPMPKVVVLEFLLPHSTIEQLSTDDEKLVESTQSEETDADRLRRLEEVCGAMEYVSMEDMVDSLEPLPPPPQITPIDPSVNVRFILAIKVIESWCGKLAIEFGKRNMILGLTLFIQRCNKWSLTSLILQSSLKEGFLGIDSFKYPSWDTFLEEEEYAIGVYGERELVLKQFPIRLIIAPNPNSLIFKYRPTAMKVYPLGPTIFVFVGYPNGTKGYYFYNTYEEKVSITRIGVFLEKQYISHGANGGM

SEQ ID NO: 175853 - protein, 125 aa, Glycine max
  Coding DNA Sequence Number=SeqID_84168
  Subcellular localization annotation: CTP_CleavageSite=38; ConfidenceScore=5.31e-01
GIPPTVCPSVAYPRQGSKSARLWWGISCVIARRAQLAQASKVASSRSNSLLEESSRGPKWACFRRSYRNSRFAQKYFFSISATLRNFTERKMMTKVMTKSSKVNQRMSSRFKRKVEEHFKIQEES

SEQ ID NO: 175854 - protein, 77 aa, Glycine max
  Coding DNA Sequence Number=SeqID_84169
MGSNQAHAFKKRGGARADEGRHGGHERVDDHNVEALMSIGRMMEVNTTTVVAASTATEVDPTHPPGFNQVNHLASHM

SEQ ID NO: 175855 - protein, 51 aa, Glycine max
  Coding DNA Sequence Number=SeqID_84170
MATIALLSRYGRWCLASDVQQAGFMVNLEATFVDDLVFLAGRVVGNEMDRY

SEQ ID NO: 175856 - protein, 99 aa, Glycine max
  Coding DNA Sequence Number=SeqID_84171
  Gene Ontology: Mol. function=dihydrodipicolinate reductase activity; Cellular component=chloroplast stroma; Biological process=lysine biosynthetic process via diaminopimelate
  Homolog annotation: Hit_ID=A5BWJ3; Match level="QueryCoverage=76%, HitCoverage=29%, E-value=1e-22, Identity=65%"; Hit description =Putative uncharacterized protein
  Pfam annotation: Domain name=DapB_N; Domain location=21-99; Score= -39.5; E_value=0.1; Accession=PF01113.11; Description=Dihydrodipicolin ate reductase, N-terminus
MEWDESHSGTCWCSGNAYILMHVVINGATKEMGKAAVVAVTKACRMEVAGAICGMEEILQIPIINGLTMILGSISQFQAVGIVVDFTNPSFVYDNVKQV

SEQ ID NO: 175857 - protein, 134 aa, Glycine max
  Coding DNA Sequence Number=SeqID_84172
  Subcellular localization annotation: CTP_CleavageSite=44; ConfidenceScore=5.35e-01
MLCAIGPCSIVGGSMLRVTWISPRSRFLLSNPNSVRHKAQRSLRVLMVVEAKLHDESTMIQRTSQENQDQDQDSRIKNSRLKKKAYKQVSRFKIQDLKNQRSRFKNQESRLKISRIKIKIKDSRFENEEKTQSR

SEQ ID NO: 175858 - protein, 136 aa, Glycine max
  Coding DNA Sequence Number=SeqID_84173
MIMRGQDIYSSQDKATTLPSSSECEEAKGAESSEEIYPQEEGLPLVVKEKCKEVSVSSKRVFGCGETEKELSLTRKPSCGAFDEILRGCEEASLLWRAKSSVGSSYGVLDYSILVCLYLDHALACLVRVTQYWEMV

SEQ ID NO: 175859 - protein, 57 aa, Glycine max
  Coding DNA Sequence Number=SeqID_84174
ENDRSPPAQVVAAQIRTLLYKHEGCTGLSTNHLDVILTSSVGPECVELISFVQRAIS

SEQ ID NO: 175860 - protein, 96 aa, Glycine max
  Coding DNA Sequence Number=SeqID_84175
MIRATYASWMKNNVSTGEGDLSLLNDHLEETLGSTKIEENHSKCINLTRGKVYGKLGFWLKACRMARHDICQGLGLASGSGIKGMSHIISMTHTQQ

SEQ ID NO: 175861 - protein, 78 aa, Glycine max
  Coding DNA Sequence Number=SeqID_84176
MAVKHFYLSEKNGYDFDDVKRRIKQGSFASRLIQDCFNKQSLASRLTQDQALPLKQSAFKTFKALVIDYPKTGLRNSC

SEQ ID NO: 175862 - protein, 57 aa, Glycine max
  Coding DNA Sequence Number=SeqID_84177
VPLLQKKIFTFKPDAILPRRGPITRAMTRRLQEDWVGNAGEGPMVLMSLRVDFGPMG

SEQ ID NO: 175863 - protein, 144 aa, Glycine max
  Coding DNA Sequence Number=SeqID_84178
MALDASKFNFERLDILRDSIGHPSSTFNFERLDILRDSIRHPSKKLLSLNWLIGSTFNFERLDILQDSIRHPSKKLLLFELAQRFNIQFRASRYITGLNQNIRVKSYCRFELAQRFNIQFRASRYIWDSIRHPSKKLLSFEYGS

SEQ ID NO: 175864 - protein, 351 aa, Glycine max
  Coding DNA Sequence Number=SeqID_84179
  Gene Ontology: Mol. function=hydrolase activity, acting on glycosyl bonds; Cellular component=outer membrane; Biological process =metabolic process
  Homolog annotation: Hit_ID=Q9CM43; Match level="QueryCoverage=63%, HitCoverage=20%, E-value=6e-15, Identity=26%"; Hit description =Putative uncharacterized protein PM1000
  Pfam annotation: Domain name=Autotransporter; Domain location=81-335; Score=31.6; E_value=2.8e-06; Accession=PF03797.10; Description =Autotransporter beta-domain
DNREPYLPEPEPEPQPEPEPQPEPEPENPQVPQPEPKPEPGKVRAAVIPQVPTYISLPAAFHSVTHNLQALFSSSAQQAGAEGRPDLFVSGYTGDDRYHSAGGFMDYGYDFHSRYQGWMIGSRFPLQSALALSVGVNKGNLSITPEARDGNSHARVDTLGASALLSWQPDQGLQLAVPAGVMQYRGSVSTDLRGNVTQLKARGANLGLDSGWRWQSGAHALTPVAGVNAQWLDINDFTDSDGAQVSYRNPLQWQLSGGVKYDFRLNEKLKLGAETHYVQRISQRDRVAIGDGQQAAHFATGRGGNSLQYSGYAGWQVLDNLELNTQLQGQQRLTQEGISDWNLQAGVKISF

SEQ ID NO: 175865 - protein, 149 aa, Glycine max
  Coding DNA Sequence Number=SeqID_84180
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=34%, HitCoverage=50%, E-value=4e-24, Identity=100%"; Hit description=LacZ protein
MVQRLNVSLLSKTKRSLMEICEIPGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 175866 - protein, 61 aa, Glycine max
  Coding DNA Sequence Number=SeqID_84181
MKIRGGDGGTASSSGKKGGFTTGDCGLAGSELTCTVTDKGVGVDDEGMSSILALFLDSICN

SEQ ID NO: 175867 - protein, 97 aa, Glycine max
  Coding DNA Sequence Number=SeqID_84182
MTGHGSPLDFLFPTYRYIGMDASGARVTTDRSLPLPGAKQAENVAARQPSSSGKMLTHKEGGDMVNVPLKKNGRLARLGEQPLHPNYKNEGGERFCI

SEQ ID NO: 175868 - protein, 296 aa, Glycine max
  Coding DNA Sequence Number=SeqID_84183
  Homolog annotation: Hit_ID=A4PP05; Match level="QueryCoverage=66%, HitCoverage=55%, E-value=6e-15, Identity=29%"; Hit description=IMP dehydrogenase/GMP reductase, putative
MDDAIQMLVDLLMISTEAARAETGQCRGSYVRLQWALRDLSQIERYTWGVAALVHMYDHLNDASISISRQLDSYITLLQCWIYEHFPSIVESTANPDYNEDSPRACRWIATKKTVKSICTLAYRERLDRLWIPDICWIPYGEHRLTIPTPPVDSWVSYDDIHDKWMHYSDHMATAGEVCAMPGQCASDYIDWFFRISHHFMTPGQASDPLPDGHAPQPRVIPQVPELDIPHVSKPGSPSTSARPAADEPRHAVEVCYGIAERLECHLSLGVVTPGSSTHEVIEECLRWPGVSHRTS

SEQ ID NO: 175869 - protein, 107 aa, Glycine max
  Coding DNA Sequence Number=SeqID_84184
MSLNSSVYFVKMASRKRKSIGARPTAQYDTRQFHSLDAWNCYTDNVLGRNILPERKVEIYHMEFDDFKTELERRNLHKRLTYLADGTIDLALVKEFYVNLYSSEGIL

SEQ ID NO: 175870 - protein, 99 aa, Glycine max
  Coding DNA Sequence Number=SeqID_84185
MTRGNLGDLQPFDPEIDRTFHRLVRHSVHPDHSVHFEHSEYFVASDSEYFDFEHSTTNFHTENMAQPPPHERNLREMVAPDFTYESLCIQYPDEGLPFI

SEQ ID NO: 175871 - protein, 253 aa, Glycine max
  Coding DNA Sequence Number=SeqID_84186
KGHALRRPYRTRARARVMGEVEEIQEKMKADMEAIKEKMATMMEAMMSVKKIMEANAVAIAATSVVAKVNPMSPSGLKQMNHPTSNMVGKDLGSTGGPHDVQIQNEHAFPSYGLPLNYTPPNVAYTPNKNVNNSTPIPLKASNPKLIMHMSLKLITHNCTSCIPQRLKTLMTMAGMGKLDHLEERLRAIEGGEDYAFANLEELFLIPKHGHSQVQGAGLWQVQGTTRSKNHLKMYCRKMGAYAKDEKLLIHFS

SEQ ID NO: 175872 - protein, 97 aa, Glycine max
  Coding DNA Sequence Number=SeqID_84187
MEALKIFKWSLFFTPMSDSGASHIEMLKIEQLKLSKYSNGLDFSHGGVSHIETLEIYQRKLSRNGSSRDIQMVITFHTEVRQAQGGRMQAHNITRRS

SEQ ID NO: 175873 - protein, 69 aa, Glycine max
  Coding DNA Sequence Number=SeqID_84188
MKAQVEKDEGPEAETLSRLLIVAEGPSNPCGVYPDLSSFTGSGVYHDLSSFTGSGVIQTFVACIKRSAP

SEQ ID NO: 175874 - protein, 285 aa, Glycine max
  Coding DNA Sequence Number=SeqID_84189
MLHVITLRGLHTLIFRGLHVLAFRGIHVLDCRGLHALTFIGQHILAFRGLHVLTFRGLHVFPFRGLHALAFRGLHRTTHPRLYKATRPPHQRAMRPRLRRATRSHLERTTRPRLQRATHPRLQRTTCPRLHRATRHHLLRTTRPLLERATLPRLQRTTPLPLQRSKGYTSSPSGTTRPHLQRTTCPCLQRTTRPRLQRTTRPRHQRATLHVLAFRGLHVLIFRETHVLAFKGLRILLFRGLHVVAFRGLHVLIFRGLHVLTFRKLHALTFIGPQSLAFRGLHVLT

SEQ ID NO: 175875 - protein, 182 aa, Glycine max
  Coding DNA Sequence Number=SeqID_84190
  Homolog annotation: Hit_ID=A6FJQ2; Match level="QueryCoverage=20%, HitCoverage=84%, E-value=4e-11, Identity=92%"; Hit description=50S ribosomal protein L5
MRKEKIPHQAPFAIQAAQLLGRAIGAGLFAITPAGERGMCCKAIKLGNARVFPVTTFAPSSVLAKRKRDDNAGALGHKKSRALLSLRALRQAVGFTPGLGHPLSLQDVRPTPVVVEAPASTVVATVTPAPPPPLVVPVQEVTLVAGVDVLGYRARIRNHGHSCFLCEIVIRSQFHTTYEPEA

SEQ ID NO: 175876 - protein, 262 aa, Glycine max
  Coding DNA Sequence Number=SeqID_84191
WVQFCQTRRHPSWEDVRKKAQAIQKQNTTPHVLSHGGYDYLEQKLLAKKTKKKLEEAAQSGSVDGVIDPPSPVRRYVKWKMARTKKTGEMTTEAAKEIADKIVSHTESFVPHGHQDVLVAAIGRPEHPGRVCAAKVGVTIKQYFGSAPRTSHSASSLPLDELQQLTQQIRDQLKESIIEKVTSQMQSQGLAVPPKPLIGPFDPRVSIKGSCVDPSGNDPETGDSDRCGLYIEANPARLVAMGRVYEGSTVVHNTPLLPGQVK

SEQ ID NO: 175877 - protein, 183 aa, Glycine max
  Coding DNA Sequence Number=SeqID_84192
MGEAEEVQEKMKADMEAMKEKMATMMEAMMSMKTIMEANAVIVAATSVVAKVNPMLPSGLKQINHPTSNMAHISQTMGETHEIPHHDLVDFEPWLGYATEGQAVGGISFENTLEDPQCHPQPQPSHATAVKNPHATAEMGKRKGSGPLKEVLDFDKYKGTTCPKNHPKMYCRKIRAYAKMRNC

SEQ ID NO: 175878 - protein, 90 aa, Glycine max
  Coding DNA Sequence Number=SeqID_84193
  Homolog annotation: Hit_ID=Q5XM22; Match level="QueryCoverage=85%, HitCoverage=43%, E-value=2e-22, Identity=62%"; Hit description =Resistance-like protein HAAS-2
MELLEVSGEEARAETVRAHGAYLRLSWLREVYQSRCHARRWIVVARAYLLHLAGCTLFSNKSATNVHVVHLEGFRDLGQTGVYAWGAAAL

SEQ ID NO: 175879 - protein, 68 aa, Glycine max
  Coding DNA Sequence Number=SeqID_84194
  Homolog annotation: Hit_ID=Q2HW89; Match level="QueryCoverage=85%, HitCoverage=5%, E-value=6e-08, Identity=51%"; Hit description =Integrase, catalytic region; Ribonuclease H
MVLLQCVDAREDEQILVEFHEGSFGTHANEHAMARKILRVGGQMSYRMSRHHASEHADCMCPYEQIKQ

SEQ ID NO: 175880 - protein, 480 aa, Glycine max
  Coding DNA Sequence Number=SeqID_84195
  Homolog annotation: Hit_ID=Q2HW90; Match level="QueryCoverage=57%, HitCoverage=70%, E-value=1e-18, Identity=28%"; Hit description =Putative uncharacterized protein
DPQVNVKGLDVTSLKELGRLMAPLQRQAFRKVYGKILDLTVAEVFTEAVVSLAQYYDQPLSKRVGSHEANSEWNSGPATEILGRQGKGYGEPREVGPFADILALLIFGVVLFPNVDGLIDLVAIDAFLAYHHSKESPVVAILENLFDTFDRRHPCPLQSYRSCAEKGRVDWDQHLAGIGGSAINWFPRWKEGMEGVLLSCGDYPNVPLIGTRGCINYNPALAIRQLGYPMRGAPTEESLSPFLVTGLGAQSLKAIQRVHKAWISPLKKDKELRGIRNGVIGGYHGWLRIHTRGLDWLSKLKVIEEENFEAPEEDEEVQALKLELGKARLAKEKFKSATTHIRKECTEIQEENAATARALEQETKRARKEEYGREKFRGALWGSNNELKLRREERDWSRVHGMILKEELVACARSKRSLAQHLEATEQSMLAIIGQYKEELNQSVAHEQKLVEDFAQVYAEKEARGRVIDALHQEATMWMD

SEQ ID NO: 175881 - protein, 271 aa, Glycine max
  Coding DNA Sequence Number=SeqID_84196
  Gene Ontology: Mol. function=hydrolase activity
  Homolog annotation: Hit_ID=A7PMP1; Match level="QueryCoverage=88%, HitCoverage=86%, E-value=2e-99, Identity=70%"; Hit description =Chromosome chr14 scaffold_21, whole genome shotgun sequence
  Pfam annotation: Domain name=DUF1637; Domain location=30-268; Score =437.3; E_value=2.1e-128; Accession=PF07847.3; Description=Protein of unknown function (DUF1637)
MGIERTLADRKRKRLFNSRRNRRRQRKKPPVQKLFETCKVVFASAGTGFVPPHEDIDELQSVLDGIKPEDVGLRPDMPYFRTSATQRVPRITYLHIYECEKFSMGIFCLPPSGVIPLHNHPGMTVFSKLLFGTMHIKSYDWVVDLPPESPTTIKPSENQGPEMRLAKVKVDADFTAPCNPSILYPEDGGNLHCFTAVTACAVLDVLGPPYSDAEGRHCTYYHNFPFSNFSADGLSIPEEEKNAYEWLQEREELEDLEVNGKMYNGPKIVES

SEQ ID NO: 175882 - protein, 481 aa, Glycine max
  Coding DNA Sequence Number=SeqID_84197
  Gene Ontology: Mol. function=actin binding; Biological process =culmination during sorocarp development
  Homolog annotation: Hit_ID=A7PMN9; Match level="QueryCoverage=95%, HitCoverage=51%, E-value=0.0, Identity=73%"; Hit description =Chromosome chr14 scaffold_21, whole genome shotgun sequence
  Subcellular localization annotation: CTP_CleavageSite=59; ConfidenceScore=5.46e-01
NQVHLYLLNLPPDSSNSNSNPNSKPYAYTYSPGDSSAAVTKCSGTFFTSSHRFFWIDLRAGPVDYGPSISGDGVIPRGEFHPLAALHGRPKSNKAFAADLASLVWSAYHVFLAPSLRIPVPFENSLVIQFVHVHSENEKDLAGLDWKSIEKSFRFEGKSNGLLLGDQSLSFRKYEIRYSECSICSFAISRSINSYTSRFLFDNYTLIVSEYLDSKRLHQILSDSGDELRKLAGVPEEDFGRVVPVYVFDLDYTSLLLLDRYHQSVAFKDMVIAVRTRNTQTTRQLERPIVGSILQSMWGVSPTHLNWSPQHNETLVDYTWSMGQTPFGPFSEMLSLSFVQKDAARRNVLLTSLNYSITSAIDVLQSVETHGGAKSLLKQKQHVEFVQRWNLFKYKLNKAVSALSHLDFDMALFYLRSSDHDLYAIHSIVYHASQEIEASLVCFRDPPFPWGSVSISVSAFLAVSYIYARRDKLFRNKRKQF

SEQ ID NO: 175883 - protein, 398 aa, Glycine max
  Coding DNA Sequence Number=SeqID_84198
  Gene Ontology: Mol. function=DNA binding; Cellular component =chromosome; Biological process=regulation of transcription, DNA -dependent
  Homolog annotation: Hit_ID=A7PMN7; Match level="QueryCoverage=92%, HitCoverage=58%, E-value=1e-177, Identity=82%"; Hit description =Chromosome chr14 scaffold_21, whole genome shotgun sequence
  Pfam annotation: Domain name=Rtt106; Domain location=232-373; Score =172.5; E_value=1.1e-48; Accession=PF08512.3; Description=Histone chaperone Rttp106-like
  Pfam annotation: Domain name=SSrecog; Domain location=102-307; Score =423.4; E_value=3.2e-124; Accession=PF03531.5; Description=Structure -specific recognition protein
  Pfam module annotation: Pfam domain module=Rtt106::SSrecog; Domain location=232-373::102-307
MLAFMVGSKQAFEVSLADVSQTQLQGKNDVILEFHVDDTTGANEKDSLMEISFHIPNSNTQFVGDENRPPAQVFRDKIMSMADVGAGGEDAVVTFEENLHWFFLSFLLQGQANDFKIQYSSVVRLFLLPKSNQPHTFVIISLDPPIRKGQTLYPHIVMQFETDYVVQSELAMNEDLYNTKYKDKLELSYKGLIHEVFTTILHGLSGAKVTKPGKFRSCQDGYAVKSSLKAEDGILYPLEKSFFFLPKPPTLSLHEEIDYVEFERHAGGGSNMHYFDLLIRLKSEQEHLFRNIQRNEYHNLYEFISSKGLKIMNLGDAQPTVGIKKVLENDDDDAVDPHLERIKNEAGGDESDEEDSDFVADKDDEGSPTDDSGADDSDGSDSGDEKEASDFGLPLLSL

SEQ ID NO: 175884 - protein, 113 aa, Glycine max
  Coding DNA Sequence Number=SeqID_84199
MSAYCSFFETKFSSPIHAPCSNALPPSTTQKKHSDSGGVKEVENEHANPNIVELSNAHDASFTAWSPRALGCCGGEVGYDAAADCGAEKTKDVIKWQHARVWRVGVGGGGNRE

SEQ ID NO: 175885 - protein, 194 aa, Glycine max
  Coding DNA Sequence Number=SeqID_84200
FYAFLQDDAGDKLADVLGDDDEAGDSPGSEGSLHNKVEEVRASFTFVEDLRKVLAPVDEFPMLEYWRPKILFSIAIGIGIPLLLDDARAGYAFFVDVVYERLPSFCSSCKIVGHSFESCKKRAKEVSRKLVDPKGEPRKKQIYVPKNKNKDHKVIQDDVVIRPGPSYTNNPEGHVSPPDLVDVVPQTQPEISDC

SEQ ID NO: 175886 - protein, 78 aa, Glycine max
  Coding DNA Sequence Number=SeqID_84201
MAAQVVPPIMGRELIMLIVDTLPVSYYEKMPGANGENEKEEGTHVLATIPTWPNFPPTQQCHYSADISPPRYPPSNHP

SEQ ID NO: 175887 - protein, 78 aa, Glycine max
  Coding DNA Sequence Number=SeqID_84202
MNYQGVCQFLLLVNMCWIWDEDSRDRANYYRSMGPMKNKKNGPQHQGKPYSTSPKQYDKRGIFREIVHIPRRSKMVGA

SEQ ID NO: 175888 - protein, 84 aa, Glycine max
  Coding DNA Sequence Number=SeqID_84203
MGEHMNASYGNRLHVENSNSKPFSTVISQPCLLVMWDATAFGVFNQDIPLYIKHEDLSEIAQGGQCLNISVIQLWIMHLTKTSM

SEQ ID NO: 175889 - protein, 340 aa, Glycine max
  Coding DNA Sequence Number=SeqID_84204
  Gene Ontology: Mol. function=transporter activity; Cellular component= cell outer membrane; Biological process=nutrient import
  Homolog annotation: Hit_ID=Q79AD2; Match level="QueryCoverage=100%, HitCoverage=37%, E-value=0.0, Identity=94%"; Hit description=HasR protein
  Pfam annotation: Domain name=TonB_dep_Rec; Domain location=90-314; Score=29.0; E_value=1.8e-05; Accession=PF00593.15; Description=TonB dependent receptor
MEGVTPAGNRSVGSLFANLTYDYDGWLTLEGGLRYDRYRLRGQTGLSYPDLAKDGQRYTIDNPCKALRLTGCSTTTREDWDVDRDQGKLSPTLAVAVRPGVEWLELYTTYGKSWRPPAITETLTNGSAHSSSTQYPNPFLQPERSRAWEVGFNVQQPDLWFEGDRLVAKVAYFDTKVDNYINLAIDRNKPGLVQPSIGNAAYVNNLSKTRFRGLEYQLNYDAGVFYADLTYTHMIGKNEFCSNKAWLGGRLRYGDRSRRGNFYVEPDAASNDFVTCDGGTQFGSAAYLPGDRGSVTLGGRAFHRQLDAGVTVRFAPGYHDSSEPSNYPYLVDWPKYTLFD

SEQ ID NO: 175890 - protein, 233 aa, Glycine max
  Coding DNA Sequence Number=SeqID_84205
  Homolog annotation: Hit_ID=Q84VI1; Match level="QueryCoverage=74%, HitCoverage=30%, E-value=9e-51, Identity=57%"; Hit description =Envelope-like protein
KLSASGSPAVPSSPHQEQPEFNIQPIQIIPGQASVPEKLIPRRPQGVKIAENPNPAISPREVDTEMDRKSAKDVPTSSTSNAEVLPSPSEEESTDEEDQSTEETPAPRAPEPAPGDLIDLEEVESDEEPIANKLAPGIAERLQSRKGKTPLKRSGRIKTMAQKKSTPITPTTSRRSKVAIPSKKRKEISSSDSDDDEAAEEEEAAEEEEEVAEEEEDAAEDTESDDDDSEATP

SEQ ID NO: 175891 - protein, 124 aa, Glycine max
  Coding DNA Sequence Number=SeqID_84206
  Subcellular localization annotation: CTP_CleavageSite=55; ConfidenceScore=5.77e-01
MAAKSTKPSTFGKRTTPKINKANISTNGPHFSWLAISLALPSKYFRGRPTTPFRVCFMRSNSFAESPTIAAILLKEGSKPEKRYGFLPLRGHPNISSNSSIDGTIWKSPNVNTSTAGHSIGRGI

SEQ ID NO: 175892 - protein, 315 aa, Glycine max
  Coding DNA Sequence Number=SeqID_84207
  Subcellular localization annotation: CTP_CleavageSite=70; ConfidenceScore=5.07e-01
VDSRGSPHLLRAAHPRLQRIACSHLLRAARPRLQRTTRPRHQRAARPHLLRTTHPCHQRTTCPHLQRTTRPSLQRGCMPSPSKDYKSLPTEGCTPSPSKDYTGLHVLTFRGLHTLTFKGLYVLPLRGLHALAFRGLHVPLCRGLHSLAFRGRNVLDFGGLHALSPLERYASSLLVGSINFLLSALGPPPDPGGGPTMLAQPEEEAITQLLCIPGQDFTRAAAKRRVWIMRTNMTTLTQIWMTLLLSNFLPSDRNADLPLQKDRTRKSPSGPGEVKQGPGVSSSDYGPLSVLQSARRPQQGAPPPPLEFTSAYPQK

SEQ ID NO: 175893 - protein, 31 aa, Glycine max
  Coding DNA Sequence Number=SeqID_84208
IDDRSRSKKEASSDDANRTFPNRHHPIVIKG

SEQ ID NO: 175894 - protein, 251 aa, Glycine max
  Coding DNA Sequence Number=SeqID_84209
  Homolog annotation: Hit_ID=Q6WAY6; Match level="QueryCoverage=96%, HitCoverage=54%, E-value=2e-19, Identity=28%"; Hit description =Putative uncharacterized protein
MGSNQMPSLKKRFYQVKVKSLGTTSLKELGQLMGQLQRQAFRKAYGKIWDLAMVEVSTEAIASLAQYYDQPLRCFTFGDFQLSPMETIPLLRVLSLISKNFQDSSNLSAGIRPQKASRKWGGWNTKKIFGGKSKILVVIDTFLTYHNHKESPVVAMLADLYDTFDQRCEKSKKGGANWDQLLESKEGASVNWFPRWKEGRIGVLISCGGFPNVPLMGMRGCISYNPVLAIRQLGYPMRGAPLEDELVPVIS

SEQ ID NO: 175895 - protein, 256 aa, Glycine max
  Coding DNA Sequence Number=SeqID_84210
  Gene Ontology: Mol. function=tricarboxylate secondary active transmembrane transporter activity; Cellular component=integral to membrane; Biological process=transport
  Homolog annotation: Hit_ID=P16482; Match level="QueryCoverage=86%, HitCoverage=49%, E-value=3e-79, Identity=66%"; Hit description =Citrate-proton symporter
WRWRIRSRWLLIVLLSSFTPQLNETAEYTERKEHPTLGQSLTILLANWRVVIAGMLMVAMTTTAFYLITVYAPTFGKNVLLLSASDSLLVTLLVAISNFIWLPIGGMLSDKFGRKPVLVSMTLLAIFTSWPALSLLARMPDFAMMLSVLLWLSFIYGIYNGAMIPALTEIMPRSVRVAGFSLAYSLATALFGGFTPAMSTALIKVTGDKAAPGYWMSFAAICALLATLGIHLRLCACCRRAGDHGDDFRRLLCGVG

SEQ ID NO: 175896 - protein, 37 aa, Glycine max
  Coding DNA Sequence Number=SeqID_84211
MDIFLHTGPIKLVSEYDKGLVYPKVAYEPTLMALLSQ

SEQ ID NO: 175897 - protein, 78 aa, Glycine max
  Coding DNA Sequence Number=SeqID_84212
MGWRGLDQGPHKQHFSTWWADLKALNQDHNMTAVSKQFCWKMGRGDQILFWEDAWAEDGIPLKDQFPDLYSKMPQQCL

SEQ ID NO: 175898 - protein, 56 aa, Glycine max
  Coding DNA Sequence Number=SeqID_84213
MAVEWRRKRERRCHFKEKMSQEEAHHHRKPWIRAWRYEKKNGGRRRGSTKFCSSKE

SEQ ID NO: 175899 - protein, 58 aa, Glycine max
  Coding DNA Sequence Number=SeqID_84214
MVFHLRLVMGFKTKKGKHRLKGINSRKHQQESSQGYCASNQWVKTHQMIMMMAQILTK

SEQ ID NO: 175900 - protein, 21 aa, Glycine max
  Coding DNA Sequence Number=SeqID_84215
MGYEGTCLEHLAEQKFWFTLG

SEQ ID NO: 175901 - protein, 178 aa, Glycine max
  Coding DNA Sequence Number=SeqID_84216
  Homolog annotation: Hit_ID=Q2HTA0; Match level="QueryCoverage=83%, HitCoverage=23%, E-value=3e-16, Identity=35%"; Hit description=IMP dehydrogenase/GMP reductase, related
  Pfam annotation: Domain name=DUF1723; Domain location=97-146; Score =52.8; E_value=1.2e-12; Accession=PF08330.1; Description=Protein of unknown function (DUF1723)
MALADVEDTRADIPADTGTQAAEDEHEGFLGCPSDPSVLTQYADHVTCSIWMGEERLELKLSSHGRKVHSLGRLVPAIEGLVAGTGLSPLIACSVDTSDRGLLSLFVERWHRETSSFHLPVGELAITLDDVSLLLHVPVVGDLHAFQPLHVDDAVQMLVDLLMVSAEAARAETGQCRG

SEQ ID NO: 175902 - protein, 65 aa, Glycine max
  Coding DNA Sequence Number=SeqID_84217
MSVKNLVGRLGGGQSGSQCFARMLQLCGIDTGLKEHSNQVTPKAYTPKSPSGPLPPNSGPIQKTF

SEQ ID NO: 175903 - protein, 139 aa, Glycine max
  Coding DNA Sequence Number=SeqID_84218
LFEPLDPEDNVSATNRENVEGGGRGGGKLEIFSNPGLNKIVGAPFVDEHCDTGVMDEAKEAKCIRGGVGWEIMGVGGGEVVSGSGSSSSTMSKKKRALHLWLVVGGLGKGEGKGDGEGEGEGEGSRGGGGVGTAGEGGF

SEQ ID NO: 175904 - protein, 67 aa, Glycine max
  Coding DNA Sequence Number=SeqID_84219
MDVPQQLHHIVDITPASLGDMLHANTPIILFTKLLHLRPGAEIAPCGSGITTHFTASGYLPRQVAEG

SEQ ID NO: 175905 - protein, 90 aa, Glycine max
  Coding DNA Sequence Number=SeqID_84220
MKDCPCVFRTCKRNLQDSGTLKRVAWGLDVGTRISEATCLTLPPSVEPVVPPPIFVMKSHPEVLASEAPITIDPMPAPPPLPPKSPPPIP

SEQ ID NO: 175906 - protein, 90 aa, Glycine max
  Coding DNA Sequence Number=SeqID_84221
MDDHHRPCILSQRALLQASEGEAHGCAFQRRKDARSRHQRLFVENVGKNRRKPVKTKILSSGVVFTFEEGRQKLGSCSYVPSIEEEIRPT

SEQ ID NO: 175907 - protein, 159 aa, Glycine max
  Coding DNA Sequence Number=SeqID_84222
MEELINKTQLSPKIIPTSSRRLGGSSTESYFMYPTTVILLPRTSVPLGVGVQRQATVAYDGHRWSWVVENEVLGIGWHFGEEKSEKIVFFTLKTPLYTRAGLTHPWALSATSSLVGIGLSTPLGAQHNFLSVGIALNAPFAKFEDDPTVDEFGIAILLN

SEQ ID NO: 175908 - protein, 155 aa, Glycine max
  Coding DNA Sequence Number=SeqID_84223
MPKEKKDKDKSSIIFYQENIQDKKKFFKTRQKKGLMSTWEDLDGTSLDEDDEKANISLMADTTFEESESDHEDEIILTNHYNTIEVPQTNLEMNTMGRYMFMIRTLSYPNFIRELLLGGMQPLIDRFKVVGTLRCTICEVPRRAGNQKEALLRNP

SEQ ID NO: 175909 - protein, 111 aa, Glycine max
  Coding DNA Sequence Number=SeqID_84224
MSHHSSSVNGEGRHRSHLRPHSHRREKERKPQKANINLPYFHGKDNVEANLVWEIRIEQQLKKKSTSKSYGSHSNSKKDQGQGILGVTPSKPKDDKGKTIEKQAPKASMHE

SEQ ID NO: 175910 - protein, 61 aa, Glycine max
  Coding DNA Sequence Number=SeqID_84225
MQILMMGASIGTPKASAPLSEEEKQKAKKEVMLCSHCSAVFDKSAAKAFKASEIRKNFLKI

SEQ ID NO: 175911 - protein, 175 aa, Glycine max
  Coding DNA Sequence Number=SeqID_84226
MTLLLSNILPSDHNYDLPLPKCMPPTRHPLDPDKSNMALGFPALITGLCQSFGVPVAPSKAPNAPPPPPQADPAGSFDTERYLRHLVRQQAANHRAHVQTHDSLYQLSLSLQSQGFASFPCPTLDQFRAEVAWPEDWPEAQAAEASAEAPGEPDKAREDEEMSDLLGFLGGSGAT

SEQ ID NO: 175912 - protein, 171 aa, Glycine max
  Coding DNA Sequence Number=SeqID_84227
MTTITQIRMTLLLSNILPSDHNSDLPLPKCQLVYTILTQVSVHVTQLISDAIYQFTRIKPPRHSVDSEKSNRALGFPALITGLYQFYGVAVTSTKLIRPPISRAFIEKYCMPRQVQGQAPQQPAADAPPPPLEEPRDEIDFEIRAGPVGAPRDNGGTQEDGDMADVLDLFT

SEQ ID NO: 175913 - protein, 209 aa, Glycine max
  Coding DNA Sequence Number=SeqID_84228
MSILILSILILHILRTWHNLHSVRWSSPQQQQQQPAPSFQNAAGPRRPYIPPPIQQQQQPQKQPTVEAPPQPSLEELVRQMTMQNMQFQQETRASIQSLTNQMGQLATQLNQQQSQNSDKLPSQAVQNPKNVSAISLRSGKQCQGPQPVAPSSSANEPAKLHSTPAKGDDKNLPNNFCAEAAHSPSSIPSKSSFQQKNGRGRERDLGHV

SEQ ID NO: 175914 - protein, 404 aa, Glycine max
  Coding DNA Sequence Number=SeqID_84229
EELKKHHWDEKLTNFADSSMDIAIVKEFYANLYDLEDKSPKHVRVRGHLVKFDEDILNTFLKTPVVLEEGENLCTYSRFALLRPDPQELAARLCIPGRGFELNADGLPLKILRKNLTTLAQSWSVLSFSNMVPTSHISDITLDRARLIYGIIQKMDMNLGYIISAQISMIAQHDSSRLGFLALITALCKARGVISDSLTLESLSSTINVDYVKKNYWNLDDLSVTFRGPRKAKGKRSEAPVSSEISSSSAPAPIPSVPFGVVHHHAEPAGLRLAIHHEHGGEPAFEEPAVAAAEGEDELTPPEPFYFDAGIHMAQEEDASIDKIPEPSPTPIPDDATPSAPTPELEQPISQDSPAAQPLEENEHVIGSMTENVSQFVRLIVKECINRILAVFDGDSHLAKKDDH

SEQ ID NO: 175915 - protein, 154 aa, Glycine max
  Coding DNA Sequence Number=SeqID_84230
  Gene Ontology: Mol. function=cysteine-type peptidase activity; Biological process=proteolysis
  Homolog annotation: Hit_ID=Q6L477; Match level="QueryCoverage=80%, HitCoverage=19%, E-value=1e-11, Identity=27%"; Hit description =Putative uncharacterized protein OSJNBa0009L15.8
RPVRHVDLATGKADGPHRKKLRTYLGIVACDKVDITYENWKEVPTAQKDLIWEDIQAEFDIPEASDSRTKRKLLQMLGERWRQFKLDLKSKWALAADQDGVEDTVCEKYGIIKEKWAQFCQTHRDPSWEDVHKKAQAIQKQNTAPPPCFVSWGL

SEQ ID NO: 175916 - protein, 251 aa, Glycine max
  Coding DNA Sequence Number=SeqID_84231
  Homolog annotation: Hit_ID=A5BQD7; Match level="QueryCoverage=57%, HitCoverage=15%, E-value=2e-08, Identity=28%"; Hit description =Putative uncharacterized protein
  Pfam annotation: Domain name=zf-CCHC; Domain location=16-33; Score =24.6; E_value=0.00028; Accession=PF00098.14; Description=Zinc knuckle
KFSKPSKKIESKNNTFTCFACGKQGHIKYECPIYLRKQLAEKKRNKDRKQKRTYIAWEDNASTSSSSSSEEEVANVSLMKDSIDESSTIEETKVTSKFKEVLEAFNEMLEEAQRLAIMNNKLRSNLKLHITKLASTQSELDKLRQENQKLVSSYKATRCVYASTSLNMDDYKSLQIEFEKFKKNRYVERMKLQTKLSYLKDMFRKMNKGNSSLSHMLSVHKHTTDKTVLGYNKQTTFSKKTKFASSNKGIL

SEQ ID NO: 175917 - protein, 65 aa, Glycine max
  Coding DNA Sequence Number=SeqID_84232
MDKPPTNYLTSSCMRSSLSEFQVIKAFNINIHAPKAAHSKGWDKLWLEVNSLLVLKAFNVITVAP

SEQ ID NO: 175918 - protein, 67 aa, Glycine max
  Coding DNA Sequence Number=SeqID_84233
  Homolog annotation: Hit_ID=A6FJQ2; Match level="QueryCoverage=56%, HitCoverage=84%, E-value=3e-11, Identity=92%"; Hit description=50S ribosomal protein L5
MQLLRRSQLSMRKEKIPHQAPFAIQAAQLLGRAIGAGLFAITPAGERGMCCKAIKLGNARVFPVTTL

SEQ ID NO: 175919 - protein, 96 aa, Glycine max
  Coding DNA Sequence Number=SeqID_84234
MGSQAINEDIELNWLAEHVGGSLPNKMGIWIFIREPMKEIALNQLEEKMWIRDIGSLNFGPGYACEILGCRGTRVVIQGDPPWPVFFHDVFFKVGM

SEQ ID NO: 175920 - protein, 189 aa, Glycine max
  Coding DNA Sequence Number=SeqID_84235
ASEPVDTQRLTSSSAPLSSRDGKSDDIDGKSDDMRRYLLVIHTFCQLEASEPVDTHRLTSSSAPLLSKDDKSDDMQRYLMVIRTFCQLEASEPVDMQRLTSSSAPLSSRDDNEPVDMQRLTSSSAPFPEMSTSSGRDCEKFSFLPSDSRDQCGHLHPSQRCQRLPAETAKKSHFCHQTQVSGSMQRRPI

SEQ ID NO: 175921 - protein, 99 aa, Glycine max
  Coding DNA Sequence Number=SeqID_84236
MGGALTLLDVPSGGNRAVKESKHLLGGWLRIFSLSMVIALDGWSSPASALDRASIYIKYLQGRTNRGFSICGVKIKSDGSTDKEAGSGICVGAGGITGI

SEQ ID NO: 175922 - protein, 121 aa, Glycine max
  Coding DNA Sequence Number=SeqID_84237
MPISACRCIGWDHAHKTPSGPEEVQQGPGGSRLQDTQWTRRSPAGSWSCQALITGLCQFYGVPVTSSKGIRPPTNRAFIKKYCVPRQAQGKIPKQPGDGRQRATDAPPTPLEFTSAHPQKG

SEQ ID NO: 175923 - protein, 230 aa, Glycine max
  Coding DNA Sequence Number=SeqID_84238
  Homolog annotation: Hit_ID=A5B5G7; Match level="QueryCoverage=90%, HitCoverage=14%, E-value=9e-08, Identity=24%"; Hit description =Putative uncharacterized protein
MASRKRKSTTSRPTAQYDSRRFQSLEAWNRYTDNILSRNIIPERNVKIYHTEFDEFKVELERRNLHKRLSNLQDGSIDVALVKEFYANLYRPEEPTPKQVRVRGHLIKIDADNLNEFLQTLVVLEEGKSLPTYSRFCRLRINHQEIETSLCIPRKGFILNAEGQPWKLLKKDLTTLAQTWSVFSYSNLAPTSHTSNLNMDRARLVYGLVSNMNMNTVALISELEELPLTV

SEQ ID NO: 175924 - protein, 72 aa, Glycine max
  Coding DNA Sequence Number=SeqID_84239
MEQEEKRFVYRIRCSSDENNKEEEIEEGISVPESRNVVDSDSKNPFRFFNGAGTRCNQLQYLVIDYTLLNCL

SEQ ID NO: 175925 - protein, 79 aa, Glycine max
  Coding DNA Sequence Number=SeqID_84240
MSERIVIIKKGKIMEAMTSKIILMMPKNQELSKFQRIRLQESSLKESRFKNNSVLRFKIQEQSRSRFKIQDSREEIEKQ

SEQ ID NO: 175926 - protein, 66 aa, Glycine max
  Coding DNA Sequence Number=SeqID_84241
MGTQHRTFDHQLSPFAKRKPRTKCICCHALSGESLALKLIWSAKLAKAELSPFQCYLNLAKRWPAR

SEQ ID NO: 175927 - protein, 102 aa, Glycine max
  Coding DNA Sequence Number=SeqID_84242
  Homolog annotation: Hit_ID=A7PHV0; Match level="QueryCoverage=73%, HitCoverage=31%, E-value=4e-07, Identity=35%"; Hit description =Chromosome chr13 scaffold_17, whole genome shotgun sequence
FARAWILRFMGGVLFVDKSINKVSLRQMCSATDYKTKSIGGMCILLQMWACERCPTLAPKRTPSQVVNKPLGHRWLRRGNQHIGNDDVRVFRRKLDIMKRHE

SEQ ID NO: 175928 - protein, 154 aa, Glycine max
  Coding DNA Sequence Number=SeqID_84243
STLEDPPPEEVRGASASAALTAVQEVQRQTADLSVVRAALADELNAHPPSAADSDRDTGAASAHTVEPARTVEPPESTSTPAGVSDVVEPPAVVEPPDAVEPPDVVEPPDPAEPAVVRPRTHPIVLPTVDVAELGVADRLGLSDGDDEEVGPTS

SEQ ID NO: 175929 - protein, 72 aa, Glycine max
  Coding DNA Sequence Number=SeqID_84244
MEATMVEKKKRKSNVEGRKESHKGEKKLDLFGCRNPSSVCMLPLWFQFLAFLCTRRGPFSKVGNIYISKCSE

SEQ ID NO: 175930 - protein, 103 aa, Glycine max
  Coding DNA Sequence Number=SeqID_84245
  Gene Ontology: Mol. function=helicase activity
  Homolog annotation: Hit_ID=Q2A9E0; Match level="QueryCoverage=73%, HitCoverage=5%, E-value=1e-09, Identity=39%"; Hit description =Putative uncharacterized protein
MAHKFCFEALDQSLRDIIKDKSSSDKIFGESNIHATDRGETTAFAQWILDFGDWIVGPQNDGYATVEIPQDLLITEYDDPIHSIVNSTFPDLRQHYTSPEYFQ

SEQ ID NO: 175931 - protein, 109 aa, Glycine max
  Coding DNA Sequence Number=SeqID_84246
MVILFQSDVRFRRKIYRHARIEHRKLSKNSNGHNFSLECSIQALNISRRSKLKNGSSQEIQMVITFHTEVHHISARLKLNNRSSREIQMVKNFHTEVQFRRITYRDARN

SEQ ID NO: 175932 - protein, 72 aa, Glycine max
  Coding DNA Sequence Number=SeqID_84247
MDEFIELMKERNSETLGCLSAHLAVAMTNFARCFQIIIVTRALWSDMGVRPETDTLTPKFVSPQISRLGLPR

SEQ ID NO: 175933 - protein, 146 aa, Glycine max
  Coding DNA Sequence Number=SeqID_84248
MQLPQEPLNKKPRGLARKSMVVTNFVELCGAATRLYETETNILAIVSKYQEELNLATAHEHKVADEYAQVYVENEARGRVIDALHQEATMWMDRFALTLNGSQELPRLLAKAKAMADTYSTPEEIHGLLSYCQHMIDLMAHIIRNR

SEQ ID NO: 175934 - protein, 45 aa, Glycine max
  Coding DNA Sequence Number=SeqID_84249
MEMLKVREQESDSSQQIEEDWRRHRSDTKNIFYNSETTTVDQELP

SEQ ID NO: 175935 - protein, 38 aa, Glycine max
  Coding DNA Sequence Number=SeqID_84250
HTHGIDEFAPPEAPGDGEEAHEDEEMADLLDFLGGSGD

SEQ ID NO: 175936 - protein, 80 aa, Glycine max
  Coding DNA Sequence Number=SeqID_84251
MPDIRKQCQRSAPTSKCLGRAVAIYFSTHTSNIHLMIASVVTVVTNEVEAVVSSHWHKQYIHRHRLVELEGGGGGGGSPL

SEQ ID NO: 175937 - protein, 84 aa, Glycine max
  Coding DNA Sequence Number=SeqID_84252
NKLGIGSTFGRPPVLGYLVSPTGIERVLTEKDLLVDSYSDLEASILEEKEFILLKNKRCGLMMQSYPARALGRRLQVDWARDPR

SEQ ID NO: 175938 - protein, 104 aa, Glycine max
  Coding DNA Sequence Number=SeqID_84253
  Homolog annotation: Hit_ID=A6FJQ2; Match level="QueryCoverage=36%, HitCoverage=84%, E-value=2e-10, Identity=89%"; Hit description=50S ribosomal protein L5
MRKEKIPHQASFAIQAAQLLGRAIGAGLFAITPAGERGMCCKAIKLGNARILNMDSFEVNVDENDNGSIDVDVHENVIHEDEPIESKMSKKRARNYSSHVWNFF

SEQ ID NO: 175939 - protein, 97 aa, Glycine max
  Coding DNA Sequence Number=SeqID_84254
MVYGWSDKNFTLLLKVVQRILPEENMFLTSLYKSIRKFMHALMIAYYTEMSLKKYINALGEGYHSSNSRMMKIVAVMKAQRKALNEGVMVSFFHSKV

SEQ ID NO: 175940 - protein, 295 aa, Glycine max
  Coding DNA Sequence Number=SeqID_84255
  Gene Ontology: Mol. function=DNA binding; Cellular component=nucleus; Biological process=regulation of transcription
  Homolog annotation: Hit_ID=A7Q7B9; Match level="QueryCoverage=41%, HitCoverage=77%, E-value=4e-50, Identity=60%"; Hit description =Chromosome chr18 scaffold_59, whole genome shotgun sequence
  Subcellular localization annotation: CTP_CleavageSite=63; ConfidenceScore=5.80e-01
MEIQKMNNGHSVVTATVTATATPTPTTTFVAAATAITTTPSSLSSLSSSRWPKTEVHALIRLRTSLETKYQENGPKAPLWEDISAGMLRLGYNRSAKRCKEKWENINKYFKKVKESNKQRREDSKTCPYFNELEALYKEKSKTQNPFGASFHNMKPHEMMEPLMVQPEQQWRPPSQYEQGAAKENNNNERKEREEEEEDEEEEEEEEEDENEEGDLESVEDEGGHDDGTNTGTIKFNSLIMNDPSKSMVVQKQKQKQKHKIIGAVGHIPAAMNWDQRSLINTKKQQFTWASKAEA

SEQ ID NO: 175941 - protein, 68 aa, Glycine max
  Coding DNA Sequence Number=SeqID_84256
MEKSLAITRIHSASGGHRQRSLIGAMNYPSHDSSTDGDWVGTRQLSHFDLIIATLLPKMSFPIYSECL

SEQ ID NO: 175942 - protein, 394 aa, Glycine max
  Coding DNA Sequence Number=SeqID_84257
  Gene Ontology: Mol. function=protein dimerization activity; Cellular component=nucleus; Biological process=regulation of transcription, DNA-dependent
  Homolog annotation: Hit_ID=A7Q7A7; Match level="QueryCoverage=43%, HitCoverage=54%, E-value=7e-33, Identity=54%"; Hit description =Chromosome chr18 scaffold_59, whole genome shotgun sequence
  Pfam annotation: Domain name=bZIP_1; Domain location=162-219; Score =53.3; E_value=8.5e-13; Accession=PF00170.12; Description=bZIP transcription factor
  Pfam annotation: Domain name=bZIP_2; Domain location=162-215; Score =33.8; E_value=6.3e-07; Accession=PF07716.6; Description=Basic region leucine zipper
  Pfam module annotation: Pfam domain module=bZIP_1::bZIP_2; Domain location=162-219::162-215
MASSNSRKSETSPSPAPQFTTTNFIPIPAAAAPKTVDDVWQEIVTGDRRECKEEALDDDDDDDNEMMTLEDFLAKADAVDDADHDHDHAHDHDPDYHNDDVKMPMPLTERLGSGTLFSFDHLPTTPFHDPSEGSVIGFGNGVEVIECGRGKRSRPVLEQLDKAAQQRQRRMIKNRESAARSRERKQAYQVELESLAVKLEEENDKLLKEKSLNLSFPISIVSTHATVLVFIASMLAFGMFLRPFWVAKNPHFLLNVPKTGDAERKKKRYKQGTGYLLVATDRIVIGVVGRAADAGILGSGAVAGTTRHVGLPGATRRAGQAFPSMRFPGHDANQDASGKGVGQRACTQGATRSACRPSATRGALPLARPIPVSAALTPRPTMQRVSFMWNTPLG

SEQ ID NO: 175943 - protein, 224 aa, Glycine max
  Coding DNA Sequence Number=SeqID_84258
  Homolog annotation: Hit_ID=A7Q7A8; Match level="QueryCoverage=82%, HitCoverage=89%, E-value=7e-48, Identity=52%"; Hit description =Chromosome chr18 scaffold_59, whole genome shotgun sequence
MHFPILFLFLLPSLFKFSYSATILVDGSSEWKNPTVSIGDSIIFKHKQHYNLYIFKNEKAFKLCNITQATLLTNPYTWHPSRPGFFYFTFHNGSLKACQDSQKLAIEVTSSAMAPEVSPAPSSGGEVPSSPSFPWPFHPGQEASSPGPAPQAQAQASSPVTIPLVPDKGGGMPFINSNPAVPLPTGEVDSATIRPLPITSGHQGQEIADKNANVDTLTVIMWLQ

SEQ ID NO: 175944 - protein, 104 aa, Glycine max
  Coding DNA Sequence Number=SeqID_84259
MVLWRGKNRSLGEGAKTLLNETKLPEYFWANAVFRIKIMLLKMKPELKCLNKAKKSLPCLLKTSLENGELKKTSPWTTLLEKYPREFLLTLDSGFYANNMGLVS

SEQ ID NO: 175945 - protein, 342 aa, Glycine max
  Coding DNA Sequence Number=SeqID_84260
  Homolog annotation: Hit_ID=Q6WAY6; Match level="QueryCoverage=36%, HitCoverage=21%, E-value=4e-12, Identity=32%"; Hit description =Putative uncharacterized protein
RRIDWDQLLAGIGGRTISWFPRWKEGKEGVLFSCGRYPNIPLVGTRGCINYNPALAIRQLGYPMRGASTEESMSPFLVRDFGAQNSKTIQRIHKAWETPLKKDQELRGIRNGIIGGYHEWLKVHIRGLDWLAKLKVVSEESFEAPEEDEEVQALKSELGKAKLAKEKFKLPLHTFGRSVPGYGKRMRLPQEPLNKRPRGLARKSMAGMNFAELYGELIACSKSKRSLSQCLCETETNMLAIIAKYQEELGLATAHEHRIADEYAQVYAEKEARGRVIDSLHQEATMWMDQFALTLNGSQELPRLLAKAKAMADTYSALEEIHGLLGYCQHMIDLMAHIIRNR

SEQ ID NO: 175946 - protein, 84 aa, Glycine max
  Coding DNA Sequence Number=SeqID_84261
MTISSWQNKLNRVFYVQDPSDEKWCVVLHGKTIGVNVEDDHSYMDNYVSPLSTQMTPNIIGEKEVDDVHANRNDHDEGELITIV

SEQ ID NO: 175947 - protein, 180 aa, Glycine max
  Coding DNA Sequence Number=SeqID_84262
DPTADHPAFIEKYCTPRQAQGDAPQAADVASLNNDWVDSLSKSDPEIVLEFYANAWPTEEGVRDMRQFLGDPLMLEEGQECEFSQRRNRADGFDEEAISQLLCTPGQDFARTAAGRRVRIMRTSRTTLTQMLMTLLLNNVLPSDHNSDLPLPKCQLVYAILTRMSVHVAQLIADAIYLFA

SEQ ID NO: 175948 - protein, 130 aa, Glycine max
  Coding DNA Sequence Number=SeqID_84263
  Homolog annotation: Hit_ID=UPI0000ECBAF8; Match level="QueryCoverage =31%, HitCoverage=48%, E-value=1e-16, Identity=100%"; Hit description= UPI0000ECBAF8 related cluster
MTILSHGLSLFQEGKSSGNLKTNESNKENAGEDITGAKNEVKCDNQAPENKSETEKSIPVTKKDGENPTPAKASRPAGMQAWHWPSFYNVVTGKTLALPNLIALQHIPLSPAGVIAKRPAPIALPNSCAA

SEQ ID NO: 175949 - protein, 60 aa, Glycine max
  Coding DNA Sequence Number=SeqID_84264
MSHGPRRMRRKDIKKEDPRRRILLGMTMTHLMVRRRRLTFYPWTMKVMKTSLKKFNYFLS

SEQ ID NO: 175950 - protein, 63 aa, Glycine max
  Coding DNA Sequence Number=SeqID_84265
  Homolog annotation: Hit_ID=A6FJQ2; Match level="QueryCoverage=60%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARVFPGVVGNGRRPK

SEQ ID NO: 175951 - protein, 417 aa, Glycine max
  Coding DNA Sequence Number=SeqID_84266
MAVFVVNLLEVVDIQNNQRRRTALQRLADALNNRAAIPHRPPAPAGLTAHSRGSARVRRGRCARSAARFRASGADSGDSGAAAPRGNPVRSACFVLPRPINLQIGKIQRQFLTKLFRDVIFRIKQPVQRDALTALRQLVEQIEQAEQHFGAGAIEVAQRDSDDHRVIVGGLPLLKGIQQRAIKRRRVLRPRLAAQRKLAGGKIKTHFGRALSGSDNQVLHTTSILVNGGFKPKRGVAAGGQRTQFILQRFTDITGKRQQTDIGPFAGGGALGAQTDTVGLLNFVVTHGTQQIEPVAQLLAGGLFDLITALQHIAIAIHVQCYGAKAIVLFGMAQGTAVLRIAQNVLHNLDKAGEQPAAHFQRGLLVFQKHFDHFTHRGDVLRRKEAGIVQRNAVGRQVRAGGSWMHKRLVNNAGQTR

SEQ ID NO: 175952 - protein, 90 aa, Glycine max
  Coding DNA Sequence Number=SeqID_84267
MFFYGPSQIFVTTFNTPPSAYNLPPSTSYYRPSLPTQMHDIGHENEEDDDDGDDDDDNGGDHVLQQQHTIIREHPRTRGGRDRRPIGQQT

SEQ ID NO: 175953 - protein, 101 aa, Glycine max
  Coding DNA Sequence Number=SeqID_84268
MKAIFDCDSHLAKKLTIEKGGANRNQAHSGLLEGSKRRRCLLVEATLLAWASWAATTSLFSPINRGKRAEQKGSALLVLRNLSKLVRKIVFVEKIQAEVFP

SEQ ID NO: 175954 - protein, 233 aa, Glycine max
  Coding DNA Sequence Number=SeqID_84269
  Subcellular localization annotation: CTP_CleavageSite=41; ConfidenceScore=5.38e-01
MAELSKKRKGSSSTAAAAAHRRHGPSGEPTTPIHPSLSSPRSSTLFSSDDQHLRILLPRSSNLAQASEEDLILMWAFLTGRQIDWAHLVRYRMHKALRANAPLPYPHLITLFLRHFQIPLDDEPFVQVKRSFAIGAGAVTSFGYRKDRNGQWLKKDALPLQDERTPSPPPQREDSALMNEVLSELRGLRLYVGDRFDSLDSRFAGMDIRLTQLEEDVGYIRQSFDLPPPPPSS

SEQ ID NO: 175955 - protein, 33 aa, Glycine max
  Coding DNA Sequence Number=SeqID_84270
MGPILPEPQRPFVGEKKLMDEKTKKKLEEAAQS

SEQ ID NO: 175956 - protein, 214 aa, Glycine max
  Coding DNA Sequence Number=SeqID_84271
RGIVMLDFEIRAHFLHHLVIQIGTIFGNDLPRESVPTNQLPLDESNHYTPCDIGVGSRFDPFGEIIYCHENEAMTVRSLGFDGPYDVYPPHGKRPRGGHDIQRMWRSIDIVRERLTFMAFPYMDAEITFHGEPVITCSQDFPSHSMPVGYAPAHEEIGRQSPQCPFIVVGSPLWVSFAFNETCQKSKGSIVMQSMKFRNVPEIKRKYCYAIREF

SEQ ID NO: 175957 - protein, 336 aa, Glycine max
  Coding DNA Sequence Number=SeqID_84272
  Homolog annotation: Hit_ID=Q6WAY4; Match level="QueryCoverage=90%, HitCoverage=76%, E-value=1e-14, Identity=24%"; Hit description =Putative uncharacterized protein
MGSSQMPSLERTFYQVKVKSLGTTSLKELGQLMGQLQRQAFRKAYGKIWDLAMVEVSTEAIASLAQYYDQPMRCFTFRDFQLSPMVEEFEEILGWPLGKKVENRVVGIPRKSLEAKARILASKGEWALFIDILALLIFGGVLFPNVDGAVPGLSAVLPVFMYGWFHTFFAKREGASVNWFPRWKEGRTGVLISCGGFPNVPLIGTRGFNKTNVETLQKVRKAWEVLQKKDKELRGSNNGPIGGYLKWLKAHVQGLDWLPSLRTAKREEVEAPKEDEEVQALRAELKQAQTETKRARREEHGRNKFRLWGSNSKLKLQREERDQSRVDSLILKDELK

SEQ ID NO: 175958 - protein, 120 aa, Glycine max
  Coding DNA Sequence Number=SeqID_84273
  Subcellular localization annotation: CTP_CleavageSite=5; ConfidenceScore=5.07e-01
MSLPSAVHVSSTFESGAPRMSLPSTVRQFSILHFFSNPHECHCLALFMHPPPKEFGAMLYDCLRVDPLVQSSILHFFSEPRECHCLALFMCPPPSSLEPRECHCLALFANSPFSTLIRSP

SEQ ID NO: 175959 - protein, 51 aa, Glycine max
  Coding DNA Sequence Number=SeqID_84274
MSLCSLAFQDYLPDSGMEQEVFILCRYWQKQALGCLVNSLFSEKRRGFRPF

SEQ ID NO: 175960 - protein, 73 aa, Glycine max
  Coding DNA Sequence Number=SeqID_84275
  Homolog annotation: Hit_ID=A7P1M4; Match level="QueryCoverage=50%, HitCoverage=4%, E-value=5e-07, Identity=70%"; Hit description =Chromosome chr19 scaffold_4, whole genome shotgun sequence
  Subcellular localization annotation: CTP_CleavageSite=36; ConfidenceScore=5.08e-01
MDSFSGVVLKWKFLSGVDSGIFSFSKTAIDLVQRIRIGNVKVRKGSPLVTCLLEGSRGSGKTALSDTVGIDSN

SEQ ID NO: 175961 - protein, 118 aa, Glycine max
  Coding DNA Sequence Number=SeqID_84276
MENVKTIKAVLRSFELASGLKINFAKSTFGAFGQTDLWKQQAATYLNCQLLELLRDRLPTRKNLQRRQIQLTDSLCPLCRTQQEDASHLFFHCSKVQPIWWETMSCLQVKGAFPLSPQ

SEQ ID NO: 175962 - protein, 98 aa, Glycine max
  Coding DNA Sequence Number=SeqID_84277
  Subcellular localization annotation: CTP_CleavageSite=75; ConfidenceScore=5.20e-01
MSHAVKDSRDKWAPNYEGPFVVKRAFSGARSRIVSGHSQKSRQVNGRNQPRYIGTDASGARVTTDRSLPLPGAKQAENVAAGQLSILCVRSFFYYCLF

SEQ ID NO: 175963 - protein, 61 aa, Glycine max
  Coding DNA Sequence Number=SeqID_84278
MEACLWGSYGGWIFELQLGPLMVIFHHGDVAEDKGEEAASLRSFLKKTSLRSFFEKTSLRS

SEQ ID NO: 175964 - protein, 91 aa, Glycine max
  Coding DNA Sequence Number=SeqID_84279
MWELECQMEAAYPSLFESVFLDIPKICFYSLTVGILKTITFDLPLCEKGALSAIPTEGNCIERPKAALSPFPTERKCVKCPEGPLSESCKL

SEQ ID NO: 175965 - protein, 142 aa, Glycine max
  Coding DNA Sequence Number=SeqID_84280
  Homolog annotation: Hit_ID=Q6WAY6; Match level="QueryCoverage=78%, HitCoverage=19%, E-value=6e-07, Identity=30%"; Hit description =Putative uncharacterized protein
MARVAKLVKISAQELDRVKQNRNGVVGIPRQRLEERAEALVDKGEWTLFIDILALLVFGIVLFPNVDELVDLVAIDAFLAFHHSKESPVIAIVATYHTAEARNGQNQGPRSLSPREKMSGVTTNIYLRKKLEKPKKTKVYVF

SEQ ID NO: 175966 - protein, 108 aa, Glycine max
  Coding DNA Sequence Number=SeqID_84281
MLRNFTDYATMLVFDFQNAVKLYGLRNNACVEGPEGSKQSSRTNRKYSWTKLGYDSFEGRSLELQEPLDLRSNPFQGEGNDAILPPGHWIEDFKMIGSEMQEKALRFS

SEQ ID NO: 175967 - protein, 100 aa, Glycine max
  Coding DNA Sequence Number=SeqID_84282
MDKDQWTYNYVMSQEVHMDYDYDNEEECGVNEPHVDCSNAFNTSQWVRTVVHENRFVVVIMRSDIDTGIKNSLEETLGVGNVIVPSSFVRNQCMEGKVGW

SEQ ID NO: 175968 - protein, 241 aa, Glycine max
  Coding DNA Sequence Number=SeqID_84283
  Gene Ontology: Mol. function=zinc ion binding
  Homolog annotation: Hit_ID=A2Q4S5; Match level="QueryCoverage=63%, HitCoverage=26%, E-value=2e-17, Identity=33%"; Hit description=IMP dehydrogenase/GMP reductase, putative
  Pfam annotation: Domain name=DUF1723; Domain location=156-205; Score =63.3; E_value=8.1e-16; Accession=PF08330.1; Description=Protein of unknown function (DUF1723)
MVRTRGLRRVLGTGRARDLSQDVAEDVPRRRRPTASARRQRVTQMAEDVAEDVPQLAEDVPDASDGSPERTGVVDAAESDGVASDGIAADDEGFPGGPRDPSVLIGFVDHVAHSIWRGQLVSHGRKVDKFWRPAAEIKGMIAATGLDSLIRCSVITTDPRLISAFVERWLRETSSFHLPVGEMTITLDDVSSLLHIPITGALHSFGPLAKNAIVYQKLMPTSSSRSSGTKSLLRMPLFIEN

SEQ ID NO: 175969 - protein, 91 aa, Glycine max
  Coding DNA Sequence Number=SeqID_84284
MEDDARGEEDLDAGRHCCTRGALVAEEEELEGEEALGRGRRRRNRRRKKKAFGRGRKGNCVTSHNCWVHQPFCWVHLAIALQLIRSIHVKA

SEQ ID NO: 175970 - protein, 348 aa, Glycine max
  Coding DNA Sequence Number=SeqID_84285
  Gene Ontology: Mol. function=heat shock protein binding
  Homolog annotation: Hit_ID=A7QBC5; Match level="QueryCoverage=21%, HitCoverage=43%, E-value=2e-17, Identity=62%"; Hit description =Chromosome chr4 scaffold_73, whole genome shotgun sequence
  Pfam annotation: Domain name=DnaJ; Domain location=69-124; Score= -12.1; E_value=0.064; Accession=PF00226.22; Description=DnaJ domain
DFDGHEQIFQATFGNKWYTWSFNNWRSSSSEHSTSGFEWREHSNRTNKWKNESDTEHEDDDSCCEGSSSDRTVLGLPPTGPLKIEDVKNAIRLSALKWHPDKHQGPSQATKERSQDALEKVFGDNDWGVGGFLVVNLELVVGNNGIVVGIGGGESDLDVPEFLGGQAEGELVAAALGDGDPAVAALEAGGLGQGQEDEAQEDEEYLEELVELLLLEVDGTLLLQGPGRLFLSTGAGAGCCFRTLPWMESKVFPCPCPDNNVATFLRPVAFLTGSDLVPGPAAGVFPSRGGHGIGGSMLVVQHLEAGPNDPRWFGGIGGDPAFPGGLPFQVLALKQCNFNEVYITSLVP

SEQ ID NO: 175971 - protein, 86 aa, Glycine max
  Coding DNA Sequence Number=SeqID_84286
MATVQHLVMDNKKKRPIICKTKPDLNKNFKEATKAIEASNQLAWAKDLTSALSKKLAENPSAFNSEESMQRLRKKKEKKKSGVEAL

SEQ ID NO: 175972 - protein, 118 aa, Glycine max
  Coding DNA Sequence Number=SeqID_84287
MALSATSSDYEVPRGGGDIPTPLLNARLALSQSSLTRAKCENGAKCDVEVRKPFLKPGITELKESLKSANTKEQIRVKESSFEILGRFVSFLAIMRFLEVEETSPLLCKKTISLNSSS

SEQ ID NO: 175973 - protein, 189 aa, Glycine max
  Coding DNA Sequence Number=SeqID_84288
MVIYTVYIKDSMSIDLDYFSLQFFNQRQASPLTRRDKYGHLHPFVKDSMSVDRDYFSLHFVNQRQANYYFSLHFINQRQASPYTRKDIYGHLHPFVKDSMSIDRDYFSLDFVNKRQRQASPYTRKDKYCHLQPFVNDSMSIDRDYFSLHFVNKRQARPLTRRDKYGHLHPFVEDLMSVDGDYFSLHFFN

SEQ ID NO: 175974 - protein, 205 aa, Glycine max
  Coding DNA Sequence Number=SeqID_84289
MVIEDSMSVDRDYFGLHFANERQVSPLTRRDKYGNLHPFVKDSMSVDQDNFSLHFVNQRQVISLTRRDKYGHLNPFIEDSMSIDRDYFSLPFVNQGQASPLTRKEQYGHQHPFVKDSMSIDRNYFSLDFVNQRQASPLKHRDKYGHLHPFVEDSMSIHRDYFSLPFVNQRLASPLTRREQYAHLHPFVEYSMTIDRDYFSLHFEN

SEQ ID NO: 175975 - protein, 92 aa, Glycine max
  Coding DNA Sequence Number=SeqID_84290
  Subcellular localization annotation: CTP_CleavageSite=13; ConfidenceScore=5.05e-01
MKPKGHKGSLGVVATYPSAGGRRVTRGMRVPRKEYARSRHQRLFEENVGKTGKDVIYELLSERFGSCIYARGRVFPFAPTYSSICDEEIRPT

SEQ ID NO: 175976 - protein, 220 aa, Glycine max
  Coding DNA Sequence Number=SeqID_84291
MAYHASSTANHNAIQKQEIQCAKVGKLVEEVIQAMSRREENIVEVDSQEESLVNEHDLEEDEEKVQQWKQCLQTRAQQEDNFQVNTCSHQLTIKEERHEDHEGSLILGQPCLSFASCVLDMGKGKLELNVEDQKISFDLIEEIKHPVNGEDWFEAEISEQEMELTASAMVLQTPGEKEFEYVTECLVNEDGGRMLACIEELGDLDDESIGHVMFEELENN

SEQ ID NO: 175977 - protein, 19 aa, Glycine max
  Coding DNA Sequence Number=SeqID_84292
MGVKYLEVIKRRSYPNKQM

SEQ ID NO: 175978 - protein, 69 aa, Glycine max
  Coding DNA Sequence Number=SeqID_84293
EGRLFQISLTPGLCISAVLGEKNCFREENPSQGAFVMLPRRFCEQIREGFPSFFTVLHSFFVHSSFFNG

SEQ ID NO: 175979 - protein, 131 aa, Glycine max
  Coding DNA Sequence Number=SeqID_84294
MGIYEGVMITFAAPDKNWKFDIHFSPPLHAQTCGRPVHSAREYVFTVDVDNRMIVRLYPLVLPLDVVGYVNAGDDYVTVLGVRGRRQFWKLSMHNGLKCFADPWFQFLTKNDLMAGDEVVFYFRPNQLLWE

SEQ ID NO: 175980 - protein, 80 aa, Glycine max
  Coding DNA Sequence Number=SeqID_84295
MEEDVQEVLGADPKYCLMVIPAPAARTRPGCSSRPMTTFTISFAASDAMWPVFFGAGQLPLHVLSDERWRINDDVSAFRN

SEQ ID NO: 175981 - protein, 167 aa, Glycine max
  Coding DNA Sequence Number=SeqID_84296
  Gene Ontology: Mol. function=nucleotide binding; Cellular component =intrinsic to membrane; Biological process=defense response
  Homolog annotation: Hit_ID=Q2YE88; Match level="QueryCoverage=92%, HitCoverage=12%, E-value=1e-78, Identity=94%"; Hit description=NBS -LRR type disease resistance protein Rps1-k-1
MAEDLLKKSSKGRTLEEVGHEYFDDLVSRSFFQRSNTSRSSWPYGKCFVMHDLMHDLATSLGGDFYFRSEELGKETKIKTKTRHLSFTKFNSSVLDNFDVVGRAKFLRTFLSIINFEAAPFNNEEAQCIIVSKLMYLRVLSFHDFQSQDSLPDSIDVTTTVPTSNLK

SEQ ID NO: 175982 - protein, 151 aa, Glycine max
  Coding DNA Sequence Number=SeqID_84297
  Homolog annotation: Hit_ID=A2Q4P8; Match level="QueryCoverage=38%, HitCoverage=25%, E-value=5e-13, Identity=60%"; Hit description=IMP dehydrogenase/GMP reductase, related
  Pfam annotation: Domain name=DUF1723; Domain location=74-123; Score =49.7; E_value=9.9e-12; Accession=PF08330.1; Description=Protein of unknown function (DUF1723)
RVVIVVAKDVEHVDHAADEVHEEPHEPVMDHEHTELKLTSYERKVEKFERLAHEIKGIMVATVLSYLISCSLETGDRGLLFTFAERWHKETSSFHLPIVELTITLDDVASLLHLPITGVFHTFDAIDIEEVVDLLVELLEVSRQEAKDETE

SEQ ID NO: 175983 - protein, 303 aa, Glycine max
  Coding DNA Sequence Number=SeqID_84298
MSRMLVWWKPLARKHCRAACRIRVRQQGSVQPRPKPACAASEELVEQTVERQPSFVGHNAIAAEQRCDPPGVAEVVDQAARGQRQILVAIGHAQPATVNETAETAFGCQQVRQAGVAMADHQILVIGPGGAQFGEHLLRALPQAFVIEVIGVDQARLDPCLCGLQARGQPLVERTARHRQGMQAPQRIGQQLHQVLGRERRRRGQIVARQRTHQQPAPTRFFGSGHHRRCGHAPAPAASAGAYLVAQLTEGVDHFRLQEGIGLPWTMHAGNVRTRNTRSTAVQCARRPALPATPTAAAAAGHQ

SEQ ID NO: 175984 - protein, 78 aa, Glycine max
  Coding DNA Sequence Number=SeqID_84299
MERELITMIVDTLPVSYYEKMVGYTSSSFVDLVLVGERVEVGLRRGKFDCLGLTSKKPGENGENEKEEGTHVLAAIPT

SEQ ID NO: 175985 - protein, 81 aa, Glycine max
  Coding DNA Sequence Number=SeqID_84300
MQICPRCGVSRYKVKDDDERSSDGNSKKGPQRRCCGIFRSFHGLSICLLMEMTQKILHGMQMGETTMECFVIWMIPPNGRT

SEQ ID NO: 175986 - protein, 26 aa, Glycine max
  Coding DNA Sequence Number=SeqID_84301
MAGWGSTATGGCRTGGERIPPARKAG

SEQ ID NO: 175987 - protein, 30 aa, Glycine max
  Coding DNA Sequence Number=SeqID_84302
MKRCVMQSRNMPECHVCVEKVFLTMNVIDR

SEQ ID NO: 175988 - protein, 78 aa, Glycine max
  Coding DNA Sequence Number=SeqID_84303
MDKSLKVEGDEWRERERGGHGIYTSNELWFNQLIQDQVQDFPLYVLRCLEACKTWRTCTKCDYMMWQWGIASKCSPIP

SEQ ID NO: 175989 - protein, 42 aa, Glycine max
  Coding DNA Sequence Number=SeqID_84304
MWQEYEGDQWGPDPRRKRTAKGCPVLTHIPTEMDKDENEREI

SEQ ID NO: 175990 - protein, 76 aa, Glycine max
  Coding DNA Sequence Number=SeqID_84305
  Subcellular localization annotation: CTP_CleavageSite=20; ConfidenceScore=5.28e-01
MASYGVASPLSLPSPFRGHSSSKKQRNPLMKKILGLQAPMELTSGGLLIEFPYGNRKFDEAITILEVSKPCTRIKL

SEQ ID NO: 175991 - protein, 92 aa, Glycine max
  Coding DNA Sequence Number=SeqID_84306
MKWRGRGFIRKRDVAGPPLVDVLDRLPLVVAPGAPPLLVAPGRPPLVVVPDRPPLPPLSYRPVKSRHVSRSGGTHPSEGTHYDEHTSLLGKY

SEQ ID NO: 175992 - protein, 54 aa, Glycine max
  Coding DNA Sequence Number=SeqID_84307
MARHDTCQGLVWLKDKRDAPHYFHDTKCKNDDLEILCKTGHACTYVDTQDDVPK

SEQ ID NO: 175993 - protein, 172 aa, Glycine max
  Coding DNA Sequence Number=SeqID_84308
LVRHPVRQPVPFGAAGDGAAVVLSGGSKLITTGSRAFAENRYSPDLGYGSLFPHLARPIFRRAGAGHDPLAIHAAGDPAAGVPRHGAAAADPGHRAVPGYLAGLRTEPGRLLPHRPRRLGAGKLFEEKDCLMISLKNVSKWYGHFQVLTDCTTEVKKGEVVVVCVFSSASPP

SEQ ID NO: 175994 - protein, 124 aa, Glycine max
  Coding DNA Sequence Number=SeqID_84309
MVASLRTTLGWERILQVSLPENSFSDWRLCSNWSCRRGEGFGQVGAEVTMWASPSFFFPPLAQNLLLLVPAGGCHLCCQVPPPLGVLLKGLMLPLAHILQLGSIGSHVSIVLVPPNEGSNQVLP

SEQ ID NO: 175995 - protein, 198 aa, Glycine max
  Coding DNA Sequence Number=SeqID_84310
MDAHPCQDGVHQLALRHGEVGIMIGGQDVAESNHPYLGQSGQNPAPVYIAAGRWPLIEPIRPVPPLAILAFLALFQHHRISQELADSVGIERDPLTPNPGSHVTHALLCWPSIGIKFKDHFWIKLGHRSNQWCPPPAPYFLLKISILVVPELDAPLPEKRPSLDGFEALLVYNAPKAVTVVLRGGTSSFGRLVLPGPL

SEQ ID NO: 175996 - protein, 131 aa, Glycine max
  Coding DNA Sequence Number=SeqID_84311
MVEFCLTRGICGRCLITIRLDYHEKSGFSISGDTIEHIIFYMHRSPTGDSVPLDLEIEAILRRNRAEKRRKLLQDRTVASIIEEETHFSNSLSPDSPSSRESATQLPKATTMADEQHQRITLEDYSSSSLP

SEQ ID NO: 175997 - protein, 29 aa, Glycine max
  Coding DNA Sequence Number=SeqID_84312
MVTTTKVEFLEWALSTACLALVNYVTKAI

SEQ ID NO: 175998 - protein, 137 aa, Glycine max
  Coding DNA Sequence Number=SeqID_84313
MRIMIVDTLPVFYYEKMVGYTPSSFADLVFAGEMIETNEKTGASEEGENEGEARAVTAIPIQPSFPPTQQCHYSANKPSPYPPPSYPQRQSLNQPQSLSTALPMTNTTFSTNQKHQPRNEFCSKKALEFTPNSGVIC

SEQ ID NO: 175999 - protein, 64 aa, Glycine max
  Coding DNA Sequence Number=SeqID_84314
  Gene Ontology: Mol. function=ATP-dependent helicase activity; Biological process=DNA recombination
  Homolog annotation: Hit_ID=A3AAM2; Match level="QueryCoverage=89%, HitCoverage=5%, E-value=2e-18, Identity=75%"; Hit description =Putative uncharacterized protein
MEVIGSGYQGIQTGEVSMVIGTHSLIADSVEFSALRIAVVDEQHRFGVIQRGRLNSKVVHIFRI

SEQ ID NO: 176000 - protein, 348 aa, Glycine max
  Coding DNA Sequence Number=SeqID_84315
KLSLAISHGQRLEDEHVKVSTLQVEREARERVIESFHEEAVKWIDRIALTLNGSQEIPRLLARANAMADEVQEQMKANMDAMKDQMTSKMEAMLSVRRMMEDNTVTVATTSVAAEADPTHPSDINQTSCPAPDMVGQGGEVLGSTGGPHMVQNKNSYPPYGLPPNYTPPNAVHVPSENANYFVPVEGQQPQLGHAPVTQPMGEAREEPRDHALGEFEPYPTYATEGPEFSGMPQPNATKALQHRPLQPLYFSVGRLPSTMEEREKFDLIEERLRAIEGIGDYPFVDMARLCLVLDIVIPPKDFDKYKGTTCPKNHLKMQYQYNTDMALDRTQLQNMCKKEHESFKEYA

SEQ ID NO: 176001 - protein, 75 aa, Glycine max
  Coding DNA Sequence Number=SeqID_84316
MLSPPKPNSSSLDSPLSGRLLFRQQKNEENMRVELETTKEIREMARIKEEAVKLRALRRCNTKVQPRAFQPANLI

SEQ ID NO: 176002 - protein, 127 aa, Glycine max
  Coding DNA Sequence Number=SeqID_84317
MEMGLSKRKGSPKGRVCLGFYQAYGVASRLTKDEPWVLWTCKDQQAQSLSLTSLVCNHALAYVPLTKRHESIGLTKGGPWILQALWMIDQGVANLGFGHRALAYMPLDVGGTCWRRGDMLLHICHSL

SEQ ID NO: 176003 - protein, 182 aa, Glycine max
  Coding DNA Sequence Number=SeqID_84318
MTQSENSFDSSHSLIQKHSKDFYKVERNLKDRRSLGDWRPLDPTVNIPKYNRERRTEEDTGRQPKNKGDEIQTQVHRATQQRQTKPLSYADAVRKKNITHQRRKDQKQHSHGYENYTSSVYLNIKTKEIKWLEDAWVGRLNNLAMFKRLVEELRWELGMDIAPKYLGDDLVLLPGLTEAEAE

SEQ ID NO: 176004 - protein, 469 aa, Glycine max
  Coding DNA Sequence Number=SeqID_84319
  Gene Ontology: Mol. function=helicase activity; Biological process =viral genome replication
  Homolog annotation: Hit_ID=Q2A9E0; Match level="QueryCoverage=59%, HitCoverage=19%, E-value=1e-61, Identity=44%"; Hit description =Putative uncharacterized protein
MTTVGAKKRTRTSPCDAHLFVDSALPHTQFTPLSESTLSANQTEQHFTEQFETRPKNFVNSRTINASSIQRNLLSKFGKENLTLSNLNSSPSIATHTTTGCRPMQIGTTSQHINSGRYTILNSKLIEHISDDTNDKLDITQGDIVTDYSFDDPATEDVVDTDDDRNLDAPYHNENTSFYIQCAGYKDIGDPILQCKQCKAKMWYDERINKDKQTRNLMFTLCCGDGKIQLPILHDAPQPLRQLLFDTRDSQAKKFQQNIRLYNLMFAFTSPGVKVDTSYNTGRGPPTLRIHGQSHHLIGSLLPMPDNSPKFAQLYIYDIENEVNNRLSQYPIKNNVDEDIIIGIKNMLDTHNRYAQKFRMSRDKLHSSAVCDLKLKLISGRQSDGRLYNLPNATEVATLIIGDEHIVNNRDIIIEKQTSMLQRINELHPAYLPLQYPLLYPHGEDGYRPNILHKDNPHSQVAKRNKVTM

SEQ ID NO: 176005 - protein, 621 aa, Glycine max
  Coding DNA Sequence Number=SeqID_84320
  Homolog annotation: Hit_ID=Q9C8B2; Match level="QueryCoverage=59%, HitCoverage=75%, E-value=7e-12, Identity=20%"; Hit description =Putative uncharacterized protein F10O5.9
MSHKENLICELHTKKGTWKIAVRITDMWRLNKQNGRQSIEMGTKIGATLWQELFLEFEPKLRCGGAYVIQNIKVVDTHSDYKVSTIKYLVYFVKTTSVKEVDRPEIPPNVHAITAFADIILGVAKPDTLVDVVGLIAEVIERKTVNPAYRVTVKLRGNIHAEIIMTVWEEYALQLDDAIEKNHFLQKPLVVMFTFARIKEPKDKFLHNAQIVSFGEIKSLRQDCYYLTVGTVDEVMIDTPGSYDSCPYCTTTFGQLKIGAACHSCQNHVTHTIPRYKLVVKMEQNGEKANFHFWDAVCIKIFGKTADECRQELIASGDEIKMFLACVDQLLSKTWVVRFKYRIQMHQSFVLDFSEQEHHIQSLISTLGLQDEQCISNRSLAIGAASSSQQDYHPTPSLSQSAEYDPGNTAFVTPAKRMSDQQGSSKFDSEEYATYELSTNKHIKVEELVDPPMLFASSMTYQFKAIFHVDRFKRDIGIYECVMITFAAPNKNWKFDIHFSPPLDAQTCGRPPHSVRNYVFTVDVDNLMIARLYPLVLPPDVVSYVNAAHEYITVLGVRGRRHFWKLSIHNGLQCLGQPWFQFLTQNDLMAGDEVVFYYKPNQRVWEVISRKQTTRDEDDSP

SEQ ID NO: 176006 - protein, 62 aa, Glycine max
  Coding DNA Sequence Number=SeqID_84321
MVVEVLEMIQVNLSEVNREVDCHKSLKLVRRISGLASKDQQVAIDVGKLDILLGVVLCHLFN

SEQ ID NO: 176007 - protein, 192 aa, Glycine max
  Coding DNA Sequence Number=SeqID_84322
  Gene Ontology: Mol. function=hydrolase activity; Biological process =pathogenesis
  Homolog annotation: Hit_ID=A5BKT0; Match level="QueryCoverage=100%, HitCoverage=100%, E-value=6e-86, Identity=80%"; Hit description =Putative uncharacterized protein
  Pfam annotation: Domain name=NUDIX; Domain location=8-173; Score =82.6; E_value=1.3e-21; Accession=PF00293.19; Description=NUDIX domain
MEGLPQGYRPNVGVCLINSDDQVFDKDLSLVLAEQFRTNKMIFVASRLNVPGAWQMPQGGIEDGEEPKSAAVRELREETGIVSAEIIAEVQKWLTYDFPPAVKAKVNRLWGGEWHGQAQKWFLMRLTKDDSEVNLANGEAEREFAEWKWADPEEVIEQAVDYKRPTYEEVIRTFKPYFQGSGISAKCKSTKW

SEQ ID NO: 176008 - protein, 285 aa, Glycine max
  Coding DNA Sequence Number=SeqID_84323
  Homolog annotation: Hit_ID=A8GCN8; Match level="QueryCoverage=88%, HitCoverage=60%, E-value=1e-85, Identity=65%"; Hit description=O -antigen polymerase
  Subcellular localization annotation: CTP_CleavageSite=91; ConfidenceScore=5.63e-01
RLTGSWHPSSGLRSVNPVAAFRRVFSLINEYATMLFNSVVFSSIQTPPQQRLFAFTAFLLGVSLPTSNPLMNISLGLVVICILWQRDIRPLVALAGHPLVWLPALMFALLALSLLTHAHAYGPKMVGKYQKLLYVLPLALFFLADPRLMTHFVRGFLWANAVILAISLTSGLGHVTLGGLNPDNPTVFKLQITQNVFMALAALVWLSRAFVCRGKRRWGYAGLVLLATLNVLLMVQGRTGYVALAIGMGVWLLLTLRRKQQMAVLACGILALAMLVMTPNRAMER

SEQ ID NO: 176009 - protein, 45 aa, Glycine max
  Coding DNA Sequence Number=SeqID_84324
MPLQGEDESRTSSPPKEAMDKSLKVREDEWRERERRSTKFYASNE

SEQ ID NO: 176010 - protein, 154 aa, Glycine max
  Coding DNA Sequence Number=SeqID_84325
MAAGPIQAETKFGHFAPLCHLEAAGPMIRGDTLRLFAPFCHPEAAGPMTSRDQVWSFCTLVSSRGGGPDDTRRYLTVIRTLLSSRGGGPDDKQRPKADIVFCTFCSSGNNKSFTCGNFMVARDSRQPRGAKLVSYTDFRGPLLDDMRPFFGPCE

SEQ ID NO: 176011 - protein, 109 aa, Glycine max
  Coding DNA Sequence Number=SeqID_84326
MSRNLTDYTIIPSLASGMLRNFTDCALTRPFNSRHVAELRGLPNDGCQVPRSGQARVSPQQTDDPRTKLGRIMTIICLCVASDMIVSGWQKVRNDHNLSPHVIGLAAFG

SEQ ID NO: 176012 - protein, 50 aa, Glycine max; identical to SEQ ID NO: 127663
  Coding DNA Sequence Number=SeqID_84327

SEQ ID NO: 176013 - protein, 34 aa, Glycine max
  Coding DNA Sequence Number=SeqID_84328
MSEIGRFGGLGMEERRKEEGAAQGFLENEEAAYW

SEQ ID NO: 176014 - protein, 96 aa, Glycine max
  Coding DNA Sequence Number=SeqID_84329
MLKVQNENFKEIRTKVQTNRQIVMLEVWETWSFKEGLPGVQRKEQGWSKMMTLLGGLIREQTSHVCKDRRWFKEFRPIDDGSMFEDDKQVCKVDNP

SEQ ID NO: 176015 - protein, 74 aa, Glycine max
  Coding DNA Sequence Number=SeqID_84330
MRFQMLAFVPKRPFRGNTGPNRIEENHSKCINLTQFSSEGRDYGKLGFWLKVVRMRAHKAYLCQIKKQTEKNAM

SEQ ID NO: 176016 - protein, 189 aa, Glycine max
  Coding DNA Sequence Number=SeqID_84331
  Homolog annotation: Hit_ID=A8GBG5; Match level="QueryCoverage=50%, HitCoverage=26%, E-value=4e-34, Identity=75%"; Hit description =Adenosylhomocysteinase
MTVKTSDTCSSRRRSQLVCKRMPGADKPVRARQRMRKEKIPHQAPFAIQAAQLLGRAIGAGLFAITPAGERGMCCKAIKLGNARVFPVTTLIPILNVGHVAEEIDVGFLQGLPHHEPMPYVNAYQLNEKTVYLLANGSMFNLTAGYGDSLNAFDVTLAVMAAGIGHIVGAGARQTPGLYLLPQSAWQPA

SEQ ID NO: 176017 - protein, 129 aa, Glycine max
  Coding DNA Sequence Number=SeqID_84332
MGAKSLEVVKRGSYPNNGWSLKEIRAQNDHNLSLRVFGHDRAWMARRRMTIICLCVPPDTMASGWQKGVGNGHNLSPRVFGHDQAWVARRRMTIICLCVPPDTIASGWRKGVGNDHNLSPPSSRLIVPE

SEQ ID NO: 176018 - protein, 63 aa, Glycine max
  Coding DNA Sequence Number=SeqID_84333
  Subcellular localization annotation: CTP_CleavageSite=42; ConfidenceScore=5.17e-01
MAGVGRYMAPTDIFQPTLRNFLYKRWPIILKNLQRRTARFFRASSTEGTFRPTLACCSSHLGG

SEQ ID NO: 176019 - protein, 144 aa, Glycine max
  Coding DNA Sequence Number=SeqID_84334
MVCNDQAEKTGRLLAGSLTFDCCIMYYIIVRILLPHSSNLAQASEEDLILMWAFLISRQIDWAHLRSFAIGAGAVTSFGYRKDRDGQWLKKDALPPHDERTPSPPPQQDDSSALMNEVLSELQGLRTYVALKAWIPASPSLKRM

SEQ ID NO: 176020 - protein, 105 aa, Glycine max
  Coding DNA Sequence Number=SeqID_84335
CNVNCGRQLLPWRLMKDVFRETPRKKLSSAVDITTAEECFFCGISRKIKLIDTVDPEYEEDCGVNEVHVDCSDAFNTSQVFATREDVLKWARMVVHENGFVAVII

SEQ ID NO: 176021 - protein, 52 aa, Glycine max
  Coding DNA Sequence Number=SeqID_84336
MDKSLKQENAHLLMQSYPPRTLDKRLQEDWARDAREGPKVLMSLRVYFEPMG

SEQ ID NO: 176022 - protein, 154 aa, Glycine max
  Coding DNA Sequence Number=SeqID_84337
  Gene Ontology: Mol. function=helicase activity; Cellular component =nucleus; Biological process=termination of RNA polymerase II transcription
  Homolog annotation: Hit_ID=A5BNC8; Match level="QueryCoverage=89%, HitCoverage=9%, E-value=4e-66, Identity=87%"; Hit description =Putative uncharacterized protein
MTMITNSSSVPVQKTVKSLGVGKITVGIITPYKLQLKCLQREFDEVLNSEEGKDLYINTVDAFQGQERDVIIMSCVRASSHGVGFVADIRRMNVALTRARRALWVMGNANALLQSEDWAALINDAKSRNCYMDMDSLPKDFLVSKAPSYTSGIL

SEQ ID NO: 176023 - protein, 73 aa, Glycine max
  Coding DNA Sequence Number=SeqID_84338
MTTLVSACYRTLSLTDSERVCAGYRIGRLRMPTDSWVTVTKGGVVDKSEAFAPTYPQFVMRNSDLRSSCFCDV

SEQ ID NO: 176024 - protein, 215 aa, Glycine max
  Coding DNA Sequence Number=SeqID_84339
  Homolog annotation: Hit_ID=UPI00016621D1; Match level="QueryCoverage =96%, HitCoverage=40%, E-value=2e-17, Identity=32%"; Hit description =UPI00016621D1 related cluster
  Subcellular localization annotation: CTP_CleavageSite=45; ConfidenceScore=5.04e-01
FSHKGGPLGTSTLSFRGLHVLTFRGLHVLTFIGLHALTFRGLHALAFRGSCTFTFRGLHILAFKGLHALTFRGLPVLAFKGLHALIFKGLHALTFRGLHVLTFIGLHALTFRGLHALAFRGSCTFTLRGLHVLAFGGLHALVFRGLYVLPLRRLHVLTFGGLHALAFRGLHVPLFRRLHALAFRGRHVLAFGGLRSPSPFEGYASSLSVGSISTP

SEQ ID NO: 176025 - protein, 80 aa, Glycine max
  Coding DNA Sequence Number=SeqID_84340
MMTKVMTKSSKINQRTTQNNSRVQDKNQEEFKTQDESLESRIKIQGSRSQESRSRFKTQDSRNKRRLNHDKYEKFFSKIE

SEQ ID NO: 176026 - protein, 94 aa, Glycine max
  Coding DNA Sequence Number=SeqID_84341
ICSGLFTFTWSPGGIFETSLLAEAGVRLRERFVKESCGAVKGFPLGCQGGRRRPQVEATDALVIQLTPPVRACCHAGAGLSALPTIGFEPMTLA

SEQ ID NO: 176027 - protein, 731 aa, Glycine max
  Coding DNA Sequence Number=SeqID_84342
  Gene Ontology: Mol. function=sequence-specific DNA binding; Cellular component=nucleus; Biological process=regulation of transcription, DNA-dependent
  Homolog annotation: Hit_ID=A7QUM2; Match level="QueryCoverage=99%, HitCoverage=97%, E-value=0.0, Identity=61%"; Hit description =Chromosome chr10 scaffold_179, whole genome shotgun sequence
  Pfam annotation: Domain name=Homeobox; Domain location=48-104; Score =74.6; E_value=3.2e-19; Accession=PF00046.20; Description=Homeobox domain
  Pfam annotation: Domain name=START; Domain location=251-470; Score =199.9; E_value=6.2e-57; Accession=PF01852.10; Description=START domain
  Pfam module annotation: Pfam domain module=Homeobox::START; Domain location=48-104::251-470
MEMSLQRTSSENNSGRNREEQEPSNKETTMEAPASGDDDQDLEEGFKRRRHTRHTHHQISEMESFFKGCPHPDEKQRKALGRELGLEPLQIKFWFQNKRTQVKTQQERYENNLLRVENDKLRAENRRYRNALANALCPSCGGPTALGEMSFDEQQLRIENARLKEEIASMSGPAAKHAGKSGSNSYCNMPSQNQMPSRSLDLGVGNNNKNNNFVAVAQAQPAAMVGEIYGGNDPLRELPLFSCFDKTLIGEIGLVAIEEINRLSLSGDPLWVPGNYGSEVVNEDEYLRVFPRGIGPTLLGARTESSRQTAIVIMHHMKLVEMLMDVNQWSNMFCGIVSRAVTHEVLSTGETIRYDGACQVMSAEFQVPSPLVPTRDNYFIRFCKKHQGQSWAVVDFSMDHLRPGAITKIRRRPSGCIIQELPNGYSKVIWVEHVEVDDSEVHNLYKNLVDSTLAFGAKRWVAAIDRTCERLASAMATNIPQGALCVITSHESRKSMMKLAERMVLSFCTGVGASTANAWTPLPSGLEDVRVMTRKSVDDPGRPPGIVLSAATSLWLPVPARRVFEFLRSENTRNQWDILSTGAQVNELAHIANGRDHGNCVSLLRVNTQNVGQNNMLILQESFIDATGSFVIYAPIDVAAINVVLGGGNPDYVALLPSGFAVLPDGPGLNGGPGPICEAGSGGGCLLTVAFQILVDSAPTSKISVGSVTTVNSLIKRTVEKIRDAVSLDGN

SEQ ID NO: 176028 - protein, 937 aa, Glycine max
  Coding DNA Sequence Number=SeqID_84343
  Gene Ontology: Mol. function=nucleic acid binding; Cellular component= intracellular; Biological process=intracellular protein transport
  Homolog annotation: Hit_ID=A7QUM0; Match level="QueryCoverage=99%, HitCoverage=99%, E-value=0.0, Identity=48%"; Hit description =Chromosome chr10 scaffold_179, whole genome shotgun sequence
  Pfam annotation: Domain name=DUF618; Domain location=115-175; Score =1.2; E_value=0.0054; Accession=PF04818.4; Description=Protein of unknown function, DUF618
MFSQNVILPPENPRPTAFASKPMSNEIAKPLPSILVGRFKALLKQRDDELRVAAGDPVPPASTDEIVQIYELLLSELTCNLKPIITDLTIIAEQQREHAKGIADAICARILEVPVDQKLPSLYLLDSIVKNFGQEYIRYFSLRLPEVFCEAYRQIQPTLHSAMRHLFGTWSKVFPPSVLRKIETELQFSQAVNTQSSTLNPVRASESSRPSHAIHVNPKYLRQLERSTVDSASKTHQFLSSSSSLGISSSSPSRIGVDRPLSASMDEYAVDNSAVRLIERNSPHPAVDYGVAKALGRDVDLTEWQQKQYPGDGRNRFPTSVTYSLSNGHQRQSPRALIDAYGSDKSQETSSSKPLLVERLDRNGIDKVLSTSWQNTEEEEFDWENMSPTLTDHSRNNSLLPSTFGFSRERPGVAANATLSEQDTRKGWSSGSQLPPVDDSSAIAEDAFASSTFRRTPPGQVPGSQNQINHSLGSSQPHDAWKISHHPSNIFSNRGRARNLMIPPMDNIRNTDNNPYWVRPSMSRMEARPSVLPAPFEMRPSVNVNVTRPPIINPINPLQKHVRSQFNAINTSNPIANHVNKSSFMPKQSFDSVENKDASISKIHQLPNQLPGVISSNQQNHGQAPQLQFFPSQDPSTSQFCHGSSLQGHGASISTAMSNPLPVIPFPLPFQSIANNPLHLQGGAHPSLPPGRPPAPSQMIPHPNVGAYMSSQQPTVGYTNLISSLMSQGVISLANQLPAQDSVGTEFNPDILKVRHESAVNALYGDLPRQCTTCGLRFKCQEEHSSHMDWHVTKNRMSKTRKQKPSRKWFVSDRMWLSGAEALGTESAPGFLPTETIEERKDDEELAVPAEEDQNTCALCGEPFDEFYSDEMEEWMYRGAVYLNAPTGTTAGMDRTQLGPIIHAKCRSESNMATSEDLGPDEKGADEEGSQRKRMRS

SEQ ID NO: 176029 - protein, 139 aa, Glycine max
  Coding DNA Sequence Number=SeqID_84344
  Homolog annotation: Hit_ID=A7QUM4; Match level="QueryCoverage=94%, HitCoverage=85%, E-value=3e-24, Identity=46%"; Hit description =Chromosome chr10 scaffold_179, whole genome shotgun sequence
  Pfam annotation: Domain name=PBD; Domain location=13-131; Score=36.8; E_value=7.8e-08; Accession=PF00786.19; Description=P21-Rho-binding domain
MGTVPVLKEREMEIGYPTDVKHVAHIGWDGPSGTGPSWMNDFKTAPDFSTSLGNLGELNDPNGMAVTASWSSQESTGSQPASNIYKGIPSAGVSHASKKSKKKKTKSPSSSESLSASSRHSRATKSKAAYSDREATPIS

SEQ ID NO: 176030 - protein, 460 aa, Glycine max
  Coding DNA Sequence Number=SeqID_84345
  Gene Ontology: Biological process=protein modification process
  Homolog annotation: Hit_ID=A7QUN3; Match level="QueryCoverage=66%, HitCoverage=82%, E-value=9e-19, Identity=28%"; Hit description =Chromosome chr10 scaffold_179, whole genome shotgun sequence
  Pfam annotation: Domain name=ubiquitin; Domain location=12-82; Score =46.9; E_value=7.1e-11; Accession=PF00240.14; Description=Ubiquitin family
  Pfam annotation: Domain name=ubiquitin; Domain location=192-267; Score=14.0; E_value=0.01; Accession=PF00240.14; Description =Ubiquitin family
  Pfam module annotation: Pfam domain module=ubiquitin::ubiquitin; Domain location=12-82::192-267
MEVILEILGGNSFFIDVGPWFFIEVGPLDTVLDVKEKVQNLHNIPISYQTFLFNGEILQDDLQVSTSGIDRGSRIGLLVAPPDDANLAPPQPTLTPPWHTRPFGMPEFPPSLHLNILPHVYDPFGYGMPNIPEFSSLTELRPMPQMPQQLPSSSTEEMPVPSNSNEFEEPLPDLTEASPPSETAVRVTLNVKVPEIQDRIPIEMEFEDTVLKVKEKIVAREEMRGVPVERIALQSHSAGVELLDHQVLQDCCSVLENNEIDAFSKTCSEKRMVNVKLPMSQNRIRIEVEVDDTFRKLKEKIVALEGMQGVPVERILLYPCSPIPQSVLNPIFYVYLKSSVPVAGGGSSSASSGKMTVYLKPNGLPKCYPLQVNAVDNVSALGQQLGLLLQNHPLRLPPNEVFFMVYKGEWMNEQESFEWHGIRDCTKIATFVGCPKQSKPVEYLSVTNQITSWQTTLPIC

SEQ ID NO: 176031 - protein, 256 aa, Glycine max
  Coding DNA Sequence Number=SeqID_84346
  Homolog annotation: Hit_ID=A7QUN3; Match level="QueryCoverage=99%, HitCoverage=66%, E-value=5e-16, Identity=27%"; Hit description =Chromosome chr10 scaffold_179, whole genome shotgun sequence
  Pfam annotation: Domain name=ubiquitin; Domain location=5-74; Score =29.5; E_value=1.2e-05; Accession=PF00240.14; Description=Ubiquitin family
MDLSLVMENDKTLCMEVGFFDSFQEIKEKIEKFTGIPTYRQTLLFNGQVLRNEAIIFNTDISEASRVHFLLDADFGNHHDEITDMHIPSGEELEELMRWNPDGSVTPMTVTENALPPRNPEFTPSPPPPLHETEITPGGSSNMKNLEESPAPSDMQTSQVIPKPYDSSRIVTLSLKAHKYWKDRFPMEADLDDTVLKLKKFILASMKVLAGFEMEHVTVDRMVLHSHSTRVELLDHQLIRDCNVSENHEIDLSVRE

SEQ ID NO: 176032 - protein, 596 aa, Glycine max
  Coding DNA Sequence Number=SeqID_84347
  Gene Ontology: Mol. function=catalytic activity; Cellular component =integral to membrane; Biological process=metabolic process
  Homolog annotation: Hit_ID=P59715; Match level="QueryCoverage=65%, HitCoverage=94%, E-value=0.0, Identity=91%"; Hit description =Putative cardiolipin synthetase ybhO
  Pfam annotation: Domain name=Exo_endo_phos; Domain location=2-201; Score=44.6; E_value=3.5e-10; Accession=PF03372.14; Description =EndonucleaseExonucleasephosphatase family
  Pfam annotation: Domain name=PLDc; Domain location=298-325; Score =36.7; E_value=8.2e-08; Accession=PF00614.13; Description =Phospholipase D. Active site motif
  Pfam annotation: Domain name=PLDc; Domain location=475-502; Score =9.9; E_value=1.2; Accession=PF00614.13; Description=Phospholipase D. Active site motif
  Pfam module annotation: Pfam domain module=Exo_endo_phos::PLDc::PLDc; Domain location=2-201::298-325::475-502
MGAHEVHPLHVENWPDTSHYEFLADTMWSDFAYGRNAVYPEGHHGNAVLSRYPIEHYENRDVSVDGAEKRGVLYCRIVPPMTGKAIHVMCVHLGLREAHRQAQLAMLAEWVNELPDGEPVLVAGDFNDWRQKANHPLKVQAGLDEIFTRAHGRPARTFPVQFPLLRLDRIYVKNASASAPTALPLRTWRHLSDHAPLSNKIQLLENGEQYYPAVFKAIGEAQERIILETFIWFEDDVGKQLHAALLAAAQRGVKAEVLLDGYGSPDLSDEFVNELTAAGVVFRYYDPRPRLFGMRTNVFRRMHRKIVVIDARIAFIGGLNYSAEHMSSYGPEAKQDYAVRLEGPIVEDILQFELENLPGQSAARRWWRRHHKAEENRQPGEAQVLLVWRDNEEHRDDIERHYLKMLTQARREVIIANAYFFPGYRFLHALRKAARRGVRIKLIIQGEPDMPIVRVGARLLYNYLVKGGVQVFEYRRRPLHGKVALMDDHWATVGSSNLDPLSLSLNLEANVIIHDRHFNQTLRDNLNGIIAADCQQVDETMLPKRTWWNLTKSVLAFHFLRHFPALVGWLPAHTPRLAQVDPPAQPTMENAGSGRN

SEQ ID NO: 176033 - protein, 258 aa, Glycine max
  Coding DNA Sequence Number=SeqID_84348
  Gene Ontology: Mol. function=4 iron, 4 sulfur cluster binding; Cellular component=integral to membrane; Biological process=protein -chromophore linkage
  Homolog annotation: Hit_ID=P56766; Match level="QueryCoverage=83%, HitCoverage=28%, E-value=1e-119, Identity=93%"; Hit description =Photosystem I P700 chlorophyll a apoprotein A1
  Pfam annotation: Domain name=PsaA_PsaB; Domain location=74-258; Score= -280.1; E_value=0.03; Accession=PF00223.10; Description=Photosystem I psaApsaB protein
AIRQGDSEVAESWFNQAAEYWKQAIALTPGLFVCVVWKEEDSMIIRSPEPEVKILVDRDPIKTSFEEWAKPGHFSRTIAKGPDTTTWIWNLHADAHDFDSHTNDLEEISRKVFSAHFGQLSIIFLWLSGMYFHGARFSNYEAWLSDPTHIRPSAQVVWPIVGQEILNGDVGGGFRGIQITSGFFQIWRASGITSELQLYCTAIGALVFAALMLFAGWFHYHKAAPKLAWFQDVESMLNHHLTGLLGLGSLSWAGHQIH

SEQ ID NO: 176034 - protein, 136 aa, Glycine max
  Coding DNA Sequence Number=SeqID_84349
  Homolog annotation: Hit_ID=A5B3J2; Match level="QueryCoverage=53%, HitCoverage=16%, E-value=1e-07, Identity=43%"; Hit description =Putative uncharacterized protein
MNAICRRCNQERIRNFLQDLEAAAIPEEEPQSFEASSSFLIAGHSHLDHIKDHLMAEEPRRVTLEDYSSSNVPQFFTSIAQPEVQAQTITYPPSLIQLIQNNLFHGLPNEDPYAHLATYIEICNTIKLAGVPEDAI

SEQ ID NO: 176035 - protein, 63 aa, Glycine max
  Coding DNA Sequence Number=SeqID_84350
MEKSNKKNFKEKKACITWKDNDLDSSSDSENEIINLGLIAKDYESGEEMHSMICIKNLSNLSN

SEQ ID NO: 176036 - protein, 63 aa, Glycine max
  Coding DNA Sequence Number=SeqID_84351
MTASTSSASACKARFRAEVAWPGDWPEAQAGEAPAEAPGEADEARMDEEMTNLLDFLGGSGAT

SEQ ID NO: 176037 - protein, 68 aa, Glycine max
  Coding DNA Sequence Number=SeqID_84352
ATSFVVQEEGTSTWVVVTENKRRYISCGSVQVEGTSTWLFKENKGGYIPCGSQGPQVAWGLDVGTGCC

SEQ ID NO: 176038 - protein, 123 aa, Glycine max
  Coding DNA Sequence Number=SeqID_84353
MTQFMQNPKEECKAMMTRSKRFMEAKDEDSVVYKKKAAEKKGTDEKKDDVIGESNHEKEKQIMNEEKNRSEQVREKKTEKAVNEGVEVPYPMVPSKKEKDLHLARFLDIFWKLEMTMPFGEAL

SEQ ID NO: 176039 - protein, 127 aa, Glycine max
  Coding DNA Sequence Number=SeqID_84354
  Pfam annotation: Domain name=Transposase_23; Domain location=37-107; Score=5.7; E_value=0.00028; Accession=PF03017.5; Description =TNP1ENSPM transposase
MQSQELALPPEPEVGPSAARFSTKESCVDPLWNDPNTGDLDKCRLHIEENPPRLVALGRVYEGSTTVHNIPLLHDQVKVSVEEVKDTDAPIPVPTDEVNLVGQALDTFLTWPTHLVKRLSEQVFCFH

SEQ ID NO: 176040 - protein, 145 aa, Glycine max
  Coding DNA Sequence Number=SeqID_84355
  Subcellular localization annotation: CTP_CleavageSite=41; ConfidenceScore=5.54e-01
MAESTKKRKGSSSTTAAAGHRRHRPSEAPTAPVPPSVSSPRSSTLFSSDDQRLSQGVPFDSTIVDDWKFDYSSHDARCMVCNDQADMTDRLLAGSLTFDYRIMHYIIVRILQPRSSNLAQASEEDLILMWVFLTSHQIDRAHLVR

SEQ ID NO: 176041 - protein, 198 aa, Glycine max
  Coding DNA Sequence Number=SeqID_84356
MAPKKLSAKRSRRDAAAEGTSATPEFDSHRFRSAEHQQRFEAIKGWSFHRERRAQLRDNEYTDFQEEIARRHWTSLVTPMAKFDPDIVLEFYANAWPTEEGVRDMRSWVKGQWIPFDVDSLSQFLGDPLVLEEGQECEFSQRRNRAQWVRRRGHCSAFMHTRLGFRSDRCRKAGADHAHQHEHLDLDVDDIAARQYLA

SEQ ID NO: 176042 - protein, 101 aa, Glycine max
  Coding DNA Sequence Number=SeqID_84357
MLKLLSKIKVKKNHTFPVVYECEFYDVKGLVLVEALNQQPENDRERALEGLKAKLVEQSDVFAEDEHNRHNQRCGELNNWVAYQITLRKGNYCLRLEKAAG

SEQ ID NO: 176043 - protein, 103 aa, Glycine max
  Coding DNA Sequence Number=SeqID_84358
RQARQGASAGVGGCRGWLNYAASEQIVLRVHHMRAIGAGLFAITPAGERGMCCKAIKLGNARVFPVDSRGSPKRRKAETSMVKDSPTRNGCVTNLPEEKMNID

SEQ ID NO: 176044 - protein, 136 aa, Glycine max
  Coding DNA Sequence Number=SeqID_84359
MEAMKEQMATMMEAMMSMKKIMENNVAAIAATSTIAEVDLTPIYGLNQINHPTPDMVSQPMGETHEIPHHNLANVEPCLGYATKGQVVGGIPLQNTLEGPQYHPQPHPLPSTAGKNPHAMAEMGEVGSSRGKAQGR

SEQ ID NO: 176045 - protein, 366 aa, Glycine max
  Coding DNA Sequence Number=SeqID_84360
  Homolog annotation: Hit_ID=Q6WAY6; Match level="QueryCoverage=54%, HitCoverage=35%, E-value=4e-12, Identity=27%"; Hit description =Putative uncharacterized protein
MGTNQNRKRFYQVKVKSLDVTSLKELAQLMGPLQRQAFRKVYGKILELTAAEIFTEIVVSLAQYYDQPLRCFTCGRRFGKRVGSHEANSKRRSGPTAEILGRQGKGYGKSREPQLMLSLYITIARKAQWWLSWWTYSIHLTKGARRTAHGSSATCPLYEGKEGVLFSCGDYPNVPLIGTRGCINYNPALAIRQLGYPMRGAPMEENLSPFLVRDFGAQSLEVVQRVHKAWRSPLRKDKELRGIRNGVIGGSHEWLRAHTRGLDWLSKLKFIDEKNFEAPKEDEEVQALKLELGKARLAKEKFKTAATNIRKECTELREENAATARALEQETKRARKEEHGQDKLRGSLWGSNNELKLQREERDKSR

SEQ ID NO: 176046 - protein, 347 aa, Glycine max
  Coding DNA Sequence Number=SeqID_84361
  Gene Ontology: Mol. function=transporter activity; Cellular component= membrane; Biological process=transport
  Homolog annotation: Hit_ID=A9CKR6; Match level="QueryCoverage=93%, HitCoverage=89%, E-value=1e-155, Identity=88%"; Hit description=ABC transporter, membrane spanning protein
  Pfam annotation: Domain name=BPD_transp_2; Domain location=83-346; Score=189.0; E_value=1.2e-53; Accession=PF02653.7; Description =Branched-chain amino acid transport system  permease component
MERSGGKSMSDQPVRAQPHNEFEKVLSGSSTQVAAFDTHDKSALEKFQHFLHSSPAAVPLIVLVLSLIIFGLLLGGKFFSAFSLTLILQQVAIVGIVGAAQSLVILTAGIDLSVGAIMVLSSVVMGQFTFRYGLPAELSILCGLAVGAFCGFINGVLVSRMRLPPFIVTLGMWQIVLATNFLYSANETIRAQDIAQQAPILQFFGANLRIGNAVFTYGVIAMVLLVALLWYVLNRTAWGRHLYAVGDDPDAAELAGVNVKRMLTTVYTLSGLICAFAGWALIGRIGSVSPTAGQFANIESITAVVIGGLSLFGGRGSIMGMIFGALIVGVFSLGLSLLGQTRNGPIC

SEQ ID NO: 176047 - protein, 120 aa, Glycine max
  Coding DNA Sequence Number=SeqID_84362
MNVRRHRRKGWWMMKLPTNISWMKSYEDPPHSQRGERATICRCKTQGASPGGTVVGADLGGNLKYRNESFEGRRGERFRVNGTCLWISRSYGTGEARLIALCARTPKGNRVEIPEPGRGD

SEQ ID NO: 176048 - protein, 270 aa, Glycine max
  Coding DNA Sequence Number=SeqID_84363
  Gene Ontology: Mol. function=helicase activity; Biological process =viral genome replication
  Homolog annotation: Hit_ID=Q2A9E0; Match level="QueryCoverage=98%, HitCoverage=19%, E-value=1e-51, Identity=40%"; Hit description =Putative uncharacterized protein
MWYDKRISKDKNCGSPRFSLCCGDGKVELSLLQNPPQYLQQLLFDDNTIDSKNYQHNLRAYNMMFAFTCAGIKLEKTINDSRGPTTIRIQGQPCHRIGSLLPMLGKNPNLHNYISLTQKMKCKGHIVSSLSHMLDEHYSHAKSFRMTRDRLADDEVDNIKLQLIAARGKDGRVYNMPNVPEIAALIVGDFHPGSKRDIIVETQNGELQRIHELHPSYLPLQYPILFPYGEDGYRAYILHRSTSSSKKRKQNRLTMREWFAYRLQSKSNKA

SEQ ID NO: 176049 - protein, 71 aa, Glycine max
  Coding DNA Sequence Number=SeqID_84364
MVITIHLEIEQWKRLSNSNSHNFSLGGPIQAHDISGDAQNLTTEALEKFKWSGSFDTGYGGLDDATSGEGR

SEQ ID NO: 176050 - protein, 60 aa, Glycine max
  Coding DNA Sequence Number=SeqID_84365
MVVVWDSGGFRTTRSSVGGGKQPWKLRTLSDGHGRQPWKLRTLAELRGSAPPRRRREEES

SEQ ID NO: 176051 - protein, 118 aa, Glycine max
  Coding DNA Sequence Number=SeqID_84366
  Homolog annotation: Hit_ID=A7QD51; Match level="QueryCoverage=77%, HitCoverage=63%, E-value=8e-31, Identity=63%"; Hit description =Chromosome undetermined scaffold_80, whole genome shotgun sequence
MTMITPSSKLTLTKGNKSWYRAPPRGKLKDKHRSKHSKVEGHMDFQELSNDDYFAKNNEFATWLKEEKNVFFSDLLAESARELFSDFIKAWNKGKLDSHYYEGIATGPRTSHNWNIKK

SEQ ID NO: 176052 - protein, 224 aa, Glycine max
  Coding DNA Sequence Number=SeqID_84367
  Gene Ontology: Mol. function=thiosulfate sulfurtransferase activity; Cellular component=mitochondrion; Biological process=sulfate transport
  Homolog annotation: Hit_ID=A2ZMK2; Match level="QueryCoverage=94%, HitCoverage=74%, E-value=9e-69, Identity=50%"; Hit description =Putative uncharacterized protein
  Pfam annotation: Domain name=Rhodanese; Domain location=139-216; Score=9.2; E_value=0.038; Accession=PF00581.11; Description =Rhodanese-like domain
  Pfam annotation: Domain name=Rhodanese; Domain location=25-124; Score= 46.3; E_value=1.1e-10; Accession=PF00581.11; Description=Rhodanese -like domain
  Pfam module annotation: Pfam domain module=Rhodanese::Rhodanese; Domain location=139-216::25-124
MASSSVGRRATYSTQSVSTNEPVVSVDWLYDNLKEPDIKVLDASWYMPDEQRNPIQEYQLPHMLPSEEAFAAAVSALGIENKDDLVVYDGKGLFSAARVWWMFRVFGHDRVWVLDGGLPRWRASGYDVESSASSDAILKASAASEAIEKLLDSSQTLLPADELKKRFEQEGISVESPAVTSCGTGVTACILALGLHRLGKSDVAVYDGSWTEWGAQSDTLVDTS

SEQ ID NO: 176053 - protein, 318 aa, Glycine max
  Coding DNA Sequence Number=SeqID_84368
  Gene Ontology: Mol. function=iron-sulfur cluster binding; Biological process=electron transport
  Homolog annotation: Hit_ID=Q1H0P7; Match level="QueryCoverage=59%, HitCoverage=91%, E-value=3e-69, Identity=72%"; Hit description =Uncharacterised conserved protein UCP030820
  Pfam annotation: Domain name=DUF934; Domain location=155-315; Score =107.1; E_value=5.5e-29; Accession=PF06073.3; Description=Bacterial protein of unknown function (DUF934)
  Pfam annotation: Domain name=NIR_SIR; Domain location=9-158; Score =17.9; E_value=8.8e-05; Accession=PF01077.13; Description=Nitrite and sulphite reductase 4Fe-4S domain
  Pfam module annotation: Pfam domain module=DUF934::NIR_SIR; Domain location=155-315::9-158
RAAGLATPNIGLLTDIICCPGGDFCSLANAKSIPIAEAIQLQFDNLDYLYEIGDLELNISGCMNACGHHHVGHIGILGVDKDGSEWYQVTVGGKQGNDASIGTVIGPSFSAEEMPGVVQRLIEVYANIVADAWTRVIPPAAGEESVRKQAGKVVLFKLTGEQTYTADQIANTQIPATGKVLVPLTIWQARKAELQPRLAAGELGIVLATHETAEALQAEFPDLNVLPLIAVFVERFADGRIFTLGNWLRTRFGFKNELRAIGDVLRDQLFFHKRAGFNSFLIRADRSAEDALASLNDFSQPYQGGVADVPVWRRVNRA

SEQ ID NO: 176054 - protein, 100 aa, Glycine max
  Coding DNA Sequence Number=SeqID_84369
  Homolog annotation: Hit_ID=B0HC01; Match level="QueryCoverage=31%, HitCoverage=65%, E-value=1e-09, Identity=100%"; Hit description =Putative uncharacterized protein
MEKRQQRGLFTVLAFCWPFAHMFFLRYPLILWITVLPPLSELIPLAAAERPSAARNSYDHDYEFELGTHFIDHCDMLMSASIGLMHESQGGTTYLGAHDS

SEQ ID NO: 176055 - protein, 67 aa, Glycine max
  Coding DNA Sequence Number=SeqID_84370
MAEEIVPPLADGRCDRVEFPDESRKPLEPRAKELAKESYRVSSLRKYNAHCDPESIGLQAKHDSEIR

SEQ ID NO: 176056 - protein, 152 aa, Glycine max
  Coding DNA Sequence Number=SeqID_84371
MEDAPVSPRVALLALPSRRRVGYRTCGRARVMGKVEEAMMSMKKIMETNAVAVAATSAVAKVNPMPPFDLNQMNHPTLDMVGKDLGSTDGPMMCKFKMSAPSRHMACLPTIHHPMWHTLPIRMSITSLRYSLKANNLNPIMHMCLNPWGRHM

SEQ ID NO: 176057 - protein, 58 aa, Glycine max
  Coding DNA Sequence Number=SeqID_84372
MATLAAVFWGANFNLASRVLAEMTPLRHVVAGVCPPLDSPAKTLACLPHAGSGRRIWI

SEQ ID NO: 176058 - protein, 276 aa, Glycine max
  Coding DNA Sequence Number=SeqID_84373
  Gene Ontology: Mol. function=transporter activity; Cellular component= integral to membrane; Biological process=transport
  Homolog annotation: Hit_ID=Q7W068; Match level="QueryCoverage=98%, HitCoverage=67%, E-value=3e-85, Identity=59%"; Hit description =Probable transporter
  Pfam annotation: Domain name=MFS_1; Domain location=13-275; Score =80.9; E_value=4.1e-21; Accession=PF07690.7; Description=Major Facilitator Superfamily
MSSSGIPLALYALMAGAFGIGTTEFVIMGLLPEVSRDLQVSIPMAGLLISGYALGVAVGAPIMSLVMARFSRKSSLLWLMGIFTLGNLICAIAPDYTTLMVARVITSFAHGTFFGIGAIVATGLVPKDKRAFALALMFTGLTVANVVGVPAGTWLGQMLGWRSTFWAVTMIGPIALAALYYLLPKDHHTEKVDVTSEINTLLQPQVIAGLLLTIIVDTGLFAILTYVAPILTDVAHFSPAAVSPVFLLFGAGMVIGNILGAKLADIHLDKTLIGAL

SEQ ID NO: 176059 - protein, 435 aa, Glycine max
  Coding DNA Sequence Number=SeqID_84374
MHGTVGGCLDGRDRVVAERGATTLWRVAHRSGAGDGQDIDGAPARHAAEGDDHPARARYLAAFDRIRTHRPGGATVAGDPRHRTRWQCTEVWRAGGGLSSCAEWQGKSRSRAAFSKVRQRCCSARRAADRLRQRCALAGLRIHPHHHHVAVGVQLRVVLLVDDAMADGHAAVAQALDEQLDQDVVGPHDRQPVVDVGRGHHRCDAVGHRHAFNAQHPAHARFLQIGNVLGVVDVAHAVHVTPAHADRDAGQDLVFAAHQASFFFLLAVAVLLDLPVLLEATAFFAGFSGFTLRGGRASGLLATAAGCSGRALVEGSMRARNWPVYDCGQAATSSGVPVTRIVPPRWPPSGPRSTIQSAVLITSRLCSITTTVLPSSRSLCSTPSSASMSWKCRPVVGSSRMYRVRPVSRRDSSLDSFTRCASPSDSVVALWPSLM

SEQ ID NO: 176060 - protein, 118 aa, Glycine max
  Coding DNA Sequence Number=SeqID_84375
  Subcellular localization annotation: CTP_CleavageSite=25; ConfidenceScore=5.32e-01
MHALLGLFNSKNWSDSKVLDSTGLSCRTITRNRVLVEFSPTRGICGRCLSKIRLNYCRNLPFGGRVTRGSQVRLPWEENAQSRHQRLLEENIGKTGKVWSTNFKCERFESCFYARGRY

SEQ ID NO: 176061 - protein, 158 aa, Glycine max
  Coding DNA Sequence Number=SeqID_84376
MSLPSAVHVFSLIKCEASGDWEARYSVVFQIGSFAKRKKEEVEMRVVIAKRAGRTKSVSYLCFPLISDERLARSVKFRNVAEVEKRSFLQKAVASGGSNLARLGELGGKHLPYFAINRRGTEALPKRFRNVSVKNFAKGFNRSSTYFIRSSLYFDLQR

SEQ ID NO: 176062 - protein, 51 aa, Glycine max
  Coding DNA Sequence Number=SeqID_84377
  Gene Ontology: Mol. function=aspartic-type endopeptidase activity; Biological process=DNA integration
  Homolog annotation: Hit_ID=A5B2I2; Match level="QueryCoverage=100%, HitCoverage=9%, E-value=7e-15, Identity=62%"; Hit description =Putative uncharacterized protein
MKKECSEYAAWRVKKDTWWVDSGATTHISMTMQGCMWSRPPSDDERFIFVG

SEQ ID NO: 176063 - protein, 81 aa, Glycine max
  Coding DNA Sequence Number=SeqID_84378
MRLQAGAGQNTTAALGWLVAGDRHTATISRVHLISSIKRLERCLRHMADQQATKSKAKGSKIPWICMYIAKIPHKNIHMFR

SEQ ID NO: 176064 - protein, 218 aa, Glycine max
  Coding DNA Sequence Number=SeqID_84379
MERSMIDAASGGALGDMTPAEARNLIEKMASNSQQFSARSDAIVIRGVHEVVTNSSGETKKLEGKLDVLVNLITQLAMNKKYAPVARLYGLCSSADHHTDLCLSVQQSEAIEQPEAYDANIYNRPPQPQQQNQSQQNNYDLSSNRPYVPPPIQQQQQQQPQKQQTIEAPPQPSLEELVRQMTMQNMQFQQETRASIQSLTKSDGTVGYTVKSTTVLEF

SEQ ID NO: 176065 - protein, 111 aa, Glycine max
  Coding DNA Sequence Number=SeqID_84380
  Homolog annotation: Hit_ID=A7PVZ9; Match level="QueryCoverage=32%, HitCoverage=14%, E-value=8e-07, Identity=80%"; Hit description =Chromosome chr8 scaffold_34, whole genome shotgun sequence
MDKTTSTTTSERETHDFMNVDSFSQLPFIRPAPLLKEKPAIRLFGIEFAGENNNNNNTSVVVASADDSESVETTTNNNNNNNLNSFDLDPTNKDDTATATNSTNGESSRRF

SEQ ID NO: 176066 - protein, 152 aa, Glycine max
  Coding DNA Sequence Number=SeqID_84381
  Subcellular localization annotation: CTP_CleavageSite=25; ConfidenceScore=5.16e-01
MTFLFSDGIQFFFFAPQKSGPVPVPTDEVSLVGQTLHTFLSWLTHLVKSLSQQVVVSPAKPPPKPDDPLYLMTLTIPELFSRPYQVRWDATVFGVFNLDFPLYIKHEDLSEIAHGGQCLSISVLQLWILHLTETCMRAGNSDIYGFLEPQSI

SEQ ID NO: 176067 - protein, 63 aa, Glycine max
  Coding DNA Sequence Number=SeqID_84382
MEENPPSFPSALRHMLLKGPPTTEWSVQFGHQSEDGFLGSPTTKSMEILSHFHWGISKGCNFP

SEQ ID NO: 176068 - protein, 172 aa, Glycine max
  Coding DNA Sequence Number=SeqID_84383
MTLRVEANDIPRLRKHIFLPPFPLPHCSQQKNNGYIKAFYSNLEIQEGTLISEVYGIKMVIDQSLFYDLTQLSSEGVPFEGTLNDDWKFDFSVLDACRLVCTNQVDMTERLLAGSLAFESRILHYLIVPILLPRSSNLAQVSEEDLIVMWAFHTGRQIDWAHLVRYRMHKAL

SEQ ID NO: 176069 - protein, 73 aa, Glycine max
  Coding DNA Sequence Number=SeqID_84384
MYFREENPSRGVAITLPRRFCEQIREDFSLFFTVLRSFFSLQPEKKPCFSRPPQEIVMVQRLNVSLLSKPRDR

SEQ ID NO: 176070 - protein, 187 aa, Glycine max
  Coding DNA Sequence Number=SeqID_84385
EQAIGFAPAFGHRHGFGGQLLPRLGRFVPVNFLHPQQQAQTRRTGAWVFINYTPLLVAFHQLFQALRRVFQFVFVIDKSKVAVVERHKGVVFPAARHVNGFCRYAAFGKEVGLRGGLQQVVIEPEHHIRFAVFSFHAQTVEQGNAVLQRHELQFAVAVRFKGFFDDRAWAPVGRERVVGVDRQNGLS

SEQ ID NO: 176071 - protein, 42 aa, Glycine max
  Coding DNA Sequence Number=SeqID_84386
IGKEDWCHPLKKFESKKARGPTTLRAIGTKKHSKLSETLKRE

SEQ ID NO: 176072 - protein, 413 aa, Glycine max
  Coding DNA Sequence Number=SeqID_84387
  Gene Ontology: Mol. function=ligase activity, forming aminoacyl-tRNA and related compounds; Cellular component=cytoplasm; Biological process=tRNA aminoacylation for protein translation
  Homolog annotation: Hit_ID=A1ABQ2; Match level="QueryCoverage=82%, HitCoverage=53%, E-value=0.0, Identity=91%"; Hit description =Threonyl-tRNA synthetase
  Pfam annotation: Domain name=HGTP_anticodon; Domain location=262-352; Score=100.2; E_value=6.5e-27; Accession=PF03129.11; Description =Anticodon binding domain
  Pfam annotation: Domain name=IF3_N; Domain location=352-413; Score =113.7; E_value=5.5e-31; Accession=PF05198.7; Description=Translation initiation factor IF-3, N-terminal domain
  Pfam annotation: Domain name=tRNA-synt_2b; Domain location=1-159; Score=212.0; E_value=1.4e-60; Accession=PF00587.16; Description=tRNA synthetase class II core domain (G, H, P, S and T)
  Pfam module annotation: Pfam domain module=HGTP_anticodon::IF3 _N::tRNA-synt_2b; Domain location=262-352::352-413::1-159
FVRTKLKEYDYQEVKGPFMMDRVLWEKTGHWDNYKEAMFTTSSENREYCIKPMNCPGHVQIFNQGLKSYRDLPLRMAEFGSCHRNEPSGALHGLMRVRGFTQDDAHIFCTEDQVRDEVNSCIRMVYDMYSTFGFEKIVVKLSTRPEKRIGSDEMWDRAEVDLAEALKENNIPFEYQPGEGAFYGPKIEFTLHDCLDRAWQCGTVQLDFSLPKRLDATYVGETNDRQTPVMIHRAILGSMERFIGILTEEFAGFFPSWLAPVQAVVMNITDGQAEYVSELTKKLQNAGIRVKADLRNEKIGFKIREHTLRRVPYMLVCGEKEVEAGKVAVRTRRGKDLGSMDVIKGGKRVQPTRPNRINGEIRATEVRLTGVDGEQLGIVSLREAIEKAEEAGVDLVEISPNAEPPVCRIMDYG

SEQ ID NO: 176073 - protein, 199 aa, Glycine max
  Coding DNA Sequence Number=SeqID_84388
  Subcellular localization annotation: CTP_CleavageSite=17; ConfidenceScore=5.26e-01
YVGAKASLLSTTPPFVTVTQESGGMRRHSTVTRTHPLSSKDGEFDDMRRYLMVIRTFCQSEASEPVDTDSESDDMRRYLMVIRTFSQPEASEPVDTQRLTSSSAPLSSRDGESDDMRRYLMVIRTFSQPEASEPVDMQRLTSSSAPLSSRDDESDDMRRYLMVIRTFSQLEASEPVDTHRLTSSSAPLSSRDGKSDDMR

SEQ ID NO: 176074 - protein, 247 aa, Glycine max
  Coding DNA Sequence Number=SeqID_84389
  Pfam annotation: Domain name=zf-CCHC; Domain location=142-159; Score =20.3; E_value=0.0013; Accession=PF00098.14; Description=Zinc knuckle
  Pfam annotation: Domain name=zf-CCHC; Domain location=31-48; Score =30.9; E_value=4.7e-06; Accession=PF00098.14; Description=Zinc knuckle
  Pfam module annotation: Pfam domain module=zf-CCHC::zf-CCHC; Domain location=142-159::31-48
DEDKSKDKNKTRGKFNDGLSKEERQKRYDSKACLRCGEVGHFRRDCPKNEVKQGAVKIGMLRIATPYPTEEPDETLSDLDLYDEARQADYEAFLSKTYEEVMEEEFEMVKEALGLKDFKWDEPLPTDWQVEGAEVLRRLRDQQCWICGNTRHQANDCDIEGRITITGPRAEEIACRAAQEQPRFKESDDEETPRTFEERMEQHERLRWVDCPRQCDYHLRKREETRNNEDDCCHINLWHNEIKLIDT

SEQ ID NO: 176075 - protein, 166 aa, Glycine max
  Coding DNA Sequence Number=SeqID_84390
IAPTRHPVDPKKSNRALGFPALVTGLCQSYRVPVPPARSCHHDIGIAPTKTPSGPGEVQQGHGGSCPQDTQWTRRSPTRSWSCQALITGLCQFYGVPVTSSNGIRTPTNRAFIKKYCVPRQARGKIPQQPGDGRQRATDAPPSPLEFTSAHPQKCLSIAYTTWPSQ

SEQ ID NO: 176076 - protein, 629 aa, Glycine max
  Coding DNA Sequence Number=SeqID_84391
  Gene Ontology: Mol. function=catalytic activity; Cellular component =nucleus; Biological process=metabolic process
  Homolog annotation: Hit_ID=A7PPE3; Match level="QueryCoverage=93%, HitCoverage=99%, E-value=0.0, Identity=45%"; Hit description =Chromosome chr8 scaffold_23, whole genome shotgun sequence
  Pfam annotation: Domain name=PPR; Domain location=108-142; Score =33.3; E_value=8.9e-07; Accession=PF01535.11; Description=PPR repeat
  Pfam annotation: Domain name=PPR; Domain location=210-244; Score =35.5; E_value=1.9e-07; Accession=PF01535.11; Description=PPR repeat
  Pfam annotation: Domain name=PPR; Domain location=245-279; Score =17.6; E_value=0.048; Accession=PF01535.11; Description=PPR repeat
  Pfam annotation: Domain name=PPR; Domain location=311-345; Score =34.0; E_value=5.6e-07; Accession=PF01535.11; Description=PPR repeat
  Pfam annotation: Domain name=PPR; Domain location=346-380; Score =18.5; E_value=0.025; Accession=PF01535.11; Description=PPR repeat
  Pfam annotation: Domain name=PPR; Domain location=382-416; Score =16.2; E_value=0.094; Accession=PF01535.11; Description=PPR repeat
  Pfam annotation: Domain name=PPR; Domain location=7-41; Score=26.3; E_ value=0.00011; Accession=PF01535.11; Description=PPR repeat
  Pfam module annotation: Pfam domain module=PPR::PPR::PPR::PPR::PPR::PP R::PPR; Domain location=108-142::210-244::245-279::311-345::346 -380::382-416::7-41
MSQRNMVSWTSIITGFAHNSRFQEALSSFCQMRIEGEIATQFALSSVLQACTSLGAIQFGTQVHCLVVKCGFGCELFVGSNLTDMYSKCGELSDACKAFEEMPCKDAVLWTSMIDGFVKNGDFKKALTAYMKMVTDDVFIDQHVLCSTLSACSALKASSFGKSLHATILKLGFEYETFIGNALTDMYSKSGDMVSASNVFQIHSDCISIVSLTAIIDGYVEMDQIEKALSTFVDLRRRGIEPNEFTFTSLIKACANQAKLEHGSQLHGQVVKFNFKRDPFVSSTLVDMYGKCGLFDHSIQLFDEIENPDEIAWNTLVGVFSQHGLGRNAIETFNGMIHRGLKPNAVTFVNLLKGCSHAGMVEDGLNYFSSMEKIYGVVPKEEHYSCVIDLLGRAGKLKEAEDFINNMPFEPNVFGWCSFLGACKIHGDMERAKFAADKLMKLEPENSGAHVLLSNIYAKEKQWEDVQSLRKMIKDGNMNKLPGYSWVDIRNKTHVFGVEDWSHPQKKEIYEKLDNLLDQIKRIGYVPQTESVLIDMDDNLKEKLLHYHSERIAVAFSLLTCPTERNIIVRDISRFHHFSNGSCSCGDYWLSTDKDPRKECGKDVGLASVSKVTEVLMFQPHGTKEKCKG

SEQ ID NO: 176077 - protein, 717 aa, Glycine max
  Coding DNA Sequence Number=SeqID_84392
  Subcellular localization annotation: CTP_CleavageSite=35; ConfidenceScore=5.23e-01
MDKYCLVPRVVTSIDVAVASLSSLTSPRAWTSVVRAAYVRLSEVDMFLVSQARSDVSGIPSLIMSSFLSDSAIDMGGNDSRDSIQQPLMDQEVIFIGSSSKEDTRSNASDNESSSLERLRVSCHTGGGTSRLHRKTWPSATSPARELIPVIVILSPSFSKGARTSGRDIRASPHVRRSHSVGSPSSSPIVTGYDCVRDDILKYKSSLTFAVSVAAMQCQVKLENLEDSCKVVVQPCRSNDFSFLRAASGNSPFFFIYRCLFEVLDLILPLTASQCALLKHLNVLTGKIGWVSLNSVSKKLFEFDSNIFHHFKYHFFKSVPIKFKSFDKDLLTLMERVDKDILEQLSASLNARAILSLPSESDPLVALNRIMDVFPWRPLVKQVVPIVGATEVTLGAPSSILAKRKRDGATRVSGFGVPTEVFALVVVAILVPAKVVVVTLALPPPPAVHLLNLGVTASARSVVALSSTIVASLLSARVATMGAPVMAPPPSLASPVPPSVVLTSTSSSSSSCPHVPLHNIYTSNDVDSLCGIGYKPKQKTLFGDLGKEWTTAPRGSKQGGFLGGIGRQMKAYCSHSLESGAPKGSELDGDELFKRCKGLQEEKKDLASKVEGITMERDKLSKLIVDKKVDDILKFEFNLIKGLATHVVVLPIIMVVVPLVEPRPLTVVVVRPHGGRQMYLLKSGAGTCQGRQVKGGLQDFALRLESGPCYKDKKEDL

SEQ ID NO: 176078 - protein, 204 aa, Glycine max
  Coding DNA Sequence Number=SeqID_84393
MAAKAQCPYALHARGKEILIEDDEYTPSTHYVKTRLSRLFKHEVAALQQKRDLTSKDWLALKRYYKLGAHCSSLESKEKPPLDGVHHKTEHCYQTTNHNLFEALDLLHQWSPLLLEHQWQQNGEGGKVLHTPPSPSFIKLSPSLKKVNSDNEILVFTEDTTIEVYDGPPPSWEYVHLHEEALLKTRGSLAEAFQDKTHVERKAK

SEQ ID NO: 176079 - protein, 117 aa, Glycine max
  Coding DNA Sequence Number=SeqID_84394
  Subcellular localization annotation: CTP_CleavageSite=12; ConfidenceScore=5.44e-01
MTNAWDANTLPSFSKYADPRPFPFWFFQRFPRINIGGDSTRFASMEDAPLARPRGSFCTPTEGQVATKGVELKPILLSLIGSHPFAEMDHDNPYTHLSTFIELCSTMGASDEDVKAV

SEQ ID NO: 176080 - protein, 73 aa, Glycine max
  Coding DNA Sequence Number=SeqID_84395
MTIVDSCTWRSLVSKVFLAGKSIHGVQAVGLVGVVEVQDIRAYWWQWLSEVGKPWGGNRPGRPTEAYDLATNI

SEQ ID NO: 176081 - protein, 84 aa, Glycine max
  Coding DNA Sequence Number=SeqID_84396
MDTRHGKKIRTRGYPFESVITLTDNIRVDRLFVITVSETSRGRNNMAFRQWGWQNRHDISSLELTKQAPITSRQQWVLLVVLAK

SEQ ID NO: 176082 - protein, 99 aa, Glycine max
  Coding DNA Sequence Number=SeqID_84397
  Gene Ontology: Mol. function=structural constituent of ribosome; Cellular component=intracellular; Biological process=translation
  Homolog annotation: Hit_ID=Q32703; Match level="QueryCoverage=38%, HitCoverage=90%, E-value=3e-11, Identity=84%"; Hit description =Putative uncharacterized protein
MPFFVHVRYSGVLGVEEPHQSIPNLVVKLYCGDDTVGEISSGDDGVGPVAQRIRARGYEPRCRGFESLLAHNRPKKGRIFPSGGRKIMIGLADPKLWNL

SEQ ID NO: 176083 - protein, 81 aa, Glycine max
  Coding DNA Sequence Number=SeqID_84398
MPRVITAIWLAIRDGKRSSYVIGSGVNSGIGFGGKFLIALELPAGRVVVGAGTWGASLWMVALGYTDAELEEFPTQAEKLG

SEQ ID NO: 176084 - protein, 83 aa, Glycine max
  Coding DNA Sequence Number=SeqID_84399
MSETVKICMVYFKCMKWPRGNLPQRDPGRIKRPKELVPLPSMIVTALGALNTSSASRPSRDGHFSGSDASSSGTMSIPISRRR

SEQ ID NO: 176085 - protein, 84 aa, Glycine max
  Coding DNA Sequence Number=SeqID_84400
  Subcellular localization annotation: CTP_CleavageSite=41; ConfidenceScore=5.41e-01
MAEPSKKRKGSSFTAAAAAHRRHGPSGAPTAPIHPSLTSPRSSTLFSSDDQGLRYLSQFSSRIILDPKYLDIEFFNDETFDCYQ

SEQ ID NO: 176086 - protein, 114 aa, Glycine max
  Coding DNA Sequence Number=SeqID_84401
  Homolog annotation: Hit_ID=A6N1H4; Match level="QueryCoverage=32%, HitCoverage=33%, E-value=1e-14, Identity=100%"; Hit description =Retrotransposon protein
MGDKLHRREGNSPDHQLRPLNDRSVIKEVGVQRQPGGKDPREQCWTKRKRECRLALTQTLVRIQCLENPRVPPQGSSTEGESGPKIRPKGVVDGQQVNIPVLPFVGPEGRRRLG

SEQ ID NO: 176087 - protein, 166 aa, Glycine max
  Coding DNA Sequence Number=SeqID_84402
MKKKKQATTKPSGEFSSIDSPSPEKPLVIDSMARRGGEGNIPAMRTLGDYAYQQGPKHYNKIVIPPFSNKVVELKPTLLCLIGKAKTWLHHIQTKVSTLVKKWRENSLQGSFLCPDSSVQNQPLLLFPKGLMNLFVKHGRDLSLHCEGSQTIVLMMLLNYIFSTMV

SEQ ID NO: 176088 - protein, 56 aa, Glycine max
  Coding DNA Sequence Number=SeqID_84403
MTIIHEQISIGAVGLGSSSSMDSFASWKINGSGMEKEEREETPLQGEDESRRSSPP

SEQ ID NO: 176089 - protein, 325 aa, Glycine max
  Coding DNA Sequence Number=SeqID_84404
ARTATSVLPRADGRRRPSSAGAHGARWAWPSREHGPPRRAWPSWGLPQRGRTPKRCSSSMIRQAAGSTGGLDLRQQLRPAHVAYFLGALALGLAPLLATERMQRRGFRRRTRIAADQVQLGDRHIQAVALGIFDFEELAGHAADVHRDQATIAADAMILVHDRRALGQFTEVADDRFRLAAGTARAPGAAGALGEQLALGQHRDARIVQREAILQRRHGDRKARIVGEEAGQVGHHRRLQLGGLQHFQQGLATPGRIGGDQHPARIVAEEGFQRVACGGLACGHRQRRQRLVTQRMGIGDARVVSRPHLDARGIVQALAQQLRRQ

SEQ ID NO: 176090 - protein, 167 aa, Glycine max
  Coding DNA Sequence Number=SeqID_84405
  Homolog annotation: Hit_ID=A5C365; Match level="QueryCoverage=82%, HitCoverage=17%, E-value=6e-08, Identity=25%"; Hit description =Putative uncharacterized protein
MVEEECKEVSVSSKRLAKKERHFEIKTNIKEISPLRQPPHFLLCKKTLVSIATPYRLEFIPQVKELLDEGLVRKSLNPCVLWVPKIGIIRLEIPKIGVMMNVLSGAILFCKITRAPNIFMICVHRDSLGSDQGFPMNPKRIKVIPEWPTPPSIRKIWGFHDLTNFYK

SEQ ID NO: 176091 - protein, 95 aa, Glycine max
  Coding DNA Sequence Number=SeqID_84406
  Subcellular localization annotation: CTP_CleavageSite=79; ConfidenceScore=5.39e-01
MNCVFVHVSSTFEFGAMRSDCLVQFSILNLFRNPMNCVFVHVSSTFQFGAMRRDCLVQFSILNLFGTPRIAFSFKWPPPSSLEPCLIIGFGNSPI

SEQ ID NO: 176092 - protein, 35 aa, Glycine max
  Coding DNA Sequence Number=SeqID_84407
  Gene Ontology: Mol. function=translation elongation factor activity; Cellular component=intracellular; Biological process=translational elongation
  Homolog annotation: Hit_ID=A0JZ88; Match level="QueryCoverage=100%, HitCoverage=8%, E-value=5e-12, Identity=97%"; Hit description =Elongation factor Tu
MAKAKFERTKPHVNIGTIGHVDHGKTTLSAAISKV

SEQ ID NO: 176093 - protein, 309 aa, Glycine max
  Coding DNA Sequence Number=SeqID_84408
  Subcellular localization annotation: CTP_CleavageSite=37; ConfidenceScore=5.11e-01
MTSAVPPSAAPPLTCPPSPRPTPEGPRDLDPALLPARGGAGGAAPGRTSCSPPGLSSWAPPSGADDHDLRDRDDPRGRCGWCWPPAPGHRRDAVDLQLHLAAAHRGGRGARAVGAVRADGLWAGGLGRLAAGRPVGRCAAVRDPRDHGVGDVHGLPGAAADPLAAGARAGAVRAAGAGMGLSANPCWWGSRTGTGARPRRWPPPAHRDLHLGTALGTAGRGGAGQRAGGHGTRSVGSIGPLRLVWALWLVLAETCAMVTGGTLSIYSFISGSGAMGGDGRLGIDHEERAVDVAAGERTARGRGADLRAR

SEQ ID NO: 176094 - protein, 307 aa, Glycine max
  Coding DNA Sequence Number=SeqID_84409
PRRTRLPDRGRRRGPDHQQLEPRGSGPGAHGDGARRAGGSPGLQEFDAAMLAQLAEIARFAPRPRVRAAPAAPAGGRRLAAHSWAIVKGHALVYRRRGRGGRLITPAGLPQPTPRAPEGAHGDGALGALVLHALPCANRSTSSAWPTWLRLFTDIRLRRRSRRARALRATPRAHRRLPAREASATARRRHRTGRMDVNDRTDSPSAPHLTRPPSCRDLTSDSVHTRLDASSLTSRAAGDRVPGPRRRGKVHHHPLSLLEPAAGQRDPGPEVLGMHATGLTAVRSTPPRLRPLGTPPCGRSSPAARRS

SEQ ID NO: 176095 - protein, 288 aa, Glycine max
  Coding DNA Sequence Number=SeqID_84410
  Pfam annotation: Domain name=Usp; Domain location=148-285; Score =22.7; E_value=0.0014; Accession=PF00582.17; Description=Universal stress protein family
  Pfam annotation: Domain name=Usp; Domain location=29-140; Score=43.6; E_value=6.8e-10; Accession=PF00582.17; Description=Universal stress protein family
  Pfam module annotation: Pfam domain module=Usp::Usp; Domain location =148-285::29-140
MFRWVRSSSEPTGPHRRDGQSSGRLQRPPRRGVPALIVYVAEWAGMGFPGVQPVSERELLTLGEKLVTKELARVRAQFADVQVRGELTTGDASAVLIEASHRAGLVIVGARGLGPLAGRLLGAVSQKVAAHAAGPVMVVREEAPTEMPGPVVVGADPADPAVEVLRFAFEEARRRGVGVVVVAAVRQFRTTLRSDLAAAENLDRAEQDRQQLTDLVTHLAAEHEIHAEAQYPDARPADALLTAAGAESLIVVGSRGRASVAEVALGSVTTAVISRAMAVAVVRVPPSS

SEQ ID NO: 176096 - protein, 324 aa, Glycine max
  Coding DNA Sequence Number=SeqID_84411
  Homolog annotation: Hit_ID=A0HCS8; Match level="QueryCoverage=23%, HitCoverage=23%, E-value=7e-09, Identity=48%"; Hit description =Putative uncharacterized protein
WVGRRSCIPGEAQPVQPGRGLGGRGAAGGAAEHARQDDVLERGELGQQLAVLEDEAEVVAAQAGAAAVAEGRQVRAVVPDGAGGGREDPGEDVQQGGLSAAGGAHHRERVGAGDVEVFIRPRAQSTGDSGAAPGWATGCGAGEAGCGGGPAGAGESWFVFMVPSVPRPGTAARPPPERFPGRGVRPWSDPGVRPGARGSAEAAGDVVLGLRVRGVGEDRVGVVDLDEVAGLAGAGDVEEAGAIRDPGGLLHVVGHDDDRVLLLQLVDEVLDREGRDRVQRRAGLVHQHHLGLHRDGAGDAQPLLLPAGETHPGLVQAVLDLVSR

SEQ ID NO: 176097 - protein, 85 aa, Glycine max
  Coding DNA Sequence Number=SeqID_84412
MDGLVDLAAINAFLAYHHSKESLVVVVLADAYDTFDRRCEKSSARIVCCTPALYVWLASHIFRHESRPICPLQGHRMCAEKGKAN

SEQ ID NO: 176098 - protein, 94 aa, Glycine max
  Coding DNA Sequence Number=SeqID_84413
  Subcellular localization annotation: CTP_CleavageSite=39; ConfidenceScore=5.15e-01
MHMTQMQFTNMGARETVSFLDTTSRVAKCPNRGSRQNPCAMHMRKAQHGNVHSMTILTDISKRVYDTYACSVKNGTQRVCSVPLFKGPIRERAN

SEQ ID NO: 176099 - protein, 47 aa, Glycine max
  Coding DNA Sequence Number=SeqID_84414
MEIVFGTYPLSSCLSQTGLCFRDCNHIVEFAFVEFVSALPSKLGTKG

SEQ ID NO: 176100 - protein, 285 aa, Glycine max
  Coding DNA Sequence Number=SeqID_84415
  Gene Ontology: Mol. function=unspecific monooxygenase activity
  Homolog annotation: Hit_ID=Q5CEG7; Match level="QueryCoverage=36%, HitCoverage=99%, E-value=4e-44, Identity=84%"; Hit description =Senescence-associated protein
  Subcellular localization annotation: CTP_CleavageSite=52; ConfidenceScore=5.26e-01
MIGRADIEGSKSNVAMNAWLPQASYPCGNFSDTSSFKFRRTKGSIGHAFTVRIRTGNQNQTSFYPFVPHEISVLVELILGHLRYLLTDVPPQPNSPPDNVFRPDRPAEADLGSKKRGSAPLPIHGITPTYPTPLKSFHKVGLESSSTGSSFPADSAKPVPLAVVSLDSRQGQWESLGFPCRTSSELTVDARGRGPKGPFPIRPPTGTRRPALAAEAARAVHRQPTGSGLGPPCPALRANPFPEYDRAWEALGPPDFQGPPGAHRTPRDVRCSSSRWTLPPAEPFP

SEQ ID NO: 176101 - protein, 18 aa, Glycine max
  Coding DNA Sequence Number=SeqID_84416
MTKIIQLIEGAKDTVIIQ

SEQ ID NO: 176102 - protein, 166 aa, Glycine max
  Coding DNA Sequence Number=SeqID_84417
MSVNVAQVITDTIYLFTGMPPTRHPLDSDKSNRALGKVIRPPITRAFIEKYCTPRQAQSDAHQAADPPPPPHQADPAGSLGMERYLQHLVRQQAANHRGLSQQGQGFAPFACPTPEQFGTEVAWPGDWPEAQEGEEPAGSPNEAEEARMDEEMIDLLGFLGGSRAT

SEQ ID NO: 176103 - protein, 137 aa, Glycine max
  Coding DNA Sequence Number=SeqID_84418
MSLNWLRDSTFNFELLVILRDSFRHPSKKLLSLNYLRVSTFNFERLVILRDSIRHPSKKLLSFQFAQSINIHFRASRYITGLNQTSEGSTFNFERLVILRDSIRHPSKKLLSFELAESSNIQFQASRYMTGLNQTSE

SEQ ID NO: 176104 - protein, 148 aa, Glycine max
  Coding DNA Sequence Number=SeqID_84419
  Subcellular localization annotation: CTP_CleavageSite=51; ConfidenceScore=5.47e-01
MAWSLVAMFSINSITSSSVFNMIFPPAKASSNCFEWGRKPSMKSKPWKRLRASLSDSSGNWWNEEIFTFPLVVFDFGKYFFKNFSTTSSYVRKLFPLNKCNHLFASPAKENGNRLRQMASSGTPAIFIVLQISMYVARWAYGSSLGSP

SEQ ID NO: 176105 - protein, 940 aa, Glycine max
  Coding DNA Sequence Number=SeqID_84420
  Gene Ontology: Mol. function=nucleic acid binding; Cellular component= nucleus; Biological process=meristem development
  Homolog annotation: Hit_ID=A7PHR4; Match level="QueryCoverage=97%, HitCoverage=97%, E-value=0.0, Identity=51%"; Hit description =Chromosome chr17 scaffold_16, whole genome shotgun sequence
  Pfam annotation: Domain name=RRM_1; Domain location=226-292; Score =53.6; E_value=7.1e-13; Accession=PF00076.13; Description=RNA recognition motif. (a.k.a. RRM, RB
  Pfam annotation: Domain name=RRM_1; Domain location=320-386; Score =38.0; E_value=3.3e-08; Accession=PF00076.13; Description=RNA recognition motif. (a.k.a. RRM, RB
  Pfam annotation: Domain name=RRM_2; Domain location=748-860; Score =203.9; E_value=3.8e-58; Accession=PF04059.3; Description=RNA recognition motif 2
  Pfam module annotation: Pfam domain module=RRM_1::RRM_1::RRM_2; Domain location=226-292::320-386::748-860
MAASPGIIFNTSSPLETNSKTGLSISQTTLSREITEDLHFGRETGNTDMLKDSTTESLNYHKRSWSNVYRQSASGSYGLIGSKIVTNAASRESSLFSSSLSDMFSQKLRLLGNGVLSGQPITVGSFPEEEPYKSLEEIEAETIGNLLPDEDDLFSGVTDELGFSTGTRMNDDFEDFDLFSSSGGMELEGDEHLISGKRTSCGDEDPNYFGVSKGKIPFGEKSSRTLFVRNINSNVEDSELKALFEQYGDIRTIYTACKYRGFVMISYYDLRAAQNAMKALQNRSLRSRKLDIHYSIPKIYLDLMTYQGNAPEKDIGHGTLMISDLDSSVLNDELKQIFGFYGEIREIYEYPQLNHVKFIEFYDVRAAEASLRALNGICFAGKHIKLEPGLPKIATCMMQQSQKGKDEPDFGHSLSDNISLRHNKGVSSGFIASGVSLENGYNQGFRSETQLPAFMDNSLFHVNSSIHKTTRGASAGKVSGVFEACNAIDAMKFASISRFHPHSLPEYRESLANGSPYNFSSTINMAANIGTGSTESSDSRHIQGMSSTGNLAEFNAAGNGNRPHHGLYHMWNGSNLHQQPPSNSMLWQKIPSFVNGACSPGLPQIPSFSRTPPHVLRASHIDHQVGSAPVVAASPWDRQHSFLGESPDASGFRLGSVGSPGFHGSWQLHPPASHNIFSHVGGNGTELTSNGGQGSPKQLSHVLPGRLPMTLVSKNLYSRRSEPNTNNNADKKQYVLDLGRILRGDDNRTTLMIKNIPNKYTSKMLLVAIDEQCRGTYDFLYLPIDFKATIINVFLRQFYKWLQNKCNVGYAFINMIDPGQIIPFHQAFHGKKWEKFNSEKVAVLAYARIQGKSALIAHFQNSSLMNEDKRCRPILFHTDGPNAGDPEPFPLGNNIRVRPGKIRMNGNEENGSQGNPSSLASGEESGNGTESTSSSSKSSD

SEQ ID NO: 176106 - protein, 269 aa, Glycine max
  Coding DNA Sequence Number=SeqID_84421
  Gene Ontology: Mol. function=transcription factor activity; Cellular component=nucleus; Biological process=regulation of transcription, DNA-dependent
  Homolog annotation: Hit_ID=Q9LY29; Match level="QueryCoverage=70%, HitCoverage=67%, E-value=2e-26, Identity=41%"; Hit description =Ethylene-responsive transcription factor ERF115
  Pfam annotation: Domain name=AP2; Domain location=85-136; Score=78.4; E_value=2.3e-20; Accession=PF00847.11; Description=AP2 domain
MEGRSISHSSEREEEYDLFPIYSERSQQDMSAMVSALTQVIGGSNSDSLQQHEGLLTSSHNNTSTQNNNEQSQAPQQEQGSVRRRHYRGVRQRPWGKWAAEIRDPKKAARVWLGTFETAEAAALAYDEAALRFKGSKAKLNFPERVQGTASEFGYHLTNQHSTSSHDQQASNPIITPHFATTQETYSPSHHFQYAQQQLMGGGSNSFNNNQDMLRFYGGHNMFVSSQQSASSSSSTALSQNQQDELLRFSMQFGASSHSDHSGNWRGGQ

SEQ ID NO: 176107 - protein, 145 aa, Glycine max
  Coding DNA Sequence Number=SeqID_84422
  Homolog annotation: Hit_ID=A7PHS6; Match level="QueryCoverage=42%, HitCoverage=38%, E-value=1e-10, Identity=53%"; Hit description =Chromosome chr17 scaffold_16, whole genome shotgun sequence
  Subcellular localization annotation: CTP_CleavageSite=11; ConfidenceScore=5.25e-01
MAMHLQALTISLNTARSPPPSLAPATNAGLRPHFNPLALNLLLELPGFRCVWPPSKPISVAIAGWLPLDFCLTLLSLDDSFCGAPKGRFRPYAPAVARNANDKDVRKARKSKIKKEEAIGNALPIAAALGIAVLVGLYFYLNNKF

SEQ ID NO: 176108 - protein, 358 aa, Glycine max
  Coding DNA Sequence Number=SeqID_84423
  Gene Ontology: Mol. function=oxidoreductase activity; Cellular component=cytoplasm; Biological process=metabolic process
  Homolog annotation: Hit_ID=A5C199; Match level="QueryCoverage=87%, HitCoverage=100%, E-value=1e-132, Identity=69%"; Hit description =Putative uncharacterized protein
  Pfam annotation: Domain name=Epimerase; Domain location=83-351; Score= -52.3; E_value=0.0028; Accession=PF01370.12; Description=NAD dependent epimerasedehydratase family
  Pfam annotation: Domain name=adh_short; Domain location=81-243; Score= 30.7; E_value=1.2e-07; Accession=PF00106.16; Description=short chain dehydrogenase
  Pfam module annotation: Pfam domain module=Epimerase::adh_short; Domain location=83-351::81-243
MHRHQFAPWHAENVCDANYISSMLKVPVTPRTSNIQFIQKEIEKMGHKEKSKDRKEKRLQQISLMRTIPYSDHQRWWSKETIAVVTGGNRGIGFEICRQLADHGVTVILTSRDESVGVESAKVLQEGGLTEVACHQLDILDPSSINQFAEWMKENYGGVDILVNNAGVNFNHGSENNVENARNVIDTNYYGTKSMIEAMIPLMKPSAAGARIVNVSSRLGRLNGKRNRVENDALREQLSDEESLTEELIDGMISNFLQQVEDGSWRSQGWPHSFTDYSVSKLAINAYTRFLARKFSVRPEGEKIYINCYCPGWVKTALTGYSGSVTLEQGADTAVWIALAPDQAITGKFFAERREINF

SEQ ID NO: 176109 - protein, 67 aa, Glycine max
  Coding DNA Sequence Number=SeqID_84424
  Subcellular localization annotation: CTP_CleavageSite=52; ConfidenceScore=5.07e-01
MHGIVDFGCRSHRSPCTGAILLTRNCRIRPLGKWTCMPVSSVSSGCSDHVTKASRFQNSNSGGGNGI

SEQ ID NO: 176110 - protein, 868 aa, Glycine max
  Coding DNA Sequence Number=SeqID_84425
  Gene Ontology: Mol. function=diacylglycerol kinase activity; Cellular component=nucleus; Biological process=activation of protein kinase C
  Homolog annotation: Hit_ID=A7R368; Match level="QueryCoverage=52%, HitCoverage=94%, E-value=1e-166, Identity=63%"; Hit description =Chromosome undetermined scaffold_488, whole genome shotgun sequence
  Pfam annotation: Domain name=Lipase_GDSL; Domain location=541-844; Score=170.1; E_value=5.8e-48; Accession=PF00657.13; Description=GDSL- like LipaseAcylhydrolase
  Pfam annotation: Domain name=PPR; Domain location=160-194; Score =28.0; E_value=3.6e-05; Accession=PF01535.11; Description=PPR repeat
  Pfam annotation: Domain name=PPR; Domain location=263-297; Score =48.6; E_value=2.3e-11; Accession=PF01535.11; Description=PPR repeat
  Pfam annotation: Domain name=PPR; Domain location=298-332; Score=2.6; E_value=3.8; Accession=PF01535.11; Description=PPR repeat
  Pfam annotation: Domain name=PPR; Domain location=334-368; Score =15.5; E_value=0.11; Accession=PF01535.11; Description=PPR repeat
  Pfam module annotation: Pfam domain module=Lipase_GDSL::PPR::PPR::PPR: :PPR; Domain location=541-844::160-194::263-297::298-332::334-368
MARYYHSNMKSVYNLHATLIKNAQHDNPLSLRTFILRCANSSSPPDTARYAAAVLLRFPIPGDPFPYNAVIRHVALHAPSLALALFSHMHRTNVPFDHFTFPLILKSSKLNPHCIHTLVLKLGFHSNIYVQNALINSYGTSGSLHASLKLFDEMPRRDLISWSSLISCFAKRGLPDEALTLFQQMQLKESDILPDGVVMLSVISAVSSLGALELGIWVHAFISRIGVNLTVSLGSALIDMYSRCGDIDRSVKVFDEMPHRNVVTWTALINGLAVHGRGREALEAFYDMVESGLKPDRIAFMGVLVACSHGGLVEEGRRVFSSMWSEYGIEPALEHYGCMVDLLGRAGMVLEAFDFVEGMRVRPNSVIWRTLLGACVNHNLLVLAEKAKERIKELDPHHDGDYVLLSNAYGGVGNWVKKEGVRNSMRESKIVKEPGLSLVHIDQVAHEFVSGDNSHPQWEEITRFLGSVIDTVKLGGYTPSTKNVLHDIQEEEKEHSLGYHSEKLAVAFVLLYHRDRKTIRVIKNLRICYDCHSFMKHVSAMFVFGDSLVDSGNNNYLNSLARANFVPYGIDFSEGPTGRFSNGKTVTDILGEIIGLPLLPAFADTLIKSRNISWGVNYASAAAGILDETGQNLVQDFNTTVRQMKIQMEHNQLSQHLANSLTVVIHGSNDYINNYFLPEQYTSSFNYDPKNYADLLIEVYKRHILSLHDLGLRRFLLAGLGPLGCIPRQLALGSVPRGECRPHINDIVDMFNVLLKSLVDQLNAEHHGSVFAYGNTYGVFNDLINNAKTYGFTVTDSGCCGIGRNQAQITCLFALFPCLDRDKYVFWDAFHTTQAVNNIVAHKAFAGPPSDCYPINVKQMAQMWVLPS

SEQ ID NO: 176111 - protein, 609 aa, Glycine max
  Coding DNA Sequence Number=SeqID_84426
  Homolog annotation: Hit_ID=A5YVF1; Match level="QueryCoverage=99%, HitCoverage=98%, E-value=1e-158, Identity=47%"; Hit description=SGS3- like protein
  Pfam annotation: Domain name=XS; Domain location=315-440; Score=-0.5; E_value=5.4e-06; Accession=PF03468.5; Description=XS domain
  Pfam annotation: Domain name=zf-XS; Domain location=245-283; Score =43.3; E_value=8.9e-10; Accession=PF03470.5; Description=XS zinc finger domain
  Pfam module annotation: Pfam domain module=XS::zf-XS; Domain location= 315-440::245-283
MSSKRGGGRPVTVANNDMSKGKSISEAHPKVEQLTQGIADTKLNSGQDDGEWEVYARKSKNKAGSSAAKPWAPPAHNSNPRAWGNAEMAQKPGIRGHGGLGRSSGNPWQTQNANFRRPAGRGNGRPQLATSGYESNYVPNPAIRPPLEHGWNWQSRPGALQSNARDEISPEDLQKNDDVDDDDGEEDSDAFEDTDDDLMSDDYDSDASQKSHETRKKIKWFKKFFEILDGLTVEQINEPERQWHCPACQGGPGAIDWYRGLQPLVTHAKTKGSKRVKIHRELAILLDEELRRRGTSVIPAGEVFGKWKGLKEEEKDHDIVWPPMVVIQNTKLEQDENDKWIGMGNQELLDYFSTYDAVRARHSYGPQGHRGMSVLIFEASASGYLEAERLHKHFAEQGTDKDSWFSRPILYLPGGNRQLYGYMATKEDMDFFNRHSQGFISSFLAVKGAKHTKALEESIGIMSEKLRKTMEENRIVRRRTKMQHEETKEEMYMQEQFFKDQIKIIHDSRDAKEEDFERMQQEEREKVKQSSTTGHVNAEEYRLKVEEYLKFVEVQDKEMENFVAEKEKLLHAHGTGYAAMKRRHWEEEVQYEQKFDEELANLMEKYSPS

SEQ ID NO: 176112 - protein, 158 aa, Glycine max
  Coding DNA Sequence Number=SeqID_84427
VGVKDKLVEQDEDIGRTKTAQTVWSRGAWKHYPQGFVLESGCDRQQVDDEEMVPDTYTEELLWDGGEDVKPKYRGDDMVLLMGLIDTKEEELCRKEDESGLSMFHTLEKWSPTLKSGFRLVWVWGIPLHAWDLENIKKIAGVVDIDDDVEDLQRLDRA

SEQ ID NO: 176113 - protein, 230 aa, Glycine max
  Coding DNA Sequence Number=SeqID_84428
  Gene Ontology: Mol. function=binding
  Homolog annotation: Hit_ID=A5B4L7; Match level="QueryCoverage=80%, HitCoverage=30%, E-value=6e-37, Identity=40%"; Hit description =Putative uncharacterized protein
MIFGKTDETAGNYGRTTAMLLLTLAISVRSYKVGWVVKGEGREGKALEGVQMILNMSNNKRVDCELLERITKEVEKRLSTSNVPPLITDNKPKTDQFCIVDPGSENQEQVSGASITGRSRETEQLLLLLGKVLQQIIKTGSGCGPEIWGLYAKWHRINGDLMMCSEALLKQVRSLQGSDTWKDRDRFKKFAKVSLELCQAQSFTDTEEFRDLQACYDEVKIKLQSNSMPS

SEQ ID NO: 176114 - protein, 59 aa, Glycine max
  Coding DNA Sequence Number=SeqID_84429
MTACGDIRLRKEGEGRRKSCWCWCVVVTIWEHETLLRIQRDIGVGESNRRERGSRNRRE

SEQ ID NO: 176115 - protein, 55 aa, Glycine max
  Coding DNA Sequence Number=SeqID_84430
MDETNRPTKMDQSNWPTEMFLSGWLPLSPIALSLIASQLVVVGDSFSLIITLIAS

SEQ ID NO: 176116 - protein, 321 aa, Glycine max
  Coding DNA Sequence Number=SeqID_84431
  Gene Ontology: Mol. function=protein serine/threonine kinase activity; Cellular component=cytoplasm; Biological process=protein amino acid phosphorylation
  Homolog annotation: Hit_ID=Q39893; Match level="QueryCoverage=100%, HitCoverage=100%, E-value=1e-168, Identity=86%"; Hit description =Protein kinase
  Pfam annotation: Domain name=Pkinase; Domain location=4-235; Score =227.1; E_value=3.9e-65; Accession=PF00069.16; Description=Protein kinase domain
  Pfam annotation: Domain name=Pkinase_Tyr; Domain location=4-239; Score=-54.0; E_value=4.3e-09; Accession=PF07714.8; Description =Protein tyrosine kinase
  Pfam module annotation: Pfam domain module=Pkinase::Pkinase_Tyr; Domain location=4-235::4-239
MDKYETVKDLGAGNFGVARLMRNKVTKELVAMKYIERGPKVVLTPTHLAIVMEYAAGGELFERICSAGRFSEDEARYFFQQLISGVHFCHTMQICHRDLKLENTLLDGSPAPRLKICDFGYSKSSLLHSRPKSTVGTPAYIAPEVLSRREYDGKLADVWSCAVTLYVMLVGAYPFEDQDDPRNFRKTIQRIMAVQYKIPDYVHISQDCRHLLSRIFVANPLRRITIKEIKNHPWFLRNLPRELTESAQAIYYQRDSPNFHLQSVDEIMKIVGEARNPPPVSRAVKGFGWEGEEDLDEEVEEEDEYDKRVKEVHASGEFQIS

SEQ ID NO: 176117 - protein, 563 aa, Glycine max
  Coding DNA Sequence Number=SeqID_84432
  Gene Ontology: Mol. function=protein binding; Cellular component =cytoplasm; Biological process=steroid metabolic process
  Homolog annotation: Hit_ID=A7NV72; Match level="QueryCoverage=98%, HitCoverage=78%, E-value=0.0, Identity=58%"; Hit description =Chromosome chr18 scaffold_1, whole genome shotgun sequence
  Pfam annotation: Domain name=Oxysterol_BP; Domain location=199-540; Score=103.5; E_value=6.4e-28; Accession=PF01237.9; Description =Oxysterol-binding protein
MNVCSVRENSSDERRFSVSTGTKKRLHLRAESREDRASWVEAMSAVKDLFPRLPKSEAMSPFSSPLVSTQRLRDRLLMEGVRETAIREVEEIVKFEFSQLQKHIVALKQKQSLLMDTLRHLEAEKVDLENTLIDDQRQSKDETESYLSTQEKYSEGSGDDSFEEHDGDDHSDDGDDAFYDTCDDILSTTSSEHLRSCHDSEYEETSPNGDEKSAIGSFGFNYPQIKRRKKFPDPVEKESSVSLWSIIKDNVGKDLTKVCLPVYFNEPLSSLQKCFEDLEYSFLLDQAYEWGKMGDSLKRMLHVAAFAVSGYASTNGRSCKPFNPLLGETYEAEYQDKGIRFISEKLDPVGLLTVEFDDGEVFHWSKGNREYSCKIKFKEQSIIDRNPHQIHGIVEDKKGRTVATIFGKWDESLHFIIGGNSGKGKRSSNVSSKPHLLWKRNPTPEYQTRYNLTQFAITLNEITPGLKEKLPPTDSRLRPDQRCLENGQHEMANSEKLRLEQRQRQAQKMQEKGWKPRWFAKEKGNNSYRYVGGYWETREKGNWESCPDIFGQFSTDTDFNSTP

SEQ ID NO: 176118 - protein, 37 aa, Glycine max
  Coding DNA Sequence Number=SeqID_84433
MERSMVTPILQCGSAVSIARWGPPERKGASRKDGLQQ

SEQ ID NO: 176119 - protein, 122 aa, Glycine max
  Coding DNA Sequence Number=SeqID_84434
MELRNCRYRERESYQERKRCAERGQRGLKPIVLHFASKLLSIFRSPSSFHSFRERLFREFIGRCCVLFGGWSASGGRDDGWFDRRRWVKINEYEGGVNEEHVNCSDTFNTSQVFVTRDDVLQ

SEQ ID NO: 176120 - protein, 92 aa, Glycine max
  Coding DNA Sequence Number=SeqID_84435
MLQKLLKNYEIDLQEGVEAQAEQALASKSTVQQNEGAIMSIEVFAIFFTFQIPTLRTRLKFKGGGNVKDVREGDSFCMVSIWELNKCSTMKE

SEQ ID NO: 176121 - protein, 66 aa, Glycine max
  Coding DNA Sequence Number=SeqID_84436
  Subcellular localization annotation: CTP_CleavageSite=43; ConfidenceScore=5.57e-01
MMTPPPPPSLVSSAPLLPRLHWHYPTPSSASSPPAVAPPSAPPCANSQSPPPSPLSLPILFPNPKS

SEQ ID NO: 176122 - protein, 79 aa, Glycine max
  Coding DNA Sequence Number=SeqID_84437
MGQHRYMKVINAQVGGLNRYIRETMKKSRLAASMKDEEASQKTTFDLDRQYEHDELIAQVKPYQDKTKYSYSISNKDRE

SEQ ID NO: 176123 - protein, 31 aa, Glycine max
  Coding DNA Sequence Number=SeqID_84438
MAGKDFVDVLFSFLILPLGTIARLVEKKSLT

SEQ ID NO: 176124 - protein, 778 aa, Glycine max
  Coding DNA Sequence Number=SeqID_84439
  Gene Ontology: Mol. function=amino acid transmembrane transporter activity; Cellular component=integral to membrane; Biological process=amino acid transport
  Homolog annotation: Hit_ID=A7PKT3; Match level="QueryCoverage=61%, HitCoverage=100%, E-value=0.0, Identity=88%"; Hit description =Chromosome chr7 scaffold_20, whole genome shotgun sequence
  Pfam annotation: Domain name=AA_permease; Domain location=286-770; Score=-40.2; E_value=0.00012; Accession=PF00324.12; Description =Amino acid permease
  Pfam annotation: Domain name=PsbP; Domain location=62-238; Score= -9.3; E_value=6.5e-05; Accession=PF01789.7; Description=PsbP
  Pfam module annotation: Pfam domain module=AA_permease::PsbP; Domain location=286-770::62-238
  Subcellular localization annotation: CTP_CleavageSite=43; ConfidenceScore=5.53e-01
MALRSCSALLRSSFFHQLSQTQSTYASSRTLVSILLPKCTSPTCIYESNKDMHLALSFSKRNLNLSILLTTFLWGEGVLMPNARDALLLAQELELQRYTDSEEGFTLLTPSSWTKVDKAGATVLFQEADMGSNNIGVVVNPVRLKTLEEFGTPQFVADKLLQAERRKESTKEAELITVAERSGEGGLQIYEFEYKVDSTRGGMKRIFSAAFVASKKLYLLNIVHSDKPESPLDPHKRMILEQGTPQLKPGSMGSENSFAEVTGNTTMDSAEKRLNELGYKQELRREMTMFKTLAISFSTMTLFTGITPLYGSSLQYAGPATLVWGWIVVSFFTWFVGIAMAEICSSFPTTGSLYFWAAHLAGPKWGPFSSWCCAWLETIGLIAGIGTQAYAGSQTLQSIILLSTGTNKGGGYFTPKWLFLCMYIGLTVIWAALNTFALEVIALIDIVSIWWQLIGGLVIVIMLPLVALTTKSASFVFTHLELAPESTGVSSKPYAVILSFLVSQYSLYGYDAAAHLTEETKGADKNGPIAILGSIGIITVFGWAYILALTFSIQDFGYLYDPNNETAGAFVPAQILYDAFHGRYHNSAGAIILLFVIWGSFFFGGLSITTSAARVVYALSRDKGVPFSHLWRQLHPKYKIPSNAVWLCAAICILLGLPILKVNVVFTAITSICTIGWVGGYAVPIFARLVMSEKNFKPGPFYLGKARRPVCLVAFLWICYTCSVFLLPTLYPITWDTFNYAPVALGVGLGIIMLWWLLDARKWFTGPVRNIDIQNGMV

SEQ ID NO: 176125 - protein, 361 aa, Glycine max
  Coding DNA Sequence Number=SeqID_84440
  Gene Ontology: Mol. function=ubiquitin-protein ligase activity; Cellular component=intracellular; Biological process=protein modification process
  Homolog annotation: Hit_ID=A7PKR9; Match level="QueryCoverage=98%, HitCoverage=84%, E-value=1e-166, Identity=60%"; Hit description =Chromosome chr7 scaffold_20, whole genome shotgun sequence
  Pfam annotation: Domain name=RCC1; Domain location=134-183; Score =40.9; E_value=4.6e-09; Accession=PF00415.9; Description=Regulator of chromosome condensation (RCC1)
  Pfam annotation: Domain name=RCC1; Domain location=186-235; Score =31.3; E_value=3.4e-06; Accession=PF00415.9; Description=Regulator of chromosome condensation (RCC1)
  Pfam annotation: Domain name=RCC1; Domain location=239-287; Score =16.4; E_value=0.012; Accession=PF00415.9; Description=Regulator of chromosome condensation (RCC1)
  Pfam annotation: Domain name=RCC1; Domain location=290-336; Score =22.3; E_value=0.0018; Accession=PF00415.9; Description=Regulator of chromosome condensation (RCC1)
  Pfam module annotation: Pfam domain module=RCC1::RCC1::RCC1::RCC1; Domain location=134-183::186-235::239-287::290-336
MELEVTAATSPPSRVLLISAGASHTVALLSGNVVCSWGRGEDGQLGHGDTDDRLLPTHLSALDAQQIDSIALVTFGILRFSSGSHSVFSRGDFGRLGHGNSSDLLIPQPIIALQGLRIKQIACGDSHCLAVTMEGEVQSWGRNQNGQLGLGTSEDSLVPQKIQTFQGVPIKMVAAGAEHSVAITENGELYGWGWGRYGNLGLGDRNDRWIPEKVSSVDCDKMVMVACGWRHTISVSSLGGLYTYGWSKYGQLGHGNFEDSLVPQKLQALSDKLISQVSGGWRHSMALTSTGLLYGWGWNKVGVGDNVDRCSPVQVKFPHDQKVVQISCGWRHTIAVTEKENVFSWGRGTNGQLGHGDTVDR

SEQ ID NO: 176126 - protein, 94 aa, Glycine max
  Coding DNA Sequence Number=SeqID_84441
  Homolog annotation: Hit_ID=A7PKS9; Match level="QueryCoverage=97%, HitCoverage=95%, E-value=3e-31, Identity=76%"; Hit description =Chromosome chr7 scaffold_20, whole genome shotgun sequence
MDDVSHFADSKGDSLPTEGVEIAHFSLEQAHYMIYTPSDPLLFVAVKDQNGVLQIADDELLEDPAITSAIDEETEFNALVEEEAALLDSLLGKR

SEQ ID NO: 176127 - protein, 620 aa, Glycine max
  Coding DNA Sequence Number=SeqID_84442
  Homolog annotation: Hit_ID=A7PKT1; Match level="QueryCoverage=97%, HitCoverage=95%, E-value=0.0, Identity=59%"; Hit description =Chromosome chr7 scaffold_20, whole genome shotgun sequence
  Pfam annotation: Domain name=F-box; Domain location=10-57; Score =35.8; E_value=1.5e-07; Accession=PF00646.24; Description=F-box domain
MEPEHHDSSNMLLFLPDDVFAIVSRFMSPRDVCNLCLCCKSLNALVASEKLWLTQCDLLSTVPHKDLVEWRKGVASYKALCRFLMSVKPLIGIWVHQNPELGNVVIIPQELGPLGIEEGPILWASVFEVVSDLDGSMMFFLHGREKGVNYVYPGSVKVADRSCNVLLLEVEPGGCRNVSALLQSKSFVHHSGVEESSSSRKVCRSNSDVSSSQRVVGNGEGMVSFGKLAFSDRRKLLEVTTSQVRQKVPDKMIGPLFPGLRDDEENFQKDLVLLWKRRSLLSQMYKVGSGQNDEYKTSSQEAVDPTQLELDDVRASFDRSRSISHPLPEEDGHTQCIKRKGFRGYVWNGIKQILGRSNTMNASPLVAKKHTSNGEIRQARLQEFLRSSDTVRLMLKASTVKLSSYRAWPNMHDSRFALYKLPLRVPKDDQEYAGLWGGTFGWPPGKPSEDKPGKALFFLLLSYEEFQGQQLLIATKILEGTHYVLHPNGSAMFTANINDPSSEPFPWDTDADSVPVNIKQAFVGEGIASGYGFRYPGSKPGSLFVLENGILAFIWKESRAVLNLQRLNLQELLKKGERVPSLPPVTNFSYLTKSYSNVFAGFPSSSNFLSSPRFALTLTC

SEQ ID NO: 176128 - protein, 130 aa, Glycine max
  Coding DNA Sequence Number=SeqID_84443
  Subcellular localization annotation: CTP_CleavageSite=37; ConfidenceScore=5.06e-01
MRPSSPPLCRSVGVNPGDGVTGNTCESTPDVRGTPSTASGRSAAGALDGGFVGQKVGQRDGSHQNNGGWPENEADSPMGDEQQGPSRFGEKGDNKRGPPECRKKWKNRRKRCGEYKGQSEIGKRMIEERQ

SEQ ID NO: 176129 - protein, 82 aa, Glycine max
  Coding DNA Sequence Number=SeqID_84444
MVEGFKNGSPSLTSGSGFSKQTEMEGWPERTAAGSQEDCYEELWRIKISSKIAVFAWRRRRHPTYSFTAAKSNLSGGKPCPD

SEQ ID NO: 176130 - protein, 76 aa, Glycine max
  Coding DNA Sequence Number=SeqID_84445
  Homolog annotation: Hit_ID=A5AG59; Match level="QueryCoverage=94%, HitCoverage=6%, E-value=7e-12, Identity=46%"; Hit description =Putative uncharacterized protein
MVDPSSALHTIQFNMIEQSTEIDRHFIREKLDSGLIATEYIPSKLQLANMFTKGLPTEQLQDLTCKLGMIDIHSPT

SEQ ID NO: 176131 - protein, 85 aa, Glycine max
  Coding DNA Sequence Number=SeqID_84446
MDDVKKGDKSKAEVLVTILQKMEACFLEQNPTYLVGIHVMAEYSRCLPANSTATFHSTLMCFVRRHKDQKMAVMVAGLNLDYMAA

SEQ ID NO: 176132 - protein, 231 aa, Glycine max
  Coding DNA Sequence Number=SeqID_84447
  Gene Ontology: Mol. function=nucleotidyltransferase activity; Biological process=RNA processing
  Homolog annotation: Hit_ID=A7QT56; Match level="QueryCoverage=95%, HitCoverage=41%, E-value=2e-34, Identity=42%"; Hit description =Chromosome chr1 scaffold_166, whole genome shotgun sequence
MNYMLAYGSGEASLRLLWKSGLLDILLPFQAAYLLNMDFKDRIEEPICFWQQPYRCTKSHTLSVPVTGLWTIHFSFWDLELKPENGSGGMGIKLSTSGIYVFRVGILALHKALSDRLRDPLAVAAFSLAVHNGGNLLEAINITGMINKPHDARFPELLDPSGLDAEALEAEILDLAESVRGTILQMTNEHFVSQAMADYPQSPRSNLVSIFFLDFFARGKCCPFTPVDGLH

SEQ ID NO: 176133 - protein, 249 aa, Glycine max
  Coding DNA Sequence Number=SeqID_84448
  Gene Ontology: Mol. function=lithium ion binding; Cellular component =integral to membrane; Biological process=calcium ion transport
  Homolog annotation: Hit_ID=A7QRH9; Match level="QueryCoverage=99%, HitCoverage=41%, E-value=2e-72, Identity=56%"; Hit description =Chromosome chr8 scaffold_150, whole genome shotgun sequence
  Pfam annotation: Domain name=Na_Ca_ex; Domain location=97-240; Score =97.7; E_value=3.7e-26; Accession=PF01699.15; Description =Sodiumcalcium exchanger protein
MPLYLPRRLTIPVVCEERWSKVYAVSSVTLAPLLLSFLWGSPYIVNSFFSKNVIVYGIGILFGTILGVIGFFTTKMSGPPNKCLFPWLAGGFVMSVTWSYIIAQELVGLLVSIGYICGISPSMLGLTVLAWGNSIGDLMTNLTMALNGGQDGAQVAMSGCYAGPIFNTLIGLGLSLVTCTWSEYPQAVVIPRDPYLWETMVFLVAGLVWALVVLIKRDMKLDGLLGGGLLSVYFLSLFIRLIQTKGSLQ

SEQ ID NO: 176134 - protein, 189 aa, Glycine max
  Coding DNA Sequence Number=SeqID_84449
  Gene Ontology: Mol. function=sequence-specific DNA binding; Cellular component=intracellular; Biological process=regulation of transcription, DNA-dependent
  Homolog annotation: Hit_ID=A5B0K3; Match level="QueryCoverage=30%, HitCoverage=28%, E-value=3e-13, Identity=66%"; Hit description =Putative uncharacterized protein
MSFDKGGNGLITCPLVVWRGPQREIGTGAGKPVPRDLLVGRHSRKLQNAIPMPKALQTRSEPLCFWNKLIIEKLLDFENPIERGVVWVVFWAMDEGCIVKSVTRCNNKRQAITDIGGNWLQGLVTEATKAGMEDESHSNLPSGVITGSPESPCLKTCNNNHHNKEQDRFLPIANVGRITKKAIPGNGKI

SEQ ID NO: 176135 - protein, 166 aa, Glycine max
  Coding DNA Sequence Number=SeqID_84450
MGDIDSGGSIWQPLMDQEVISIRGSSSKNTCHDASNSETSSSEKLRVSRYTGGGISHLRGRAWPSAASPARELVQVTLILLPSASGGAKRSDGDVRASPRVRHSHSVGSSLSPPSVASYEWVKDDVLKATSGSSHFFFMYRCLFEVLGLILPLTAFHCALFEHLNV

SEQ ID NO: 176136 - protein, 104 aa, Glycine max
  Coding DNA Sequence Number=SeqID_84451
  Homolog annotation: Hit_ID=A7QMS5; Match level="QueryCoverage=59%, HitCoverage=14%, E-value=2e-13, Identity=56%"; Hit description =Chromosome undetermined scaffold_127, whole genome shotgun sequence
MLTWMCPNSEFWVDVVEWGPELHTSAWRGRINILANRLDLWYEYASLSSSLIREGFSPSTIEETTDISSIDQNRLIVGAQVSDSLVHSKADLNLAQAPLRDSPP

SEQ ID NO: 176137 - protein, 145 aa, Glycine max
  Coding DNA Sequence Number=SeqID_84452
MAQLLAILLGPNNGTVVKKKREIACEIETAGEPSSGGDIKLGPTAVLEALHVPNRPPKRFGIGCFPVSDAAEILDRQDDLPRRNIAEEAGAEEPNGPGGKVEGEKGDEGEEEEDEGPGGSGTGSQDHGSKGGGGGGGGGDGGEKE

SEQ ID NO: 176138 - protein, 178 aa, Glycine max
  Coding DNA Sequence Number=SeqID_84453
MFKVINEKPGGINLRVTGRVIIVGAAGADAGAGNRARSENKALLDAEALRGGDRGARQGEALVDGGGGGGTEIAAAARGVSDDVVEALGGPVGPGLVELVEIEVKDTGGGASSSAMRGVVVVFLRLLVLALAGLFTPPIGRGKIRRRIQKKKETAKDERGVWRGRQTVVGWIIDVAIS

SEQ ID NO: 176139 - protein, 694 aa, Glycine max
  Coding DNA Sequence Number=SeqID_84454
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=Q93XQ3; Match level="QueryCoverage=95%, HitCoverage=90%, E-value=1e-133, Identity=73%"; Hit description =Putative beta-1,3-glucan synthase
  Pfam annotation: Domain name=Glucan_synthase; Domain location=62-594; Score=94.3; E_value=3.8e-25; Accession=PF02364.6; Description=1,3 -beta-glucan synthase component
MALRTTDGISLTVLGKAYQTAGVLFEVLCAVNKTEKVEEVAPEIIAAARDVQEKTEIYAPFHILPLDSAGASQPIMQLEEHFAFCSVLTPYYSEETVYSKNDLEVENEDGVSIIYYLQKIYPDEWINFMERLDCKKDSEIWEKDENILQLRHWALLRGQTLSLTVRGMMYYRRAIKLKAFLDMENEQEIVDGYKAVTAPSEEDKKSQKSLYASLEAVADMKFTYVATCQNYGNQKCSGDRHATEILNLMVNNPSLRVAYIDEVEEREGGKVQKVYYSVLIKAVGNLDQEIFRIKLPGPAKIGEGKPENQNHAIIFTRGEALQTIDMNQDNYLEEAFKMRNLLEEFNEDHGAAILKLARRKGDDALKAALASQSLVQLGLIMTLPMFMEIGLERGFRTAIGAKYRATGRGFVVRHEKFAENYRMYSRSHFVKGIELTILLICYKIYGSATPDSASYALLSWSMWFMVCSFLFSPFLFNPSGFEWKKIVEDWDDWQKWISNRGGIGVPSNKSWESWWNEEQEHLQHTGFLGRICEIILDMRFFVYQYGIVYHLNVARGDKSILVYALSWIVIVAVMVILKIVSMGRKQFSADFQLMFRLLKLFLFIGAIVALSLMFTLLSLTVGDIFASLLAFLPTAWAVIQIGQACRPFLKGFGMWGSVKALARGYEYLKGVAAVQPSIQPSTSNPAHSDWRQEE

SEQ ID NO: 176140 - protein, 489 aa, Glycine max
  Coding DNA Sequence Number=SeqID_84455
  Gene Ontology: Mol. function=phosphotransferase activity, alcohol group as acceptor; Cellular component=Golgi apparatus; Biological process=phosphoinositide-mediated signaling
  Homolog annotation: Hit_ID=Q9FMJ0; Match level="QueryCoverage=99%, HitCoverage=46%, E-value=1e-141, Identity=53%"; Hit description =Phosphatidylinositol 4-kinase
MVRLLGLTRGEVDEPREIASRSNLTSESSENGWLIRFFDSSFFCEWIAVSYLYKHDHAGVRDYLCNRMYTLPLQGIESYLFQVCYLMIHKPSPSLDKFVIDICSKSLKIALKVNWFLLAELEDSDDNEGISRVQEKCQIAATLMGEWHPLIRPQSAPACPGGKNLVLNRILSSKQRLLSLTSSPPAQRSLSFSPSSGNNFQEDGSPQSPEENKLFKKFMPGPKVRDALLFRKSVEKDDDDDSEKDGFFKRLLRDSKGDDELGQKIRDPFLFRKSSEKYDEDSEKDNFLKRLLRDGEESEKDGFFRRFLRDCKAEDEDLASSSEGFFKRLFRDRKNDSDDKTNSKTMEDEEKEGFFRKFFREKLEDKKDGNDEGDIVNSEEKCAKPAEEDEKEGFFRKFFKDKFDKKEANDKIDDGTTNVEEEEPSDFSLFKRIFRVHPEDGKSSSANENNGGLFESSPGTENFFRKLFRDRDRSIEDSELLGSQKQKEV

SEQ ID NO: 176141 - protein, 141 aa, Glycine max
  Coding DNA Sequence Number=SeqID_84456
MPPKLYMIDRKVNKFHRETLKNKLWEDRCHRSADIRKSNRAVRQYWRSDHDNRYPRRRIDAEHCHLLILTSHKVLQSHNTVNQPSSNDLKMQILIDEQSPCKLSQKGTSKRSPSTNYFTISRSKPSGNNHTAVSAMHPGYC

SEQ ID NO: 176142 - protein, 392 aa, Glycine max
  Coding DNA Sequence Number=SeqID_84457
  Homolog annotation: Hit_ID=A7PHP9; Match level="QueryCoverage=82%, HitCoverage=58%, E-value=1e-124, Identity=73%"; Hit description =Chromosome chr17 scaffold_16, whole genome shotgun sequence
MGTSVPHGKYESVWLATLILRCLLMTIQSASAQPACMGVRAAKCGRMLGSNCKIWDLSLTSEVASLGEGVSLEAKLLSRKEAALRQREAALKAAQQTQSGRDEDIAALRVEIQNLKDDATAALEQQQEAEAEAKALRTMTQRMILTQEEMEEVVLKRCWLARYWGLAVKHGICADIAQSKHEHWSSLAPLPFELVISAGQKAKEESWNKKHGPGADGPDRSKLVRDLNDLAGEGNIESMLSVEMGLRELANLKVEDAVVLALAQHRRPNSVRQSVLDSKSHGDAKYSEAFELSEEEAEDVLFKEAWLTYFWRRALFHCVEEDIAEERLQFWIARSGQSPSSHDAVDVERGLLELRKLSIEQQLWEASRKGIDQLQGSANANHKHATDSDASS

SEQ ID NO: 176143 - protein, 120 aa, Glycine max
  Coding DNA Sequence Number=SeqID_84458
MSYLVSKRRRRCRFSASPPPWGRMRSRIWAADREVLEPSCHMASGTLRLITTSHEGHRHTDHGAHDVVNFVKALSVCDLIKLLNQDIEIKGPSCPRSRGDNDGSLEAVDGLSKAAYRLVR

SEQ ID NO: 176144 - protein, 324 aa, Glycine max
  Coding DNA Sequence Number=SeqID_84459
  Gene Ontology: Mol. function=enzyme inhibitor activity; Cellular component=cytoplasm; Biological process=metabolic process
  Homolog annotation: Hit_ID=A5BEQ8; Match level="QueryCoverage=45%, HitCoverage=81%, E-value=5e-52, Identity=63%"; Hit description =Putative uncharacterized protein
  Pfam annotation: Domain name=ADH_zinc_N; Domain location=96-227; Score=-21.7; E_value=0.049; Accession=PF00107.17; Description=Zinc -binding dehydrogenase
  Pfam annotation: Domain name=PMEI; Domain location=168-318; Score =104.5; E_value=3.3e-28; Accession=PF04043.6; Description=Plant invertasepectin methylesterase inhibitor
  Pfam module annotation: Pfam domain module=ADH_zinc_N::PMEI; Domain location=96-227::168-318
MSTSGKPGDHVLPVFTGECKECDHCKSKESNMCDLLRINTDRGVTLNDGKLSEYTVVHVSCVAKINPAAPLYKVCVLSCGISTGLGATLNAAKPTKGSSVVVFGLGAAGLAAAEGARLAVASRIIGGWGVAVPNKDDAIKTHLVNLLNEKTLKGTFFGNYKPRSGIPSVVEMYMNKRTCKNTKYYNLCFSSLKSDPSSPNADPKGLAVIMIGIGMTNATSTSSYLSSKLPTPSNNTTWKRVLKECADKYSYAGDALQDSVQDLANEAYDYAYMHITAAKDYPNACHNAFKRYPGLVYPRDLARREDGLKHICDVAMGIIDNLDW

SEQ ID NO: 176145 - protein, 142 aa, Glycine max
  Coding DNA Sequence Number=SeqID_84460
MVLHVKFFFSICWPLSLPKGDVPFQLCGQCVINATQKLSSDLQCSLSKGVHGSLFQPLLFLHRRHKTCYWHKKRRKSVIRFRIRRKSAGAEGAWEIFLGSGGWLVERRRMQFNLCSFENGITCRALPPHLLSMGAGEAPQRS

SEQ ID NO: 176146 - protein, 665 aa, Glycine max
  Coding DNA Sequence Number=SeqID_84461
  Gene Ontology: Mol. function=protein phosphatase type 2A regulator activity; Cellular component=protein phosphatase type 2A complex; Biological process=signal transduction
  Homolog annotation: Hit_ID=A7QB92; Match level="QueryCoverage=100%, HitCoverage=100%, E-value=1e-168, Identity=49%"; Hit description =Chromosome chr4 scaffold_73, whole genome shotgun sequence
  Pfam annotation: Domain name=WD40; Domain location=216-254; Score =40.4; E_value=6.3e-09; Accession=PF00400.23; Description=WD domain, G-beta repeat
  Pfam annotation: Domain name=WD40; Domain location=303-340; Score =40.8; E_value=4.9e-09; Accession=PF00400.23; Description=WD domain, G-beta repeat
  Pfam annotation: Domain name=WD40; Domain location=344-382; Score =36.5; E_value=9.7e-08; Accession=PF00400.23; Description=WD domain, G-beta repeat
  Pfam annotation: Domain name=WD40; Domain location=385-423; Score =4.3; E_value=9.3; Accession=PF00400.23; Description=WD domain, G -beta repeat
  Pfam annotation: Domain name=WD40; Domain location=476-516; Score =8.6; E_value=2.8; Accession=PF00400.23; Description=WD domain, G -beta repeat
  Pfam module annotation: Pfam domain module=WD40::WD40::WD40::WD40::WD4 0; Domain location=216-254::303-340::344-382::385-423::476-516
MLISDEGDSDVFFDSVDCFSPTRDSVLTEQEFGYEIWVNEPVSVMERREKFLQEMGLGDGSSKVCSQENNVMSSDDSSERLGLERIRDSGAVSNASCSCILPDDDQVSELVLSGSEATSEAQGLFDEHKGCPKDESCFEGKVYEVSCTDQEVRHRKAEVREKYMGEKEKKNWWKHFISSKKGGGGKVRSKLNSSTNKTRRINVRQNKKRWMELSALYIGQEIRAHKGLIWTMKFSPNGQYLASGGEDGVIRIWRVKTLNTSSICFNAEDSAANKVKHDFSSSQKKHSSQSFVVLPSKIFKIEESPLHEFSGHASDVLDLAWSNSDTLLSSSSDKTVRLWKIGCSQCLSVFHHKDYVTCIQFNPVDENYFISGSIDGKVRIWGIHEERVVDWADIRDVISAISYRPDGKGFVVGSLPGTCRFYVASGKHFQLETKIHVNGKKSTSGNKITGIQFSQKNHQRVMITSEDSRVRILEGTEFVQTYKGLPRSGSQMSGSFTSGGEHIVSVGGDSRVYIWNFNDLGNASSKQTKSKYSCEHFGSEGVTVALPWSCMSAEEQSGSSNDFAHHSSSQHQLEASHGVRESERFSFGSWFSIDGSCRGSVTWPEETLPRWDLPLVEVEFDHQKLCTKDPSHEKHVSETWGLSIVAAGCDGTIKTFHNFGLPIRL

SEQ ID NO: 176147 - protein, 526 aa, Glycine max
  Coding DNA Sequence Number=SeqID_84462
  Gene Ontology: Mol. function=enzyme inhibitor activity; Cellular component=cell wall; Biological process=cell wall modification
  Homolog annotation: Hit_ID=A0ZNK0; Match level="QueryCoverage=96%, HitCoverage=88%, E-value=0.0, Identity=65%"; Hit description=Pectin methylesterase 2
  Pfam annotation: Domain name=PMEI; Domain location=18-166; Score =85.6; E_value=1.6e-22; Accession=PF04043.6; Description=Plant invertasepectin methylesterase inhibitor
  Pfam annotation: Domain name=Pectinesterase; Domain location=212-519; Score=618.6; E_value=5.9e-183; Accession=PF01095.10; Description =Pectinesterase
  Pfam module annotation: Pfam domain module=PMEI::Pectinesterase; Domain location=18-166::212-519
  Subcellular localization annotation: CTP_CleavageSite=86; ConfidenceScore=5.24e-01
MASIFTLFLIFFFLHHPHSAVAQIHQACKATRFPLQCHSSLLPNLPSNPTPLQIIHSALTTSTSNLLLARSKVQSIVDASPDNHTRSTAAKSCLQVLHYSHHRTSLAASALPRGATKHARAWMSASLGYQYGCWNGLKYINHTSLVAQTMSFLDSLTILSSNALSMIVSYDRFGNDTASWRPPMTERDGFWEPSVTEGFGVGPAVPSKLTADVTVCKGKGKGEGRYYETVQEAVNAAPDEGEKRFVIYIKEGVYEERVRVPLKKRNVVFLGDGMGKTVITGSANVGQPGMTTYNSATVGVAGDGFIAKDLTIQNTAGANAHQAVAFRSDSDLSVIENCEFIGNQDTLYAHSLRQFYRSCRIIGNVDFIFGNSAAIFQDCEILVRPRQARPEKGENNAITAHGRTDPAQSTGFVFQNCMVNGTEEYMALYYSKPKVHKNYLGRPWKEYSRTVFIHSFFEALITPQGWMPWSGDFALKTLYYGEFQNSGPGSNLTQRVPWSNQVPAEHVFSYSVQSFIQGDDWNHHLS

SEQ ID NO: 176148 - protein, 624 aa, Glycine max
  Coding DNA Sequence Number=SeqID_84463
  Gene Ontology: Mol. function=transferase activity, transferring hexosyl groups; Cellular component=soluble fraction; Biological process=carbohydrate biosynthetic process
  Homolog annotation: Hit_ID=A7QB81; Match level="QueryCoverage=98%, HitCoverage=97%, E-value=0.0, Identity=75%"; Hit description =Chromosome chr4 scaffold_73, whole genome shotgun sequence
  Pfam annotation: Domain name=Glyco_transf_8; Domain location=295-507; Score=211.5; E_value=2e-60; Accession=PF01501.11; Description =Glycosyl transferase family 8
MEVQTLTTVNELYKRRLPRSKVKDAEKPFHLSVQDRSSRCKLSFLKLILLITICGTFVTLLYSPEVYNTNHLSSSGSRWIWGGSDPRYMSNVATDWDDILKITEKLTGEDELEGIGLVNFNKTELAQWEHLIPEATHVVLPLEYAARNVTWESLYPEWIDEEEETQVPVCPSLPSLRSPGIRLNLITVKLPCRNGGNWSRDVARLHLQLAAASLATSFKGNYPVYVLFVTNCFPIPNLFTCKELVARQGNAWLYKPNLSVLREKVQLPVGSCELALPMRGKELVYNGNAPREAYATILHSAHVYVCGAIAAAQSIRMSGSTRDLVILVDETISSYHRSGLEAAGWKVRTIQRIRNPKAEKDAYNEWNYSKFRLWQLTDYDKIIFIDADLLILRNIDFLFGMPEITATGNNATLFNSGVMVVEPSNCTFQLLMDHINEIESYNGGDQGYLNEIFTWWHRIPRHMNFLKHFWIGDEEEKKQMKTLLFGAEPPILYVLHYLGVKPWLCFRDYDCNWNADIFHEFASDVAHAKWWKVHDAMPELLQQFCLLKSKQKAQLEWDRRQAEIANYTDGHWQIKVKDRRLKKCIDNLCNWKSMLRHWGETNWTDDEFYTPTPPTVTTTSLSAL

SEQ ID NO: 176149 - protein, 49 aa, Glycine max
  Coding DNA Sequence Number=SeqID_84464
MEGDIGKIGTGGATGDPAQHSLALGKLKPFVVCSRTQIAIKDTQGKAVS

SEQ ID NO: 176150 - protein, 86 aa, Glycine max
  Coding DNA Sequence Number=SeqID_84465
MVVRQCCLVVVEVWSRWMKGGGDGSGQRWCGTTTMVQQCCLVVRDDINNSKKLAGEATSKRGSTPVKRWRKKKRKTGERDLVEKAT

SEQ ID NO: 176151 - protein, 144 aa, Glycine max
  Coding DNA Sequence Number=SeqID_84466
  Homolog annotation: Hit_ID=Q8GT91; Match level="QueryCoverage=40%, HitCoverage=10%, E-value=4e-22, Identity=82%"; Hit description =Putative uncharacterized protein
MVLTISLAFCHVASKAMRTWPKEGPREEMWRVEADEGKRKMARGKRSRRGERWRAVREEEVEARGRDKRDWDGRRWSSAGNEVPPGLGGKVGKEVQNSYKKREELFTEQRRNVDLKTFASWEDSPEKMMMDMISDPNAVRREDH

SEQ ID NO: 176152 - protein, 372 aa, Glycine max
  Coding DNA Sequence Number=SeqID_84467
  Gene Ontology: Mol. function=DNA binding; Cellular component=nucleus; Biological process=regulation of transcription
  Homolog annotation: Hit_ID=B0EW03; Match level="QueryCoverage=97%, HitCoverage=84%, E-value=1e-146, Identity=66%"; Hit description =Trihelix transcription factor
MLEISTLPETATENADGGSAAVSDGSKAEHSEDGDRNSAANRWPREETMALLKIRSEMDVAFKDANPKAPLWEQVSRKLAELGYNRSAKKCKEKFENVYKYHRRTKEGRFGKSNGAKTYRFFEQLEALDGNHSLPPPTTTTDNNNNVDDDDVILNAVPCSVIAAAAHEHSSSTTSSSGKMKRKLTRFLEGLMREVIEKQETLQRKFMEVLDKCEKDRMAREEAWKKEELERIKKERELLAHERSIAAAKDEAVLAFLKKFAEAEGTVQLLEKIQVQNDKQKNKHQNGANANRGGDVTVVTDMDKQECGNNGVSVGNFVHMSSSRWPKDEVEALIRLRTEFDVQAQGNNNNSNNGSKGPLWEEISFGYEEHWL

SEQ ID NO: 176153 - protein, 117 aa, Glycine max
  Coding DNA Sequence Number=SeqID_84468
  Gene Ontology: Cellular component=membrane
  Homolog annotation: Hit_ID=A2XZH1; Match level="QueryCoverage=76%, HitCoverage=24%, E-value=7e-17, Identity=50%"; Hit description =Putative uncharacterized protein
MGELKPYLAVFIIQLIYSGLTLLSKAAFNGGMNTCVFISYRQLTGTVIMVPLALILERLTLALNMQAIALVYTSATLAAAIVNSLPASTFFFAVQNGEATPSILQGTPVKDRTSHFI

SEQ ID NO: 176154 - protein, 982 aa, Glycine max
  Coding DNA Sequence Number=SeqID_84469
  Gene Ontology: Mol. function=nucleoside-triphosphatase activity; Cellular component=chloroplast; Biological process=nucleotide -excision repair
  Homolog annotation: Hit_ID=P35100; Match level="QueryCoverage=100%, HitCoverage=100%, E-value=0.0, Identity=81%"; Hit description=ATP -dependent Clp protease ATP-binding subunit clpC homolog, chloroplast precursor
  Pfam annotation: Domain name=AAA; Domain location=322-548; Score =39.2; E_value=6.1e-09; Accession=PF00004.20; Description=ATPase family associated with various cellular activities (AAA)
  Pfam annotation: Domain name=AAA_2; Domain location=694-869; Score =366.5; E_value=4.4e-107; Accession=PF07724.5; Description=ATPase family associated with various c
  Pfam annotation: Domain name=AAA_5; Domain location=698-857; Score =19.2; E_value=9.9e-05; Accession=PF07728.5; Description=ATPase family associated with various
  Pfam annotation: Domain name=Clp_N; Domain location=106-158; Score =79.8; E_value=8.6e-21; Accession=PF02861.11; Description=Clp amino terminal domain
  Pfam annotation: Domain name=Clp_N; Domain location=181-233; Score =74.2; E_value=4.3e-19; Accession=PF02861.11; Description=Clp amino terminal domain
  Pfam annotation: Domain name=NACHT; Domain location=697-865; Score= -34.9; E_value=0.031; Accession=PF05729.3; Description=NACHT domain
  Pfam annotation: Domain name=ResIII; Domain location=300-423; Score= -31.4; E_value=0.021; Accession=PF04851.6; Description=Type III restriction enzyme, res subunit
  Pfam annotation: Domain name=Sigma54_activat; Domain location=668 -861; Score=-184.1; E_value=0.052; Accession=PF00158.17; Description =Sigma-54 interaction domain
  Pfam annotation: Domain name=Torsin; Domain location=650-902; Score= -163.7; E_value=0.0038; Accession=PF06309.2; Description=Torsin
  Pfam annotation: Domain name=UVR; Domain location=569-604; Score =54.8; E_value=3e-13; Accession=PF02151.10; Description=UvrBuvrC motif
  Pfam module annotation: Pfam domain module=AAA::AAA_2::AAA_5::Clp _N::Clp_N::NACHT::ResIII::Sigma54_activat::Torsin::UVR; Domain location=322-548::694-869::698-857::106-158::181-233::697-865::300 -423::668-861::650-902::569-604
  Subcellular localization annotation: CTP_CleavageSite=45; ConfidenceScore=5.43e-01
MARVLAQSVNVPGLVAEHRHGQQKGSGKLKRSTKMMSALRTNGLRMSGFSGLRTFNPLDTMLRPGIDFHSKVSIATSSRQARATRCVPKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPTNIRTQASIMPSFTFFPQTSVYMETFSSNLKFDVIRMVGESADSVTATVGSGSSGNKMPTLEEYGTNLTKLAEEGKLDPVVGRQPQIERVTQILGRRTKNNPCLIGEPGVGKTAIAEGLAQRIANGDVPETIEGKKVITLDMGLLVAGTKYRGEFEERLKKLMEEIKQSDEIILFIDEVHTLIGAGAAEGAIDAANILKPALARGELQVVLSLDMFRMDLLLADSDLEVNMICKEGERMSLCIGATTLDEYRKHIEKDPALERRFQPVKVPEPTVDETIQILKGLRERYEIHHKLRYTDEALVAAAQLSYQYISDRFLPDKAIDLIDEAGSRVRLQHAQLPEEARELDKEVRQIIKEKEEAVRNQDFEKAGELRDREMDLKAQISTLVEKGKEMSKAETEAGDEGPIVTEADIQHIVSSWTGIPVEKVSTDESDRLLKMEETLHKRVIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRKIGFDLDYDEKDSSYNRIKSLVTEELKQYFRPEFLNRLDEMIVFRQLTKLEVKEIADIMLKEVFDRLKVKDIELQVTERFRDRVVEEGYNPSYGARPLRRAIMRLLEDSMAEKMLAREIKEGDSVIVDVDSDGNVIVLNGSSGAPESLPETLPV

SEQ ID NO: 176155 - protein, 156 aa, Glycine max
  Coding DNA Sequence Number=SeqID_84470
MNWTLRVEELGELSGDLAGSSGSSRDALEKKESFGELWKVSVIPKAAHLVWRLFSNGVAIKVNLQRRNVHIGEYTASQKITFCSSIGYPVMKHCKPENHFLQQHWLPSYEARTSKFFVVFGVRHDTDTDVHVWIEFDVFKRCPRIHIRVVSVFLSY

SEQ ID NO: 176156 - protein, 168 aa, Glycine max
  Coding DNA Sequence Number=SeqID_84471
  Gene Ontology: Mol. function=phosphoprotein phosphatase activity; Biological process=intracellular signaling cascade
  Homolog annotation: Hit_ID=A7PHV0; Match level="QueryCoverage=92%, HitCoverage=48%, E-value=2e-26, Identity=36%"; Hit description =Chromosome chr13 scaffold_17, whole genome shotgun sequence
MWAWERCTTLAPKRTPPIMENKPLGHRWLRRGNQHIGNDDLIVFRRKLDIMKRHEFLWEPYTTTVMSMLPPICLVGSMAWCAVVPLICFHVVEWHQPDRVLRQFGMQQPIPESPSQPWNVHGLTLKGKMDENWFQLLAPFISQWNNQAEFRAQTKMFIDPNNANTATL

SEQ ID NO: 176157 - protein, 202 aa, Glycine max
  Coding DNA Sequence Number=SeqID_84472
MSALTCISFFLPFLPTSTKELPNRQWRETRDHLIKPAFIRVWVIYCKLFLIIFDCVYTCVLKVANPKEKGNEVDDNKELILFHEGIMNNPTLSRLFPGLNREREMSAMVSALTHVVSGEVPITGDSSSSSSLVLHHQPHDDTVIVTPTMPSSSSSSTYVVGTSSLKRSRENDTYTSSLFSHPPSSSPAMPTKYNSSTFKIAV

SEQ ID NO: 176158 - protein, 296 aa, Glycine max
  Coding DNA Sequence Number=SeqID_84473
  Gene Ontology: Mol. function=ARF GTPase activator activity; Cellular component=cytoplasm; Biological process=regulation of ARF GTPase activity
  Homolog annotation: Hit_ID=A7QT71; Match level="QueryCoverage=84%, HitCoverage=39%, E-value=5e-39, Identity=34%"; Hit description =Chromosome chr1 scaffold_166, whole genome shotgun sequence
  Pfam annotation: Domain name=ArfGap; Domain location=36-132; Score =69.8; E_value=9.2e-18; Accession=PF01412.9; Description=Putative GTPase activating protein for Arf
SDDSESSDCYSANKMYLLKGSPDDDPAVSGDSIKNEKPIEVLRKVGGNEKCADCGKPDPDWASLNLGILICIECSGVHRNLGVHISKSLGNLFANSVWKELLHSTSTSQTDDTPDGYYLNQVEYVGDRELELEGFPCCSMLANDKKAVYRHVVKSDVDVIAISGEAGFSSNMPSSSNPNTSCKTKTRQEEDIQDGSSVLHLYGADVNAIDSRGRTPLHYSTMRGESAITKVLYYKEELKPHPNDMVYALTMEGANPLAGDKEGNTPFKLAPEPDTVVKDTLALNQQTTCPQNLLEK

SEQ ID NO: 176159 - protein, 28 aa, Glycine max
  Coding DNA Sequence Number=SeqID_84474
MVIFSHGVAAEDKGEEHMGSVLEKQDSF

SEQ ID NO: 176160 - protein, 57 aa, Glycine max
  Coding DNA Sequence Number=SeqID_84475
MSCLQSPFLLLHSAAIDLQEAKDSIDEEDPRPTRSTWSYITKLGKITFPSLTGAKAN

SEQ ID NO: 176161 - protein, 43 aa, Glycine max
  Coding DNA Sequence Number=SeqID_84476
MVTKRWKLEVGSGSYWKLKVENGSWKWKLLEVEVGSWKMEFEI

SEQ ID NO: 176162 - protein, 142 aa, Glycine max
  Coding DNA Sequence Number=SeqID_84477
LPPPIPDERAPSPPPPRVDSSSLLTKVLIELCALRAFVGERFDAMDTCLDAMDARFDGMVVVIIKKGENVNHAGFDDVKKNFLDIIKKGENVNVCIHDFDDAKEESNKAASKDKNCFKINIRLLQQTKFYEDFGLVILCCSF

SEQ ID NO: 176163 - protein, 50 aa, Glycine max
  Coding DNA Sequence Number=SeqID_84478
MSGERGREGGMNCMPQLRLIRQALESVVFHLLAKPICWLSERPLSATLMG

SEQ ID NO: 176164 - protein, 169 aa, Glycine max
  Coding DNA Sequence Number=SeqID_84479
MPQRLQGLGKGFFCFWVVFLFVKNCVFWFEKKGKGKVTGGGGRDGVRKVRCGSRGCKCEIQTLIETTNVISVVGTTESTNPNCSGVVCWNSLVKRCENGPARSTWAGMQRVKLKVGWSSSVHFCCLNIGRKKLAQYLFSTRAPMLNVDLLATVVIGRLNTSHANLQRFG

SEQ ID NO: 176165 - protein, 16 aa, Glycine max
  Coding DNA Sequence Number=SeqID_84480
MDEFEYRTQGTSIRQA

SEQ ID NO: 176166 - protein, 314 aa, Glycine max
  Coding DNA Sequence Number=SeqID_84481
MASKKRKSLASSSTQARFDRSRFHSQEAWESINVAIVKEFYANLYDPEDKSLKQVRVRGHLIKFDEDTLNTFLKPPVILEEGENLYAYSRFALLRPDPQELAAKLCIPGRGFELNADALITALCKARGVTSDSRSLESLSPAINLAYIKKNYWNLDDPIVTFRGPKKTRGKRTEAPTTSAAPETTTPSSSTTPAPPSSTPIIPAPFPFQLPTLSSFGPSQFLFTPEMLHSMLQSLHRGQAIIIGGSGGSTFTRPYPRAISAPTAISEDAPIPEDTMLAEDTQPSAPVLEHEQLTIQDSSAAPILDLNEDQPQED

SEQ ID NO: 176167 - protein, 158 aa, Glycine max
  Coding DNA Sequence Number=SeqID_84482
  Gene Ontology: Mol. function=aspartic-type endopeptidase activity; Biological process=proteolysis
  Homolog annotation: Hit_ID=A5B589; Match level="QueryCoverage=46%, HitCoverage=20%, E-value=2e-09, Identity=44%"; Hit description =Putative uncharacterized protein
MKLELSKPNERLRRRNSERNRNFLQDLEVAGTPEEEPRSSEASSSFPVVGHSQIEPIEDLIMAEELRGVTLEDYSSSTMPQFFTSIAQPEVQAQTITYPPSLIQLIQNNLFHGLPNEDPYAHLATYIEIYNTIRLAGVPADAIRLSLFSFSLAGEAKK

SEQ ID NO: 176168 - protein, 182 aa, Glycine max
  Coding DNA Sequence Number=SeqID_84483
  Homolog annotation: Hit_ID=A5B326; Match level="QueryCoverage=59%, HitCoverage=10%, E-value=3e-10, Identity=29%"; Hit description =Putative uncharacterized protein
  Pfam annotation: Domain name=Retrotrans_gag; Domain location=68-159; Score=-0.2; E_value=0.056; Accession=PF03732.8; Description =Retrotransposon gag protein
MVTTKELETRMDSYEKIVSNLQESMQNSFEMMQKSIEGLMVSIATQHKGPKIATKDENHSGTHEPIVSVVDRAQIPFPSFDGSNYREWKAKSEQFFKLEGTLEEQRIRLLLLSMDVAELARLMQEDSLIDYIERFDTLLARIAIPEELALSFFLSGLTIELEKSVRVYRPSSIQEVVRIARL

SEQ ID NO: 176169 - protein, 45 aa, Glycine max
  Coding DNA Sequence Number=SeqID_84484
MEGVMAGQNDCVIIDALETLAQAMGNQNKGEVAGAIEYQGLDFFQ

SEQ ID NO: 176170 - protein, 353 aa, Glycine max
  Coding DNA Sequence Number=SeqID_84485
  Homolog annotation: Hit_ID=Q5XM22; Match level="QueryCoverage=27%, HitCoverage=69%, E-value=9e-13, Identity=42%"; Hit description =Resistance-like protein HAAS-2
MSHHSSSVNGESTSHKDPLSRILDELSFLKLWKEKKKEKKRVEINQDEREQIREEERRKIMKEMKRENHASYSSHDSCKSLREELSYYYRRRHSSHIKHHSQRREKDIRPQEVNISLPYFHGKDNVEAYLDWEMKVEQLFACHHISEERKVPLATLSFQGVPLGRGAFPPTMKGSLWTLFANKNVTHVHAVFLDAFRDLTQSGAKGAAALVHMYDNLNDAPKSTARLLAGYITLLQCWIYEHFPYVGSVVATEDYDERKPRACHWKSGKALPVSMYRRHSDRLMSDVVCWIWYGDHRAFREFKICLAPSQCSPDYMNWFYMIYHPFMSPAQPGDPPRHPPVQHHDTFVELDVA

SEQ ID NO: 176171 - protein, 177 aa, Glycine max
  Coding DNA Sequence Number=SeqID_84486
MASRKRKSIGSRPTTQYDTRRFSSLDAWNWYTDNVLGRNILPGRKVKLYHTELDDFKTELERRNFHKRLTNLVDGSIDLVLVKEFYAKLYSSKGPSPKQSRVRGHLVKIDADSLNTFPETLVILAEGETLPTYSRYCRLPTNYREIEVALCIPGRGFILNTEGHPGKILRKDLTTLA

SEQ ID NO: 176172 - protein, 65 aa, Glycine max
  Coding DNA Sequence Number=SeqID_84487
MFAYSPFAKRKPRAKRISIHVLSRESQALSAQPLHLRLIWSTKLAKAELSQLQFDLNAVKGQPNC

SEQ ID NO: 176173 - protein, 96 aa, Glycine max
  Coding DNA Sequence Number=SeqID_84488
MEVTIKLILNTFYGALTEPVLELARVMREVEEVQEKMKADMEAMKEQMATMVEATMSMKKIMEANAVTVAATSTVAKVNLMPPSDLNHMNHPTSIW

SEQ ID NO: 176174 - protein, 163 aa, Glycine max
  Coding DNA Sequence Number=SeqID_84489
  Subcellular localization annotation: CTP_CleavageSite=55; ConfidenceScore=5.43e-01
MTTPSRSSPPPDSSSATTKRKTRQNQPRPTVHVDTTTGRGCGPHKEKFHSYLGVVAREKIPIVHSTWKDVPETLKVLIWDDILAKFDIPEGLTAKKKSLFIDLYLITLIGNMQKEQEIQKFNDSPHVLSHGGYDMLEKKLMAEKTKSRVNQGEGTENTDMEEG

SEQ ID NO: 176175 - protein, 118 aa, Glycine max
  Coding DNA Sequence Number=SeqID_84490
  Subcellular localization annotation: CTP_CleavageSite=30; ConfidenceScore=5.39e-01
MYPLLFSVTTTQVDVPSTCTTKDVPSNVLRQSSQVVSPSKHCEGDTKDISGRRRETQKEFRRLVLGEFFLAKGEENKRYNTLLFSRFGKPENFRKLLQGKKKNKKKKFKKMFKEIQRL

SEQ ID NO: 176176 - protein, 71 aa, Glycine max
  Coding DNA Sequence Number=SeqID_84491
MVVVTENMRGYISGGSVVVEGTTRLFKENKGGYIPCGSLLIKQVNNTRELLTQFGATSPTSGGYQAREEIH

SEQ ID NO: 176177 - protein, 16 aa, Glycine max
  Coding DNA Sequence Number=SeqID_84492
VLTNQGLGLVDLLGFK

SEQ ID NO: 176178 - protein, 83 aa, Glycine max
  Coding DNA Sequence Number=SeqID_84493
MEDCLEVPFLGNPETQLQTQSGGHMNDNAIHSCGSGKGREWRIALRAIMKHSSKLENGGHMNDNAVHSCGSEKGCLAGPNGPP

SEQ ID NO: 176179 - protein, 200 aa, Glycine max
  Coding DNA Sequence Number=SeqID_84494
  Gene Ontology: Mol. function=transferase activity, transferring glycosyl groups; Cellular component=membrane; Biological process=UDP- glucose metabolic process
  Homolog annotation: Hit_ID=Q7WZC8; Match level="QueryCoverage=100%, HitCoverage=23%, E-value=1e-109, Identity=98%"; Hit description =Cellulose synthase catalytic subunit
  Pfam annotation: Domain name=PilZ; Domain location=23-120; Score =81.4; E_value=2.8e-21; Accession=PF07238.5; Description=PilZ domain
MAWVFYNLIILGGAVAVSVESKQVRRAHRVEICMPAAIAREDGHLFSCTVHDFSDGGLGIKINGQAKVLEGQKVNLLLKRGQQEYVFPTQVVRVTGDEVGLQLMPLTKKQHIDFVQCTFARADTWALWQDSFPEDKPLESLLDILKLGFRGYRHLAEFAPSSVKLIFRSLTSLVSWVVSFIPRRPGRDEAKQADPVMAQQ

SEQ ID NO: 176180 - protein, 262 aa, Glycine max
  Coding DNA Sequence Number=SeqID_84495
  Gene Ontology: Mol. function=electron-transferring-flavoprotein dehydrogenase activity; Cellular component=mitochondrial inner membrane; Biological process=electron transport
  Homolog annotation: Hit_ID=A1FUA5; Match level="QueryCoverage=100%, HitCoverage=46%, E-value=1e-110, Identity=76%"; Hit description =Electron-transferring-flavoprotein dehydrogenase
MIARYTLDEVKDPQAYGIGIMELWQIDPAKHEPGLVVHAAGWPLDSDTYGGAFLYHADGGKVAIGYVVGLDYKNPWLSPFEEFQRFKTHPSIRKHLEGGTRIGYGARAITAGGLLSLPKTVFPGGALVGCEAGYLNASRIKGSHAAIKTGMLCADAAFDALAADRQHDELSAYPKAFEASWLFTELQQAKNFKQWFKKGQTVATLMTGVEQWLLPKAGRAQSAVDAAPHPAGSCLPGTGVPSTPASPTPSPMAWLTFDRLSS

SEQ ID NO: 176181 - protein, 101 aa, Glycine max
  Coding DNA Sequence Number=SeqID_84496
  Homolog annotation: Hit_ID=A5BR63; Match level="QueryCoverage=50%, HitCoverage=7%, E-value=6e-08, Identity=52%"; Hit description =Putative uncharacterized protein
MECEEIVDDVTDGVEEIDHIGGTKESGDMIMDDRRGEPDAGFDEQATQLPLGKKALGCKWVYKIKHKYDGSVEQFKARDLEEVVYMKPPSWLSSSALWHGV

SEQ ID NO: 176182 - protein, 250 aa, Glycine max
  Coding DNA Sequence Number=SeqID_84497
  Gene Ontology: Mol. function=hydrolase activity, acting on acid anhydrides, catalyzing transmembrane movement of substances; Cellular component=integral to membrane; Biological process=metal ion transport
  Homolog annotation: Hit_ID=A4WFP8; Match level="QueryCoverage=99%, HitCoverage=34%, E-value=1e-107, Identity=82%"; Hit description =Heavy metal translocating P-type ATPase
  Pfam annotation: Domain name=Hydrolase; Domain location=12-167; Score= 46.0; E_value=1.3e-10; Accession=PF00702.17; Description=haloacid dehalogenase-like hydrolase
MAIVREAQSRGLTIPAATAQRALVGSGIEATVDGKKVLIVAAGKSSNPEVEALEKAGQTVVAVMLDGVVKGILALRDTLRDDAREAVAALHQLGVQGVILTGDNPRAAAAIAGELGLEFKAGLLPADKVSAVTELNAHAPLAMVGDGINDAPAMKASTIGIAMGSGTDVALETADAALTHNRLTGLAQMIALARATRANIRQNIGIALWLKGIFLDTTLLGMTGLWLAVLADTGATVLVTANALRLLRRR

SEQ ID NO: 176183 - protein, 28 aa, Glycine max
  Coding DNA Sequence Number=SeqID_84498
VLGTHHYASCEVPGHAGNQKKILMHNPQ

SEQ ID NO: 176184 - protein, 160 aa, Glycine max
  Coding DNA Sequence Number=SeqID_84499
MHDGEKREQEKEKNEVPKRNRKKKSDSPERKSDTHERKFNCLAKATEVRKVLLAREPLYLLYCKDDTLGSLLNQSQTYQDTLGSLLNQSQTYQGNPCSIYPDLSSLFGSGVIQNSITYIKRSSPSKDHIKFPLVDVLIILLQSLVIPFMNIEICMNGLYP

SEQ ID NO: 176185 - protein, 157 aa, Glycine max
  Coding DNA Sequence Number=SeqID_84500
MVMGDFISRLSFPACLHFSGENTETFSSLTSYPELRRSEFLIGGYGGARALLLWGRPIIFVILTLRSCDVHPCIIQRRRGPMIRGDTLRLSAPFCHPGYNRASLHLVSSRGGGPDDTRRYLTVIRTLLSSRGGGPDDKQRPSLVILHPCIIQRRRAR

SEQ ID NO: 176186 - protein, 152 aa, Glycine max
  Coding DNA Sequence Number=SeqID_84501
VGWLTFQEDRPNVKTNPLANHGGGAVNAIGSDRPRRSKPLKDVATPRKFIFEALQKGGVIPHGGHKEDSCLLHPDELYSKETCLAVEELLQRMIDQGRLEVSDEGGEEQHICMQSVDERSFGRPKPLVIYFTKGTASQKPRHPSAPKLVPFP

SEQ ID NO: 176187 - protein, 164 aa, Glycine max
  Coding DNA Sequence Number=SeqID_84502
DNVEANLDWEIRVEQQLKKKSTSKSYGSHSYPKKDQGQGILGVTPSKPKDDKGKTIEKQAPKASLRSPSSSESEEAKEEESSEEIYPQEDGQPLMVKEECKETLVSIATPLGLEVIPQVKELLDEGVPTNPKRIKVIPEWLTPPTPLIELVRNHLPSWEDAQEM

SEQ ID NO: 176188 - protein, 159 aa, Glycine max
  Coding DNA Sequence Number=SeqID_84503
AKGKEKEEKDSAKKIVKKENHFATKGDIKRALLLKQSLYLLLSREKSLSTAIPLELKVIPQVKELLDEGLVCIMRHQIPMIGGCSHSGIQLVCVDAKSTGKCTGSSTINVSKCENKYLKVLGPLTEQIDAIKDVSLIKDVFVFYAEGSSTKHRCLMSLA

SEQ ID NO: 176189 - protein, 144 aa, Glycine max
  Coding DNA Sequence Number=SeqID_84504
MASRKRKSAASRPQAQYDTRRFESLEAWNRYTDNILDRRILSERNVKIYHTEFDKFKAELERHNLHKRLTNLQDGSIDVAMVKEFYANSLGETLPTYSRFTRMRIDPQEFVARLCILERGFVLNAEGHPWKLLRKDLTTLAQTW

SEQ ID NO: 176190 - protein, 65 aa, Glycine max
  Coding DNA Sequence Number=SeqID_84505
DSFEEQATQGSFVPYGRQDVLAAAIGRPEHLIRVRAAGAGIIIKQYFGSASQTSRNASSLPPDEL

SEQ ID NO: 176191 - protein, 93 aa, Glycine max
  Coding DNA Sequence Number=SeqID_84506
MEVGHLSPFLGRQIIHMENTKKDEGVLTDPKRIKVIPEGPIPPTPLIALVRNHVPSWEDAQERGFQTLPYFNIPNTTYFWALYLGLYSVGRVP

SEQ ID NO: 176192 - protein, 164 aa, Glycine max
  Coding DNA Sequence Number=SeqID_84507
  Subcellular localization annotation: CTP_CleavageSite=46; ConfidenceScore=5.09e-01
MYPPLFSLNLVDVPPLELIHKRCSLSCSQSTTQVDVPSTCTTKDVSSNMLRQRSQAVKPLILCEWGYKRILKREKGDTKEFRRLVLRSFGKGRRETQKKFRRLVLGEFFLAKGEEMKRMNSTIFQGLENQKTLESFWHKEEEVQRDSRLVKDCIRLIGLIERLI

SEQ ID NO: 176193 - protein, 136 aa, Glycine max
  Coding DNA Sequence Number=SeqID_84508
MWAWERRTSLAPKRTPPVIENKPLGHRWLRRGNQHIGNDDLLVFRSKLDIMKRHEFLWEPYTTNVMLVLPPICLVGSVAWRKTKMFVDPKNANTTTLAEVTETLQYMVSPQGRNTWTVDDLVPYVEKITILSEEQE

SEQ ID NO: 176194 - protein, 101 aa, Glycine max
  Coding DNA Sequence Number=SeqID_84509
MEIIVGVDASFVDTASPMGSIHQLSKSLFANLSAPHALTVKRANLKLPIAMIEEVGVQVWPWYGCVGDYEYVMMKVVKGFPWQCEIWIFQGDCEEAIVSMK

SEQ ID NO: 176195 - protein, 146 aa, Glycine max
  Coding DNA Sequence Number=SeqID_84510
MLPTGKVTAFNLCHFFSKTDPHAFYDAMDFLSVHYDSKLDLDALTLRGGRVTVMARQSYSLILFNSVFYVVLCFTVLSLFTLGASLLFFISLRSVRFGEGEGTGVQHCGGRRWHTRYAFALGVRSGVPQVVQIKKTIYMRINLICN

SEQ ID NO: 176196 - protein, 366 aa, Glycine max
  Coding DNA Sequence Number=SeqID_84511
  Gene Ontology: Mol. function=motor activity; Cellular component=cell projection
  Homolog annotation: Hit_ID=UPI00016621D1; Match level="QueryCoverage =52%, HitCoverage=41%, E-value=7e-21, Identity=34%"; Hit description =UPI00016621D1 related cluster
HALTFVGLHALTFRGLHVLTFKGLHALAFRGLHALAFVGLHALTFRGLHILAFRGLYVLTFRGLHVLVIRGLHILTFRGLHVLTFRGLHALTFRGLHALTFRGLHVLAFKGLHVLTFRGLHILPFRWLHAVAFVGLHTLTFRGLHVLAFRGLHALTFRGLHILAFRVLHALAFIGMHAITFIGLHICAFRELKGSSPHDTQWTRRSPTGLWGFQLWLWASVNPTGCPSPPQQGIAPARHPVDPEKSNRVLGFPALITGLCQFYGVPVAPNKVIRAPINRDFIKKYCAPQAGTGRDTTAAWGWPAAGNRRTAATSRAPQLIYKGWSVAYDPWSTSRRPSPKPKVSKSTRSMTNKSSRVQLKTLKKRY

SEQ ID NO: 176197 - protein, 123 aa, Glycine max
  Coding DNA Sequence Number=SeqID_84512
  Homolog annotation: Hit_ID=Q0ZCD0; Match level="QueryCoverage=39%, HitCoverage=4%, E-value=8e-07, Identity=44%"; Hit description =Integrase
EVHEVATDSSSSTENKKLEGKLDALVNLQNQQQQNNYDLSSNRYNPGWRNHPNLRWASPPQQQQSIHPFQNAAGPSKPYVPPPIQQLSQQRKQATDAPPQPSLEELVRQMTIQNMQFQQETSV

SEQ ID NO: 176198 - protein, 50 aa, Glycine max
  Coding DNA Sequence Number=SeqID_84513
MAKSMNGTSTSEEIEVCLKARDSLWYLDSGCSRHMTGDKSKLSNFVSKDG

SEQ ID NO: 176199 - protein, 43 aa, Glycine max
  Coding DNA Sequence Number=SeqID_84514
MVRNLMTPMGVRHLVGNSLVAQADHRGGGGVTVHDWVASTIIA

SEQ ID NO: 176200 - protein, 32 aa, Glycine max
  Coding DNA Sequence Number=SeqID_84515
MFPHGKMPRKRVFRADPTVLRKKVQRFKNLGI

SEQ ID NO: 176201 - protein, 60 aa, Glycine max
  Coding DNA Sequence Number=SeqID_84516
MVAAQLAQASSARPGEPGFLFPRCLINWVLVMEDYSDVEEDAFEAESEAKELLGTQEDPS

SEQ ID NO: 176202 - protein, 63 aa, Glycine max
  Coding DNA Sequence Number=SeqID_84517
  Subcellular localization annotation: CTP_CleavageSite=36; ConfidenceScore=5.69e-01
MASPPASPPPPPPPPSPPLAPFDASASLSAVKRTCKASRLPSLSTRPPGAERPVVHIDPAIGK

SEQ ID NO: 176203 - protein, 110 aa, Glycine max
  Coding DNA Sequence Number=SeqID_84518
MDKSLKVEEDEWREKEKREQNFEREERKNEDTLNFWGTLVATYPSAGGRREAHGCIFQGRKMRGVTTKVYLRKTLEKPKVGLRTLSMKVSGVVFTHGEGISTPRVRHKGR

SEQ ID NO: 176204 - protein, 139 aa, Glycine max
  Coding DNA Sequence Number=SeqID_84519
  Gene Ontology: Mol. function=protein binding
  Homolog annotation: Hit_ID=A7PE29; Match level="QueryCoverage=47%, HitCoverage=20%, E-value=7e-17, Identity=62%"; Hit description =Chromosome chr11 scaffold_13, whole genome shotgun sequence
  Subcellular localization annotation: CTP_CleavageSite=58; ConfidenceScore=5.23e-01
MATKYNTFLVKVLIIVLCIILSTYTPSFTVTSITVSKFNVNTHVELAVKLSNWNMRLRLSYPMKYATLTPRNSDNLILEPTNTSHYLDILSLAAHPLVYITTASSLDSFIRVFIVDSNATIATLEASPSKVWQMHFDPK

SEQ ID NO: 176205 - protein, 275 aa, Glycine max
  Coding DNA Sequence Number=SeqID_84520
MGHGQDVVFVRITTWVFLPAIDSWVRINRCCLCTDNHLGIYACHMTHGRISRCCLCTDNDLGISACHLTHGSRSTDVVFVQITTWVFPPASWLMGSADVVFVRITTWDFQLPPDSWVRINKCCLCTDNHLDVVFVRITTWVFPLATWLMDKHLGIFAFHLTHGSESTDVVFLRITTWGADDHIGLCCQSNLGSPNDEVRISVRVCVDYRIGHLRVPPDSHVMIAKGGALLAKPICRLSESFAERTTLVAEHEEESGRRMSCVATYPFAGERGEAH

SEQ ID NO: 176206 - protein, 336 aa, Glycine max
  Coding DNA Sequence Number=SeqID_84521
MGLNQAPTFKKRFYHVKIKSIEVASLQKLGQRMNQLQRQAFCKTYGMIWDLVMIEVFVEAISSFAQYYDESLRDLGMLARRKKAISLFWVISLHGEDSQSGQNLGTRIGPGEWASFINVLALLVFRVVLFPNVDGLVDLAAIDTFLAYHHSKESPIVAVLADAYDTFDRRCEKSGARIVCCTPALYANWEQLLAGMVGASINWFPRWKEGGVGVLSSCEGGALSEESVMPFIARGFSDPNARTFQKVTKAWSAVQRKDKELRGSSNGIIDGYHKLKVSSEEETETPEENEEEKFKTTATKVRKECDKLTDVNVATTKALERETKRARKEEWGRNKF

SEQ ID NO: 176207 - protein, 371 aa, Glycine max
  Coding DNA Sequence Number=SeqID_84522
SEEDLILMWAFLTGRQIDWAHLVWYRMHKALRANAPLPYPQLVTLFLCDFQIPLDDEPFVQVKRSFAIGAGAVTSFGYREDWNGQWLKKDALPLQDERTPSPPPQRDDSALMTEFFPSYGVFVLMLVNVSARWILALPEWISVSHSLKNMWVWIMRTSMTTLTQIWMILLLSNIPPSEHNFDLLLPKCQLVYSIMTQISVLVAQLILDAIHLFVGIAPLRHPVDPNKSNKALGSPALITGLCQFYGVPVAPTKLIQPPINRSVIEKYCMPRQGQQLGQDQQQQLVANHRGQMKLNDSFYQYTLHHHRQDPNPYLWPTLKEFKATIAWPRDRPNFQEEACPTGAQGAAQGGKGGAEVDGDMADLLDFFIGGD

SEQ ID NO: 176208 - protein, 84 aa, Glycine max
  Coding DNA Sequence Number=SeqID_84523
MADTNEEHTQIDEDEPQIDEDQGAMKNKPHHSHFFMDLNLPQPLEVIMRSQRGEMDLHKVLRKHGDNVVDGPALILDEISTANI

SEQ ID NO: 176209 - protein, 103 aa, Glycine max
  Coding DNA Sequence Number=SeqID_84524
KYCTPRQAQGGAPQAPDAPPPPHQADPAGSFDMEQYLRHLSQGFTSFPCPTPDQFRAEVAWPGDWPEAQVGEAPAEAPGDGEEARMDEEMTDLLDFLGGSGAT

SEQ ID NO: 176210 - protein, 114 aa, Glycine max
  Coding DNA Sequence Number=SeqID_84525
MSKTCGGGMTGPLDESISCFLIRVDPWVLVPIIFRGLHVLAIRGLHALTITLTVERTTRPRLERTTRPQHQRATRPHHQRTTCPRLEEGYTSSPWVLVTLTIRGLHALTIRGLH

SEQ ID NO: 176211 - protein, 69 aa, Glycine max
  Coding DNA Sequence Number=SeqID_84526
MEVDEPWLGLWLPLNYQVDMGASGVRHWNNDIVGFGGKLGRTGMAITTWVSPSSSPSLFAPVFSVVLVG

SEQ ID NO: 176212 - protein, 129 aa, Glycine max
  Coding DNA Sequence Number=SeqID_84527
  Subcellular localization annotation: CTP_CleavageSite=36; ConfidenceScore=5.39e-01
MPISPYGNISWSVPSRHRDRAHKTPSGPRKVQQGPRVSSSGYGPLSILQGARTPPARSCHPDIGKDRARRTPGGPKEVQQGSGVSSSDYGPLSVQRSARRPNKVIRPRINWAFIKKYCAPRRAQGETPQ

SEQ ID NO: 176213 - protein, 63 aa, Glycine max
  Coding DNA Sequence Number=SeqID_84528
MTLPCKLTFQTFVFVGNGSEKAFHEEVVATYPSAGGRRVARGLFKNLHLTNKSGKDHFQALDL

SEQ ID NO: 176214 - protein, 82 aa, Glycine max
  Coding DNA Sequence Number=SeqID_84529
MERYFQHLVRQQAANHRGQVQIHKCLYQLSLNQFRAEVAWPGDWPEDQTEEAPAGVPDGAEDARMDEEMTDLLGFLGRSGAT

SEQ ID NO: 176215 - protein, 141 aa, Glycine max
  Coding DNA Sequence Number=SeqID_84530
MHETLGFSCPRENIKHKNIVRSPIGSLVPLDLEIEATLKRNRAERRTKLLQDRTTTSILEEEAQSSDSTSSDSQSSRESATDLSEAFFMVKEHQYRVTLEDYSSSSVPQFFTSIVRPEVQAHNINYPHSLIHLIQGNLFHG

SEQ ID NO: 176216 - protein, 103 aa, Glycine max
  Coding DNA Sequence Number=SeqID_84531
MSLHSSSSVNGEGSTPKDPLYKILDELRSLKLVERKTREKSKRKLEQEDCISCRIDLKKQEAHPHTVKGSCIEHSKLSNKREYKHHNGTFFFREEERTSIANF

SEQ ID NO: 176217 - protein, 181 aa, Glycine max
  Coding DNA Sequence Number=SeqID_84532
  Homolog annotation: Hit_ID=A7A2E2; Match level="QueryCoverage=75%, HitCoverage=69%, E-value=3e-07, Identity=25%"; Hit description =Conserved protein
MKLAKYRLKAQVEKDEGPSGEGQSPRVERGNPCGVYPDLSSFTGSGVYPDLSSFIGSGVYPDLSSFTGSGVYPDLSSFTGSGVIQISVTCIKRSAPTQTYQGNPCGVYPDLSSFTGSGVYPDLSSFIGSGVYPDLSSFTGSGVYPDLSSFTGSGVIQISVTCIKRFAPTQVHIIWYQSFSS

SEQ ID NO: 176218 - protein, 124 aa, Glycine max
  Coding DNA Sequence Number=SeqID_84533
  Homolog annotation: Hit_ID=A8GEK2; Match level="QueryCoverage=44%, HitCoverage=69%, E-value=5e-18, Identity=80%"; Hit description =Putative uncharacterized protein
MKKNLSCISLNYRKVAGASAPVLVIDFCNENNERYTLRYNLPPDTPERTERRAGLFTGQSGYSGNNARCESARGFYVGGPVVHGGQSSAPIGVEGKIGHRARCVKTSVLLSAGKKIKEAPYYDL

SEQ ID NO: 176219 - protein, 240 aa, Glycine max
  Coding DNA Sequence Number=SeqID_84534
  Gene Ontology: Mol. function=heme transporter activity; Cellular component=membrane; Biological process=respiratory chain complex IV assembly
  Homolog annotation: Hit_ID=A8GH97; Match level="QueryCoverage=48%, HitCoverage=47%, E-value=3e-48, Identity=80%"; Hit description=Heme exporter protein CcmC
  Pfam annotation: Domain name=Cytochrom_C_asm; Domain location=5-143; Score=38.4; E_value=2.5e-08; Accession=PF01578.11; Description =Cytochrome C assembly protein
MWKWLHQLARPERLYHVCGRFIPWLGLAAAACLLLGWAWGFGFAPKDYQQGDSFRIIYIHVPAAMWSMGIYASMAVAAFIGLVWQMKMSDTVVAAMAPIGAVFTFIALVTGSAWGKSDVGHLVGVGCASDLRAGAAVPLYGRHRAVQRLRRPPPGGPRRRDSGAGGCGEYPDHPFLGRMVEYAASGLDQHAAVHRAQHAHPAALGDPRLPAAVRHADADAPAQSDPVPGTPAPVGRRAGE

SEQ ID NO: 176220 - protein, 58 aa, Glycine max
  Coding DNA Sequence Number=SeqID_84535
  Homolog annotation: Hit_ID=A7PII8; Match level="QueryCoverage=98%, HitCoverage=14%, E-value=2e-17, Identity=75%"; Hit description =Chromosome chr13 scaffold_17, whole genome shotgun sequence
MDIDYAIRKDEPTAITNESSPADVALYERWERSNRLSVMFIKTKISAGIRGSVEPAEQ

SEQ ID NO: 176221 - protein, 192 aa, Glycine max
  Coding DNA Sequence Number=SeqID_84536
  Gene Ontology: Mol. function=oxidoreductase activity, acting on NADH or NADPH, quinone or similar compound as acceptor; Cellular component=integral to membrane; Biological process=ATP synthesis coupled electron transport
  Homolog annotation: Hit_ID=A6YA17; Match level="QueryCoverage=98%, HitCoverage=40%, E-value=3e-39, Identity=49%"; Hit description=NADH -plastoquinone oxidoreductase subunit 2
  Pfam annotation: Domain name=Oxidored_q1; Domain location=1-114; Score=-71.0; E_value=0.0007; Accession=PF00361.11; Description=NADH -Ubiquinoneplastoquinone (complex I)
MILGNLIAITQTSMKRMLAYSSIGQIGYVIIGIIVGDSNGGYASMITYMLFYISMNLGTFACIVSFGLRTGTDNIRDYAGLYTKDPYLALSLALCLLSLGGLPPLSGRLIFLSFNRTPYECCFYLLLFKNNQVINDWTKPRNNSSRAKLSKAPFKINNSIELSMIVCVIASTIPGISMNPIMKLLRIPFFSF

SEQ ID NO: 176222 - protein, 88 aa, Glycine max
  Coding DNA Sequence Number=SeqID_84537
  Homolog annotation: Hit_ID=A0ST23; Match level="QueryCoverage=30%, HitCoverage=55%, E-value=2e-08, Identity=100%"; Hit description =Putative reverse transcriptase
ALYPGSWEHKEWSPYCYNMFFIKLIDTVDLEGGPVGKPVVPAALMNRPTRGERRFAYWALAECILAYYVGTDEGVSEVLHVAGEKRLH

SEQ ID NO: 176223 - protein, 163 aa, Glycine max
  Coding DNA Sequence Number=SeqID_84538
MAPKKLSMKRSRKEAAGEGSSTTLEFDGHRFRSAEHQQRFEAIKGWSFHRERRIQLREDEYTNFQEEIAHRHWTTLVTPMAKFDPEIVLEFYANAWPTEEGVRDMRSWASNVSSARGRIGPTGSTRRRVRIMRIMHTRVGFRPDRSREVGADHAHQHDHFDPD

SEQ ID NO: 176224 - protein, 573 aa, Glycine max
  Coding DNA Sequence Number=SeqID_84539
  Homolog annotation: Hit_ID=A7PKD1; Match level="QueryCoverage=26%, HitCoverage=34%, E-value=2e-23, Identity=36%"; Hit description =Chromosome chr15 scaffold_19, whole genome shotgun sequence
MAGAIHATKHQKLPLAQHQEDQNKFYYHFLYKATLVLIFFVILPLFPSQAPEFINQSLLTRNWELLHLLFVGVAISYGLFSRRNDETEKEHNNNNSKFDTAQTLVSRFLQVSSFFEDESESPVESDNETKVQTWSSQHYRNEPVVVVAASPRLKKHSSFDDQSGDKPLLLPIRSLKSRLSDEAEDVDVQSLNRSMNSKRFSSNSNRKAEVEADADVQSLNRSTTFKRFSSNSNRNGEVEADGVGVDVDVQSISRSTISQRFSSNSNRKAEVEADDVDVHVQSLNRSTSSKRFSCNSNRNTEVESSRVENKNKESVVLPSPIPWRSRSGRLEPKQEEFDDAFNMMLSPSKEESRPVKSQPSRASSRASSVSPSPSFSSESLAKNSEDSVRKKAFYKSCPPPPPPPPPMMFHKSVSMKPRYGGSFNEEPSFNKELKRSFKSERNMPVGKKIDEENKPMQRTSFRSDKIMGHASVPLVSQPAEKESFLVESNDDEDEDTETEDEDVGGGRIIVQNQNNDSGKGPQVIGGESSKTDGDEGPDVDKKADEFIAKFREQIRLQRIECIKRSTKSARNST

SEQ ID NO: 176225 - protein, 90 aa, Glycine max
  Coding DNA Sequence Number=SeqID_84540
MEARIEAWVRVNEDKKLAKEDNRIGQESPSIFNGKINGIMSLARRYKKPTLEYKLCSNKPLIAAFLHGYKDLKVLLSIQNAFSCISQHMT

SEQ ID NO: 176226 - protein, 127 aa, Glycine max
  Coding DNA Sequence Number=SeqID_84541
MAGTNFEGLCGAVTASLSSEEKKGTNVLCETETNMLAIISKYQEELNLATTHEHKVANDYARVYVEKEARGRVIDSLHQEATMWMDRFALTLNGSQELPRLLAKAKAMTAPTPPPRRFTGSSTIASI

SEQ ID NO: 176227 - protein, 88 aa, Glycine max
  Coding DNA Sequence Number=SeqID_84542
GIVPARHLVDPKKGQQCLGVASSKYGSLSVQGSACCPQQGHQAGAGRNTTAAWDGRQRATDAPPSPLEFTSAHPAKRLERCLRPMADQ

SEQ ID NO: 176228 - protein, 145 aa, Glycine max
  Coding DNA Sequence Number=SeqID_84543
  Homolog annotation: Hit_ID=Q2HW20; Match level="QueryCoverage=93%, HitCoverage=74%, E-value=1e-10, Identity=28%"; Hit description =Putative uncharacterized protein
MDDIFKDLWKLKIPAKASIFAGRLIRDRLPTKSNMRKRQIDINDSLCPFCSTSGAYPINPRLHFLQHNNGMKGGKKYNRWKCWWVALNWSIWQHRNKIIFTNAPFNGSNLLEDALFLAWTWFRTMEKNFTMHFKYWSSNLPAGFL

SEQ ID NO: 176229 - protein, 472 aa, Glycine max
  Coding DNA Sequence Number=SeqID_84544
  Gene Ontology: Mol. function=oxidoreductase activity; Cellular component=mitochondrial matrix; Biological process=fatty acid metabolic process
  Homolog annotation: Hit_ID=A8GGE1; Match level="QueryCoverage=30%, HitCoverage=99%, E-value=9e-73, Identity=91%"; Hit description =Phenylacetic acid degradation protein PaaD
  Pfam annotation: Domain name=3HCDH; Domain location=51-136; Score =82.6; E_value=1.3e-21; Accession=PF00725.13; Description=3 -hydroxyacyl-CoA dehydrogenase, C-terminal domain
  Pfam annotation: Domain name=3HCDH_N; Domain location=1-49; Score= -89.7; E_value=0.011; Accession=PF02737.9; Description=3-hydroxyacyl -CoA dehydrogenase, NAD binding domain
  Pfam annotation: Domain name=4HBT; Domain location=379-454; Score =84.2; E_value=4.2e-22; Accession=PF03061.13; Description =Thioesterase superfamily
  Pfam module annotation: Pfam domain module=3HCDH::3HCDH_N::4HBT; Domain location=51-136::1-49::379-454
MAGLHFFNPAPLMKLVEIVSGLETGTDTLAALQALAQRWGKQSVVCRSTPGFIVNRVARPFYAETLRALEERVADAATLDAVLRDAGGFAMGPLQLTDLIGQDVNYAVTESVYQAFLSGSALHALTGATGAGGGRAPRPQVRPRFSTATTHRDPPPRSPFAPPAQAALPQRVTLHGDCWPTNVERPWCCSISVPTMRTPRHCHQLRGAKRCATQCQSDSPVAVPRQAGHSTAGLPRPADDAHPGHAGQRSARRGEQRRRQRRRYRSGDAARRQLSARPAGLGRRARLVPHSGDAGKPATLLRRSALSPNAAAAPLRFPRLFPRSRTMNANTPRALAQRCAEQMFQQDTCAQAMGMHIDAVDAGYAQVSMTVGPQMLNGHQTCHGGQLFSLADTAFAYACNSQGLAAVASGCSIDFVRPALAGDRLTASAAVRHQGKATGLYDVEIVNQRGKTVAWFRGRAHRLGHSILGDQA

SEQ ID NO: 176230 - protein, 196 aa, Glycine max
  Coding DNA Sequence Number=SeqID_84545
MLYFNVRVYEENDGVIFEGSKKTIQIKLEISFNALEKKIGDKAQPPTNVNNLHGDEEDDDDDYLVSNSYAEEYLEEDDSVDGISDTDDEVADMIQPVRIVHPAEGVQGIENPFWNDALHYNNINWSHPDEEDICGLEMPSSFNVGQELYVGMDFDTKDAVKNALKQYVMKVHQTFKVVESKSNKVSLSVLYEGNFI

SEQ ID NO: 176231 - protein, 119 aa, Glycine max
  Coding DNA Sequence Number=SeqID_84546
  Homolog annotation: Hit_ID=A7H917; Match level="QueryCoverage=63%, HitCoverage=94%, E-value=1e-24, Identity=62%"; Hit description =Putative uncharacterized protein
MKQAALAWRRCERPTPARHVAFTATDIRTGHTAGSFQSRRCPMATCDVCGNDYDKSFTVQQGGRSGTFDSFECAIHAFAPRCTHCDCAIIGHGVEGNGQIFCCAHCASHAGVKGVADRA

SEQ ID NO: 176232 - protein, 123 aa, Glycine max
  Coding DNA Sequence Number=SeqID_84547
GVRKKAQIFQKPDTAPRMMSRGGYEYLEKKLIDEKRKKKLEEAAQSRSIDTAIDPPSSIKQHVKWKLARTKKTGHMTSEAAKEIADKIDAFEEQASQGSFVTQLEDSFTEKVTRQLMLCFSQM

SEQ ID NO: 176233 - protein, 247 aa, Glycine max
  Coding DNA Sequence Number=SeqID_84548
VFQPDAGLAPPGRGDAVQRLDPAHFQDDAQLQMVLQVLAHAGQGVAQRNAAFAQTRRLADPRQFQQLRRIDGARRQHHLARRAHAGGQAVAAHLHADAARAFEQQALGMRARTPSRCSTPAAALVHVEIADAEVVAPVEVRHARNAFLFRRAGEGVEDVPAQPLRLDPPFAAGRRGIHRPRDNGRIAGDLGPLVVVLALPAHVDHAVDRRAAAQHPAARIDQRPPAQPRLGAGAVHPVGAGIADAIQ

SEQ ID NO: 176234 - protein, 81 aa, Glycine max
  Coding DNA Sequence Number=SeqID_84549
  Subcellular localization annotation: CTP_CleavageSite=48; ConfidenceScore=5.12e-01
MARYRGSSTIGWSSLFLFLFTAGSPTAAFIDVVRRDRANGYLFRSPAEAAKKSSNGGPGGFLSRLKAVSVEGTKEIQFTVL

SEQ ID NO: 176235 - protein, 234 aa, Glycine max
  Coding DNA Sequence Number=SeqID_84550
MVMLHLWSSRGGEPDDIRRQIMVIRTPFRHPETIESDGTQRQIMVILHLSSSTGCELDGMRRQIMVIRTPFCHPETIESGGTQRQIMVILHLLSSRGGEPDDMWRQIMVIRTLFRHPKTIESDGTQRQIMVILHLLSSTGGELDGMRRQIMVIRTPFCHPETIESNGTQRQIMVILHLLSSRGGEPYCMRRQTMVIRTPFWHPETIDSDGTQRQIMVILHLLSSRGGEPDDMRR

SEQ ID NO: 176236 - protein, 95 aa, Glycine max
  Coding DNA Sequence Number=SeqID_84551
MQSSLLWLPECYRTSRIVQQCFLLTSGMLRNLTDCATMLPFDLRYVTELHGLPNDGCQVPRSGQTRVASQQMDGPRMKLGYDNLLTSDYFFSTMT

SEQ ID NO: 176237 - protein, 108 aa, Glycine max
  Coding DNA Sequence Number=SeqID_84552
GGEEGGGGGVGSSCGVHCLTYHFFHLISGHNSWGSIVELEAKLHGESKVIQRCFDDNNDDNKEFKIRIKKNSRLEKKIKSQESRFKVQDLKNQDQDSRFKNEEKTQSR

SEQ ID NO: 176238 - protein, 97 aa, Glycine max
  Coding DNA Sequence Number=SeqID_84553
  Homolog annotation: Hit_ID=B0HC01; Match level="QueryCoverage=36%, HitCoverage=74%, E-value=4e-09, Identity=80%"; Hit description =Putative uncharacterized protein
MRKRHASRREKGGQVSGKRQGRNRRAHEGASRGKRLGGGAYGKTPATRPFYGSWPFAGLLLTCSFLRYPTIMWITVLPPQTDTIPLAAADRPSAASQ

SEQ ID NO: 176239 - protein, 79 aa, Glycine max
  Coding DNA Sequence Number=SeqID_84554
MTMLVSACYRTLGSDGRNETFSWSRPEDADIFGKGADDYVSLCMSIRLGVSERRDADNRKVSPRAIGLSGHRIAKNVCG

SEQ ID NO: 176240 - protein, 117 aa, Glycine max
  Coding DNA Sequence Number=SeqID_84555
MAQKLGIPIRHNAPRQSMKTHYLFEEKIYHMTSVVHLVTWNEVCHIGKPINNHKNQILGPLGPWNTKYKIHGNVGPRGGRNWQWSIQTMMHDFGLCLMSYNAIRTKLDNIMFHFRPK

SEQ ID NO: 176241 - protein, 60 aa, Glycine max
  Coding DNA Sequence Number=SeqID_84556
MQICPKFGGGMKAKCQRKRGKCGEGMKKMKVILWMNALLEPKLLNPRKTMNCWKPNPLQA

SEQ ID NO: 176242 - protein, 82 aa, Glycine max
  Coding DNA Sequence Number=SeqID_84557
  Homolog annotation: Hit_ID=A6FJQ2; Match level="QueryCoverage=46%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARRSIHHVRKNHTLPWPLPSLTSHPAPPAIIGFQ

SEQ ID NO: 176243 - protein, 182 aa, Glycine max
  Coding DNA Sequence Number=SeqID_84558
  Gene Ontology: Mol. function=protein serine/threonine kinase activity; Biological process=protein amino acid phosphorylation
  Homolog annotation: Hit_ID=Q9FIH3; Match level="QueryCoverage=31%, HitCoverage=15%, E-value=2e-13, Identity=61%"; Hit description =Serine/threonine protein kinase-like protein
AQYANRLSPRVGRFINAAGTTGFPTGKRAVSATQLIYDHDYEFELGKNLDAFQGFYKFTAEMETLSRLCHPNIVKNLSYWALGPERLLVYEFIEKGSLDQWLHKPDISLSLPPLPWPILVNIIRGMALEEVIRLAGLHEGKVAAQHLHGLRDGSVGEHCHWNPMIAGGAGCDVREGRGQGSV

SEQ ID NO: 176244 - protein, 96 aa, Glycine max
  Coding DNA Sequence Number=SeqID_84559
  Subcellular localization annotation: CTP_CleavageSite=31; ConfidenceScore=5.50e-01
MARAFSLLKVRTCSPLMARACSPLKVRTCSPLMARACNPLKVRTCSPLMARTCSPLKGVKPYEGDRYKYPRVHPYEKARDRLIKRAGHPKSIRFGH

SEQ ID NO: 176245 - protein, 154 aa, Glycine max
  Coding DNA Sequence Number=SeqID_84560
MLPFDFRCVTETYGLCINIFLVFRHVLEFHKLPNDGCQAPHKDQRMVARHRAKAGVDTIEIEWLVKTVEELRAGAEKLSQGNDLLAKGIDGFFEVVMTSGDTLLRSVRIDKTVNDRSPGHNRDMQVVHELCNSLTLHKLDFKDSFRGGLLTDTH

SEQ ID NO: 176246 - protein, 24 aa, Glycine max
  Coding DNA Sequence Number=SeqID_84561
MARRLQEDCARDIREGIHSVGKVP

SEQ ID NO: 176247 - protein, 70 aa, Glycine max
  Coding DNA Sequence Number=SeqID_84562
MDAFENENEINVYFHHEVDPILEEVPQMLYLECDPIPEAVENEDHLDDVPVAGHEEDDGGGEREVGAGEH

SEQ ID NO: 176248 - protein, 191 aa, Glycine max
  Coding DNA Sequence Number=SeqID_84563
  Subcellular localization annotation: CTP_CleavageSite=29; ConfidenceScore=5.49e-01
MHQMVESSKKRKGSTSTTTATSQRCHGTSGDSTAPPNPTISSPCSLTLFSFNDQCQSQGVPFEDTLVDDWKHIYSNHDARKMAHLVRYRVHKALRANAPLSYPQLVTLFLQHFNVPLDEEPFVKVKCSFAIGAAAVASFGYRKDMDGQWVWKQDLSPTVPDESTPSPTPQRDSSSSLLHDVLTKLQDLRAF

SEQ ID NO: 176249 - protein, 71 aa, Glycine max
  Coding DNA Sequence Number=SeqID_84564
IHDVGYNVLDILPENTGGAAQCTTQIFRKNDRSHPAQEVAVQKRTLLYKHGGCTSSVLSPGLKSYFVSFGT

SEQ ID NO: 176250 - protein, 121 aa, Glycine max
  Coding DNA Sequence Number=SeqID_84565
  Homolog annotation: Hit_ID=Q94LG0; Match level="QueryCoverage=89%, HitCoverage=8%, E-value=3e-07, Identity=31%"; Hit description =Putative retroelement pol polyprotein
MEMGGDLHNHINKFNQLLMRCKQIKEDLKKLRDMNKDGTNSQTNVVKSVEDEDVVFLAINNEVAKTKWVMDFAASKHICIDREMFDTLKTDGEFDHFKLGNGKKMKFGIGSVRMKLHDGVV

SEQ ID NO: 176251 - protein, 197 aa, Glycine max
  Coding DNA Sequence Number=SeqID_84566
  Subcellular localization annotation: CTP_CleavageSite=54; ConfidenceScore=5.02e-01
HPSSNNVCKVFFDVGQCGFCGVPATTIWVFRHCRGFCGFQRGQCGFSGNVGGSVASTDDNVGVEGAVSGRFQAGGERGAISGRRMTKRRGRASAKVDVSLSELNALSECHPLSEASTRLANRRNLEGNLSHRHTLSASLARSASRLSPSRLSASLAPSENSLTRAKRENGAKRDVEICEFLSDCEIPKSGGDIPTPL

SEQ ID NO: 176252 - protein, 53 aa, Glycine max
  Coding DNA Sequence Number=SeqID_84567
MEHGIPCDPPQLMQSYPPSALDRRLQEDWARDAREGPRVLMSLRVDFEPMGLV

SEQ ID NO: 176253 - protein, 223 aa, Glycine max
  Coding DNA Sequence Number=SeqID_84568
  Gene Ontology: Mol. function=RNA-directed DNA polymerase activity; Cellular component=chromatin; Biological process=chromatin assembly or disassembly
  Homolog annotation: Hit_ID=Q10PF2; Match level="QueryCoverage=37%, HitCoverage=8%, E-value=4e-09, Identity=41%"; Hit description =Retrotransposon protein, putative, unclassified
MHALLGSFNSGNWSDSDDLDRTGLSCVLSRGIEAWLKIKPYQQKSITKGPLQKFLCRYPGPFKVRRRIRVVAHLLDLLASAKLHSVFHVSLLCCYIGPPPTTLTSLPKEVCSIKEDQEFIATEKEKATFESPHSPDAQVPSTWKVELNIALFDQSTSFNSNSKTVCLASTHTTQDTNTGSSPSSDQVMIRVHPATSESTPLATNTDVPQQILDTSLVIEDETF

SEQ ID NO: 176254 - protein, 46 aa, Glycine max
  Coding DNA Sequence Number=SeqID_84569
MDILILASRLELFDTSYCARRRIIQYFGQGCGKYPREGQKGVREAE

SEQ ID NO: 176255 - protein, 130 aa, Glycine max
  Coding DNA Sequence Number=SeqID_84570
MEIIIQQAQGSTQSIIYKLNMGARDSSFMNKHYQICHSKFATEVPEGSGVAGVGAGSAGGGAGTGGVEEEGVEVSGPLALVLRVPRKVIMGSSRAKGLKSQRIGYYSSGYAQSCKMCKKAKPRGVELGHL

SEQ ID NO: 176256 - protein, 62 aa, Glycine max
  Coding DNA Sequence Number=SeqID_84571
VSTATDWQKVLANFSVTATNTVILLIFGVKKCLPEWGRVTPFYNKKERFACISDNEPRLTVH

SEQ ID NO: 176257 - protein, 66 aa, Glycine max
  Coding DNA Sequence Number=SeqID_84572
MTDDSYGKKESNRKEPAPKYHYAPKPAFHQSWLVAILDDQVLHKDVWIFRLLFGQRDKYGTLGSTD

SEQ ID NO: 176258 - protein, 164 aa, Glycine max
  Coding DNA Sequence Number=SeqID_84573
  Homolog annotation: Hit_ID=Q6VPE8; Match level="QueryCoverage=26%, HitCoverage=5%, E-value=2e-07, Identity=55%"; Hit description =Putative gag-pol polyprotein
MEAGYLLLGSPWQYDRKIIYNGLTNEITLTHLGTKFVLHPQTPSRKKKDSKALSSKAKGKEKEEKDSSKKIVKKENHFTTKRNIKRALLLEQSFYLLLSRETSLSTAIPLELEVIPQVKELLNEGMARKSLNPCVFGTQNRYYEAPNPYDRWYDECVKWCNLLL

SEQ ID NO: 176259 - protein, 150 aa, Glycine max
  Coding DNA Sequence Number=SeqID_84574
LCQSFGVPVAHTKVIRPPITRAFIEKYCTQRQAQGDAPQAAGAPPPPHQAGPVGSFDVEQYLRHLVRQQAANHRAHVQTHDCLYQLSLSMQSQGFASFSCPTPDQFRAEVAWPGDWPEAQAGEAPPGAPNDGEEAHEDEEMADLLDFLGG

SEQ ID NO: 176260 - protein, 133 aa, Glycine max
  Coding DNA Sequence Number=SeqID_84575
  Gene Ontology: Mol. function=homocysteine S-methyltransferase activity; Cellular component=cytoplasm; Biological process =methionine biosynthetic process
  Homolog annotation: Hit_ID=A4W733; Match level="QueryCoverage=100%, HitCoverage=42%, E-value=2e-65, Identity=90%"; Hit description =Homocysteine S-methyltransferase
  Pfam annotation: Domain name=S-methyl_trans; Domain location=1-133; Score=-75.2; E_value=0.00042; Accession=PF02574.7; Description =Homocysteine S-methyltransferase
ALAALLPEYPRARAWFSFTLRDSEHLSDGTPLREVVDVLANSPHIVALGINCIALEYTTAALKHLQSLTALPLVVYPNSGEHYDAVTKTWHHHGEACETLAGYLPQWLAAGAKLIGGCCRTTPKDIAELNAKR

SEQ ID NO: 176261 - protein, 150 aa, Glycine max
  Coding DNA Sequence Number=SeqID_84576
MDEIEKVQEQMKADPEALKEKMATMVEAMMSIKEIVEVSAAYQTRARAKIMGEVEKVQEQMKADMEAMKEQMVGKDLGSTDDPMMCKFKTSTPSHHMACLPTIHHPMWLTLSMKISITPFRYSLRTNNLNLIRHISLKPWGRHMKFPTRI

SEQ ID NO: 176262 - protein, 151 aa, Glycine max
  Coding DNA Sequence Number=SeqID_84577
  Gene Ontology: Mol. function=beta-lactamase activity; Biological process=beta-lactam antibiotic catabolic process
  Homolog annotation: Hit_ID=P62593; Match level="QueryCoverage=29%, HitCoverage=15%, E-value=4e-17, Identity=100%"; Hit description=Beta- lactamase TEM precursor
GERGSRGIIAALGPDGKPSRIVVIYTTGSQATMDERNRQIAEIGHHFKNSVAPPTYLALLILLPVAAASGDKSCLTGATLPEGRKADRYPVSGRVGTGERTRELPGGNACLWKNASNAAFLRFLAFCWPFAHMFFPALSPDSVDNRITAFE

SEQ ID NO: 176263 - protein, 108 aa, Glycine max
  Coding DNA Sequence Number=SeqID_84578
  Homolog annotation: Hit_ID=Q51617; Match level="QueryCoverage=37%, HitCoverage=59%, E-value=1e-14, Identity=95%"; Hit description =Putative uncharacterized protein
  Subcellular localization annotation: CTP_CleavageSite=36; ConfidenceScore=5.02e-01
MTVKTSDTCSSRRRSQLVCKRMPGADKPVRARQRVLAGVGAGLTMRASEQIMRKEKIPHQAPFAIQAAQLLGRAIGAGLFAITPAGERGMCCKAIKLGNARVFPVTTL

SEQ ID NO: 176264 - protein, 95 aa, Glycine max
  Coding DNA Sequence Number=SeqID_84579
  Homolog annotation: Hit_ID=A5AK77; Match level="QueryCoverage=90%, HitCoverage=10%, E-value=9e-11, Identity=39%"; Hit description =Putative uncharacterized protein
MAQPPPHERTLREMAAPDFTYKSLCIQYPDEDVPYVLKTGLIHLLPKFHGLAGEDPHQHLKEFQIVCSTMKPSDVQEDHIFLKAFPHSLEGVAKD

SEQ ID NO: 176265 - protein, 182 aa, Glycine max
  Coding DNA Sequence Number=SeqID_84580
  Homolog annotation: Hit_ID=Q2HTA0; Match level="QueryCoverage=57%, HitCoverage=17%, E-value=4e-13, Identity=42%"; Hit description=IMP dehydrogenase/GMP reductase, related
  Pfam annotation: Domain name=DUF1723; Domain location=105-154; Score =52.1; E_value=1.9e-12; Accession=PF08330.1; Description=Protein of unknown function (DUF1723)
MVRTRSLGRTLGKVIGRTLKREDNRDSDEASQRRRPITSACRQQEVVVVAKEHPHVDDAIEEECPELKLSSHGREVQKFGRPTAEIEGLVAVTGLSPLIACSLDTSDQGLISTFMERWHKETSRFHLPVGEVTITLDDVASLLHLPIIGAFHTFETLYVNETVLMLVELLEVSGDEARAKTV

SEQ ID NO: 176266 - protein, 158 aa, Glycine max
  Coding DNA Sequence Number=SeqID_84581
  Subcellular localization annotation: CTP_CleavageSite=49; ConfidenceScore=5.43e-01
MTTPPRSPPPPIDATSYSPSTLKRTRKATRLRSLATRPVGAERPLVHVDPATGKADGPHRKKLRTYLGIVACDKVDVTYENWKQVTTAQKDLIWEDIQPTRTVSMTLYAKSTTLARRSGPNFAKAAETLHGWMCERRHMSFGNKTLSLTCCPMGVMSF

SEQ ID NO: 176267 - protein, 122 aa, Glycine max
  Coding DNA Sequence Number=SeqID_84582
MEKIFQHWSLGASRNSNRRRKVWWIVGTRSIWNFRNDMIFNNQPFVISKLVDNSIFLTWSWLRGWEKDFNVPFHQWSSNILFSIFVVLLQGSREKDGSGGATMAAEFLEETVGLAVQQQGAD

SEQ ID NO: 176268 - protein, 171 aa, Glycine max
  Coding DNA Sequence Number=SeqID_84583
  Homolog annotation: Hit_ID=Q6UUU1; Match level="QueryCoverage=50%, HitCoverage=55%, E-value=1e-18, Identity=61%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPGVSPWRLPRALSCSCLSVYRCHSAVWPRLSHSTPDTQFRVGSSLQAGLYARTPVQSDRCALS

SEQ ID NO: 176269 - protein, 103 aa, Glycine max
  Coding DNA Sequence Number=SeqID_84584
PHRVEVERSPYVVARGPQVYPSNLPNNWYQSQVQVGDRLRRVCKYRRWPEWLAPQHAPQVERGGGDVLGYKCEVKSHIRSPYVVARGPQVYPSNLPNIALLPK

SEQ ID NO: 176270 - protein, 27 aa, Glycine max
  Coding DNA Sequence Number=SeqID_84585
MAFLCFLRTSSNKGCRDDCQKFFLVLQ

SEQ ID NO: 176271 - protein, 153 aa, Glycine max
  Coding DNA Sequence Number=SeqID_84586
MESHFAIKANIKETSLLRQPPHLLFCKRTLVSIAIPLDLEVIPQVKELLDEGLVHKSLNPCALLVPKIGIIRHQIPKIGGMMNVLSGTILSCKITHAPNIFMIRIHRGSLGRFALNFGFNTNLGAHMGHLSDQEVPMDPKRIKIIPEWPLHQV

SEQ ID NO: 176272 - protein, 178 aa, Glycine max
  Coding DNA Sequence Number=SeqID_84587
MASRKRVRTEDIPSSSTPVPPSVTVGQDVQSSQTLIPMLQSLFRGQFIIMHSLQELAHNKPIITMEHFLEQVAWPQAQLPLVRPNKAALPEPTPVQVDPEPTDPQSPVVNPLSSPEREVVPPSPPLIIISDASSDEAATPPDSPARETADLPTSPVGGIADLFYSPSGEVVALTDSPV

SEQ ID NO: 176273 - protein, 95 aa, Glycine max
  Coding DNA Sequence Number=SeqID_84588
MQSSKRNVYLGAYLNGGHWQMVVILPKEYLVVWFCSLHNRPYNYLKGIINSALKGLDDAPQPKSKTAARWIVVKTIGAREIKGASDPVGTILSPS

SEQ ID NO: 176274 - protein, 271 aa, Glycine max
  Coding DNA Sequence Number=SeqID_84589
  Homolog annotation: Hit_ID=A1FZI0; Match level="QueryCoverage=13%, HitCoverage=10%, E-value=1e-13, Identity=97%"; Hit description =Putative uncharacterized protein
VARNGLRAWAVTSGNEVIDRPYETWKDGIDKSFTPEAFAAGLPGCAAGRRLDRPVGLRLARCGRPAGAAASEHGGAVCVRAWCGTGGARTARAGSDRAPGAVRAAAGSAAVFRQPGGRRVVAVADADGTDWRHQHDGRMGVAGDQCVEAVTAAEIGQARHRCAVSFCRAEPCSASSEATRFCLCSLVPSCGHALIAPGFRHEGLSRWPASSTSATVRRRFRAGCRGGSSDGSRVHRHGPAATRTRRWLRTILRPARRPACRCPARGRCGVR

SEQ ID NO: 176275 - protein, 365 aa, Glycine max
  Coding DNA Sequence Number=SeqID_84590
  Gene Ontology: Mol. function=pyruvate dehydrogenase (acetyl -transferring) activity; Cellular component=mitochondrial matrix; Biological process=metabolic process
  Homolog annotation: Hit_ID=A9CJ32; Match level="QueryCoverage=100%, HitCoverage=84%, E-value=1e-170, Identity=78%"; Hit description =Pyruvate dehydrogenase beta subunit
  Pfam annotation: Domain name=Biotin_lipoyl; Domain location=2-64; Score=61.6; E_value=2.6e-15; Accession=PF00364.13; Description =Biotin-requiring enzyme
  Pfam annotation: Domain name=Transket_pyr; Domain location=99-277; Score=173.5; E_value=5.5e-49; Accession=PF02779.15; Description =Transketolase, pyrimidine binding dom
  Pfam annotation: Domain name=Transketolase_C; Domain location=291 -365; Score=63.3; E_value=8.2e-16; Accession=PF02780.11; Description =Transketolase, C-terminal domain
  Pfam module annotation: Pfam domain module=Biotin_lipoyl::Transket _pyr::Transketolase_C; Domain location=2-64::99-277::291-365
MEEGTLSKWLKKEGDKVTSGDVIAEIETDKATMEVEAVDEGVIGKLLIDAGTEGVKVNTPIAVLIQEGESADDISSSAKKEEPKAEAANSGSDAAGGKTREATEEPSASKEAAKVPAAPKIEVAADPDIPEGTEMVMTTGLLDEFGPKRVVDTPITEHGFAGVGVGAAFAGLRPIVEFMTFNFAMQAIDQIVNSAAKTLYMSGGQMGAPMVFRGPSGAAARVAAQHSQCYAAWYSHIPGLKVVMPYTAADAKGLLKAAIRDPNPVIFLENEILYGHHFDVPKLDDFVLPIGKARIHKQGKDATIVSFGIGMTYAVKAAEELAEQGIDVEIIDLRTIRPMDIPTVIESVKKTGRLVTVEEGFPQSS

SEQ ID NO: 176276 - protein, 42 aa, Glycine max
  Coding DNA Sequence Number=SeqID_84591
MDKSLKVGEDEWRERERRSMKFCASNKPTNPRSSPRFSSKCS

SEQ ID NO: 176277 - protein, 76 aa, Glycine max
  Coding DNA Sequence Number=SeqID_84592
  Subcellular localization annotation: CTP_CleavageSite=37; ConfidenceScore=5.04e-01
MGGSDVTSRDLSEVAATSYLTCVSPSSSSTMNDSGTVASDDASSTCYEGWAPGQATLSRNCSMEGMDPGGATTYKL

SEQ ID NO: 176278 - protein, 141 aa, Glycine max
  Coding DNA Sequence Number=SeqID_84593
MVKGMDPKSLFSRRSMESKLTKLPMEVGIGSMSSFKDIDNTASFDKFPMVKGGPREFIFSKEHGVQIDQVAYGSRDGSTKCKDYCHSMKREKHDFGCQGWISTSTKHLLLKQCQKKQQMHRSTSQEAAKVVGASWTEALEI

SEQ ID NO: 176279 - protein, 279 aa, Glycine max
  Coding DNA Sequence Number=SeqID_84594
MKGIDPESLFSSRNKESKWTKLPVEAGIGPSKLTKLPMEAGIGPVSSFKNIYNSLSFDKFPMVKGMDPESLFLKRCMESKLTKLPMEAGIGLVSSFKDIYNPLSFDKFPMVKGMDPESLFSSRNKESKWTKLPMEAGIGPMSSLKDIDNTLSFDKFPMVKGMDPESLFRSRSIKSKLTKLPMEAGIGPSKLTKLLMETGIGPVSSLKDIDNTLSFDKFPMVKGMIPERSLLDFHFNKAFASEAISEEAANAQKYITRSSKSGWSFMDRSVGIMNTMRKF

SEQ ID NO: 176280 - protein, 617 aa, Glycine max
  Coding DNA Sequence Number=SeqID_84595
  Homolog annotation: Hit_ID=A7PLW1; Match level="QueryCoverage=96%, HitCoverage=92%, E-value=0.0, Identity=69%"; Hit description =Chromosome chr14 scaffold_21, whole genome shotgun sequence
MHIDDLRALAPMWLSKTEEVRQDRAHWGVNITGDIYEKGWISEMYGYSFGAAEVGLRHKINDNLMIYPGYAPREGVEPILLHYGLPFRVGNWSFSKADHDEDAIVYNCGQLFPQPPYPREVMQLETDPNLRRGLFLSIECINILNEALLLHHVANGCPKPPWSKYVNFLKSKAFAELTKPKLVTPASLEMMEDTVQEHIDHDTTRPYPKIHTVFSTECTPYFDWQTVGLMHSFHLSGQPGNITRLLSCSDEDLKLYKGHNLAPTHYVPSMSQHPLTGDWYPAINKPAAVLHWLNHANIDAEFIVILDADMIMRGPITPWEFKAARGKPVSTPYDYLIGCDNELAKLHISHPEACDKVGGVIIMHIDDLRKFALLWLHKTEEVRADRAHYARNITGDIYESGWISEMYGYSFGAAEMKLRHTINREIMIYPGYVPEPGIKYRVFHYGLEFHVGNWSFDKAEWREIDMVNRCWVKFPEPPDSSTLDHNDEDNFQRNLLSIECMKTLNEALHLHHEKRNCPKDGSVLESKEDATEESITSWKISNFSENFDSKVNHKSANDSEEMASVLKDGTGIPSSFMVLFLCAFSVSGFLVIIFLVHSGHKRKGMKMKHHRTRRRNL

SEQ ID NO: 176281 - protein, 499 aa, Glycine max
  Coding DNA Sequence Number=SeqID_84596
  Homolog annotation: Hit_ID=A7PLW2; Match level="QueryCoverage=95%, HitCoverage=99%, E-value=4e-69, Identity=35%"; Hit description =Chromosome chr14 scaffold_21, whole genome shotgun sequence
  Pfam annotation: Domain name=TPX2; Domain location=360-413; Score =7.7; E_value=0.097; Accession=PF06886.2; Description=Targeting protein for Xklp2 (TPX2)
  Subcellular localization annotation: CTP_CleavageSite=55; ConfidenceScore=5.09e-01
MYVAEKLNKGDSSACLMQQQPFCYASGFPKEANKSNPNNALGQSVSFGRFMPESLAWEKWSTFSHNRYVEEAERFTRPGSVAQKKAFFEAHYKKLAAQKAAALLEQANSASQTQQEQEEAIVDNTHNLNMTSPKSKLVLLEENAQVFNSEPDATTYNSNSNTDAALPQSDMLGGAQPLIDHQAFVVKLQNQLGKVDNYKEPSEEGTNFDQNILQSTGKKKQAVSSFKLLKVIGTPKFNSTPVKSKSPSHSSKDGIATPMSNNPALTSSKKEGSTSKLPHMSLNFTLVREINKLTVSLVRKFGSTGVGASSSKASKDSSTLIKTTTKASKNESQKHSSLTPLTEAQRSKRKTPIISSPFRLSTEERASIRKKKLEKVCNASESQKVQPHTKFKEKADTKIRKLRQSICFIAGSSPDFYQDREASKKDRLTPPESPKEGRKPTLSVVESKSSLPRNRPFQGKNCGTMTLPRTSNSSMITTHENTSPNIQHRNQNDRNYKQF

SEQ ID NO: 176282 - protein, 81 aa, Glycine max
  Coding DNA Sequence Number=SeqID_84597
  Subcellular localization annotation: CTP_CleavageSite=25; ConfidenceScore=5.12e-01
MTRTTTTRLAQQSSTTTMTTTTTTRVVQRESFWGGLLYDAVSGFHELVDSERTHESTQTRSSLRKFEQVYSDFDSTSDLTR

SEQ ID NO: 176283 - protein, 121 aa, Glycine max
  Coding DNA Sequence Number=SeqID_84598
  Subcellular localization annotation: CTP_CleavageSite=13; ConfidenceScore=5.27e-01
MVLMMPKNNQYKVASTNKHCFKINSRSSFCHKTSVSKRSRLWEIPLGSSICIIYSKGEKSFCSSQKASCNQEAGCLLDCENCNQETGCLMENLEHKGEGSQGVFKVYKGFTEIVQNLKCVA

SEQ ID NO: 176284 - protein, 42 aa, Glycine max
  Coding DNA Sequence Number=SeqID_84599
MVGSWYRIYATKNRKMQGSRMSEHENKRYAVCTTKSMLNAYA

SEQ ID NO: 176285 - protein, 61 aa, Glycine max; identical to SEQ ID NO: 112892
  Coding DNA Sequence Number=SeqID_84600

SEQ ID NO: 176286 - protein, 33 aa, Glycine max
  Coding DNA Sequence Number=SeqID_84601
MNSCYVYCNVVGPVCGDLDLGIVGLDTFSEHGQ

SEQ ID NO: 176287 - protein, 146 aa, Glycine max
  Coding DNA Sequence Number=SeqID_84602
MDQLSQSYGLGSVYGFLEPQAILNANDKCGQCQEYIEKWLKESNRDVYLGAYLNHAFNTLETKSEGKFGHSTPRWIEVKSHVQSGTYECGYYVMHWMWNIIVGQLKTNWTLWFNDGTPLDINMMTTLRKKWAEYFVKLRSIQCTKL

SEQ ID NO: 176288 - protein, 128 aa, Glycine max
  Coding DNA Sequence Number=SeqID_84603
  Subcellular localization annotation: CTP_CleavageSite=30; ConfidenceScore=5.35e-01
MYPLLFSVTTTQVDVPSTCTTKDVPSNVLRQSSQAVSPLKLCEGETKDISGGRRETQKEFRRLVLGKFFLAKGEENEKMNSTLLFSVKEQGLETRKLRKLLAKEEEEEEVQKDVQRKLVIDYQRVKTL

SEQ ID NO: 176289 - protein, 45 aa, Glycine max
  Coding DNA Sequence Number=SeqID_84604
MWVSRERFPAVFRREEKEKSDFTVTKRRGRARLNSKTYTYSFYYR

SEQ ID NO: 176290 - protein, 104 aa, Glycine max
  Coding DNA Sequence Number=SeqID_84605
RYFAIGAGAVTSFGYRKDIDEQWIRKQDLPPPIPDERTPSPLPQRDVSFTLMHEVLSELRGLRAFVGDRLDAMDAYFEGMDTRITQLEDDMGFIFRCFDPPAAP

SEQ ID NO: 176291 - protein, 88 aa, Glycine max
  Coding DNA Sequence Number=SeqID_84606
MGLAFSGIHKIQKKLNEVEDLASNRSLSDDEIKAKRELQQELWEASIAYESLLRQKSRGRQAETSTQIKNRRQVQALFRPRKLLKCGK

SEQ ID NO: 176292 - protein, 74 aa, Glycine max
  Coding DNA Sequence Number=SeqID_84607
MRHFAAQEPQPDQEDDILEASEPTAPEPFIFETDPVAATPQVTPVPDLPLSQDSSVVTTALDLNEHAMDSAQDH

SEQ ID NO: 176293 - protein, 152 aa, Glycine max
  Coding DNA Sequence Number=SeqID_84608
MAEQARQVFYGQDPCDERWCVVLQGKTIGVNVEDDDSYMDTYRQRSPKQDFIQLMFVASFIIHHPFLLCLLTVVYKSKGETKDIELVEEEQARIGADPSSETSNKSENYKEEARNATQKHKLKKVESVNADAEAFGDHWKILIALCILKLNH

SEQ ID NO: 176294 - protein, 111 aa, Glycine max
  Coding DNA Sequence Number=SeqID_84609
MSAIEFSIQSLNEIGMRSVYHRGRLWYFVGTQPPLCFGRHWPALPASDEDMFKSKGKDPLEGLGGPMTRARARKAKEALQQVLSILFEYKPKFQGEKSKVVSCIMAHMEED

SEQ ID NO: 176295 - protein, 280 aa, Glycine max
  Coding DNA Sequence Number=SeqID_84610
  Homolog annotation: Hit_ID=Q8H897; Match level="QueryCoverage=70%, HitCoverage=20%, E-value=5e-08, Identity=24%"; Hit description =Putative retroelement
  Pfam annotation: Domain name=Transposase_23; Domain location=129-199; Score=8.7; E_value=0.00013; Accession=PF03017.5; Description =TNP1ENSPM transposase
MTSEAPKEITEKIDLLEEQASQRSFVSYGRQDVLIVAIGRPEHPGRVRAVRAGVTIKQYFESNPQTSHTSSSMAPEELEQLTQQIRDQLEESIKEKGLALPLEPKVGPSTAHVSIKESCVNPSGNDPDTSDSDKCGLYIEENIPHLVALGRVYEGSITIHNIPLLHDQVKVSVEEVKDADAPVPVPTDEVNLMGHSLNTFLAWLRHLAKRLSEQGVVGPAKPIDRLHHEVMWDATVFGVFNEDFPLPDNYLKGIINSALKGLDDTPQPKSKAGARWIVVK

SEQ ID NO: 176296 - protein, 157 aa, Glycine max
  Coding DNA Sequence Number=SeqID_84611
MNKIQFATSRIIDSKGDFLTLCLLKEKLERKSGQREEGRTQVQVSETLRVGLHCGLCTERMRHKAKGLCHNNIDNCDAIGGGREAASTRARETMRARTFGSKNSSNVLLIVAPIPTSAASFKDSTVTQIGLVNFLPTPLSIAKGFLQNLSVFLLAYK

SEQ ID NO: 176297 - protein, 121 aa, Glycine max
  Coding DNA Sequence Number=SeqID_84612
MSVHVAQLIADAIYLFGDAPQAANAPPPPHQADPAGSLGMERYLQHLVRQQGANQRGQGQGFAPFACPTPEQFRAEVARPGDWPEAQAGEVPAGSPDDAEEARMDEEMTDLLGFLGGSRAT

SEQ ID NO: 176298 - protein, 171 aa, Glycine max
  Coding DNA Sequence Number=SeqID_84613
MQLPQEPLNKRPRGLARKSMAGTNFAELYGVAIVNSSCEGKKETSREHIAWSKRSLSQRLCETETNMLAIIAKYQEELGLAAAHEHRIADEYAQVYAEKEARGRVIDSLHQEATMWMDRFALTLNGSQELPRLLAKAKAMADTYSTPEEIHGLLGYCQHMIDLMAHIIRNR

SEQ ID NO: 176299 - protein, 69 aa, Glycine max
  Coding DNA Sequence Number=SeqID_84614
MALPFSNILPAIVMPISPCGSISWGRAHKTPSGPGEVQQGPRVSNFGYGPLSVHRVPVPPGKVMPSRHR

SEQ ID NO: 176300 - protein, 31 aa, Glycine max
  Coding DNA Sequence Number=SeqID_84615
MNCLPNAVHASSVIKRRASEKEERETGVVID

SEQ ID NO: 176301 - protein, 112 aa, Glycine max
  Coding DNA Sequence Number=SeqID_84616
  Homolog annotation: Hit_ID=A8G990; Match level="QueryCoverage=86%, HitCoverage=85%, E-value=1e-22, Identity=55%"; Hit description =Putative uncharacterized protein
MTYGDAPMTKVPTTESVASTLTLYRQLFNHLDLSAFNPSELLDLAALSAEQAEGLCHGLMLFGQLLQKHPQLDAEGWEQLNRYLNSTAHLVPALCNLYGRALREMEGHAVDE

SEQ ID NO: 176302 - protein, 98 aa, Glycine max
  Coding DNA Sequence Number=SeqID_84617
MVADILSKAQVEKDKSPNGEGRRPKWKRTKSQVEKDEDPSGEGRRPKWRRTKDPSNPCGVYPDLSSFTGSGIIQISAACIKRSAPSPDYIIWYQSFSS

SEQ ID NO: 176303 - protein, 92 aa, Glycine max
  Coding DNA Sequence Number=SeqID_84618
MPSFTIKWHFSQLRTKLVSSHLSNTLSRLDRQHSNEDPKTEKSFINTSIHFSTMSAKIAIIHLQKVAGALQRPKGILLKANTPKGQVNAVLS

SEQ ID NO: 176304 - protein, 94 aa, Glycine max
  Coding DNA Sequence Number=SeqID_84619
MEIKIGGVTSKKGRKIEEKKKIWRRSNPIRARHELSGPGSTRAKRAYEGPKPTSAAINREPVQGTEHITTEPPLLGVSFTPFLSFTPPLIVKPS

SEQ ID NO: 176305 - protein, 467 aa, Glycine max
  Coding DNA Sequence Number=SeqID_84620
  Homolog annotation: Hit_ID=A7WEM4; Match level="QueryCoverage=72%, HitCoverage=31%, E-value=2e-33, Identity=32%"; Hit description =Chloramphenicol O-acetyltransferase
  Subcellular localization annotation: CTP_CleavageSite=34; ConfidenceScore=5.61e-01
MPPMARASTGRARPSARPRRSRPRSPRCRPASCRATAPAACWKGISPAPAPPKPGSSGSASNRTAPGRPARTEHRGPCIGQRERPRHPRMKRAFCHPAAPVARAGSRDVHRRIRAQQDRADRHVAARGRLEQVVGDVAGVHVRAHQQVGLALERGGRQDPQAQRFIQRAVAVHFAVDLQFRLGLAHQFQRAAHLGARGRAARTEVRARQQRHLRRQEHALHFLGRGDGELGDLLGRGFVVDVRVHQHHRALVEQQDVHGGVDVAARPAADHFVDEAQVVVIGADRTADHAVGIAQVHHHRADQGHAAAHFHARHFLGDATSAHALPVRGPVLMEAFVVFRVGDFDVLAQAQAQAQFLDTGQQHRGTAHQDGTGQAFVHHYLHRAQHALVLAFGEHDAGRAAFAHDALGGREQRLHEGAGVVHELLQLLFVGFQVGQRTRGHAAFHGGLGHCRRDAHDQARIERLGNQ

SEQ ID NO: 176306 - protein, 73 aa, Glycine max
  Coding DNA Sequence Number=SeqID_84621
MHWIWNIITSDIKSDWSMPFDDDYRSHHGCLHPFRKNISWRIRSISRRIVEDCLSWQFPIDSLRQSPSDKWAF

SEQ ID NO: 176307 - protein, 564 aa, Glycine max
  Coding DNA Sequence Number=SeqID_84622
MASKKRKAPATPSQVRYEQSRFTSPEAWESYTDILVPRKLLPERNVVIYHTEFDEFKEELERRKWDEELTSFDESPKQVMVRGHLVIFWKEFYANIYDPEDKSPKQVMVRGHLVKFDVDTLNTFLKTPVIIEEGEELTAYSRFALLRLDPQELAAKLSIPGRGFELNVDGLPLKILRKNITIHAQTWSVLSYSNLVPTYHTFDITLDWANMTPLGLDFQALIITLCKARGVTSDSRSLESLSPAINLAYIKKNYCNLDDPIVTFRGPRKVRGKRSKAPSTSATPDAHAPSSSTLPDPSTPPISTPHLPSVPAPAPPIGPSSFTSETLFAMLQSLHKGQIIIQEQFKNQEKFDFKIQESSFKIQESSFKFQGTSFVVQVEGTSTWVAVTENKRWYISCGSVLVEGTSTRLFKENKEGYIPCGSLLSSGQQPAMSVEEFLAQASVAQEPVPVEEPMPDAEDEPVPLEPFIFEIDPVAQEEAAAQEPTSPPFAPASEPDQPIVQDPSAAPVLDLNEDAEDHPQEDWQDLYLLPLEEKEHVIRSITENVSQFVKLIVKECIDRIPVKV

SEQ ID NO: 176308 - protein, 134 aa, Glycine max
  Coding DNA Sequence Number=SeqID_84623
MVDVEPIMVEKLGVNDQKDKIEDRDIKGGDKSLYGSWMLVKRKNIQKLHCAQKGCLTTSVKSIELRRFLEVHLQDEECFSLSTCLWKWTRHLGLIWKIYQMLQTKHPTSEWSYIKVYIRMMKNLTLKTKLQNGV

SEQ ID NO: 176309 - protein, 119 aa, Glycine max
  Coding DNA Sequence Number=SeqID_84624
MRSFNCDFPPWRCSGGKRKRGEGRHHPLGNKPWKKELHHQECALDKKLEEDALMEERKERRGQHGIEGIKEGEKWNFEVSHKTFIHQKRASTFTSKSWSKKTWIMDKIVPKVVDADILG

SEQ ID NO: 176310 - protein, 148 aa, Glycine max
  Coding DNA Sequence Number=SeqID_84625
  Pfam annotation: Domain name=zf-CCHC; Domain location=109-123; Score =17.3; E_value=0.0037; Accession=PF00098.14; Description=Zinc knuckle
  Subcellular localization annotation: CTP_CleavageSite=33; ConfidenceScore=5.24e-01
MTLSRNGCGSHNGSFTEVYKRSSPSRKQVTRILQEIRSGLVLNSTWILRFNESLRRKSRSSFKALKVDNSSDEDSKEEFDEDELAFISRKIEGCRRKKKDKDKISIISYRCKKTGHFKSECPKLEKGQSKKKHYKTKEKKGLMSTWEV

SEQ ID NO: 176311 - protein, 86 aa, Glycine max
  Coding DNA Sequence Number=SeqID_84626
MPFKDHIKLRTPLPRGSSLCEGKYSEQHIDSDSETYLIFTSTHCSSQVAFKGKREWYNIPPSYLRIAKSPLNNGKWKLELKELIGA

SEQ ID NO: 176312 - protein, 55 aa, Glycine max
  Coding DNA Sequence Number=SeqID_84627
MKSLRGKEIALVKVQWGTDEGDSTWELEDRMRELYPMYAYVFLIEVGIVGARYAG

SEQ ID NO: 176313 - protein, 107 aa, Glycine max
  Coding DNA Sequence Number=SeqID_84628
MIVIMTTGIATNMTVVTATATTANNDSHVGGDDSGHDNDHSGGGDNNNNDNNHEHGEVSVDTVGGHVEAVGHITTFKTIAKTHHRRHQTAKAHHQTARFSLNGQIQA

SEQ ID NO: 176314 - protein, 468 aa, Glycine max
  Coding DNA Sequence Number=SeqID_84629
  Gene Ontology: Mol. function=transferase activity, transferring glycosyl groups; Cellular component=integral to membrane; Biological process=metabolic process
  Homolog annotation: Hit_ID=Q8S342; Match level="QueryCoverage=98%, HitCoverage=98%, E-value=1e-160, Identity=58%"; Hit description =Putative anthocyanidine rhamnosyl-transferase
  Pfam annotation: Domain name=UDPGT; Domain location=9-465; Score= -88.0; E_value=3.6e-06; Accession=PF00201.9; Description=UDP -glucoronosyl and UDP-glucosyl transferase
MARTEEKLHIVMFPWLAFGHLIPNLELAKLIAQKGHNISFVSTPRNIERLPKLSPNLASFIKFVKLPLPKVDKLPENAEATTDVPYDVVQYLKKAYDDLEEPLTRFLESSKVDWLFYDLIPFWAGTVASKLGIKSAFYSICTPPCMGFLGPPSVLMGEDPVRTKLKGFTVTPPWISFPTTVAYRYFEMMRNSDAVSDNDSGISDMYRFGAVIKNCDIVVIRGCTEFEPEWFQVLENIYQKPVLPVGQLINREFEGDEDNITTWQWMKDWLDKQPCGSVVYVAFGSEAKPSQDEVTQIALGLEESKTRFFWVLRVQRGPWDPDVLRLPEGFEERTKGRGIVCTSWAPQLKILSHVAVGGFLTHSGWTSVVEAVQNEKPLILLAFLADQGLNARVLEEKKMGYSVPRDERDGSITSDAIANSIRLVMVEDEGRVYREKIKEVKDLFVNTVRQEKYIDELLHYLSRNLSNC

SEQ ID NO: 176315 - protein, 161 aa, Glycine max
  Coding DNA Sequence Number=SeqID_84630
MTIHHPNQLAIPHIAVIQNPNVTFSLIVSRIPLHVAIRIPKHKRSLLLSKGSKMTGDLMNTSFELTSYGQYSIETDIDPLDESISRSSSYEFSSRSSSGSSSSTSSLMLDGCIEVGHDVVGWLDVVVRLAHFKSLYFHMYIMHHHIEERRLFLKVKNFFGA

SEQ ID NO: 176316 - protein, 196 aa, Glycine max
  Coding DNA Sequence Number=SeqID_84631
MVSNPSRAQKKVKTSKKKQDECSQAALNRLDKWFTNESKKNGYKMTGTFYPELVKVFYTCARDDLKGNLFSTVNEVEMVIDAAVWKEVASLDMGGVRKFDETPDGNLRNSFGVGGLTAKDRMLVYLITYTLTPRSSNHAQSNLLVDYEFSYIVLALRFIDYFNVDVSNEIVDYTKASSEITERHLKKLGMRFVDHE

SEQ ID NO: 176317 - protein, 392 aa, Glycine max
  Coding DNA Sequence Number=SeqID_84632
  Gene Ontology: Mol. function=transcription factor activity; Cellular component=nucleus; Biological process=regulation of transcription, DNA-dependent
  Homolog annotation: Hit_ID=Q52QU2; Match level="QueryCoverage=57%, HitCoverage=56%, E-value=2e-32, Identity=34%"; Hit description=AP2 -like ethylene-responsive transcription factor AINTEGUMENTA-LIKE 6
  Pfam annotation: Domain name=AP2; Domain location=159-219; Score =18.1; E_value=0.013; Accession=PF00847.11; Description=AP2 domain
MAGATKNWLTFSLTPMETQFGPYDITTPSHCFNDNNFYGWANSKGVMDSQSETQQLAVPKMEDFYFGDHQQDLKAIVPGFKALSGTNSVDDSAPNKTTTRVAPAELTGAHSGESCKGSALSLCDVAANGSDDSNDNKAIVAVGFDTRKKVAVQLSFIEIEVMVVMNFGQHRWTGRYEAHLWDNSCRREGQARKGRQGGYDKEDKAARAYDLAALKYWGPKATTNFPIFFLPIPFTFHPPPVYTVYSPFLFSIVIITATTTLVSWQPPPSPITSFTESASPPWTFFVRSKPLGTQSRRMRILCVLDFDGGRALCQRLSYLVGVVCLHGNRLVAPPEAFYREVLSAMRLRIVPRIQRRTSLVAFGSAEGKLTAATTVSSGTRFSSAVDDDDETI

SEQ ID NO: 176318 - protein, 226 aa, Glycine max
  Coding DNA Sequence Number=SeqID_84633
MELDEFKAELERRNFHKRLTNLANSNIELALVKEFYANLYSPEGPSPKQVRIRGHLIKIDADSLNTFLETPMVLAEGESLPAYSRYCRMSIDIREIEAALCIPGRGFVLNAEGHPRKILRKDLTTLAQVWSVLSYSNLAPTSHTSDLTLDRARLIFDLVSQLDMNVGALISIQITSIAQSNSSRLGFPALITTLCRSRGVASDSLVFERLSLVINLAYIRKNCWNL

SEQ ID NO: 176319 - protein, 30 aa, Glycine max
  Coding DNA Sequence Number=SeqID_84634
SEEKLEESPETARDATIVVGRHVSPLRSKG

SEQ ID NO: 176320 - protein, 120 aa, Glycine max
  Coding DNA Sequence Number=SeqID_84635
MAAQLIHDCMVMECLEGVWETLEGNERCRFRGTIRLTATSLILPTPTPYRLVEQVQVIEVSSSEEDPEENPEELPPEPVVDDLGLPEDDEDPLPDVDSPEDIMSASEQTLQKRRPWRDSE

SEQ ID NO: 176321 - protein, 87 aa, Glycine max
  Coding DNA Sequence Number=SeqID_84636
MAARGGHRCSWLVEKEISLSELVSLSGSPLFALSATPSTLRLAQRANSHSTQFPLGLELRLERPSCLARHQKMLFSKSQRLDYGEMS

SEQ ID NO: 176322 - protein, 221 aa, Glycine max
  Coding DNA Sequence Number=SeqID_84637
SSAASEFDSHRFRSAEHQQCFEGIRGWSFHKERHVQLREDEYTDFHEEIARRRWTPLVTPIAKFDPEIALEFYANAWPTEEGVQDMRSWVRGQWIPFDADALSQFLGDPLVLEESQQCEFSQRRNRADGRRVRIMHTSMTTLTQTWMTLLLSNVMPSDHNSDLPLPKFQLVYAILTRMSVHVAQVIANVIYLFAVPITPSKVIRPPITRAFIEKYCTPRQE

SEQ ID NO: 176323 - protein, 151 aa, Glycine max
  Coding DNA Sequence Number=SeqID_84638
MTDPLDESISCFLIKVDPWVLVPITFRGLHILAYRGLHALAFRGLRVLVFSVLHIHTLREYKGSRPQDTQWTRRSPTGSWSCQALITGLCQFYGVPVTSSKGIRPPTNRAFIKKYCVPRQAQGETPQQLGDGQQWATDAPPSPLDFTSAHP

SEQ ID NO: 176324 - protein, 114 aa, Glycine max
  Coding DNA Sequence Number=SeqID_84639
VHLLGLLTENKRGYISCGSVLVEGTSTRFKENKGGYIPCGSLLVKGFLQGYIYLGCYTENKRGYISCGSVQVKGTSTWLFKENKGGYIPCGSLACKGFYKVERNLKNRWLLENW

SEQ ID NO: 176325 - protein, 110 aa, Glycine max
  Coding DNA Sequence Number=SeqID_84640
  Subcellular localization annotation: CTP_CleavageSite=30; ConfidenceScore=5.43e-01
MAPRKLASKRSRKDKAAEGTTTALGALNTSSASRPSRGGHFSGSDASNSGTSSPAVGITGYPHGQWIPFDADAISQFLGYPLVLEEGQECEYGQRRNRSDGFDEEAIGQL

SEQ ID NO: 176326 - protein, 187 aa, Glycine max
  Coding DNA Sequence Number=SeqID_84641
  Homolog annotation: Hit_ID=UPI0000ECBAF8; Match level="QueryCoverage =21%, HitCoverage=48%, E-value=2e-16, Identity=100%"; Hit description= UPI0000ECBAF8 related cluster
LGHHFKNSVAPPTYLALLILLPVAAASGDKSCLTGATLPEGRKADRYPGETPGIFIVLSGFATSDLSVDFCDARQGGGAYGKTPATRPFYGSWPFAGLLLTCSFLRYPLILWITVLPPLSELIPLAAAERPSAASMQAWHWPSFYNVVTGKTLALPNLIALQHIPLSPAGVIAKRPAPIALPNSCAA

SEQ ID NO: 176327 - protein, 88 aa, Glycine max
  Coding DNA Sequence Number=SeqID_84642
  Homolog annotation: Hit_ID=A5BKB9; Match level="QueryCoverage=57%, HitCoverage=4%, E-value=7e-07, Identity=52%"; Hit description =Putative uncharacterized protein
MVVLCKFRRRHQRAIIDIYVGNLDTSRRTAPSLDSKRKGFLIIQTISPNEKFVFMGNRVKSLVEVVKTYRLKLDTGHHLDLLETLYFI

SEQ ID NO: 176328 - protein, 206 aa, Glycine max
  Coding DNA Sequence Number=SeqID_84643
  Homolog annotation: Hit_ID=UPI00016621D1; Match level="QueryCoverage =87%, HitCoverage=40%, E-value=2e-13, Identity=32%"; Hit description =UPI00016621D1 related cluster
MRGPLKESTSCFLVRLKSFGTCTYWLAFRGLHVLTFRGLHALAIRGLHVLTFVGLHALTFRGLHVLAFRGLHVLAFKGSWLHVLTFVGLHALTFRGPHVLTFRGLHALAIRGLHVLTFVGLHALAFRGLHALTFRGLHVLANRGLHALTLRGLHVLASRGLHDLTLRGLHVLANRGLHALTSRGLHILALRGLHALTFRGLRVLIF

SEQ ID NO: 176329 - protein, 115 aa, Glycine max
  Coding DNA Sequence Number=SeqID_84644
MGLLEYRKENAELRDINVATTKALEQETKRACREEHDWNKSKRNLSQWLCETETNMLAIVSRYQEELNLATTHEHRVADEYAQVYAEKEARGRVIDSLHQEATMWMDLFALTLNG

SEQ ID NO: 176330 - protein, 385 aa, Glycine max
  Coding DNA Sequence Number=SeqID_84645
  Gene Ontology: Mol. function=transferase activity, transferring glycosyl groups; Biological process=antibiotic metabolic process
  Homolog annotation: Hit_ID=Q2JEH8; Match level="QueryCoverage=96%, HitCoverage=94%, E-value=8e-34, Identity=29%"; Hit description =Glycosyltransferase, MGT family
  Pfam annotation: Domain name=Glyco_tran_28_C; Domain location=215 -370; Score=-0.8; E_value=2.5e-05; Accession=PF04101.7; Description =Glycosyltransferase family 28 C-terminal domain
  Pfam annotation: Domain name=UDPGT; Domain location=1-382; Score= -174.3; E_value=0.08; Accession=PF00201.9; Description=UDP -glucoronosyl and UDP-glucosyl transferase
  Pfam module annotation: Pfam domain module=Glyco_tran_28_C::UDPGT; Domain location=215-370::1-382
PTLSVGVSLIARGHEVKWFGITQLGDEHIPEGGSYFYPEEDLIPYQDEIKRILKRQDDGPACSGPEVMKLALEETYVPFAKMMMPGLSRLTENWKPDVIVNDCITFGGALFAHKHNIPCVTTTPVPPDVMGDTEKSAPKIFEWQQNLIKDLQKEVGIDDDGIFIHSHKLNLVFTSQAFAGFETVPDHMKFVGPVKGRPNDAPFDWDRLHAATTPKIFVSLGTLLVDIRKAFFEKIIAAFSDQPVTIVAATPPDIFEEWPSNFIVNSFVPQSALMPHMDMVICHGGFNTVNDTFRNGLPMLITPIAYDHFHIAKLIEQAGCGKSIRYKRLRIDSLRETVFELLEDPAYRNAAKEVQTTFLTAGGNDKAVELLENFVQQEQSTLVSV

SEQ ID NO: 176331 - protein, 75 aa, Glycine max
  Coding DNA Sequence Number=SeqID_84646
MDSLEEQTSQGSFVAHGRQDVLIAAIGRPEHPGYVCVAGAGVMIKQYFGLTPRTSHTSLFMAPEDLEQLTQKIKD

SEQ ID NO: 176332 - protein, 185 aa, Glycine max
  Coding DNA Sequence Number=SeqID_84647
MDGHIDVALVKEFYLNLYDLEDKSPKQVRVKGKLIKFYATSLNAFLETPPLIQPGDQYPSYSIFCRMRTDPQELASKLCIPGHEFVLNAEGAPWELLRMDLTTLAQTWSVLSYSNLATTSHTFDLNMDRARLFHGLVMKMDMDVGFLISHQILQMAQSNSSRLGFPTLITALCVAQGVISDSLTF

SEQ ID NO: 176333 - protein, 142 aa, Glycine max
  Coding DNA Sequence Number=SeqID_84648
FTRNSPQISASPHQLDLAPYASEPYNAQWNAPGLLRDKHTLRSSRILGEMEVDEPWLGLWLPLNYQVDMGANFVVDLGMAFVDKWAVGKEKVCYWLSNDIVGLVGNLAVQGWQSQHGMIKFASFQIHFDPFTGEDQIRKALR

SEQ ID NO: 176334 - protein, 105 aa, Glycine max
  Coding DNA Sequence Number=SeqID_84649
LAPYASEPYNAQWNAPGLLRDKHTLRSNRILGEMEVDEPWLGLFHCKIHFLVGVLVYAKGMAFVDDWVVGNEKGCYWLSNDIVGLVGNLVTHFDPFVGEDHIIKA

SEQ ID NO: 176335 - protein, 34 aa, Glycine max
  Coding DNA Sequence Number=SeqID_84650
LLKLQTLDQTLVSREKHQLCKEVRQAGPVGIPDN

SEQ ID NO: 176336 - protein, 400 aa, Glycine max
  Coding DNA Sequence Number=SeqID_84651
  Gene Ontology: Mol. function=ATP-dependent helicase activity; Cellular component=extracellular region; Biological process=DNA recombination
  Homolog annotation: Hit_ID=Q5WTN0; Match level="QueryCoverage=95%, HitCoverage=18%, E-value=5e-85, Identity=44%"; Hit description =Putative uncharacterized protein
  Pfam annotation: Domain name=Helicase_C; Domain location=253-329; Score=65.2; E_value=2.1e-16; Accession=PF00271.22; Description =Helicase conserved C-terminal domain
MLIFRELARRPKRGNNLETLGLISLRYDQIQKIEKLPEHWSSYKLTLSDWHDFLKICIDYYVRAGSSIETNGKPWRDWLSLRLPQTWLKPQDAEPAKGIRLWPKVKRANSRSILVNLLQNVLNIDASTAYGEDIVDSILNSAWKALESNIFKSSSSGYLLSLESVSFAIPEKLWICPYTRRFLDTTLNGFSPYTPLTENKQRSERVDMPLFPDDIDISSPTFTISAREWILKNQQLGLFREDALWSTYADQVLESAPFYKTAEHSAQQKSSVLDQYEREFKSGDINILSCSTTMEMGIDIGGIQLVAMNNVPPHPANYLQRAGRAGRRSETKSVSLTLCKANPHDQNVFNQPLWAFGNKFPTPKMAHGKSISMHLASQQVLNLRSIPLSSNWSEVHHLKG

SEQ ID NO: 176337 - protein, 351 aa, Glycine max
  Coding DNA Sequence Number=SeqID_84652
  Gene Ontology: Mol. function=protein transporter activity; Cellular component=membrane; Biological process=protein secretion
  Homolog annotation: Hit_ID=Q9AEG2; Match level="QueryCoverage=100%, HitCoverage=87%, E-value=1e-170, Identity=89%"; Hit description=AcrA protein precursor
  Pfam annotation: Domain name=HlyD; Domain location=64-351; Score =278.2; E_value=1.7e-80; Accession=PF00529.11; Description=HlyD family secretion protein
MNKNRGLTPLAVVLMLSGSLALTGCDDKPAQQGAQQMPEVGIVTLKSAPLQITTELPGRTNAYRVAEVRPQVSGIILKRNFTEGSDIQAGVSLYQIDPATYQASYESAKGDLAKAQAAANIAQLTVKRYQKLVGTKYISQQEYDSAVADAQQSNAAVVAAKAAVETARINLAYTKVTSPISGRIGKSAVTEGALVQNGQSTALATVQQLDPIYVDVTQSSNDFLRLKQELANGKLKQENGKAKVELVTNDGLKYPQEGTLEFSDVTVDQTTGSITLRAIFPNPDHTLLPGMFVRARLEEGINPDALLVPQQGVTRTPRGDASVMVVGEGDKVEVRQVTATQAIGDKWLVTE

SEQ ID NO: 176338 - protein, 124 aa, Glycine max
  Coding DNA Sequence Number=SeqID_84653
  Subcellular localization annotation: CTP_CleavageSite=36; ConfidenceScore=5.26e-01
MSISPCGSISWSVLSRHRDRAHKTPSGPGGAQQGPRVSSSGCGPLSVLQGAHPPQDRARKTPCGPGEVQQGLGVSSSDYGHLSVLRSTRRPNKVIRRPINRVFIKKYYAPRQAQGETPQQPGDG

SEQ ID NO: 176339 - protein, 268 aa, Glycine max
  Coding DNA Sequence Number=SeqID_84654
LVYAGERIKVGLMRVKFDYVSPIGASSRRTRIAGAKKKEGDAHTVTSTPAWPKPPQTPHGTHQYAQHHLSFSARAEASSDTALTHRGELFRLRLRLGLTRPTTLTLTQTRRGTFHLDPNDIWGTLAIFHHQPIGRGGPGKDHLVSIPKMDGPNIKMNPLANHGGEAVNAIEVSRSHGPKLLKDVTTPGRFINKVLQKAGMIPCGGRKEDSCLMHPGVLHDMETCSAIRDLLQQMINQGRLEVGSKREEEQHVCMQSVDEEGPKMPKPL

SEQ ID NO: 176340 - protein, 208 aa, Glycine max
  Coding DNA Sequence Number=SeqID_84655
  Homolog annotation: Hit_ID=A5BMC8; Match level="QueryCoverage=37%, HitCoverage=5%, E-value=2e-09, Identity=43%"; Hit description =Putative uncharacterized protein
GHVAPMRTISSSFDEGIDEQVCDACVIIIELVMVAGLNLHKGLHNEDAIGGVDVVDDRIWSSEMKGPVTRAMSKKLQEDWARAVEEGPRVLMNLSGVSSLSSFSIPLPFIFQEIKESIDKEDPRPTSSNEAYIMWDVTKSLAAVTTDILWIQTLLNELAAPYLTPMVLCDNSNVVQMAHGPVLHAKTKHMELDLSLLCQRKSLVQEAD

SEQ ID NO: 176341 - protein, 527 aa, Glycine max
  Coding DNA Sequence Number=SeqID_84656
  Gene Ontology: Mol. function=kinase activity; Cellular component =cytoplasm; Biological process=carbohydrate metabolic process
  Homolog annotation: Hit_ID=A7P2D8; Match level="QueryCoverage=78%, HitCoverage=94%, E-value=0.0, Identity=75%"; Hit description =Chromosome chr1 scaffold_5, whole genome shotgun sequence
  Pfam annotation: Domain name=PfkB; Domain location=156-498; Score =54.3; E_value=4.3e-13; Accession=PF00294.15; Description=pfkB family carbohydrate kinase
MARKKASLDSAIEEELSDNESLVEKKTTRSSKTKKETTRTRKKTKDESPGDTDSASIEGSTAASSDNSKKTQRTRKKDASSSAGLEEKKEVKEEKKVRRRKKTEEEKLIVEDKGSEAEISDQDEPSFLENVEDDSDSGLELIKDDGEDISFTYGWPPLVCCFGAAQHAFVPSGRPANRLINHEIHESMKDALWSPENFVRAPGSSAGSVAIALATLGGKVAFMGKLADDDYGQAMLYYMNANNVQTRSVRIDSKRATAASMMKVGKRNRLKMSCVKPCAEDSLTKSELNIDVLKEAKMFYFNTHSLLDRNMRSTTLQAIKISKHFGGVVFYDLNLPMPLWHSREETMMFIQRVWNLADIIEVTKQELEFLCGITPFEEFDTKNNARSKFVHYEPEVVAPLWHENLKVLFVTNGTSKIHYYTKELNGAVLGMEDAPITPFTRDMSATGDGIVAALMRMLTVQPDLLTDKGYLEHSIKYGIDCGVIDQWIFGRVRGFPPCEDMEEDIIPDPNGIRSISETEYRTAVGSA

SEQ ID NO: 176342 - protein, 75 aa, Glycine max
  Coding DNA Sequence Number=SeqID_84657
MERRRRRSFIGRRGRKYLADQHVWSRLRRSRFNGKKALPLSDYCAARKHRCWSRVITSARHMLAMQWLLNIGDKE

SEQ ID NO: 176343 - protein, 359 aa, Glycine max
  Coding DNA Sequence Number=SeqID_84658
  Gene Ontology: Mol. function=protein serine/threonine kinase activity; Cellular component=basolateral plasma membrane; Biological process=protein amino acid phosphorylation
  Homolog annotation: Hit_ID=A7P2E2; Match level="QueryCoverage=57%, HitCoverage=24%, E-value=8e-65, Identity=66%"; Hit description =Chromosome chr1 scaffold_5, whole genome shotgun sequence
  Pfam annotation: Domain name=Pkinase; Domain location=251-358; Score=- 102.4; E_value=0.018; Accession=PF00069.16; Description=Protein kinase domain
  Pfam annotation: Domain name=Pkinase_Tyr; Domain location=251-358; Score=-143.5; E_value=0.0013; Accession=PF07714.8; Description =Protein tyrosine kinase
  Pfam module annotation: Pfam domain module=Pkinase::Pkinase_Tyr; Domain location=251-358::251-358
MDRSSFSPGTGKTRTKPDIYSTFVVHDDEDDDGGGTFRRRKSGGGAQPQDDPYATMVFKDNGHDDEDDEDSSLPPLLKRLPKDFGGGAPLDYDDEDDDAGDFGTMIVKSDRSRQRDRPSSGVASPAWKARSPLNRFGGGDDDGDDDDDDGGGFSTFVVRSTVKSGERESVSGTVVRRTSGGGSVGVGVGVGSTMERAVASMQGMGEFGFGKQRKGSGSSQNDEGRHQSITTKVSTSSIPDSVTREDPTTKYELLNELGKGSYGAVYKARDLRTSEMVAIKVISLSEGEEGYEEIRGEIEMLQQCNHPNVVRYLASYQGEEYLWIVMEYCGGGSVADLMSVTDEPLDEGQIAYICREALK

SEQ ID NO: 176344 - protein, 283 aa, Glycine max
  Coding DNA Sequence Number=SeqID_84659
  Homolog annotation: Hit_ID=A3QCD3; Match level="QueryCoverage=95%, HitCoverage=31%, E-value=1e-103, Identity=69%"; Hit description=Type III restriction enzyme, res subunit
MTMITNSSSVPVKADMVGLGRSLEQFWEDADMAVIDDAYRRAARIFSPAIAHSYVDHLASQVAHRNDDPEGFIEAIVEARVTVAGLGLVMEAHAYFDTEAEKLAMNWLSKYNKQIKMLSDDRRESYRQIIEMSIEPQDVELLKPEARYEATKVNESGNVKVLPVWNDHLLCGLDGKYPAELNGWERIVVETESGRSGFCYWYRNPQQPGQSSLGIAYEKAGQYGIVRPDFLFFAEQDGSIAVDLVDPHGLHLSDALAKLQGLAQYAANHMNVYRRIESIAGIL

SEQ ID NO: 176345 - protein, 164 aa, Glycine max
  Coding DNA Sequence Number=SeqID_84660
MGEAEEVQEKMKADMEAMKEQMATMMEAMMSMKKIMEANAHAFPPYGLPPKLYTTQCVYIPNEDVNNSTPILIKSQQPQSDHAHVSRPMEETHEIPHHDLANFEPCLGYAAEGQAVGGIPLQNTLEGPQYHPQPQPSRSTAVKNPHDYGRNGKVGSSRGKAQGH

SEQ ID NO: 176346 - protein, 151 aa, Glycine max
  Coding DNA Sequence Number=SeqID_84661
MERSMIDAANGEALGDMTPTEAINLIEKMASNSQQFSARSDAIVIRGVHEVATNSSSSIETKKLEAPVTRLCGLCSSADHHTDLCPSVQQSEAIEHPEAYAANIYNRPPQPQQQNQPQQNNYELSSNRYNLGWKNHPNLRWLSPLQQQQQQ

SEQ ID NO: 176347 - protein, 74 aa, Glycine max
  Coding DNA Sequence Number=SeqID_84662
MVSKAKRVGDDSWKLRRIICQPAKTFGSFAILYSRNCGRCSIRIRVTHTRRKCTGNILGISVRISQVQLNGLIN

SEQ ID NO: 176348 - protein, 62 aa, Glycine max
  Coding DNA Sequence Number=SeqID_84663
MECSDWMKTTKSPYRFDEDDKIPARYGAGITNNSSMGPSYLQIKLIDTVDLEGGPGTSFCSL

SEQ ID NO: 176349 - protein, 198 aa, Glycine max
  Coding DNA Sequence Number=SeqID_84664
VSEESFEAPEEDEEVRALKSELGKAKLAQEKFKLAATHIRKECAGLREENATTARALEQETKRARKEEDQSRAHSMVLKEELVACSRSRRSLSQRLCETETNMLAIIAKYQEELGLATAHERRVADEYAQVYAEKEARGRVIDSLHQEATMWMDRFALTLNGSQELPRLLAKAKAMADTYSAPEEIHGLLGYCQHMID

SEQ ID NO: 176350 - protein, 42 aa, Glycine max
  Coding DNA Sequence Number=SeqID_84665
MMWVKKMAPKKLSMKRFRRDATGEGSIAASKFDSHRFRSVEH

SEQ ID NO: 176351 - protein, 184 aa, Glycine max
  Coding DNA Sequence Number=SeqID_84666
  Homolog annotation: Hit_ID=Q5QJQ3; Match level="QueryCoverage=16%, HitCoverage=24%, E-value=3e-11, Identity=100%"; Hit description =Putative uncharacterized protein
MTVKTSDTCSSRRRSQLVCKRMPGADKPVRARQRMRKEKIPHQAPFAIQAAQLLGRAIGAGLFAITPAGERGMCCKAIKLGNARMLALNASPGGAADLLAATLRETCRASCINESANARGEAVCVLGALPLPRSLTRCARSFGCGERYQLTQRRSFAPSWAVCTNPPFSPTAAPYPVTIVLSPT

SEQ ID NO: 176352 - protein, 210 aa, Glycine max
  Coding DNA Sequence Number=SeqID_84667
MGEVEEVQKQMKADMEAMKEQMATMMEAMMNMKKIMEANAVADTATSAVAKVNPMPPSGLNQMNHPTLAMVGKDLGSTGGPHYSQIQNKHAFSPYGLPPNYTPPNVAYTPSENVNNSTPILIESRQPQTDHSHVSQTVGETHEIPHHNLADFEPCLGYATEGQVVGGILLQNTLEGPQFRPQPQPLHSTAGKIPPIMEGMGKVGSSKGKA

SEQ ID NO: 176353 - protein, 121 aa, Glycine max
  Coding DNA Sequence Number=SeqID_84668
MTLLVMIRGIHCPCRMSLVGENRVVKEFKHLRGDVLGSLIYPWSVYLTVPMFPLDVVYVRGGGGCIDLVGCPWRGKIEWLKSLNISEGIFRIFNSSMVFVLDGAHCSLSASAPNRTSSIKR

SEQ ID NO: 176354 - protein, 131 aa, Glycine max
  Coding DNA Sequence Number=SeqID_84669
  Homolog annotation: Hit_ID=Q339T0; Match level="QueryCoverage=61%, HitCoverage=11%, E-value=1e-07, Identity=33%"; Hit description =Transposon protein, putative, CACTA, En/Spm sub-class
MSTSSVIGTLLNIQGKTKDGLNTCQDLAEMGIRSQLHPSLSYFVQKGEDQFLSVSAPEEVIEFCSKYIEKAKPFGLPESQHVERMGAFIPYFGFIEEIWELNYVKFTVCVFKCKWVDSNTSVQTDDVDLRW

SEQ ID NO: 176355 - protein, 85 aa, Glycine max
  Coding DNA Sequence Number=SeqID_84670
MLESFKQQDQMSVLKLYIEKDVAGGSMFHSANSLTSCGNYLSNDETQSATNMSNLPIDEDDDDDDDYLVSNSYVEESLDEDDGVD

SEQ ID NO: 176356 - protein, 70 aa, Glycine max
  Coding DNA Sequence Number=SeqID_84671
MSLGGNYYDLVIADDYSSFPAPRAPQQNGVVERKNKALEGVDMNGSGMEKEEREEMPLQGEDESRRSSPP

SEQ ID NO: 176357 - protein, 249 aa, Glycine max
  Coding DNA Sequence Number=SeqID_84672
  Gene Ontology: Mol. function=motor activity; Cellular component=cell projection
  Homolog annotation: Hit_ID=UPI00016621D1; Match level="QueryCoverage =69%, HitCoverage=40%, E-value=4e-16, Identity=36%"; Hit description =UPI00016621D1 related cluster
LHTLTIRGLHVLTFIGLHALTFRGLHVLTFRGLHVLTFRGLHVLAFRGQHVLAFAFVGLHALTFKGLHVLAIRGLHALTFKGLHILQFRGLHVLAFRWLHVLAFRGLHSLAFRGLHVLVFRGLHVLIFRGLHVLIFRGLHVLAFKGLHVPTFRGLHVFAFRGLRALAFSGIHIRTLREFKGGYHAATMHTGSRFHQCLRGKFLIALESAPKWALPAGRVVVGARAWGASLWMGAGALGCTSAELEEFPT

SEQ ID NO: 176358 - protein, 175 aa, Glycine max
  Coding DNA Sequence Number=SeqID_84673
MFHFSQTTKAKTARNPRKNRSERSEFGFTETLSAATILVPQAIARDAPETDRKSVARVDSAEMAVFLSITCCITTRHREPTLKPPTPAPPRCVRFLCSYLLPSQQVRDEPACKQQTHRNSSKPAPAPVRVFSFQDLVSDATTMNNANFKTWTSTATTPRSGCACATHGASSTAFP

SEQ ID NO: 176359 - protein, 98 aa, Glycine max
  Coding DNA Sequence Number=SeqID_84674
MKILWKMKMQVFSIRILLLKMKPKLKSLNKAMKSLPHLLKTSLENGELKKTCPWTTLLEKYHRELLLTLDSGFYAITWFLFLKLNQETYMKPCTMNTG

SEQ ID NO: 176360 - protein, 179 aa, Glycine max
  Coding DNA Sequence Number=SeqID_84675
  Gene Ontology: Mol. function=microtubule motor activity; Cellular component=microtubule associated complex; Biological process =microtubule-based movement
  Homolog annotation: Hit_ID=A7Q5T0; Match level="QueryCoverage=51%, HitCoverage=14%, E-value=2e-30, Identity=69%"; Hit description =Chromosome chr14 scaffold_54, whole genome shotgun sequence
  Pfam annotation: Domain name=DUF676; Domain location=1-171; Score= -17.2; E_value=1.8e-06; Accession=PF05057.5; Description=Protein of unknown function (DUF676)
  Pfam annotation: Domain name=Kinesin; Domain location=49-178; Score= -145.2; E_value=1.2e-05; Accession=PF00225.14; Description=Kinesin motor domain
  Pfam module annotation: Pfam domain module=DUF676::Kinesin; Domain location=1-171::49-178
MLEKVYLYHLERISSSNTYTKTFIGIDGVEKRLANEVLQVVKKTKSLKRISFLAHSLRGLFARYAIVVLYSPDTYSRDQPESVFVEVEPILRSAMDGRNVCVFAYGQTGTCKTFTMHGTNEEPRIISRALEELFHQASLDNSSSFTFTMSMLEVYMGNLKDLLSPRQSGRPHEQYMTKW

SEQ ID NO: 176361 - protein, 46 aa, Glycine max
  Coding DNA Sequence Number=SeqID_84676
MQACGISTLPSFIASGLSSGHDGKGNIRKQELFQASVALKVIYKMS

SEQ ID NO: 176362 - protein, 142 aa, Glycine max
  Coding DNA Sequence Number=SeqID_84677
MLHSLRIKRVNNPERLRRLSVRRLEEQKLLVHVDLDTRKALGSHRKTFKSYLGIIAREKVDILYHNWKQVPKVKGTTDLGRHSEIPARVVHPGYLCTPKDVKMYSLLPLDDQSTLIVFVLLKSVSPSTITLEDHVAPRLHHC

SEQ ID NO: 176363 - protein, 125 aa, Glycine max
  Coding DNA Sequence Number=SeqID_84678
MTSRKRKASASQPWEPYDTTRFVSKVAWERYAQNVHSWKILLERNVNLFVTEYDELRRELIQRNWHRALTYLREADQVASRSSGVCGQIMHPRARVCSECWRSALEAPKEGSHDISTNLEHPLIF

SEQ ID NO: 176364 - protein, 110 aa, Glycine max
  Coding DNA Sequence Number=SeqID_84679
  Gene Ontology: Mol. function=ATP-dependent peptidase activity; Biological process=ATP-dependent proteolysis
  Homolog annotation: Hit_ID=A7PDI3; Match level="QueryCoverage=49%, HitCoverage=11%, E-value=1e-11, Identity=61%"; Hit description =Chromosome chr17 scaffold_12, whole genome shotgun sequence
MEDNHQMGMAILDSTSSLAEFACEVEITECEPLPDGRFYIEKDLRILWTIDNLYKFTLRVNCNESVVTCKLKVVGDFISFVPGIKKGTVLQRLNGYKILYHQKEQVKERL

SEQ ID NO: 176365 - protein, 100 aa, Glycine max
  Coding DNA Sequence Number=SeqID_84680
MVVPKSKKMQRQDETNKEQHEIMGFVLYRNRKSSWKIPLQSMGSSRCGVLTENNNGLRWLMVAVGDGESAWNFRNGFGRKKEEEMTFFLSYTKAKAEVLK

SEQ ID NO: 176366 - protein, 236 aa, Glycine max
  Coding DNA Sequence Number=SeqID_84681
MEELNSQPKMKDDGGDVTIVFMMIKLDGKATNGSFKLKGPKAYALASLNAILVRSDGKRALGPTISEWVAIIGTWGIEWNHDPWFKEDNFVDNVRFGLSPAVREPYISPFYFDLPLVLTQYPMLGYMCVSSTPFSSPSRSSSSALSMADIVMMIEEIFAQPIVREYVLSSLNNEIPLLVDPSYNLVSQTRFLLSEHLIDWSFVLEDYVDGANDKEDDPSKDASDARETPGIDEDSS

SEQ ID NO: 176367 - protein, 204 aa, Glycine max
  Coding DNA Sequence Number=SeqID_84682
  Gene Ontology: Mol. function=DNA binding; Biological process =regulation of transcription, DNA-dependent
  Homolog annotation: Hit_ID=A9PB77; Match level="QueryCoverage=64%, HitCoverage=68%, E-value=2e-31, Identity=52%"; Hit description =Putative uncharacterized protein
MASSQSRKRVDAVDCRAASVLVCAKDGSAFAHCYDCKKNVPVALIDMHSCSLEAKIKMNLDAQVVEQAAEAKKPERKKPKSKEPMAKKAKVGKGKKVKDPNMPKRPPTTFFVFLDDFRKSFKEANPDSKDAKRVGKEAVWGMVIVAIGFSYGFVEFEVASAVQSALEIDSLKANLTELESRHSNNYPEEELHSDNYWFSCPLEG

SEQ ID NO: 176368 - protein, 271 aa, Glycine max
  Coding DNA Sequence Number=SeqID_84683
DQRLRYSSQLSTRIILDPKYLDIAFFDDETFDDYQVFQNSDLVDFMSLKLPHYVELVRVFYNNVRIQDSTLYSEVHGIPLVIDQSLFFSLTKLPTQGVPFEGTVVDDWKFDYLSHDARRMIDWAHLVKYRMHKALRTNAPLPYPQLVTLFLRHFQIPLDDEPFVQVKTSFAIGVGVVTSFGYRKDIDGQWIRKQDLPPLIPDERTSSPLPQRDASSTLMHEVLSELCGLRAFVGDRLDAMDAHFEGMDTWITHLEDDMGFIRRCFDPPAAP

SEQ ID NO: 176369 - protein, 41 aa, Glycine max
  Coding DNA Sequence Number=SeqID_84684
MDTSSAPNFSKKLCKFDPSSAPTFASWVLPYFDLDLIKSFS

SEQ ID NO: 176370 - protein, 167 aa, Glycine max
  Coding DNA Sequence Number=SeqID_84685
MSSRRNLRDAIEELTNFVDGNIDIAIVKEFYANLYDPEDKSPKQVRVRGHLIKFDEDTHNTFLKTPVIVEEGESLCAYSRFALLRPDPQELATKLCIPGWEFELNADGQPLKILRKNMTTLAQTWSGLSFSNLIPSSHTFDVTLDRARLIYGIIMKMDLNVGYLISQ

SEQ ID NO: 176371 - protein, 98 aa, Glycine max
  Coding DNA Sequence Number=SeqID_84686
MTERKTKERKKNAPKCRCCTKRWWLFLVDRMIHKKGGRIRTYGRPAPDLLGWVAGLAPLVAPVPETDALRYPARNLVSPTPLLVMPLPIAGNPRAGRP

SEQ ID NO: 176372 - protein, 95 aa, Glycine max
  Coding DNA Sequence Number=SeqID_84687
MVTLKWSNFHPSGWGGYALKQKLKFIACIRQWSSSNGVINAKKIQVLKKELNALEAGISDRILNQFEVELKKSLQEQLWHAANAYESTFPWSGIL

SEQ ID NO: 176373 - protein, 169 aa, Glycine max
  Coding DNA Sequence Number=SeqID_84688
  Homolog annotation: Hit_ID=UPI00006A2D9E; Match level="QueryCoverage =92%, HitCoverage=87%, E-value=8e-10, Identity=19%"; Hit description =UPI00006A2D9E related cluster
STLEDPLQSVLAIRGLHALTFRALYVLTIRGLHALTCRGMHVLTFRGLHALTFRGPYVLDIRGLDALTFRGLHVLAIRGLHALTCRGLHVLTIRGLHALTIRGLHVLAIKGLHALSFGGLHVLAIRGLHSSISCTLTFRGLHVLAISGTARPHLQRTTCPHQRAPRPHL

SEQ ID NO: 176374 - protein, 197 aa, Glycine max
  Coding DNA Sequence Number=SeqID_84689
  Homolog annotation: Hit_ID=Q86AI8; Match level="QueryCoverage=95%, HitCoverage=32%, E-value=4e-10, Identity=27%"; Hit description =Similar to Homo sapiens (Human). Mucin 2
TACPRHQRITTSPLEDYTSSPSEGCTPHLQRTTCPHLQRTTRPRHQRAALYVLAFRRLHVLTFGGHTFSPSEGYKPSPSEGCTPSPSEAYTSSPLEGYMPSPLEDYTSSPSDDYTSSPFEGCTPLPSEDYMSLPPEDYTFLSSEDYMSSPSEDYTFSPLEDYTTTRPHLQRTTRPRTLEGCTPSPSEDYISLPSEDY

SEQ ID NO: 176375 - protein, 128 aa, Glycine max
  Coding DNA Sequence Number=SeqID_84690
MSVLELYIEKDVAGGSMFHSANSLTSCGNYVSNDYTQPPTNMSNLNLDEDDDNDDDDYLVSNSYVEESLDEDDSVDGISDTDNEVPGMIPPVRIVHPAEGVQAIENPFWNDALPYNNINWSHPDEEDL

SEQ ID NO: 176376 - protein, 87 aa, Glycine max
  Coding DNA Sequence Number=SeqID_84691
MCHPTAYVCAYYKGKSAMLMRAPPSLVTTQKLSWSSSNQHGSTSNLEDLSNEYETWVKNHDSNTDSSSGPEGSNMSPSHETIFKQDW

SEQ ID NO: 176377 - protein, 114 aa, Glycine max
  Coding DNA Sequence Number=SeqID_84692
MMLFFSQMQSQFQSQMQSQGLALPLEPKVGPSAAYVSTKESCVDPLGNNPDTGDSEKYGLYVEENPPRLVARGRLYEGSIIVHNIPLLHDQVMVGVEEVRDADALIPVPTQEVQ

SEQ ID NO: 176378 - protein, 63 aa, Glycine max
  Coding DNA Sequence Number=SeqID_84693
MFMTPRLCILAILGEKTRFREEKLSRSASVTLSRRFCEQICEDFLPLFTVLCSFFILQPCYLA

SEQ ID NO: 176379 - protein, 176 aa, Glycine max
  Coding DNA Sequence Number=SeqID_84694
TLTFRGLHALTFRGLHSLAFRGLHVLAFRGLHALAFRRLHALAFRGLHALAIRGLHALTFKGLHALTFRGLHVLAFRGLHALAFRGLHALANRGIHILAFKGRHVLDFRGLHAVAFRGLRVLTFSGLHIHTLREFKSHGHLPDLGGGSTVRAIPEGGYHAAIMHTGARFHPAVARR

SEQ ID NO: 176380 - protein, 84 aa, Glycine max
  Coding DNA Sequence Number=SeqID_84695
MRDVFTKEYARSPTLFEENVMKTGNTRSTNFLMKGSGVVFTHGEGISTPHARPKGRQPLKAMIIFKLECGGQHDWAITFMRLRG

SEQ ID NO: 176381 - protein, 383 aa, Glycine max
  Coding DNA Sequence Number=SeqID_84696
  Gene Ontology: Mol. function=nucleic acid binding
  Homolog annotation: Hit_ID=Q5XM22; Match level="QueryCoverage=20%, HitCoverage=43%, E-value=6e-23, Identity=66%"; Hit description =Resistance-like protein HAAS-2
  Pfam annotation: Domain name=DUF1723; Domain location=24-73; Score =57.2; E_value=5.6e-14; Accession=PF08330.1; Description=Protein of unknown function (DUF1723)
PAPEIEDLVTTTELSPLIGCSVVTDDPGLISAFVERWHRETNTFHLLVGELTITLDDVASLLHLSIISAFHSFEPLLVDDAVFLLMELFEVFDEEARSETVRADAAYVRLSWLRDVYQSRCRARWWIVAARAYLLHLVGCTLFSNKSATHVHVVHLEAFQELGQSGGYAWGAAALCVIDDAYDETTPRASQWLTMKAHMKGITGVSYRARLNALTIADTIPSPLVSASLSYEDIDDRWMHFSDHVIAAGEICVVPGQEYVQPDIPEVPMAFDPPRDAMDACEGCEAIAERLERVLNLRMVTEGTELHDIMEDCLRIARGVTTQMEMLGLDEDDAQIIDRSCLGSSSSMDSFASWKMNDSRMEKEEREEMPLQGEDESRRNSPP

SEQ ID NO: 176382 - protein, 244 aa, Glycine max
  Coding DNA Sequence Number=SeqID_84697
  Gene Ontology: Mol. function=zinc ion binding; Cellular component =intracellular
  Homolog annotation: Hit_ID=P0AFM0; Match level="QueryCoverage=100%, HitCoverage=58%, E-value=1e-111, Identity=77%"; Hit description =Paraquat-inducible protein A
  Pfam annotation: Domain name=PqiA; Domain location=2-204; Score =300.8; E_value=2.6e-87; Accession=PF04403.4; Description=Paraquat -inducible protein A
MCDHHHAARHILCPQCDLLVALPPLEHRQKAACPRCGTTLTTSWDAPRQRPTAYALVALFMLLLANLFPFVYMKVGGISSEIELLEIPNVLFSEDYASLGTFFLLFVQLVPAFCLVTILLLVNRVHMPSRLKAFLARILFHLKSWGMAEIFLAGVLVSFVKLMAYGDIGVGLSFVPWCLFCLLQLRAFQCVDRRWLWDDIAPMPVIKQPLRPGVPGLRQGLRSCSCCTAVLPADEKECPRCHTK

SEQ ID NO: 176383 - protein, 66 aa, Glycine max
  Coding DNA Sequence Number=SeqID_84698
MLTSSKGAQTTTLVSACQSDLGSTNDEVQITVRRLRMLLDSRVTVAGWGGQQKRDFCSYGEKVIGA

SEQ ID NO: 176384 - protein, 58 aa, Glycine max
  Coding DNA Sequence Number=SeqID_84699
MAYAPLGNSTKFQTPLLMIFFMNGFLCFLEDEWQRKEKEEREETPLQGEDESRRSSTP

SEQ ID NO: 176385 - protein, 171 aa, Glycine max
  Coding DNA Sequence Number=SeqID_84700
MEEQASQDSFVAHGQHPGRVRAAGANVTIKQYFGPTPRTSHTSSSMAPKDMEQLTQKIRDQLEESITEKVTRQVLALPPEPVDGRSATHVSTKENVVIWFCSLHNRLDFLKGILSGFDDTPQSKSKATARWIVVKCNRQKGSTACEYYVMHRMSTIILGSFKNNWKMVTLG

SEQ ID NO: 176386 - protein, 157 aa, Glycine max
  Coding DNA Sequence Number=SeqID_84701
MQSSDRKPSKPKPLVIHFTRDITTQIPRGFQPYIAKTPAPFPYKSDKTVPWRYGVQGFDGRHDVSVMRVGTGMPTAEIMNIFGTSNMTRSGRIFALPKLPTRSKDNGKAKTYMGEREKTGLAANNEAFVRKFAKEGDNLSKREISAEEATKFLRIIQ

SEQ ID NO: 176387 - protein, 201 aa, Glycine max
  Coding DNA Sequence Number=SeqID_84702
  Subcellular localization annotation: CTP_CleavageSite=71; ConfidenceScore=5.04e-01
LKKLAYQIKPFIMAKQAKQVFYVQDPYDERHMATPPSSLPLPPESTAPSSSTSKKTRKTTWLGSLATKPVRAERPTVHVDPITRKIDDKMDDTIDNWKHVPASQKDLIWEDIQGLALPTKPEVDPFVSRVSTRGSCVDPSGEDPDTGDSNKYGLYVDKNPPRLVALGRVYEGSTIIHNDPLGNDQVKVGVEEVRDANARVS

SEQ ID NO: 176388 - protein, 106 aa, Glycine max
  Coding DNA Sequence Number=SeqID_84703
MAFFQSYLDYKAQNAQVTNALGNGNFAHTPDVFSKIPTVKSCMAPYKALYGRRCRTPLCWLDPKENLTLEHEVANKAPKRRGKEIPLVKVIWGGASGEDITWELEI

SEQ ID NO: 176389 - protein, 685 aa, Glycine max
  Coding DNA Sequence Number=SeqID_84704
  Gene Ontology: Mol. function=protein kinase activity; Cellular component=cytoplasm; Biological process=protein amino acid phosphorylation
  Homolog annotation: Hit_ID=A7P1N6; Match level="QueryCoverage=98%, HitCoverage=72%, E-value=0.0, Identity=59%"; Hit description =Chromosome chr19 scaffold_4, whole genome shotgun sequence
  Pfam annotation: Domain name=Pkinase; Domain location=23-256; Score= -97.9; E_value=0.0096; Accession=PF00069.16; Description=Protein kinase domain
  Pfam annotation: Domain name=Pkinase_Tyr; Domain location=92-255; Score=-171.7; E_value=0.067; Accession=PF07714.8; Description =Protein tyrosine kinase
  Pfam annotation: Domain name=WD40; Domain location=468-506; Score =15.5; E_value=0.2; Accession=PF00400.23; Description=WD domain, G -beta repeat
  Pfam annotation: Domain name=WD40; Domain location=518-556; Score =1.7; E_value=20; Accession=PF00400.23; Description=WD domain, G-beta repeat
  Pfam annotation: Domain name=WD40; Domain location=560-599; Score =41.7; E_value=2.6e-09; Accession=PF00400.23; Description=WD domain, G-beta repeat
  Pfam annotation: Domain name=WD40; Domain location=619-657; Score =4.7; E_value=8.3; Accession=PF00400.23; Description=WD domain, G -beta repeat
  Pfam module annotation: Pfam domain module=Pkinase::Pkinase _Tyr::WD40::WD40::WD40::WD40; Domain location=23-256::92-255::468 -506::518-556::560-599::619-657
MGDISLRLWLDKPERSVNVSECLHIFREIVEIVHVAHSQGIVVHNVRPSCFVMSSFNHVSFIESATCSDSGSDTLEEAVEIKTPTPTPSYDMHQQRCLGSEDFVPVKTSTASLTDSSCMLSSLVFVAPASLIDDTEENKMKNRRKDEEVAVKKQSFSTKQVLQMEASWYTSPEEFAGASPSCASDVYRLGVLLFELFCPLISREEKSRTMSGLRHRVLPPQLLLKWPKEASFCLWLLHPEPNSRPTIGQLLQSEFLNEPRDDIENCEAAVEVRERIDDQELLQEFLSLIQQKKEEAAEKLQHTISFLCSDIEEATKQKTLFNEITGTGLDDCTTSTFPSITVVDNEESACLGTRKRVRTIPCVDDTEGIDNNMSDDQKNDRSILSKTPRFLNNLQKLESAYFLTRCKSAYSSGKLAVQHSPIGTDERSCVNKVALKEKFREGKSPWTNPFLEGLSKYLSFSKLKVKADLKQGDLLQSSNLVCSLSFDRDAEYFATAGVNKKIKVFECNTTINEDRDIHYPVVEMVSRSTLSSTCWNTYIKSQIASSNFEGVVQLWDVTRSHVQSEMREHEQRVWSIDFSSADPTLLASGSDDGSVKLWNINQAIRPNILLYVLCLILDGISVGTIKTKANVCCVQFPLEFAHSLAFGSADHRIYYYDLRNLKVPLCTLVGHDKTNLSLLWKMKKL

SEQ ID NO: 176390 - protein, 279 aa, Glycine max
  Coding DNA Sequence Number=SeqID_84705
MARKPRQDFSVSKLERIDGDPVLRETRIWATWEYVSSVGGGQQGMGSGDLGDVRRAPGSQQIKGTKTTKQGGLWLKNEDRRLRWSLEAMRASGNRLPRGCNRLPGLEMKAAGCGGLCAFFRFSCPEAVIQVWPLIVRAAQLIHDRVEMECLEGAWETLEGNTRCRFRGTIRFTTTSLVHLDEPVRTLQRTVEWILPTPTPYRLVEPVQVIEVTSSEEDPEEDPEELPPEPVVDALDFLEGDEDPLPKVDPPEEVMSVSEADSTEDSGPGEMAISGGSSS

SEQ ID NO: 176391 - protein, 156 aa, Glycine max
  Coding DNA Sequence Number=SeqID_84706
MKANIEAMKDQMTTMMEAMMSMRKMMEVNAAAVVATGTATKVDPTHPSGINQVNRLVLDMVGQEGKTLGSTGSPHFMQVQSKRPFPPYGLPPNYAPPNVAHVSDENVDNSAPIPIESQQLQSGHAHVSQPMGETPKVPRDHVLADFEPHLRYATEG

SEQ ID NO: 176392 - protein, 247 aa, Glycine max
  Coding DNA Sequence Number=SeqID_84707
MAAEWRRKRERRRHFKEKMSLEEAHHHRRPWIRAWRKKEMNEGRGREEHEILCSKGALKSETYKGNPCGVYPDLSSFTGSGVYPDLSSFTGSGVIQILVACIKHSAPQVLPAHEPLNLQYCKDSKISTDNSNEFTISISPSVQPLLQEFKNVFPKEIPHGLSPSKGIEHQDAHAKVEYVKRLYDEVNVQIAKKNESYTKQANKKRKEVVLELGDDLGHLRANVFQEGGNDENPETGQIQAKGPSGEG

SEQ ID NO: 176393 - protein, 50 aa, Glycine max
  Coding DNA Sequence Number=SeqID_84708
MTQHDNGECDESEKGDEHRDGDVEECRGGGGDDRRVVGFSGEKGTKREGR

SEQ ID NO: 176394 - protein, 185 aa, Glycine max
  Coding DNA Sequence Number=SeqID_84709
MIKSKVKEDSRMLIFAVKADGRVIYSNKVNGHFIWDVAPEMCDSDCSYDDHDGDTNDEGYDDEDEGEGRWKPKPRPCKPPPPPQRRSDPKNGPWTTIKKKYPEDPFWKEKRMAEILGWNHPSLKILEAPIPCMMFSSTSYEQEFPSLDRKTDSVTKVSTKPHIIPTEVGPEGKLKSPSRVEEVLN

SEQ ID NO: 176395 - protein, 37 aa, Glycine max
  Coding DNA Sequence Number=SeqID_84710
MKMLLIPHDMNGSGRENEERDETPLQGEDESRRSSPP

SEQ ID NO: 176396 - protein, 116 aa, Glycine max
  Coding DNA Sequence Number=SeqID_84711
  Homolog annotation: Hit_ID=A5B5G7; Match level="QueryCoverage=93%, HitCoverage=9%, E-value=5e-10, Identity=31%"; Hit description =Putative uncharacterized protein
MSNHKSTESTLKNLEVQVGQLAKQIADKSSNSFVANTKQNPKEECNAVMTRSKRFMEVEDEDSVVYKKKTADKKSTDGKKNEENIIVEGNCSAVIQQILPPKHKNPGSVTIPCSIG

SEQ ID NO: 176397 - protein, 102 aa, Glycine max
  Coding DNA Sequence Number=SeqID_84712
  Homolog annotation: Hit_ID=A2Q454; Match level="QueryCoverage=100%, HitCoverage=50%, E-value=1e-10, Identity=34%"; Hit description =Retrotransposon gag protein
MGDRVDALETQMGNVTTTLQELALQVQQQSLILAKLSKQIGKRREPQEEEASAGDSAQSESRLAGRKVKLPLFDGDDPVAWITRAEIYFDVQNTSDDMRVKL

SEQ ID NO: 176398 - protein, 63 aa, Glycine max
  Coding DNA Sequence Number=SeqID_84713
MENNMTCRSIIGSKEMNENAKNESKRVQWKLGAAAKRDSRKLAGDFEFWGRNRGENGFTPPPF

SEQ ID NO: 176399 - protein, 53 aa, Glycine max
  Coding DNA Sequence Number=SeqID_84714
MSQNFADYLTMDVKYLEAVKRRLHATKQWSPDEIRELVTTNFELKYLLNFLDI

SEQ ID NO: 176400 - protein, 134 aa, Glycine max
  Coding DNA Sequence Number=SeqID_84715
  Gene Ontology: Biological process=transposition, DNA-mediated
  Homolog annotation: Hit_ID=Q1J7G7; Match level="QueryCoverage=23%, HitCoverage=45%, E-value=2e-11, Identity=100%"; Hit description =Transposase
VLQWLLFLSAVPPVQLLTGWCVTAKAPPDISAGKCSGHAARRVPFAIQAAQLLGRAIGAGLFAITPAGERGMCCKAIKLGNAMVFPSHDVVKRRPVNCNTTHYRANWSSTAVAAALELVDPPGCRNSMLYGLEP

SEQ ID NO: 176401 - protein, 111 aa, Glycine max
  Coding DNA Sequence Number=SeqID_84716
MVKVGTSYVPINVSFSPKVGPGLPGINRDTRDLIYSAESDLPSQWLLFSISCPSCSATDGGGRVPFAIQAAQLLGRAIGAGLFAITPAGERGMCCKAIKLGNARVFPVTTL

SEQ ID NO: 176402 - protein, 55 aa, Glycine max
  Coding DNA Sequence Number=SeqID_84717
MENVSHFWVPYEMRAWNGATVKKFYELRRKLRAHIGHGLRTGIELYELEFPVVPQ

SEQ ID NO: 176403 - protein, 142 aa, Glycine max
  Coding DNA Sequence Number=SeqID_84718
  Homolog annotation: Hit_ID=Q9LKS8; Match level="QueryCoverage=54%, HitCoverage=21%, E-value=6e-08, Identity=41%"; Hit description =Putative uncharacterized protein T15F17.m
  Subcellular localization annotation: CTP_CleavageSite=47; ConfidenceScore=5.14e-01
MLSKFILMMPKTQVKNQESSKFQESKSRSIKASFKNQRVVQSRIKIQESEVAASEAHIMVDEQPQRVTLEDYSSSTVQQFLTSIGWQEVQAHNISYPHSLIQLIQGNLFHGLPNEDPYAHLSTYIEICNTVKITGVPEDALG

SEQ ID NO: 176404 - protein, 260 aa, Glycine max
  Coding DNA Sequence Number=SeqID_84719
  Gene Ontology: Mol. function=chloramphenicol O-acetyltransferase activity; Biological process=response to antibiotic
  Homolog annotation: Hit_ID=P62577; Match level="QueryCoverage=71%, HitCoverage=84%, E-value=1e-108, Identity=100%"; Hit description =Chloramphenicol acetyltransferase
  Pfam annotation: Domain name=CAT; Domain location=6-188; Score=407.7; E_value=1.7e-119; Accession=PF00302.9; Description=Chloramphenicol acetyltransferase
MEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWSEYHDDFRQFLHIYSQDVACYGENLAYFPKGFIENMFFVSANPWVSFTSFDLNVANMDNFFAPVFTMGKYYTQGDKVLMRWRFRFIMPFVMASMSAECLMNYNSTAMSGRAGLVLLHVFPGWTQDDSYRIRRSGRTERGVRAYSPAWSELPTRN

SEQ ID NO: 176405 - protein, 75 aa, Glycine max
  Coding DNA Sequence Number=SeqID_84720
MASYGEHCIVLLSGHACNVSQPTLLRASEARLMGASYTGGKCAESPPTFIERKMLEKSKGNSHEEYSRFGSYLYI

SEQ ID NO: 176406 - protein, 173 aa, Glycine max
  Coding DNA Sequence Number=SeqID_84721
LVYAILTQMSVHVAQLITDAIYLFAGLCQSFGVPVTPSKVIRPPITRAFIEKYCTPRQAQDAPPPPHQADPAGSFGMERYLQHLVRQQAANHRGKVQIHECLHQLSLSQQSQGFAPFACPTPDQFRAEVVWPGDWPEAQAGEAPTEAPSDAEEARMDEEMTDLLDFLGGSGGT

SEQ ID NO: 176407 - protein, 80 aa, Glycine max
  Coding DNA Sequence Number=SeqID_84722
MCTCAIFGSRNALSMHEMAPRKLASKRSRKDKAAEGTSSAPEYDSHRFRSAVHQQRFEAIKGWSFLWERRVQLKTLKKRY

SEQ ID NO: 176408 - protein, 72 aa, Glycine max
  Coding DNA Sequence Number=SeqID_84723
MSILPSEENKEKKVPDQRIGRKKKEKIPNQRVGESKKKRKENSRSRIERKQKKYAERSLDQTTSKQYRIVTK

SEQ ID NO: 176409 - protein, 108 aa, Glycine max
  Coding DNA Sequence Number=SeqID_84724
MFSKKEGMMRIMKLAKYRLKAQVEKDEGPSGEGQSPRVEKDEGPNLSRVIPCGVYPDLSSFTGSGVYPDLSSSLEVASTLTYLPSLEVASSNLCSLYQTIHSYSGSHQ

SEQ ID NO: 176410 - protein, 76 aa, Glycine max
  Coding DNA Sequence Number=SeqID_84725
MGNRSGVIDILIGSVHLSNNAGSGNCNRIGFHYLLHAHHGLHHWWAICSFIASMSAFTFSCTSSALPITLALAQVW

SEQ ID NO: 176411 - protein, 111 aa, Glycine max
  Coding DNA Sequence Number=SeqID_84726
FHGGGGFTGFHCRPWSLRCIDYCHWPTRTPWSCACCWSRCHDRTILWTGSKDLPHVFVHVSERHGAVEAKNQGPAGGVDHRKSDSTSNVVLYPDAIPVSIVNAITGTRTTS

SEQ ID NO: 176412 - protein, 121 aa, Glycine max
  Coding DNA Sequence Number=SeqID_84727
MVVISLLMVSRGIIPFEKHTVAVGTTNNNMLSKRKTLDEGSLLSSNSPVESPTVTTYPLAGGRHETHRCVFQERKMRRVATSVYSRKTSEKPERYIVTKQKSFKELDHLNDLLILLKGEKH

SEQ ID NO: 176413 - protein, 127 aa, Glycine max
  Coding DNA Sequence Number=SeqID_84728
MTKNDEERWKIFTETSQKRYESASAWIFFTKTIFLTNFKGKEGGGCRLTRPGELGCFHQEAPAFCWNTLTGPSEPGCYFHTHVAQQCFLSTPDILWNFTDCLTMGVKYLEAVKRRLHPTKQMVPRRN

SEQ ID NO: 176414 - protein, 57 aa, Glycine max
  Coding DNA Sequence Number=SeqID_84729
MASSVVIMNGYEFIRKGRISCLLKIQEEFGSTLGSHGAKHASHHRVVQGRVKPVFDP

SEQ ID NO: 176415 - protein, 102 aa, Glycine max
  Coding DNA Sequence Number=SeqID_84730
MLLLIFSLVLQGYNKMKPCKVSYQNIKQKMKFGIQELPITMEFLFLQKPLLLEKVIQLLSCYQDRIKVFIPILKTFALQRRVFKAQSIKVSIQGKKQKKPLN

SEQ ID NO: 176416 - protein, 153 aa, Glycine max
  Coding DNA Sequence Number=SeqID_84731
  Gene Ontology: Mol. function=heat shock protein binding; Cellular component=endoplasmic reticulum
  Homolog annotation: Hit_ID=Q7XYV1; Match level="QueryCoverage=66%, HitCoverage=30%, E-value=1e-19, Identity=40%"; Hit description=P58IPK
MSVTKANLLKVKVLIADKEYESAIAESGFLLKEDENNLEALLLCGCAYYYLADHDIATRKAHFGLKNLPKKSKSIFHFGLCKVLVKYGRGKDALDSCSEALKIDGGACGSSCSGNSMLEICDGILPPRVLDRRLQEDWVKDAREDPRVLMSHR

SEQ ID NO: 176417 - protein, 149 aa, Glycine max
  Coding DNA Sequence Number=SeqID_84732
MPQQQVPSLYEHTTKLEETLAQFMQVSMSNQKSTESAIKNLEVQVGQLAKQLADRLSSSFTANTEKNMKEESEKKVEEHKQHLVAELTLEPISDFVELEEVVEDEDDQHERETPIKESEIEIKMKEEQEKENQKEKGKRRRKRKRKREG

SEQ ID NO: 176418 - protein, 129 aa, Glycine max
  Coding DNA Sequence Number=SeqID_84733
MVRTRGLGHVLGHVTGRGVGRGNSDDSDDAPQHRRPTTSACRQRVAVTAEHDEPVVPVTKVVGASIEPAVYADEPMAGGDVHDTRADTPVDTSAQAAEDEPEGFLGGPSDPSLLTEYEDHIAGYVWTGE

SEQ ID NO: 176419 - protein, 227 aa, Glycine max
  Coding DNA Sequence Number=SeqID_84734
MAPSNHDMARLVAEKKKVDQVVNVVVVNTIAARNVIDAGEKSITLTVDSKDSLLAGSTRTDGQLPIEEIGDNDNPMDFGNPQNEGSSLWDVVFPHSVYNHTHNMPKAYHTDMEKLSFVSSVKDAHVEITRLHVILCVVEDQWWDMMKEKKTLEKEKLCLVAKAKKLRKQVSDTEAGLVTLDQAKVNLEKDKEVLAKKEKEIMDSLENFKNEKRNLQERVTTLEVQLT

SEQ ID NO: 176420 - protein, 113 aa, Glycine max
  Coding DNA Sequence Number=SeqID_84735
  Homolog annotation: Hit_ID=A7PVN8; Match level="QueryCoverage=81%, HitCoverage=19%, E-value=1e-21, Identity=55%"; Hit description =Chromosome chr9 scaffold_33, whole genome shotgun sequence
  Pfam annotation: Domain name=zf-CCHC; Domain location=61-78; Score =21.0; E_value=0.001; Accession=PF00098.14; Description=Zinc knuckle
MLNLLIEYENQIASKKKKGTLMIVSKSSKKKGKVPKRKHLGPKCDLTKPKNKRNKINQTDVECFFCKEKGHSKRNCKKYLDSLKNKKQVRVLERALGREDVENVDNAIDEPHE

SEQ ID NO: 176421 - protein, 60 aa, Glycine max
  Coding DNA Sequence Number=SeqID_84736
MPLQGEDESRISSPPQEAMNKSLKIKEDEWKEKERRSTKFCALNEPTNPRSSPRFSTKCA

SEQ ID NO: 176422 - protein, 379 aa, Glycine max
  Coding DNA Sequence Number=SeqID_84737
  Gene Ontology: Mol. function=caspase activity; Cellular component =apoplast; Biological process=proteolysis
  Homolog annotation: Hit_ID=Q9ZSP8; Match level="QueryCoverage=83%, HitCoverage=99%, E-value=3e-77, Identity=44%"; Hit description=Latex- abundant protein
  Pfam annotation: Domain name=Peptidase_C14; Domain location=64-377; Score=58.4; E_value=2.5e-14; Accession=PF00656.13; Description =Caspase domain
MESLSAVPSDNQTHRVLQHEKLSAGHVSTYVQHNHQIHWRITTVALCSKKEVVAEECEIGTTAKKAILVGINYPRTKAKLRGCINDVWRIHRCLIEKYDFYEHDITVLIDTDESYMEPNGKNIRSVLTRLVQSAEPGDVLFMHYSGHGTRLLAKTREDGDTSYDECIVPSDMNLIIGCAFSVNVSQGCFWSISVLTVTGFWSTLVRICLANIDKVFHSTTDDDRDIELPHKQCGYVKNRLSLYDIFGEDASPKVNKFLKVILNKLEHGNGRILGLVGSLAQEFLKQKLDSNDGGGYAKPAMETKVERKYEAYVGSSSMKPRLSKWRNFDEWLLDRPNSDGSVTNQEIILKAREKLKRVGFKQRPGLYYSDDHVDGPFVC

SEQ ID NO: 176423 - protein, 88 aa, Glycine max
  Coding DNA Sequence Number=SeqID_84738
  Gene Ontology: Cellular component=chloroplast
  Homolog annotation: Hit_ID=Q49KT9; Match level="QueryCoverage=45%, HitCoverage=35%, E-value=6e-11, Identity=77%"; Hit description =Putative uncharacterized protein ORF113
MKPESLVIAGQPYGGEFVPGPCTHRPSHYGSWAMPEVVTLTARGGCQGRASDWSEVVTSHMDSLMCSSAPDPEMWIIQGTLAWRTSPV

SEQ ID NO: 176424 - protein, 38 aa, Glycine max
  Coding DNA Sequence Number=SeqID_84739
MEVRPLCSTIVSRCHVVVSFDYPERGKLSLGLARFKSR

SEQ ID NO: 176425 - protein, 150 aa, Glycine max
  Coding DNA Sequence Number=SeqID_84740
MGDQEETQEQMKADMSALKEQMASMMEAMLSMKQLIEKNAATAAAVSSAAEADPTLLATVAPSSLKHTLTWDTTERLTLMDCRPTIHHPSCKKMRATLLLPSLKESLLSSPTKSTKTLKTMLEGMSSSIPRSPKGRHQARCLNPTSRHHQ

SEQ ID NO: 176426 - protein, 108 aa, Glycine max
  Coding DNA Sequence Number=SeqID_84741
MVLLNLFLDEFDRAFIRLFPGIRYARYVHEVFVALPMSSSEKVSLEDIQTLLKVQDPRLASKVDFSVGGVTRSRKGSTHSAVKDVISSNDLIQGNETSSMTRPLSLLG

SEQ ID NO: 176427 - protein, 125 aa, Glycine max
  Coding DNA Sequence Number=SeqID_84742
  Homolog annotation: Hit_ID=Q949K7; Match level="QueryCoverage=25%, HitCoverage=36%, E-value=4e-07, Identity=71%"; Hit description =Putative gag polyprotein
MEAIKEQMATMMKAMMSMKKIMEANAVIVAAISAVAKVNPMLPSGLKQMNHPTSNIAPPAMAEKGKADHLEERLRAIEGGEDYSFANLEELFLVPNIITPPKFKVLDFDKYKGTTCPKNHLKMYC

SEQ ID NO: 176428 - protein, 190 aa, Glycine max
  Coding DNA Sequence Number=SeqID_84743
  Homolog annotation: Hit_ID=A5BSR3; Match level="QueryCoverage=33%, HitCoverage=20%, E-value=2e-08, Identity=48%"; Hit description =Putative uncharacterized protein
MARTKKTGEMTTEAAKEIAEKIDSFEEQATQGCFIPRGRQDIFTASIGRLEHPGRVRAVGAGVTIKQYFGLAPRTSRSSSSLPPEELQQLTQQIRDQLEESIIEKVTRQLLAMFSQMQSQFQSQMQSQGLALPSEPLVGPSSPRVSTKESCVDPSGNDLETDDSDSQVKVGVEEVKDPDAPIPVPTNEVP

SEQ ID NO: 176429 - protein, 186 aa, Glycine max
  Coding DNA Sequence Number=SeqID_84744
LEPLYVPINVFISPKVGPGLSRYQQGHQDLFILRSDLPSQWLLFLSAVPPVQLLTGVVRNRKKHRRTSALAKCSGHAARNHHTPPRLMRRYRARPIRHSGCATVGKGDRHDVVKRRPVNCNTTHYRANWSSTAVAAALELVDPPGCRNSITYIYLGCDTENKREYISYGSVQVERTSTWLFKENNG

SEQ ID NO: 176430 - protein, 43 aa, Glycine max
  Coding DNA Sequence Number=SeqID_84745
MVKARQKGGKRGRWLQNFTDCTTMLPFDFQHVAELHGLPNNGC

SEQ ID NO: 176431 - protein, 332 aa, Glycine max
  Coding DNA Sequence Number=SeqID_84746
  Gene Ontology: Mol. function=maltose transmembrane transporter activity; Cellular component=periplasmic space; Biological process =carbohydrate transport
  Homolog annotation: Hit_ID=P19576; Match level="QueryCoverage=100%, HitCoverage=83%, E-value=0.0, Identity=95%"; Hit description=Maltose- binding periplasmic protein precursor
  Pfam annotation: Domain name=SBP_bac_1; Domain location=1-252; Score =101.8; E_value=2.1e-27; Accession=PF01547.16; Description=Bacterial extracellular solute-binding protein
HPDKLEEKFPQVAATGDGPDIIFWAHDRFGGYAQSGLLAEVTPDKAFQDKLFPFTWDAVRYNGKLIAYPIAVEALSLIYNKDLVPNPPKTWEEIPKLDKELKAKGKSALMFNLQEPYFTWPLIAADGGYAFKFENGKYDVKDVGVDSAGAKAGLTFLVDLIKNKHMNADTDYSIAEAAFNKGETAMTINGPWAWSNIDKSKINYGVTLLPTFKGKPSKPFVGVLSAGINAASPNKELAKEFLENYLLTDQGLDEVNKDKPLGAVALKSFQDQLAKDPRIAATMDNAQKGEIMPNIPQMAAFWYATRTAVINAASGRQTVDAALKDAQGRITK

SEQ ID NO: 176432 - protein, 106 aa, Glycine max
  Coding DNA Sequence Number=SeqID_84747
MLALKPIKTQCKIKKFNLARAIPWKIIKGDSSFNPTIKRKKKEETTESTQRAFKSVVIQVGKLAEEVTKVMARREENFVVVEAQEESPVEEHDSREKDEEEMEEEA

SEQ ID NO: 176433 - protein, 90 aa, Glycine max
  Coding DNA Sequence Number=SeqID_84748
MKWKMVCTKKLSQMTYKATKEIADRIDSLEYQVSQGSFVTHGRQDALTTAIGRPEHHAHVRVARASVTIKHYFGPASRAPAPLRPWLLKT

SEQ ID NO: 176434 - protein, 18 aa, Glycine max
  Coding DNA Sequence Number=SeqID_84749
MDPVKYIFEKPALTGRIA

SEQ ID NO: 176435 - protein, 133 aa, Glycine max
  Coding DNA Sequence Number=SeqID_84750
  Gene Ontology: Mol. function=catalytic activity; Cellular component =integral to membrane; Biological process=metabolic process
  Homolog annotation: Hit_ID=A8APD4; Match level="QueryCoverage=98%, HitCoverage=23%, E-value=2e-58, Identity=86%"; Hit description =Putative uncharacterized protein
MGTPANKSMLESTGFWHPDFAEATPNDICVAVRTQEAQPEILDLIREQLEKELSAIANASGSSTQLVKARRWESACQKLPDANLLLVSVAGEYAAGVAKEGLLANKSVMLFSDNVPLEQEVELKTLAREKGAH

SEQ ID NO: 176436 - protein, 97 aa, Glycine max
  Coding DNA Sequence Number=SeqID_84751
MVQVCTIKFRTAYPNFMKIQWLQCEGFSSKLRCNIEIPNGENAQNWVANMVLKFHDDPTVNEPKIVVFLRQVWWTAGKRKGFERRKGKTKMKPKRAT

SEQ ID NO: 176437 - protein, 275 aa, Glycine max
  Coding DNA Sequence Number=SeqID_84752
MTYSELWPSLLENHLVVAIPRRVLQPPYRKWYDPGAKCAYHSGVPGHNIDSCRLFKYKDGPSRAKSLGEVATSRRFIYQSLQAACMVSRGGGERDECLFHLGESHDMETCPVVEELLQWLMDWGQLEVSKGGKEEPHICMQLEERKVPLMPKALVICFTRKETGSTPIYPRTAPKPTPFAYQSNKVVPWKYTPPAFSERVATEVDSLSAKVTNITGLNGITCSGRVFASPHPAELPSKGKAPMVQEPTDVATPSKEVDPPVVRGAEKKEVFKGIL

SEQ ID NO: 176438 - protein, 69 aa, Glycine max
  Coding DNA Sequence Number=SeqID_84753
MGWYKGPCGSHHAQQCKFPDLVKKARKEFVITTESKSSVTFGNIYSIKFGFFPLGPYYAPCPKSARREG

SEQ ID NO: 176439 - protein, 38 aa, Glycine max
  Coding DNA Sequence Number=SeqID_84754
MADTTGRIPLWIIGTVTGITRNNSPGIHSNSSKKEWIP

SEQ ID NO: 176440 - protein, 72 aa, Glycine max
  Coding DNA Sequence Number=SeqID_84755
  Subcellular localization annotation: CTP_CleavageSite=64; ConfidenceScore=5.54e-01
MEKPLCPGPLPSLLSIFLASSRKSPPRSKPVYTPLAPNTQTASPPRVGRFINAAGTTGFPTGKRAVSATQLM

SEQ ID NO: 176441 - protein, 122 aa, Glycine max
  Coding DNA Sequence Number=SeqID_84756
MAYYDPLQRHALVPTPNALLGTQWNVPGAIPDMDELLGVDLRHQFSAEADQVEDRRHRGRRNLDRHAQKWKQPCGTSSHGSSQSISFLILVDFGRPFARIVLGVGISVNEPSEGGIVASFPR

SEQ ID NO: 176442 - protein, 154 aa, Glycine max
  Coding DNA Sequence Number=SeqID_84757
  Homolog annotation: Hit_ID=Q6UUU1; Match level="QueryCoverage=73%, HitCoverage=95%, E-value=2e-24, Identity=51%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGNGGETRQDYKDTRRFPLAAPRALSVPAFRFTGVIPLYGRVCLIPRLNTQFR

SEQ ID NO: 176443 - protein, 103 aa, Glycine max
  Coding DNA Sequence Number=SeqID_84758
MGDQATSIHNIKAKLHDESRLIQRCFDDNKGDDKQLKGQSKNEFKMFKIESRTLQDSRGKLISRIKNQDSRIKLPRIKIKTQDSRIKKRLNQDKYEKVFSKTE

SEQ ID NO: 176444 - protein, 333 aa, Glycine max
  Coding DNA Sequence Number=SeqID_84759
  Gene Ontology: Mol. function=cobalt ion transmembrane transporter activity; Cellular component=integral to membrane; Biological process=nickel ion transport
  Homolog annotation: Hit_ID=A6T5K4; Match level="QueryCoverage=60%, HitCoverage=75%, E-value=1e-79, Identity=68%"; Hit description =Putative uncharacterized protein
  Pfam annotation: Domain name=NicO; Domain location=1-235; Score=57.6; E_value=4.2e-14; Accession=PF03824.7; Description=High-affinity nickel-transport protein
MAAFIVAIRGTLKQAVLLGLAATLSHTAVVWVIAMAGLWFGRGWDAHTSEPWFQLISGVLIVLIALWMAWRTWKESQPHDHHHHHHHDHDHDHDHQHDHHHEHPLVDDEWQDAHQRAHAQDINRRFSGQNVTTGQIVVFGLTGGLIPCPASITVLLICLQLKHFALGATLVFSFSIGLAITLVASGAIAALSLKHATKRWPGRPRPVAASHGSVKRLPPAEGITQLALLENKFRRDAGAPGVIAAHAHMECIKIEPASGLCTQQMLMGCLSQLLLAVAAHREMEAAIQLMRSQHQLAGITAQAIFRREDIRRMPGLQGQSPAPLLCRQLSVRI

SEQ ID NO: 176445 - protein, 218 aa, Glycine max
  Coding DNA Sequence Number=SeqID_84760
  Gene Ontology: Mol. function=transferase activity, transferring groups other than amino-acyl groups; Cellular component=1-2nm peptidoglycan-based cell wall; Biological process=lipopolysaccharide core region biosynthetic process
  Homolog annotation: Hit_ID=A8AHJ7; Match level="QueryCoverage=89%, HitCoverage=72%, E-value=9e-87, Identity=79%"; Hit description =Putative uncharacterized protein
  Pfam annotation: Domain name=Lip_A_acyltrans; Domain location=1-183; Score=99.0; E_value=1.4e-26; Accession=PF03279.4; Description =Bacterial lipid A biosynthesis acyltransferase
MEKAREKGNGVVLVGMHFLTLELGARIFGMLNPGIGVYRPNNNALLDWLQTRGRLRSNKTMLDRHDLKGMIRSLKQNEILWYAPDHDYGKTNSVFVPFFAVPDAATTAGSYMLVKSARPAVVPFVPRRKADGSGYELIILEDISEALQGGDKEAVATQMNRAIEHAVRMAPEQYMWLHRRFKTRPEGVPDRYARQKQTATRHDILSDGDFSDRSGVQH

SEQ ID NO: 176446 - protein, 637 aa, Glycine max
  Coding DNA Sequence Number=SeqID_84761
  Gene Ontology: Mol. function=calcium-dependent cysteine-type endopeptidase activity; Cellular component=intracellular; Biological process=proteolysis
  Homolog annotation: Hit_ID=A7P092; Match level="QueryCoverage=81%, HitCoverage=23%, E-value=1e-179, Identity=65%"; Hit description =Chromosome chr6 scaffold_3, whole genome shotgun sequence
MAKYLARSSTPFALWYPESFCMGSCYFSNSGAYHLGLLVDCNIGSRPDWFGCNNGWHCSSIGILFNYAVVENSVAKLKLYWIQCKPGSQKKKVKKVAGLVGAVAILLLLAVALLCAYELCAVYVTTGSRASDRYSPSGFFFGVSAIALAINMLFICRMVFNGNGLDVDEYVRRAYKFAYSDCIEVGPVACLPEPPDPNELYPRQSRRASHLVLLYLGSLCVLLVYSILYGLTAKEENWLGAITSVAVIILDWNLGACLYGFQLLDSRVAALFIAGTSRVFLICFGVQYWYLGHCISYAVMASVLLGAAVSRHLSATNPLAARRDALQSTVVRLREGFRRKEHNSSSSFSEGCGSSMKRSSSVEAGNLGNVIEVGRAMAAGDGSNWNNVLSQTTSLPDGINSDKSIDSGRSSLALHSSSCRSAVHEPEVGTSSDDRNLDHNNSLVVCSSSGLDSQGNESSASNSANQQTLDLNLALAFQERLNDPRIVTMLKRTRQGDQELSSLLQDKGLDPNFAMMLKEKSLELDPTILALLQRSSMDADRDHNENTDNTSVDNAMPNQISLSEELRLHGLEKWLQLCRLVLHHITVWFGGAPVISCDMFNYGFPSITYGRRNVHDIKTKEGTRLAVFRIKNAKFIY

SEQ ID NO: 176447 - protein, 710 aa, Glycine max
  Coding DNA Sequence Number=SeqID_84762
  Gene Ontology: Mol. function=calcium-dependent cysteine-type endopeptidase activity; Cellular component=intracellular; Biological process=proteolysis
  Homolog annotation: Hit_ID=A7P092; Match level="QueryCoverage=99%, HitCoverage=32%, E-value=0.0, Identity=68%"; Hit description =Chromosome chr6 scaffold_3, whole genome shotgun sequence
  Pfam annotation: Domain name=DUF554; Domain location=7-216; Score= -144.9; E_value=0.098; Accession=PF04474.3; Description=Protein of unknown function (DUF554)
MAPYGFIAWLLSTCVGLLLSFLSKSSVLLGISLTVPLMVACLSVAIPIWICNGYQFWVPRLNCNGSAGNDRIPRTKEGIVLLISMSVFVGSVLALGAIVSAKPLDDLRYKGWNGDPKILGSPYTSSVFLGWAMASAIGLVVTSVLPIISWFATYRFSLSSAIFIGLFAVILVAFCGVSYLEVIKTRDDQVPTNGDFLAALLPLVCIPAVLSLCCGLLKWKDDDWKLSRGVYIFVIIGLLLLLGAISALIVVVKPWTIGVAFLLVLLLMVLAIGAIHHWASNNFYLSRTQMVFVCFLAFLLALAAFLVGWFEGKPFVGASVGYFSFLFLLAGRALTVLLSNPIVVYSPRVLPVYVYDAHADCGKNVSVAFLMLYGIALATEGWGVVASLKIYPPFAGAAVSAITLVVSFGFAVSRPCLTLKMMEDAVHFLGKETVIQAIARSATKTRNALSGTYSAPQRSASSAALLIGDPTIMRDRAGNFVLPRADVMKLRDRLRNEELVAGSFFSRLRYHRTFRHEPTSDVDHRRVMCAHARILALEEAIDTEWVYMWDKFGGYLLLLLGLTSKAEQAQDEVRLRLFLDSIGFSDLSAKKIKKWMPEDRRQFEIIQESYIREKEMEEEVFMQRREEEGRGKERRKALLEKEERKWKEIEASLLSSIPNASSREAAAMAAAVRAVGGDSVLDDSFARERVSSIARRIRASQLSQRALQVY

SEQ ID NO: 176448 - protein, 377 aa, Glycine max
  Coding DNA Sequence Number=SeqID_84763
  Gene Ontology: Mol. function=nucleic acid binding; Cellular component= intracellular; Biological process=chromatin-mediated maintenance of transcription
  Homolog annotation: Hit_ID=A7QCJ6; Match level="QueryCoverage=94%, HitCoverage=89%, E-value=1e-129, Identity=63%"; Hit description =Chromosome chr12 scaffold_78, whole genome shotgun sequence
  Pfam annotation: Domain name=zf-C2H2; Domain location=142-166; Score =33.7; E_value=6.8e-07; Accession=PF00096.17; Description=Zinc finger, C2H2 type
  Pfam annotation: Domain name=zf-C2H2; Domain location=172-196; Score =30.7; E_value=5.5e-06; Accession=PF00096.17; Description=Zinc finger, C2H2 type
  Pfam annotation: Domain name=zf-C2H2; Domain location=236-261; Score =25.1; E_value=0.00025; Accession=PF00096.17; Description=Zinc finger, C2H2 type
  Pfam annotation: Domain name=zf-C2H2; Domain location=56-80; Score =26.2; E_value=0.00012; Accession=PF00096.17; Description=Zinc finger, C2H2 type
  Pfam annotation: Domain name=zf-C2H2; Domain location=85-136; Score =0.5; E_value=9.9; Accession=PF00096.17; Description=Zinc finger, C2H2 type
  Pfam module annotation: Pfam domain module=zf-C2H2::zf-C2H2::zf -C2H2::zf-C2H2::zf-C2H2; Domain location=142-166::172-196::236 -261::56-80::85-136
MERSDAARVPQDLVTTGGKCMILKWVTEDTLKTLKEKVKEPSVPEPEPEPTTEVLFLCSYDGCGKTFIDAGALRKHSHIHGERQYVCHYDGCGKVVVLILTDAHPYTCLFSSAESILFTLQKFLDSSKLKRHFLIHTGERDFVCPHEGCGKAFSLDFNLRSHMKTHSQENYHICPYPDCGKRYAHEYKLKNHIASHHEKNASVDVTKYTTPPSEKQTKTSKPSGGAYGSASSDRPYACPYDGCEKAYIHEYKLRLHLKREHPGLMADENAEHAQANVDNEMDEASDHDAYVAKRSNGKIQKQSKPKPNLKLPPSKIAKRKLSTPSLTVNKNSWPVKDEPFDEEDSEETEEDRDNVEDGWRYAGGNNEDDDEETEYED

SEQ ID NO: 176449 - protein, 375 aa, Glycine max
  Coding DNA Sequence Number=SeqID_84764
  Gene Ontology: Mol. function=protein dimerization activity; Cellular component=nucleus; Biological process=regulation of transcription, DNA-dependent
  Homolog annotation: Hit_ID=A9PHN3; Match level="QueryCoverage=98%, HitCoverage=98%, E-value=1e-124, Identity=64%"; Hit description =Putative uncharacterized protein
  Pfam annotation: Domain name=bZIP_1; Domain location=233-291; Score =24.5; E_value=0.00039; Accession=PF00170.12; Description=bZIP transcription factor
  Subcellular localization annotation: CTP_CleavageSite=35; ConfidenceScore=5.24e-01
MANSKGSSGFRNFMYPGKHPLLPPKSPFPSVSQAYADYVPNPAVGLKAGNRPRDGNTHHQRTSSESLVIEEQPSWLDDLLNEPETPVRRGGHRRSSSDSFAYIDTVNASNINYANQDEYKYKNMMSIPSWSSQDFDRSKDARHVPVYAEMNSVKQKNRSWDSFSNAMTNPVGVPSGKDSAAFQSSGLQCTPHEADGLPPASSEKHDSVESGLQDAKPFPEKKDSSHAKSSASETDTKRAKQQFAQRSRVRKLQYIAELERNVQVLQAEGSEVSAELEFLNQQNLILSMENKALKQRLENIAQEQLIKYLEQEVLEREIGRLRALYQQQQQPQTQPQQQPSGSHRRTNSRDLESQFANLSLKHKDTNSGQDPALRI

SEQ ID NO: 176450 - protein, 186 aa, Glycine max
  Coding DNA Sequence Number=SeqID_84765
  Gene Ontology: Mol. function=catalytic activity; Cellular component =membrane; Biological process=metabolic process
  Homolog annotation: Hit_ID=A5AK90; Match level="QueryCoverage=86%, HitCoverage=28%, E-value=2e-68, Identity=73%"; Hit description =Putative uncharacterized protein
  Pfam annotation: Domain name=PLDc; Domain location=32-59; Score=41.4; E_value=3.2e-09; Accession=PF00614.13; Description=Phospholipase D. Active site motif
MAPSRLAGMKLVEIKVPAFISISVSVKKFRRFMIYVHAKGMVVDDEYVIIGSANINQRSLDGSRDTEIAMGAYQPKYTWTEKNAHPRGQVYGYRMSLWAEHLGSLDHCFAEPHNLECVRHVNKIAKRNWDIYVSEEENRMRGHLMQYPVKISRDGKVSALDDYESFPDVGGKILGSPNSLPDALTT

SEQ ID NO: 176451 - protein, 767 aa, Glycine max
  Coding DNA Sequence Number=SeqID_84766
  Gene Ontology: Mol. function=1-phosphatidylinositol-4-phosphate 5 -kinase activity; Cellular component=plasma membrane; Biological process=phosphatidylinositol metabolic process
  Homolog annotation: Hit_ID=A7PYP4; Match level="QueryCoverage=93%, HitCoverage=99%, E-value=0.0, Identity=66%"; Hit description =Chromosome chr12 scaffold_38, whole genome shotgun sequence
  Pfam annotation: Domain name=MORN; Domain location=110-132; Score =32.1; E_value=2e-06; Accession=PF02493.11; Description=MORN repeat
  Pfam annotation: Domain name=MORN; Domain location=133-155; Score =31.9; E_value=2.3e-06; Accession=PF02493.11; Description=MORN repeat
  Pfam annotation: Domain name=MORN; Domain location=156-178; Score =30.9; E_value=4.6e-06; Accession=PF02493.11; Description=MORN repeat
  Pfam annotation: Domain name=MORN; Domain location=179-201; Score =19.4; E_value=0.014; Accession=PF02493.11; Description=MORN repeat
  Pfam annotation: Domain name=MORN; Domain location=18-40; Score=23.4; E_value=0.00085; Accession=PF02493.11; Description=MORN repeat
  Pfam annotation: Domain name=MORN; Domain location=41-63; Score=34.4; E_value=4.1e-07; Accession=PF02493.11; Description=MORN repeat
  Pfam annotation: Domain name=MORN; Domain location=64-86; Score=30.8; E_value=5e-06; Accession=PF02493.11; Description=MORN repeat
  Pfam annotation: Domain name=MORN; Domain location=87-109; Score =19.3; E_value=0.014; Accession=PF02493.11; Description=MORN repeat
  Pfam annotation: Domain name=PIP5K; Domain location=424-760; Score =504.4; E_value=1.3e-148; Accession=PF01504.9; Description =Phosphatidylinositol-4-phosphate 5-Kinase
  Pfam module annotation: Pfam domain module=MORN::MORN::MORN::MORN::MOR N::MORN::MORN::MORN::PIP5K; Domain location=110-132::133-155::156 -178::179-201::18-40::41-63::64-86::87-109::424-760
MEDSERFEERSFSNGDVYIGKIKGMLPHGKGKYTWSDGTVYEGDWVNGKMTGKGLITWPTGAKYEGEFSGGYLHGHGTFTHSTGCIYSGGWRMDAHHGIGRKEYSNSDIYEGLWKEGIREGCGRYSWENGNTYIGNWKSGKIDGRGVMKWANDDIFDGCWINGLKQGSGVYRFADGGLYIGTWSKGLKDGRGTFYPAEKHTATKQKFTRSFSEKISVSGRSKSSRQISHRTSSLDANCIIQDPAGDCICRDSSPTLSQTFNESQSEASGVNSLLYEREYMQGVLIMERIRNYSEIPHKNKRQNTFSVKQAKKSSWIDIFGGSRSYYLKLNLQLGISNTDRYIWAWVENVKTFKYTVGKITPVPAREVRSSDFGDRARIRMYFPKEGSQLTPPHCSIDFYWKDYCPMVFRNLREMFKLDAAEYMMSICGDSGLRDISSPGKSGSIFFLSQDDRFVIKTLKKYELKVMLNMLPKYYHHVGSYENTLITKFFGLHRITLRGGKKVRFVVMGNMFCTELHIHRRYDLKGSTQGRYTDKDKINSNTTLKDLDLKYEFHMDKKLRESLFKQISLDCMFLESQHIIDYSLLLGLHFRAPENLKALVEPPRLPQPQHGLPSEDDAQKQGEQLIIPKGLLLVAHEPSFVNTAPGPHIRGNTLRAYSIGDKQVDLLLPGTARLRVQLGVNMPAQATRKLQEDKVEESEVELFEVYDVVLYMGIIDILQEYTVKKKLEHACKSLQYDPMTISVVEPKTYAERFINFMEKKVFPEPETS

SEQ ID NO: 176452 - protein, 247 aa, Glycine max
  Coding DNA Sequence Number=SeqID_84767
  Gene Ontology: Mol. function=acetolactate synthase activity; Cellular component=chloroplast; Biological process=branched chain family amino acid biosynthetic process
  Homolog annotation: Hit_ID=A7QAY2; Match level="QueryCoverage=91%, HitCoverage=93%, E-value=1e-102, Identity=69%"; Hit description =Chromosome chr5 scaffold_72, whole genome shotgun sequence
  Pfam annotation: Domain name=ACT; Domain location=80-146; Score=44.3; E_value=4.4e-10; Accession=PF01842.16; Description=ACT domain
MGASAPFWRYSAASYPDLEGRTPVNALVGAKNMKPVAKLDTPVGGDVYPIEPSDGFTVNQVLDAHWGVLNDEDTSGIRSHTLSMLVNDAPGVLNIVTGVFARRGYNIQSLAVGHAEVEGLSRLTTVVPGTDESISKLVQQLYKLVELHEVRDITHLPFAERELMLIKIAVNAAARRDVLDIASIFRAKAVDVSDHTITLELTGDLDKMVALQRLLEPYGICENIHTGGKNSVLLVLAKMYLFSFEAL

SEQ ID NO: 176453 - protein, 32 aa, Glycine max
  Coding DNA Sequence Number=SeqID_84768
MVVVLMKKEKNVKIVLSVSMTVSLHGKGCEMK

SEQ ID NO: 176454 - protein, 418 aa, Glycine max
  Coding DNA Sequence Number=SeqID_84769
  Gene Ontology: Mol. function=identical protein binding; Cellular component=cell wall; Biological process=negative regulation of catalytic activity
  Homolog annotation: Hit_ID=A7QC07; Match level="QueryCoverage=98%, HitCoverage=47%, E-value=1e-156, Identity=68%"; Hit description =Chromosome chr10 scaffold_76, whole genome shotgun sequence
  Pfam annotation: Domain name=Peptidase_S8; Domain location=164-418; Score=-45.7; E_value=0.00026; Accession=PF00082.13; Description =Subtilase family
  Pfam annotation: Domain name=Subtilisin_N; Domain location=34-151; Score=32.9; E_value=1.2e-06; Accession=PF05922.7; Description =Subtilisin N-terminal Region
  Pfam module annotation: Pfam domain module=Peptidase_S8::Subtilisin _N; Domain location=164-418::34-151
MENMHWSQHTHLVVLFFLGMVLIPSVCQSDSTTAVYIVTLRQAPASHYHHHELITVGNNSKHGSSGRRRTRVHKQRHQNVSKPVMKRGSYFARVHDSLLNKVFNGEKYLKLYSYHYLINGFAVLVTQQQAEKLSRRREVSNVALDFSVRTATTHTPQFLGLPQGAWLQAGGFETAGEGIAIGFVDTGIDPTHPSFADDKSEHPFPVPAHFSGACEVTPDFPSGSCNRKLVGARHFAASAITRGIFNSSQDYASPFDGDGHGTHTASVAAGNHGIPVIVAGQVFGNASGMAPHSHIAIYKALYKRFGGFAADVVAAIDQAAQDGVDIICLSITPNRRPSGIATFFNPIDMALLSAVKAGIFVVQAAGNTGPSPMSMSSFSPWIFTVGATSHDRVYSNSLCLGNNVTIPGVGLARKILLL

SEQ ID NO: 176455 - protein, 690 aa, Glycine max
  Coding DNA Sequence Number=SeqID_84770
  Gene Ontology: Mol. function=nucleic acid binding; Cellular component= nucleus; Biological process=red or far red light signaling pathway
  Homolog annotation: Hit_ID=Q6E7D1; Match level="QueryCoverage=100%, HitCoverage=63%, E-value=0.0, Identity=75%"; Hit description=DNA damage-binding protein 1
MGDVSDRIGRPTDNGQIGIIDPDCRLIGLHLYDGLFKVIPFDNKGQLKEAFNISASNYEPMTLIKDYQLPKPWLCKNELRTYVKLEELQVLDIKFLYGCSKPTIVVLYQDNKDARHVKTYEVALKDKDFLEGPWSQNNLDNGADLLIPVPPPLCGVLIIGEETIVYCSANAFKAIPIRPSITKAYGRVDPDGSRYLLGDHTGLLSLLVITHEKEKVTGLKIEPLGETSIASTISYLDNAFVYIGSSYGDSQGQGQVVTCSGAYKDGSLRVVRNGIGINEQASVELQGIKGMWSLRSSTDDPFDTFLVVSFISETRILAMNLEDELEETEIEGFCSQVQTLFCHDAVHNQLVQVTSSSVRLVSSTTRELRNEWHAPSGYSVNVATANATQVLLATGGGHLVYLEIGDGILQEVKHAQLEYEISCLDINPIGENPNHSHLAAVGMWTDISVRIFSLPDLSLITKEQLGGEIIPRSVLLCAFEGISYLLCALGDGHLLNFMLNTSTGELADRKKVSLGTQPITLRTFSSKNTTHVFAASDRPTVIYSSNKKLLYSNVNLKEVSHMCPFNSAAFPDSLAIAKEGELTIGTIDDIQKLHIRSIPLGEHARRICHQEQSRTFAICSLKYNPASGEDSEMHFVRLLDDQTFEFISTYSLDTYEYGCFIISCSFSDDNNVYYCVGTAYVLPEENEPTK

SEQ ID NO: 176456 - protein, 163 aa, Glycine max
  Coding DNA Sequence Number=SeqID_84771
  Subcellular localization annotation: CTP_CleavageSite=45; ConfidenceScore=5.16e-01
MKNKGKQVQLMDSSHSDSPKNLSESRCPPYTKKRLIPDSTVISTRHASLRSAKKLIETRGTSVDVAQMKKASEDENPVANHSVQMEEHNAFEAQFIPFEQEHLEEDIEASNSGESSDKNNDKSISMVGHPSFCLNLLNLLIWGTMRLIMLDKDHGLIRLKDTK

SEQ ID NO: 176457 - protein, 197 aa, Glycine max
  Coding DNA Sequence Number=SeqID_84772
  Homolog annotation: Hit_ID=A7QBV8; Match level="QueryCoverage=73%, HitCoverage=57%, E-value=6e-39, Identity=58%"; Hit description =Chromosome chr1 scaffold_75, whole genome shotgun sequence
  Pfam annotation: Domain name=NOI; Domain location=156-197; Score =25.6; E_value=9.5e-05; Accession=PF05627.2; Description=Nitrate -induced NOI protein
MFFCLEVIEEIQKRGTREAPGDLLDDKFVQNDNLHSSLNPAAPNSNLLPSRSAVLQACIITSGLIAALGIVIRQVSHVVSVEGFPVLDCSSEVSFGFDMWHFELITGLVVLISSCRYLLLKTWPDFAESSEAAKQPISRSLAHFSLWIILLLHFCLYEQDGKPLPKFGEWDVNDPASAEGFTVIFKPSLQSLLKPSL

SEQ ID NO: 176458 - protein, 45 aa, Glycine max
  Coding DNA Sequence Number=SeqID_84773
MTTAGREVDLRLRSESKREAEDHGREKRNKEEEGVSDGDRGFAPK

SEQ ID NO: 176459 - protein, 653 aa, Glycine max
  Coding DNA Sequence Number=SeqID_84774
  Gene Ontology: Mol. function=hydrolase activity, hydrolyzing O -glycosyl compounds; Biological process=carbohydrate metabolic process
  Homolog annotation: Hit_ID=A7P476; Match level="QueryCoverage=77%, HitCoverage=91%, E-value=0.0, Identity=64%"; Hit description =Chromosome chr1 scaffold_5, whole genome shotgun sequence
  Pfam annotation: Domain name=Cellulase; Domain location=64-366; Score= 35.5; E_value=1.9e-08; Accession=PF00150.9; Description=Cellulase (glycosyl hydrolase family 5)
  Pfam annotation: Domain name=Ricin_B_lectin; Domain location=414-536; Score=10.2; E_value=0.022; Accession=PF00652.13; Description=QXW lectin repeat
  Pfam module annotation: Pfam domain module=Cellulase::Ricin_B_lectin; Domain location=64-366::414-536
MGRWWSSTLVFTVLSAPILIIALLSSTFEEVDHDNTVPVTGLLHTDSRWILDQDGRRVKLACVNWVSHLEAVVAEGLSKKPVDVISKGIKSMGFNCVRLTWPTLLVTNDSLASLTVRRSFQSLGLLESIAGVQTNNPSIIDLSLIQAFQAVVKSLGDNDVMVILDNHVTQPGWCCGNTDGNGFFGDKFFDPNQWILGLTKMATLFKGVTAVVGISLRNELRGSRQNVNDWYKYMVKGAEAAHAANPDVLVILSGLNFDTDLSFLRDRPVSLTFKGKLVFEVHRYGFTDGGAWADGNPNQVCGKVTANIKKTSGFLVDQGWPLFVSEFGGDLRGTNVNDNRYLNCFLALVAELDLDWAYWTLVGSYYFREGVIGMEEFYGLLTWDWNQVRSTSFLNRISALQIPFRGPGIIEGNPHKLIFHPLTGLCVISKSQLTSLTLAACSSSDAWTYTPQKTLLVNNTDFCIHAEEERKPATLSMTCSDPNSKWEMISDSNMHLSSKLSDGSNLCLDVDDNNIIVTNACKCLSKDKTCDPGSQWFKLIDSGRSGGDVHATTMGILGMLSSYSWDAKVVIALAANFKEFWLFQTINNLLKAMLDVTNNVVQFHELPSQYIDPEAPEMLTASNLIPGAVYWTIRSIVSCASHVLDITGLGQGY

SEQ ID NO: 176460 - protein, 156 aa, Glycine max
  Coding DNA Sequence Number=SeqID_84775
  Gene Ontology: Mol. function=translation initiation factor activity
  Homolog annotation: Hit_ID=Q0WMZ1; Match level="QueryCoverage=92%, HitCoverage=25%, E-value=2e-31, Identity=47%"; Hit description =Eukaryotic initiation factor 4B
MEEKLLKEEIDNLKKELEKESTINSNKESVDEAGGDQTSTHAILQQKEKELELLIRDLDDKVRFGQKAIERPGSSAGKSSTFSDRPHSRSGSFEDSRSVDFTDRPRSRGTGDMWMHPSDDRRQFQGSRERGWFSGSRDLNRQLEQQSLSTGTKTFA

SEQ ID NO: 176461 - protein, 325 aa, Glycine max
  Coding DNA Sequence Number=SeqID_84776
  Gene Ontology: Mol. function=two-component sensor activity; Cellular component=membrane; Biological process=signal transduction
  Homolog annotation: Hit_ID=A7P4A7; Match level="QueryCoverage=73%, HitCoverage=59%, E-value=5e-78, Identity=66%"; Hit description =Chromosome chr1 scaffold_5, whole genome shotgun sequence
  Pfam annotation: Domain name=HisKA; Domain location=185-251; Score =13.3; E_value=0.013; Accession=PF00512.16; Description=His Kinase A (phosphoacceptor) domain
MWLRSYVVCFVQVYVRPAGSYVMDRLELRRVALYPGDAEAEGIVILVGHFNIPAGLRAAEATLSNSQVNVVPECKAVVLPMVKHPFVVGFLVAELPLVEQEQCQKSQSDGPENLMSVEEPYSFPPFLDLDKKSREIQNLQVKNEAVGMHNFTSEQRSNAVNISQSLAMAYVMDQKAMLLQQSTWQNNVRMGNLVEQIRGPLSSIQTLSKILSTQTKRTQISHDIVEDLLVQGDRLRDVLQQLQDAVYLTKTNIVRYNEEAIKKMNGSTHILAESSRSQLLDSSPGDVSANKMKKSSESLSLSAAVQDIEMPLPPLALAPLQHGIR

SEQ ID NO: 176462 - protein, 737 aa, Glycine max
  Coding DNA Sequence Number=SeqID_84777
  Gene Ontology: Mol. function=protein tyrosine/serine/threonine phosphatase activity; Cellular component=intracellular; Biological process=protein amino acid dephosphorylation
  Homolog annotation: Hit_ID=A7P490; Match level="QueryCoverage=84%, HitCoverage=75%, E-value=0.0, Identity=56%"; Hit description =Chromosome chr1 scaffold_5, whole genome shotgun sequence
  Pfam annotation: Domain name=DSPc; Domain location=167-306; Score =128.0; E_value=2.8e-35; Accession=PF00782.11; Description=Dual specificity phosphatase, catalytic domain
MEILPLYKRMVGLQRYVYKIDSLYGDSFKLEDRDFSRKNFVTVIAKVIVIGGRGRRVSVATTVEEEDSDGEESNNNNNDRGGGHRRTTHSRSVSWTDRSPVTRKPPRPLQPLAINKRSVMEWPSAGCDDLGDWSLPPTPRGSTITPDSGSGKVFQFKKDYYAFYDKECSRIAEHVYLGSDTVAKSQELLRRHGITHVLNCVGFVCPEYFKTDFVYKTLWLRDSPSEDITSILYDVFDYFEDVRQQGGRMFVHCCQGVSRSTSLVIAYLMWREGQSFEDAFHYVKNARGVTNPNMGFACQLLQCQKRVHAMPASPSSVLRMYRMAPHSPYDPLHLVPKLVDHPSPRALDSRGAFVVHVPSAIYVWIGKECGSAMCCNARSAAAQVVRYERATGEIVSVVEDEEPKEFWIALSTKEVVVEIMEIDVGIRPRRVEEYDLDYGIFHKALAGGVVPPFSLSNAGSENCLPARENGWGRLTRKLASGIMKGLFTSSKCCESSVNIIEEGNQHMNVDPLPPSSNNVGGSRGSFECFGSERGKDNVQVRDQFVVPSVVGSSMPLPPSPHHRASDSFACFLRSSPKFSSNSPTLSPTSSDYASSFTFSPSSTDLSIVSSRQLSPSGLESAEPAHVKDASSSEFRSLVKKEGETFLANHTLVGAKSSLRRKGTSLSIAERRGNNPPPRMLLPSASESSRASKVRVRSRSFSLPVLDDTLMKDLLRVRLMAEDHCNMVLCHVKVGCYA

SEQ ID NO: 176463 - protein, 53 aa, Glycine max
  Coding DNA Sequence Number=SeqID_84778
  Pfam annotation: Domain name=Extensin_1; Domain location=10-19; Score= 2.5; E_value=40; Accession=PF02095.6; Description=Extensin-like protein repeat
  Pfam annotation: Domain name=Extensin_1; Domain location=20-29; Score= 8.0; E_value=0.73; Accession=PF02095.6; Description=Extensin-like protein repeat
  Pfam annotation: Domain name=Extensin_1; Domain location=31-40; Score= 5.4; E_value=5; Accession=PF02095.6; Description=Extensin-like protein repeat
  Pfam module annotation: Pfam domain module=Extensin_1::Extensin _1::Extensin_1; Domain location=10-19::20-29::31-40
MKSYIAPPPPPLYQSPHEKPPIYKPPIYEPPPLEKPPVYNPPPYGRYPPSKKN

SEQ ID NO: 176464 - protein, 74 aa, Glycine max
  Coding DNA Sequence Number=SeqID_84779
MLTCALKTLVSVLYIVTIGSILNMYPKCACRSDEFPVEPTDESSSSSSVLPNYEDNDHEPIVQTQEQEREDANI

SEQ ID NO: 176465 - protein, 386 aa, Glycine max
  Coding DNA Sequence Number=SeqID_84780
  Homolog annotation: Hit_ID=A7P4A9; Match level="QueryCoverage=85%, HitCoverage=81%, E-value=1e-141, Identity=72%"; Hit description =Chromosome chr1 scaffold_5, whole genome shotgun sequence
  Pfam annotation: Domain name=DUF707; Domain location=61-378; Score =655.5; E_value=4.5e-194; Accession=PF05212.3; Description=Protein of unknown function (DUF707)
MVKATRRIITSTTVNNKGAEIEHLIPGLNLPYGLLHLSCIQEKYIDSSITSQDQFPSDATKIWVPTNPRGAERLPPGIVNAESDLFLGRLWGLPSEDLTFKPKYLVTFTVGYEQKKNIDAAVKKVCERVFKLDMPLEQFSKDFTILLFHYDGRTTEWDEFEWSKQAIHVSVHKQTKWWYAKRFLHPDIVVPYDYIFMWDEDLGVENFNAEEYLKLVRKHGLEISQPALEPSKSTKAVCWNMTRRREHSEVHKEAVEPGKCKYPLLPPCAAFVEIMAPVFSRNAWRCVWHMIQNEFVHGWGLDFAFRKCVEPAHEKIGVVDAQWIVHQGIPSLGNQGEAQTTGKPAWRAVKERCGMEWRMFQGRLTNAEKGYYKSKGIDFSNLLVHN

SEQ ID NO: 176466 - protein, 67 aa, Glycine max
  Coding DNA Sequence Number=SeqID_84781
MEAGMTTSSLEEIVKESGKAPGQDQLPQPVQSLLSKSMISACEALKPFHIIVNAVEEVHSGSGLLQT

SEQ ID NO: 176467 - protein, 863 aa, Glycine max
  Coding DNA Sequence Number=SeqID_84782
  Gene Ontology: Mol. function=hydrolase activity, acting on acid anhydrides, catalyzing transmembrane movement of substances; Cellular component=integral to membrane; Biological process =magnesium ion transport
  Homolog annotation: Hit_ID=A7R0H6; Match level="QueryCoverage=88%, HitCoverage=100%, E-value=0.0, Identity=72%"; Hit description =Chromosome undetermined scaffold_309, whole genome shotgun sequence
  Pfam annotation: Domain name=Cation_ATPase_N; Domain location=12-92; Score=3.9; E_value=0.0015; Accession=PF00690.17; Description=Cation transporterATPase, N-terminus
  Pfam annotation: Domain name=E1-E2_ATPase; Domain location=98-338; Score=162.0; E_value=1.6e-45; Accession=PF00122.11; Description=E1 -E2 ATPase
  Pfam annotation: Domain name=Hydrolase; Domain location=342-653; Score=25.5; E_value=0.0002; Accession=PF00702.17; Description =haloacid dehalogenase-like hydrolase
  Pfam module annotation: Pfam domain module=Cation_ATPase_N::E1-E2 _ATPase::Hydrolase; Domain location=12-92::98-338::342-653
  Subcellular localization annotation: CTP_CleavageSite=35; ConfidenceScore=5.20e-01
METQKPRKRRKSTLGYTPWPSQTKTWFSSTLGPLREASLSFTEADRRLRENGPNVPLEYSFPRWWHLLWNSLFHPFIIILIVLSVLSFITCDSPNGFIMLILVFISVTLRFYQEYSSSKAAMKLSEFVKCPIKVQRCAGRVVQKELVVQVDQRDVVPGDIVIFEPGDLFPGDIRLLSSKQLVVSQASLTGESWTTDKTAEIREDHSTPLLDLKNICFMGTNVVSGTGTGLVISTGSNTYMSTMFSKVGKKKPPDEFEKGLRRIFYLLISVILAVVTIMFVINYTTSLNLSQSVLFAISVASALNPQMLPLIINTCLAKGALAMAKDRCIVKSLTSIRHMGSMDILCIDKTGSLTMNHAIMVNHLDCRGLPQEKILRYAFLNSYFKSDQKYPLDDAILAFVYSNGFRFQPSKWRKIDEIPFDFIRRRVSVILETEGGHSQFFGRFLLTKGALLEVLRVCSFIENFDKDEISPFSSNDYQRILNLSEDLSNEGLRVIAVAIRKLEMPQICETSNGSKREEEDIERDMVFIGLITFFDPPKDSAKQALWRLSEKGVKAKVLTGDSLSLTTRVCREVGISTTHVITGPELEQLDQNTFHETVQRATVLARLTPIQKQRVVQSLQTIGNHVVGFLGDGVNDSLALDAANVSISVDSGVAIAKDMADIILLEKDLNVLVAGVEHGRLSFGNTMKYLKMSVIANLGSVISLLIATLLFKYEPLTSRQLLTQNFIYSVGQIALAWDKMDEEYVKTPHKSSERGLSMFMLWNAPVCTLCDVATLLFLWFYYKAYTDVTQKFFHSAWFIEGLLLQTLIIHLIRTEKIPFIQDVASWPVIFSTVVTSAIGIALPFTPIGKVVKRLYILVYKKWL

SEQ ID NO: 176468 - protein, 58 aa, Glycine max
  Coding DNA Sequence Number=SeqID_84783
MDHRISELLSQERLTKSPVKHGLTERVEWIQIVGVGAKTSPRLSSSNVGEGDGIFFAS

SEQ ID NO: 176469 - protein, 545 aa, Glycine max
  Coding DNA Sequence Number=SeqID_84784
  Gene Ontology: Mol. function=hydrolase activity; Cellular component =integral to membrane; Biological process=lipid catabolic process
  Homolog annotation: Hit_ID=A7R569; Match level="QueryCoverage=59%, HitCoverage=93%, E-value=1e-119, Identity=63%"; Hit description =Chromosome undetermined scaffold_889, whole genome shotgun sequence
  Pfam annotation: Domain name=Abhydrolase_1; Domain location=78-318; Score=77.1; E_value=5.9e-20; Accession=PF00561.11; Description =alphabeta hydrolase fold
  Pfam annotation: Domain name=Peptidase_S15; Domain location=34-304; Score=-114.6; E_value=0.08; Accession=PF02129.9; Description=X-Pro dipeptidyl-peptidase (S15 family)
  Pfam module annotation: Pfam domain module=Abhydrolase_1::Peptidase _S15; Domain location=78-318::34-304
MAAGCISFTATRDRCFRFSFSNAGLKSVTTDLGDGTIMHCWAPKAHKDSKPNLLLIHGFGANAMWQWNDFLSPLTRRFNVYVPDLLFFGDSHTTRPDRSEAFQAQCVAALLQAHGLQRTSVVGISYGGFVAYSLAAQFPERVEKVVLCCAGVCLEDKDLDEGMFQVKTVDEAADILLPQTPEKLRQLVQLAFAKPVKTMPTCFLNDYINVMCTDNRQERKELIETLHKDRKLSNLPKITQPTLIIWGEKDLVFPMELAHRLQSISNAFSKLMPSSFGKDTEWNNGNSDIKNAQLVVIKNAGHALNVEKPKEMYKNLKSFLIDPATPTPTAQKNHSNVPNVVLVLVESSGAIQAGVIASFTNTHKPIPRRRKAAHTAATLTPTALGSAIVIIQSPTKRVLQGHSIDPVSGVRRVIPERYNRSIGTTLHGFQVELPFAVEVGGGVDAAGEEEEGGGGDLEGGGGHGRWTEGDGGGGVGDRTHRVGAGVAFQEQLVAGAVGAAGYVGAEQRGAATVAGAEGGGEEESRKRRWWRHALSLALFLFREWN

SEQ ID NO: 176470 - protein, 119 aa, Glycine max
  Coding DNA Sequence Number=SeqID_84785
MSISLEALAMAGASNVQFAMDIEEWELRDSEQNPPPHLLTEEYYNEEYFVTFTNHQEKVDRTGETRKRKCMRSIKTALQALVTSCVIMSDICVGGSRPRMAMALRVKANYGDPKISGTG

SEQ ID NO: 176471 - protein, 35 aa, Glycine max
  Coding DNA Sequence Number=SeqID_84786
MTEGTVAGTGTMHKEKESKNNCMDNPTDICNIIRN

SEQ ID NO: 176472 - protein, 495 aa, Glycine max
  Coding DNA Sequence Number=SeqID_84787
  Gene Ontology: Mol. function=binding; Cellular component=cellular _component; Biological process=protein folding
  Homolog annotation: Hit_ID=A7R3Y7; Match level="QueryCoverage=80%, HitCoverage=64%, E-value=1e-114, Identity=51%"; Hit description =Chromosome undetermined scaffold_588, whole genome shotgun sequence
  Pfam annotation: Domain name=TPR_1; Domain location=182-215; Score =12.5; E_value=0.17; Accession=PF00515.19; Description=Tetratricopepti de repeat
  Pfam annotation: Domain name=TPR_1; Domain location=360-392; Score =3.2; E_value=2.2; Accession=PF00515.19; Description=Tetratricopeptide repeat
  Pfam annotation: Domain name=TPR_1; Domain location=393-426; Score =33.0; E_value=1.1e-06; Accession=PF00515.19; Description =Tetratricopeptide repeat
  Pfam annotation: Domain name=TPR_1; Domain location=427-460; Score =8.1; E_value=0.56; Accession=PF00515.19; Description=Tetratricopeptid e repeat
  Pfam annotation: Domain name=TPR_2; Domain location=182-215; Score =19.3; E_value=0.014; Accession=PF07719.8; Description=Tetratricopepti de repeat
  Pfam annotation: Domain name=TPR_2; Domain location=298-331; Score =3.2; E_value=12; Accession=PF07719.8; Description=Tetratricopeptide repeat
  Pfam annotation: Domain name=TPR_2; Domain location=360-392; Score =0.9; E_value=23; Accession=PF07719.8; Description=Tetratricopeptide repeat
  Pfam annotation: Domain name=TPR_2; Domain location=393-426; Score =22.0; E_value=0.0022; Accession=PF07719.8; Description =Tetratricopeptide repeat
  Pfam annotation: Domain name=TPR_2; Domain location=427-460; Score =17.4; E_value=0.054; Accession=PF07719.8; Description=Tetratricopepti de repeat
  Pfam module annotation: Pfam domain module=TPR_1::TPR_1::TPR_1::TPR _1::TPR_2::TPR_2::TPR_2::TPR_2::TPR_2; Domain location=182-215::360 -392::393-426::427-460::182-215::298-331::360-392::393-426::427-460
MEYSGALLPTTTTMPTILKSHQTPLTEKKDQGGCEDVTFSGTASSNNSSARSGSKPLHMPNPVVNRTHQRNHPKVSPREGYVNSGRRVPKEAIGISGELESMITDRQKGSSSLVRASSSNVMMFGNLGNLRQGGNTNTYSQNPVASGRYTNQTVENVSKGSKEQPDALALYDAAIAIHPNKASYRSNRSAALTALGRLLEAVFECREAIQIEPRYKRAHYRLGNLNMSDLTREKDGEMDKAHYHYKQAGPEADTDQIAKVKKIQVHLNKCTEARRLGDWNKLIKETNYAVSFGADSAPHIFALQAEAFFMLRRHQHAEEAMLKGSNFDVDHCIQFFGPICNANTLVTQAWVHLAAGRAVAAARSNRNELFKASKFSEACVAYGEGLENDPYNSVLLCNRAACRSKTGQLEKAMEDCNAALSLHPSYSKARLRRADCNAKLKRWETSRQDYEILLKETPEDEELRRTLLEAKSILSNSEDDRKSTLVVNDQYSNPL

SEQ ID NO: 176473 - protein, 215 aa, Glycine max
  Coding DNA Sequence Number=SeqID_84788
  Gene Ontology: Mol. function=copper ion binding; Cellular component =mitochondrial inner membrane; Biological process=electron transport
  Homolog annotation: Hit_ID=A7R542; Match level="QueryCoverage=93%, HitCoverage=97%, E-value=4e-69, Identity=65%"; Hit description =Chromosome undetermined scaffold_856, whole genome shotgun sequence
  Pfam annotation: Domain name=SCO1-SenC; Domain location=22-198; Score= 75.6; E_value=1.7e-19; Accession=PF02630.5; Description=SCO1SenC
MMRGERFPKACFLESSLHRKGILTGHQGGGLRNVANGPIIGGPFTLINTEKQAITEHNFLGNWVLLYFGYTSSPDCGPEQVQIMAKAIDILESKQNLKILPVFVSTDPQRDTPSQLRAYLKGVLMIAEVEGANTVEFDSRIIGLTGPVAAIRQMAQEYCFYFKKVEEDGSDYLVDCSHNMYLLNPKMEVTRCFGVEYNAEELSEVIGKELNRNPS

SEQ ID NO: 176474 - protein, 669 aa, Glycine max
  Coding DNA Sequence Number=SeqID_84789
  Gene Ontology: Mol. function=ATPase activity, coupled to transmembrane movement of substances; Cellular component=integral to membrane; Biological process=transport
  Homolog annotation: Hit_ID=A5ASB3; Match level="QueryCoverage=86%, HitCoverage=69%, E-value=0.0, Identity=74%"; Hit description =Putative uncharacterized protein
  Pfam annotation: Domain name=ABC_membrane_2; Domain location=1-145; Score=45.4; E_value=2e-10; Accession=PF06472.6; Description=ABC transporter transmembrane region 2
  Pfam annotation: Domain name=ABC_tran; Domain location=237-424; Score= 77.6; E_value=3.9e-20; Accession=PF00005.18; Description=ABC transporter
  Pfam module annotation: Pfam domain module=ABC_membrane_2::ABC_tran; Domain location=1-145::237-424
MVYYKISHVDGRITNPEQRIASDVPRFCSELSEIVQDDLTAAYVLGAGATIRNFSPAFGKLMSREQELEGEYRQLHSRLRTHSESIAFYGGERREEAHIQQKFRTLVRHINRVLHDHWWFGMIQDFLLKYLGATVAVILIIEPFFSGHLRPDSSTLGRAEMLSNLRYHTSVIISLFQSLGTLSISARRLNRLSGYADRIHELMAISRELSLDNGKSSLQRQGSRNYISEANYVGFYGVKASPNGSGKSSLFRVLGGLWPLVSGHIVKPGVGSDLNKEIFYVPQRPYTAVGTLRDQLIYPLTADQEVEPLTDSRMVELLKNVKLTSNPTSISVDLEYLLDRYPSETEVNWGDELSLGEQQRLGMARLFYHKPKFAILDECTSAVTTDMEERFCANVLAMGTSCITISHRPALVAFHDVVLSLDGEGGWSVHHRREDSSTELGNDTVKALETKRQSDAKAVQRAFAMNKKGSAFSNSKAQSDISEVIIASSPSMKRNISPSAVPQLHGNTRALPMRVAAMCKVLVPTIFDKQGARLLAVAFLVVSRTWVSDRIASLNGTTVKLVLEQDKASFIRLIGISVIQSAASSFIAPSISGVGFACEKPSSERRPRSQIISEHAVDMVQYFASVDDLETESCFLHFQEIGASSKNIHQSVVDFRVSGHPAQSESVYA

SEQ ID NO: 176475 - protein, 570 aa, Glycine max
  Coding DNA Sequence Number=SeqID_84790
  Gene Ontology: Mol. function=sugar:hydrogen symporter activity; Cellular component=integral to membrane; Biological process =carbohydrate transport
  Homolog annotation: Hit_ID=Q2HSP6; Match level="QueryCoverage=99%, HitCoverage=99%, E-value=0.0, Identity=71%"; Hit description=General substrate transporter
  Pfam annotation: Domain name=MFS_1; Domain location=33-502; Score =96.7; E_value=7.3e-26; Accession=PF07690.7; Description=Major Facilitator Superfamily
  Pfam annotation: Domain name=Sugar_tr; Domain location=29-551; Score =443.6; E_value=2.6e-130; Accession=PF00083.15; Description=Sugar (and other) transporter
  Pfam module annotation: Pfam domain module=MFS_1::Sugar_tr; Domain location=33-502::29-551
MEGGVPDADVSAFSECLSLSWKNPYVLRLAFSAGIGGLLFGYDTGVISGALLYIRDEFTAVDRQTWLQEAIVSTAIAGAIVGAAVGGWMNDRFGRRTSILLADILFLIGSVIMAAAPSPGVLVLGRVFVGLGVGMASMASPLYISEASPTKVRGALVALNSFLITGGQFLSYLINLAFTKAPGTWRWMLGVAAAPAIIQVVLMFTLPESPRWLFRKGKEEEAKAILRKIYPPNDVEEEIQALHDSVATELEQAGSSEKISIIKLLKTKAVRRGLVAGMGLQIFQQFTGINTVMYYSPTIVQLAGVASNQTAMLLSLITSGLNAFGSILSIYFIDKTGRKKLALLSLCGCVVALALLTFTFRQTETHSPMISAVETAHFNNTCPGFSQAVNANEWDCMKCLKAECGFCASDVSSNRLPGACLISNDATKGMCQKEHRAWYTQGCPSKIGWLAIVGLALYIIFFSPGMGTVPWVVNSEIYPLRYRGVCGGIASTTCWVSNLIVSQSFLTLTVAIGTAWTFMLFGFVALVGILFVLIFVPETKGVPIEEVEQMLEERGLHFKFWEKRSPTQKA

SEQ ID NO: 176476 - protein, 210 aa, Glycine max
  Coding DNA Sequence Number=SeqID_84791
  Gene Ontology: Mol. function=transferase activity, transferring glycosyl groups; Cellular component=endoplasmic reticulum membrane; Biological process=oligosaccharide-lipid intermediate assembly
  Homolog annotation: Hit_ID=A7PK46; Match level="QueryCoverage=89%, HitCoverage=38%, E-value=1e-72, Identity=68%"; Hit description =Chromosome chr15 scaffold_19, whole genome shotgun sequence
  Pfam annotation: Domain name=Alg6_Alg8; Domain location=2-205; Score=- 184.2; E_value=6.4e-07; Accession=PF03155.6; Description=ALG6, ALG8 glycosyltransferase family
MWCISKELLLTRNLDSRKQQLIWPLVIWSPMLFIVDHVHFQYNGFLIGILLISLSYLEEGRDLLGGFVFAVLLCFKHLFAVAAPVYFVYLLRHYCWGGTVRGIGRLLIMGGVVTAVFASAFGPFFHLGQTQQIIQRLFPFGRGLCHAYWAPNFWVFYIMSDKGLAFIFRKLGFNVQTPTGSFTAGLVGDSSPFSVLPQASYFNFQRATVQ

SEQ ID NO: 176477 - protein, 130 aa, Glycine max
  Coding DNA Sequence Number=SeqID_84792
MWQETFRHKLFQKIFIPPRLLPIVTQCNTLEAVSPSLNHMKLDNCNQHDESRNSSPCTDSSESGIVGHAALDRRIVKTSVFRYFLSRGRAESSCMHRMKKPKEVENGIIQKKHRQEAKCKENSFPKLEIA

SEQ ID NO: 176478 - protein, 106 aa, Glycine max
  Coding DNA Sequence Number=SeqID_84793
  Homolog annotation: Hit_ID=A5AQ74; Match level="QueryCoverage=98%, HitCoverage=93%, E-value=9e-19, Identity=36%"; Hit description =Putative uncharacterized protein
MAVLVEHNFLDAYAGESRDGSLSVKFSTGDIISMNSSLQFCYSWILNSDHRKWMMPYLERFSTEMKYDIFRVVYVSGDNVVNLPYGSHNRMLEDEQESTQGQLMHQ

SEQ ID NO: 176479 - protein, 67 aa, Glycine max
  Coding DNA Sequence Number=SeqID_84794
QKKTKPKSKSLIHGTRQFDWRFPKAACVAILSGDLVTGIAIDVDDLFKDTKLAIGSDDLGPTYMLFT

SEQ ID NO: 176480 - protein, 277 aa, Glycine max
  Coding DNA Sequence Number=SeqID_84795
MKLLALLQKLFFSTAAPYMTLLSSLLQTIPIKLECLTKLILFLSRKGVTYIGFARKGVTHIFSCRDLTCLFLLNFRFSVAPTFHGFQKSDEVIKSIRLKEAQDLILIQLFADGPGDNIDRTWVSDLFEDSPNIERLCLGTSYIKILSAGIYPQVQLKAIKYLKLDGVDFNEARELLFIISLLLGSSSNLETLIIKCNSMAVELQQISKVFDYSNCYFNQLQDVKITVTTSYKPALDLIRFVFARSPTLKILTFRMDRASPRAEVRFLYDDLQRPNLF

SEQ ID NO: 176481 - protein, 123 aa, Glycine max
  Coding DNA Sequence Number=SeqID_84796
  Subcellular localization annotation: CTP_CleavageSite=47; ConfidenceScore=5.76e-01
MVKKERAPSSAAVARITSTSGLPRCPPAPSTSPTAPSGPVELSFPTRSASVRHSATGRSHKSWPTSTPLLVMVVNINGVCGGWGWYGAVMVTSELVVWMGSEGARWQWWMGFYVCGVEEDEEG

SEQ ID NO: 176482 - protein, 199 aa, Glycine max
  Coding DNA Sequence Number=SeqID_84797
  Gene Ontology: Mol. function=acyltransferase activity
  Homolog annotation: Hit_ID=A5AU50; Match level="QueryCoverage=58%, HitCoverage=26%, E-value=6e-17, Identity=45%"; Hit description =Putative uncharacterized protein
MAKHPKYQISRNPYPKSCPVEAYEEHNFNYSSHSNKLFCMRRNSNKRVHVSVFQTSSMTGPLNREKEQEETETLTKSLLAFPVPGASLFPQENLPVFSEVLFVENDAVCRRFVFEASEIDSLKAIVSSHNVPNPTRVEVVSALIYKRAVSALGLSFKTTSFRTAVNLRNRTVPPLPEKSLGNLVWFLLVLNPSEAELHE

SEQ ID NO: 176483 - protein, 478 aa, Glycine max
  Coding DNA Sequence Number=SeqID_84798
  Gene Ontology: Mol. function=protein binding; Biological process =embryonic development ending in seed dormancy
  Homolog annotation: Hit_ID=A7QBT8; Match level="QueryCoverage=96%, HitCoverage=98%, E-value=1e-145, Identity=58%"; Hit description =Chromosome chr1 scaffold_75, whole genome shotgun sequence
MALNFSHRPIFSEDNLVSPMRMGIPEKSVVDNCFDYGRERGGGGANHDDILDLLPSDPFGMDISTTVTAITGWLEDLEIVDYGGYRRDELGASDGNYQLFAGLNFIWNNAMRFHASCVEEKRGFGESCSVRNDGAAAASSNFGFGSVNNYDEVSGLPAISRSGDVVRRVGGAGRGDVARPDGGGSGGEELAPHPALSFSLGYLGLSDLLVVERVCKSLHSTVCGDPLLWRSIHVDPPLNERITDDVLFQLTNRAQGHLQCLSLVECTRITDDGLKRVLQSNPKLTKQMLKSVFRTLVKESNLSVPGCTRLSIEGIVGILKAYNSMGTQGLKHLHIGGLYGVTQKHFEELSFLLGADGPLLQHSHKPHYYCRGNLYLSCDDDRVIDIEVCPLCQNLRLVYDCPAESCQGVEHTTQICRACTLCIPRCSQCGCCINDSEYEETFCLELLCSSCSKQLVKCSEREDRKIGSDKSAVIHEQS

SEQ ID NO: 176484 - protein, 394 aa, Glycine max
  Coding DNA Sequence Number=SeqID_84799
  Gene Ontology: Mol. function=ubiquitin protein ligase binding; Cellular component=cullin-RING ubiquitin ligase complex; Biological process=ubiquitin-dependent protein catabolic process
  Homolog annotation: Hit_ID=A9LK40; Match level="QueryCoverage=100%, HitCoverage=45%, E-value=1e-164, Identity=76%"; Hit description =Cullin 4
  Pfam annotation: Domain name=Cullin; Domain location=1-296; Score =263.1; E_value=5.8e-76; Accession=PF00888.13; Description=Cullin family
NRPAELIAKFLDEKLRAGNKGTSEEELEATLDKVLVLFRFIQGKDVFEAFYKKDLAKRLLLGKSASIDAEKSMISKLKTECGSQFTNKLEGMFKNMFPSSNVQQDHGGIFVCLVDMEHWPTYPPMDVRLPHELNVYQVLHVLVTDFSFNCGLGILSDSLDMDIFKEFYLSKYSGRRLMWQNSLGHCVLKAEFPKGRKELAVSLFQFILASFIAQISIFFYINSARLAVLQTVVLMLFNDAEKLSLQDIKDATGIEDKELRRTLQSLACGKVRVLQKMPKGRDVEDDDLFVFNDGFTAPLYRIKVNAIQLKETVEENTSTTERVFHDRQYQIDAAIVRIMKTRKVLSHTLLITELFQQLKFPIKPADLKKRIESLIDREYLERDKSNPQIYNYLA

SEQ ID NO: 176485 - protein, 314 aa, Glycine max
  Coding DNA Sequence Number=SeqID_84800
  Gene Ontology: Mol. function=DNA binding
  Homolog annotation: Hit_ID=A7QBS2; Match level="QueryCoverage=91%, HitCoverage=74%, E-value=5e-59, Identity=48%"; Hit description =Chromosome chr1 scaffold_75, whole genome shotgun sequence
  Pfam annotation: Domain name=Remorin_C; Domain location=246-314; Score=6.9; E_value=0.00049; Accession=PF03763.4; Description=Remorin, C-terminal region
MRYVEDKGCYNNNGPTQETPNSSAMYSEFHKGKDATRVSNHHHRATMGKPTPSKWDDAQKWLVGLSKGGEKSHSKSKPRNSNADDLRLIAPVPQKEHDYSSSEKEEEENDACHDFMTNIISANAIAAQYEAEAKRVECDESNWGSNNNNNDNRFSGNTIQVQPICFRDMGTEMTPITSQEPSRTGTPIRATTPATRSPIHSGTSTPMRGQNGLQQVAEGGHGTTRKCGDQGSTSPCKKTHEDHQARKLSPLESRAMAWDEAERAKFMARFKREEVKIQAWENHQIRKAEMEMKKMEAEDDGSSFHALLATGKSS

SEQ ID NO: 176486 - protein, 587 aa, Glycine max
  Coding DNA Sequence Number=SeqID_84801
  Gene Ontology: Mol. function=transferase activity; Cellular component= membrane; Biological process=megagametogenesis
  Homolog annotation: Hit_ID=A7QP83; Match level="QueryCoverage=76%, HitCoverage=99%, E-value=1e-157, Identity=62%"; Hit description =Chromosome chr1 scaffold_136, whole genome shotgun sequence
  Pfam annotation: Domain name=Exostosin; Domain location=189-535; Score=307.1; E_value=3.4e-89; Accession=PF03016.6; Description =Exostosin family
  Subcellular localization annotation: CTP_CleavageSite=61; ConfidenceScore=5.06e-01
MRRGGLAGGVGCRGWSWASVRKKKKKSKGSVSIFLIALALFIRYEGFVILLLGLFTSCTSVCTLASGFVNMFSVVAFGSLSLPNSVNGCSIMCLRPKGWELGQYAPFNPAHGCVFEGRKVHGVATNVYWGKMSEKLKSVCGLRTLSVKDLGVVFTHGEGTLDIRPYFFPRLKLPSGAPAPCAPDPPLRVFMYDLPRRFNVGMIDRRSAAEMPVTVEDWPAWPVNWGLKKQHSVEYWMMGSLLNVGGGREVVRVSDPELAQAFFVPFFSSLSFNTHGHTMKDPATQIDRQLQKILDVRPYVSAIVLDYGVVQCVVVPVDLMELLKKSNYWQRSGGRDHVFPMTHPNAFRFLRDQLNESIQVVVDFGRYPRGMSNLNKDVVSPYVHVVDSFTDDEPQDPYESRSTLLFFRGRTYRKDEGIVRVKLAKILAGYDDVHYERSVATEENIKASSKGMRSSKFCLHPAGDTPSSCRLFDAIVSHCIPVIVSDQIELPFEDEIDYSQFSVFFSFKEALQPGYMIDQLRKFPKEKWTEMWRQLKSISHHYEFRYPPKREDAVDMLWRQVKHKLPGVKLSVHRNRRLKIPDWWQGR

SEQ ID NO: 176487 - protein, 288 aa, Glycine max
  Coding DNA Sequence Number=SeqID_84802
  Gene Ontology: Mol. function=O-methyltransferase activity; Cellular component=integral to membrane; Biological process=lignin biosynthetic process
  Homolog annotation: Hit_ID=Q2YHM9; Match level="QueryCoverage=81%, HitCoverage=91%, E-value=5e-74, Identity=61%"; Hit description =Caffeoyl-CoA O-methyltransferase
  Pfam annotation: Domain name=Methyltransf_3; Domain location=73-288; Score=387.0; E_value=3e-113; Accession=PF01596.8; Description=O -methyltransferase
MSGDLAYKSILQSSALMKEVVGYNRNSDSLTKSSARHCNAILPHPFNKNLDVHLNEKFFIPLFTLILECLYIFETSAYPKEHEQLKLLRETTVQKCQENSEYIMNVPVDEAQFVSILLKIMNAKKTLEIGVFTGYSLLATALALPHDGKITAIDVNRKTYEIGLPFIQKAGMEHKIDFILGDALSVLNDLINDKHEDSFDYVFVDADKAEYIKYHELVLKLVKKGGIIAYDNTLYFGTVAMPEEDVKWDILRQNRKPLIEFNNFIANDSRLESAIVSIGDGVTLCRRL

SEQ ID NO: 176488 - protein, 85 aa, Glycine max
  Coding DNA Sequence Number=SeqID_84803
MVTAEVRPVVKGRGRLCGANAVVRGGGTREGEAYVVIFQMSRSSLDARWSRVGCVTVVGTAVTGDVAIVIGDANTQPNHVHVARK

SEQ ID NO: 176489 - protein, 68 aa, Glycine max
  Coding DNA Sequence Number=SeqID_84804
MGTDNSAVPRVDLNLTTVAVYYYYLDGVSRAHAHTSHQRDPYEQVVVSGKCVKQHPLHLSPNSSHLLQ

SEQ ID NO: 176490 - protein, 85 aa, Glycine max
  Coding DNA Sequence Number=SeqID_84805
  Homolog annotation: Hit_ID=A5AE14; Match level="QueryCoverage=68%, HitCoverage=5%, E-value=2e-08, Identity=43%"; Hit description =Putative uncharacterized protein
MADSHRSPNFEPTRQFKFDRVYYRAMVTLVELLNAQKTNSNDKMTGERDTNTWIIDTGASNHVTVNLNRIRELQDIQSCPIGFPN

SEQ ID NO: 176491 - protein, 419 aa, Glycine max
  Coding DNA Sequence Number=SeqID_84806
  Gene Ontology: Mol. function=carboxyl- or carbamoyltransferase activity; Cellular component=nucleus; Biological process=ribosome biogenesis and assembly
  Homolog annotation: Hit_ID=A7PE86; Match level="QueryCoverage=93%, HitCoverage=77%, E-value=1e-160, Identity=71%"; Hit description =Chromosome chr11 scaffold_13, whole genome shotgun sequence
  Pfam annotation: Domain name=WD40; Domain location=182-221; Score =10.1; E_value=1.8; Accession=PF00400.23; Description=WD domain, G -beta repeat
  Pfam annotation: Domain name=WD40; Domain location=246-284; Score =16.7; E_value=0.085; Accession=PF00400.23; Description=WD domain, G -beta repeat
  Pfam annotation: Domain name=WD40; Domain location=292-331; Score =37.4; E_value=5.1e-08; Accession=PF00400.23; Description=WD domain, G-beta repeat
  Pfam annotation: Domain name=WD40; Domain location=336-375; Score =30.8; E_value=5e-06; Accession=PF00400.23; Description=WD domain, G -beta repeat
  Pfam annotation: Domain name=WD40; Domain location=383-417; Score =7.4; E_value=3.8; Accession=PF00400.23; Description=WD domain, G -beta repeat
  Pfam module annotation: Pfam domain module=WD40::WD40::WD40::WD40::WD4 0; Domain location=182-221::246-284::292-331::336-375::383-417
MTRGIKHRQKAKSKKKVSKKESGSSSSLAPEIPAKVWQPGVDKLEEGEELQCDPSAYNSLHAFHIGWPCLSFDILRDSLGLVRKEFPHTVYFMAGTQDVSLIKSEVAEKPSWNSIGIFKVSNITGKRREPVPKLGTDDTEMDGEDSDSDDDSEDEEGGAQGPSLQATSSSFEFLLFHFLTASNPMLRKVAHQGCVNRIRSMPQNPHICAAWADTGHVQVWDLNSHLNALAESETEGVQGVAAVFNQDPLYKFKHKDEGYAIDWSPLVPGRLASGDCNNCIYLWEPTSAGTWNVDNAPFTGHTASVEDLQWSPTEPDVFASCSVDGNIAIWDTRLGKSPAASFKAHNADVNVMSWNRLASCMLASGSDDGTISIRDLRLLKEGDSVVAHFEYHKHPITSIEWSPHEASSLAVSSSDNQLT

SEQ ID NO: 176492 - protein, 897 aa, Glycine max
  Coding DNA Sequence Number=SeqID_84807
  Gene Ontology: Mol. function=calcium ion binding; Cellular component =nucleus; Biological process=regulation of transcription, DNA -dependent
  Homolog annotation: Hit_ID=A7QP38; Match level="QueryCoverage=94%, HitCoverage=88%, E-value=0.0, Identity=58%"; Hit description =Chromosome chr1 scaffold_136, whole genome shotgun sequence
  Pfam annotation: Domain name=Ank; Domain location=596-628; Score =36.0; E_value=1.4e-07; Accession=PF00023.21; Description=Ankyrin repeat
  Pfam annotation: Domain name=CG-1; Domain location=51-148; Score =117.2; E_value=4.7e-32; Accession=PF03859.7; Description=CG-1 domain
  Pfam annotation: Domain name=IQ; Domain location=715-735; Score=7.2; E_value=7.3; Accession=PF00612.18; Description=IQ calmodulin-binding motif
  Pfam annotation: Domain name=IQ; Domain location=769-789; Score=19.4; E_value=0.014; Accession=PF00612.18; Description=IQ calmodulin -binding motif
  Pfam annotation: Domain name=IQ; Domain location=792-812; Score=33.8; E_value=6.4e-07; Accession=PF00612.18; Description=IQ calmodulin -binding motif
  Pfam annotation: Domain name=TIG; Domain location=367-450; Score =16.0; E_value=0.025; Accession=PF01833.15; Description=IPTTIG domain
  Pfam module annotation: Pfam domain module=Ank::CG-1::IQ::IQ::IQ::TIG; Domain location=596-628::51-148::715-735::769-789::792-812::367-450
MTELNNPKKNELSEVEVDPNSQQEDTYESKVEEGVNEYGSTTCYEYDINDLHQEAQARWLKPAEVMYILQNHEKFQFTQEPPQQPTSGSLFLFNKRVLRFFRKDGHNWRKKRDGRTVGEAHERLKGKLSSGAGAQLSPSSSSVYTQSPSPYSTQNPGSTSILGDSYEPNQSFSSPGSTEVTSDMFVLNNKMGHMDGTDTESGTSPELEVTQALRRLEVQLSLNEDNFEDIVSFGSKHETTHDSNPQHDQRVISNQEQSAAFSGPDDQGLFYDGYNGRQGDGGEFYHELIDHGYPDGNEKALWTEVLESSVFSQPQGVDEVKFPVYSSMVETQVINSDYYETLFDQSQIGAPPDANSSLTVAQKQKFTIKTISPEWGYATETTKVIVVGSLLCHPSDSAWACMFGDVEVPVEIIQDGVISCEAPSHLPGKVTLCITSGNRESCSEVREFEYRDKTNSCTQCTQSETEATRSPEELLLLVRLEQMLLSASTIKNDNIESGIPLIKQKADDDSWSHIIEALLVGSGTSTGTVDWLLEELLKDKLQQWLSCRSQEKDEETGCSLSKKEQGIIHMVAGLGFEWALNPILTCGVNINFRDINGWTALHWAARFGREKMVASLIASGASAGAVTDPNAQDPTGKTAASIAAGNGHKGLAGYLSEIAVTSHLSSLTLEESELSKSSAELQADMTVNSVSKENLTASEDQASLKDTLAAIRNVTQAAARIQSAFRSHSFRKRRAREVAASAGGIGTISEISAMSKLAFRNSREYNSAASAALSIQKKYRGWKGRKDFLALRKKVVKIQAHVRGYQVRKHYKVIWAVGILDKVVLRWRRKGAGLRGFRQEMDINENENEDEDILKVFRKQKVDVEIEEAVSRVLSMVDSPDAREQYHRMLEKYRQAK

SEQ ID NO: 176493 - protein, 435 aa, Glycine max
  Coding DNA Sequence Number=SeqID_84808
  Homolog annotation: Hit_ID=A7UQU7; Match level="QueryCoverage=60%, HitCoverage=52%, E-value=1e-22, Identity=30%"; Hit description=IMP dehydrogenase/GMP reductase, putative
  Pfam annotation: Domain name=DUF1723; Domain location=195-244; Score =32.0; E_value=2.2e-06; Accession=PF08330.1; Description=Protein of unknown function (DUF1723)
MRKRKLLWQICLRLIAQHLQIMVKTRGLGSALGRVGVRGIGRGGDGDDTDGAPQRQWPTASARRRRVPVILDDYVPVVPTDSPTVPEAKAVVTGDEPMVDAAAQDTGVETDAQNIGAETNGDEPVGFLGGPRDPSVLTEYADHVAGSVWSGQEHLELKLCSHGRKVHNLGRPVPAIEDMIVGTGLSPLITCSINTGDRGLISFFVERWHRETSSFHLPMEEMSITLDNAASLFHLSIVSAFHDFQPLRTDEAVMLLVKLLMVSAEVVMAETGQCGGPYVRLYWTAATRAYLLHLLGYTFFANKSVTHVHVSHLLALRDLTLAGRTSRQLAGYITLLQCWIYKHFPSVAECNTDLDYDEVSSRVCRWIATKKTVKKLRRGVVVVRYRPERVMLQFDYVQCIPTHPVHSWVSYDDVDDTWTHYSDHLAAVGDLCVVP

SEQ ID NO: 176494 - protein, 52 aa, Glycine max
  Coding DNA Sequence Number=SeqID_84809
MWIKRSGGKTKRSIYDTSNLSASYHPTRVSHFFQLQGRDRVHGAGNNSWAIL

SEQ ID NO: 176495 - protein, 69 aa, Glycine max
  Coding DNA Sequence Number=SeqID_84810
MKRARNIVKGLRFEIADIWSDEAFSQLVQSHFGVSELEHLSVTDLMELEKLVHSALSRIRSAKVLHSVQ

SEQ ID NO: 176496 - protein, 171 aa, Glycine max
  Coding DNA Sequence Number=SeqID_84811
  Gene Ontology: Mol. function=unfolded protein binding; Cellular component=mitochondrion; Biological process=cellular protein metabolic process
  Homolog annotation: Hit_ID=A7NXQ8; Match level="QueryCoverage=69%, HitCoverage=36%, E-value=1e-28, Identity=59%"; Hit description =Chromosome chr5 scaffold_2, whole genome shotgun sequence
MGSKVLSVLVDVEFILFMGRNVVMEQSFGATKVTKDGVNTAKSIEFKGKVKNVSFRLVVHVANATNDVSQYQIAWCCNRDRILREHFNCFAGTTCAIVLTRAIFTEGCKSVMAVGAAVTNLKSRARMISTSEEITQCLMPVLLVEESVVRDSILVMVIQDGVISFSCHSFC

SEQ ID NO: 176497 - protein, 191 aa, Glycine max
  Coding DNA Sequence Number=SeqID_84812
  Gene Ontology: Mol. function=P-P-bond-hydrolysis-driven protein transmembrane transporter activity; Cellular component=chloroplast inner membrane; Biological process=intracellular protein transport
  Homolog annotation: Hit_ID=A7QQS1; Match level="QueryCoverage=75%, HitCoverage=62%, E-value=8e-32, Identity=45%"; Hit description =Chromosome undetermined scaffold_144, whole genome shotgun sequence
  Pfam annotation: Domain name=Tic22; Domain location=2-189; Score= -3.9; E_value=4.5e-07; Accession=PF04278.3; Description=Tic22-like family
MMNFDGFQKALAEFQGRCSTLLGSLTRLQPNRARPPWARIAQPWGGRPMAMTVEAIEERLEGIPVYALSNASEEFLLVSGSSSGKNLGLFCFNKDDAEALLNQVTLIDPHARQGSKVVPVALNKVFQLKEREKSGFASSGFSGVPVFQGEPMFEAPTQWGLWKFKPVTEALAKAEWADDGDDSEGEQTEFF

SEQ ID NO: 176498 - protein, 191 aa, Glycine max
  Coding DNA Sequence Number=SeqID_84813
MAFENGSKKELEKVGLKISKSFPLTRTTLASMESLSLPVHQEDLGGATTLLLLPPPGSFTSLARKNRNFDKQGSFRCRCLRQQRRSWPTIQRRSLPVQRHSRPYLSSIDCHTLRRCRHSPTLKAYLSTLFLVPAMSSKVNLQLRASRHPRRRNRVFLKRWKETVVDWPEAYDDISFKDGRAPSLNSEKHRR

SEQ ID NO: 176499 - protein, 394 aa, Glycine max
  Coding DNA Sequence Number=SeqID_84814
  Gene Ontology: Mol. function=catalytic activity; Cellular component =plastid; Biological process=metabolic process
  Homolog annotation: Hit_ID=A3APP7; Match level="QueryCoverage=82%, HitCoverage=56%, E-value=8e-93, Identity=48%"; Hit description =Putative uncharacterized protein
  Pfam annotation: Domain name=AMP-binding; Domain location=122-394; Score=-119.9; E_value=0.022; Accession=PF00501.19; Description=AMP -binding enzyme
  Subcellular localization annotation: CTP_CleavageSite=57; ConfidenceScore=5.70e-01
MATIPITYNHAWTFSHPHHALSRFLSPCNFSRITFSRRKYGVGGPAPSSPLSHFRVFCQSKTEILEIRKCSPFLESSLLLGNGGVASDEWKAVPDIWRSSAEKYGNNVALVDPYHDPPTTMTYTQAILDFAEGLRVIGVRPDEKLALFADNSCRWLVADQGAQGHQLKSYCKYTTTLKEKAELVGQENKHVPVFTFMEVIDLGRQSRRALSNAHDAGQRYIYEAINTDSIATLVYTSGTTGNPKGVMLTHRNLLHQIKNLWDIVPAEAGDRFLSMLPPWHAYERACEYFIFTCGIEQVYTTVRNLKASYAYSMLDWLWARTIATILLPLHILAKKLVYSKIHSAIGISKAGISGGGSLPWEVDKFFEAIGVKVQNGYGLTETSPVIAARRPRCN

SEQ ID NO: 176500 - protein, 733 aa, Glycine max
  Coding DNA Sequence Number=SeqID_84815
  Gene Ontology: Mol. function=identical protein binding; Cellular component=extracellular region; Biological process=negative regulation of catalytic activity
  Homolog annotation: Hit_ID=Q6WNU4; Match level="QueryCoverage=100%, HitCoverage=100%, E-value=0.0, Identity=85%"; Hit description =Subtilisin-like protease
  Pfam annotation: Domain name=PA; Domain location=335-438; Score=98.4; E_value=2.3e-26; Accession=PF02225.13; Description=PA domain
  Pfam annotation: Domain name=Peptidase_S8; Domain location=126-578; Score=28.9; E_value=2.6e-08; Accession=PF00082.13; Description =Subtilase family
  Pfam annotation: Domain name=Subtilisin_N; Domain location=29-115; Score=80.7; E_value=4.7e-21; Accession=PF05922.7; Description =Subtilisin N-terminal Region
  Pfam module annotation: Pfam domain module=PA::Peptidase _S8::Subtilisin_N; Domain location=335-438::126-578::29-115
MRPPSSSIHFLLQILLVFLLHRPSFALKKSYVVYLGAHSHKPELSSVDFNQVTQSHHEFLGSFLGSSNTTKDSIFYSYTRHINGFAAILEEEVAAEISKHPKVLSVFENRGRKLHTTRSWDFMGLEHNGVIQSNSIWKKARFGEGVIIGNLDTGARYFNKGYASVAGPLNSSFDSPRDNEGHGTHTLSTAGGNMVARVSVFGQGHGTAKGGSPMARVAAYKVCWPPVAGDECFDADILAAFDLAIHDGVDVLSLSLGGSASTFFKDSVAIGSFHAAKHGIVVVCSAGNSGPADATAENLAPWHVTVAASTMDRQFPTYVFLGNNITFKGESLSATILAPKFYPIIKATDAKLASARAEDAVLCQNGTLDPNKVKGKIVVCLRGINARVDKGEQAFLAGAVGMVLANDKTTGNEIIADPHVLPASHINFTDGSAVFTYINSTKFPVAYITHPKTQLDTKPAPFMAAFSSKGPNTIVPEILKPDITAPGVSVIAAYTEAQGPTNQVFDKRRIPFNSVSGTSMSCPHVSGIVGLLRALYPTWSPAAIKSAIMTTATTLDNEVEPLLNATDGKATPFSYGAGHVQPNRAMDPGLVYDTTIDDYLNFLCALGYNATQISVFTEGPYQCRKKFSLLNLNYPSITVPKLSGSVTVTRRLKNVGSPGTYIAHVQNPHGITISVKPSILKFKNVGEEKSFKVTFKAMQGKATNNYVFGKLIWSDGKHYVTSPIVVKALLTRN

SEQ ID NO: 176501 - protein, 133 aa, Glycine max
  Coding DNA Sequence Number=SeqID_84816
MLGKICLRTPCLCITLSVEKVYATHLISIEIYTVIQPGEVVSHGEDFRQQKAKSTKKVILRNPPLATKTRIGIQSVPTCTTLAPTVNTLYDLLLPKLLGNSANTSGGKIVITWLHAPQAAKTFITRLQFRPKT

SEQ ID NO: 176502 - protein, 223 aa, Glycine max
  Coding DNA Sequence Number=SeqID_84817
  Gene Ontology: Mol. function=oxidoreductase activity; Cellular component=endoplasmic reticulum; Biological process=electron transport
  Homolog annotation: Hit_ID=A7QC35; Match level="QueryCoverage=99%, HitCoverage=61%, E-value=7e-50, Identity=39%"; Hit description =Chromosome chr10 scaffold_76, whole genome shotgun sequence
  Pfam annotation: Domain name=p450; Domain location=1-214; Score= -212.6; E_value=0.081; Accession=PF00067.13; Description=Cytochrome P450
MEQMLVLLGGFSIADFYPSIKVLPLLTNKHGVTHEDFIDILLKTQKRDDLEIPMTHNNIKALIWDMFAGGTAAPTAVTVWAMSEHMKNPKVMEKAHTEIRKVFNVKVSRENSEACVINGYEIPAKSKVIINAWAIGRESNSYDFSGTNFEYIPFGAGRRICPGAAFSMPYMLLSVANLLYHFVWELPNGAIHQELDMTHESFGLTVKRANDLCLIPIPYHPTS

SEQ ID NO: 176503 - protein, 237 aa, Glycine max
  Coding DNA Sequence Number=SeqID_84818
  Gene Ontology: Mol. function=transferase activity, transferring groups other than amino-acyl groups; Cellular component=cellular _component; Biological process=flavonoid biosynthetic process
  Homolog annotation: Hit_ID=P30080; Match level="QueryCoverage=55%, HitCoverage=43%, E-value=1e-39, Identity=58%"; Hit description =Chalcone synthase 6
  Pfam annotation: Domain name=Chal_sti_synt_N; Domain location=1-154; Score=123.6; E_value=5.8e-34; Accession=PF00195.10; Description =Chalcone and stilbene synthases, N-te
MRVHTTNAGSISFSIQLCIILSFYVYIYIHQEQRAELNEEILKENPSVCAYMTPSLDTRQDMVIVEVPKLGKEAATKTIKEWGQPKSKITHLIFCTISGVHMPGADVPTRLLCRWLRLVENNKGARVLLVWSEITAVAALFGDGAAAGIVGSDPLPVEKPLFQLVWTEYVNMSSGMCVIYHASDWEEVYKMDLTVKAWGVIFGFGPVDWTVLICHCLFRPSFFFSFFYLLTQPSSVP

SEQ ID NO: 176504 - protein, 451 aa, Glycine max
  Coding DNA Sequence Number=SeqID_84819
  Homolog annotation: Hit_ID=Q6X0N1; Match level="QueryCoverage=100%, HitCoverage=100%, E-value=1e-155, Identity=64%"; Hit description =Putative uncharacterized protein
MIPPRRKKWTEAEEKTLIDKYGEMVADGSLAKMRTREKKFKPIACHVNSVHHVRDPVAYPWQWSWKDVSTKVQNMRHQYLLVKQKIKRPEFSGSGGGGDCDDGSEFDWVEGLTHWSNFLRYKDVFGDVALAVGGHGGNELMGIEDGDHGDRDGDNGDGFLAGGGGMDMVEFGQMGHSGDGDFGAALDGVDNEVMGLGFEIEGEEGEVNYNGSGGREREDAAENGFVFEEEGEVTGSSLKKKRKVAKGMEKKAWRILANQLGQLREMETRFEQREVERERERQRRENLRVELDKQWERKLEEREKEREEREKERDKLRRQRMAEWEAMEKENEEMERKRREEELIHEREWEERMNCRRLEWKKRVDEMLSQHRAEMGQMQTRFLHEQQNLTNQLLGIFSQWPAQPSGLSDHTSASNHYLSQMMQNLHHVNGIVHGDARVEGDNQEDQFIVDG

SEQ ID NO: 176505 - protein, 693 aa, Glycine max
  Coding DNA Sequence Number=SeqID_84820
  Gene Ontology: Mol. function=methyltransferase activity; Cellular component=cellular_component; Biological process=metabolic process
  Homolog annotation: Hit_ID=Q6X0N8; Match level="QueryCoverage=100%, HitCoverage=100%, E-value=0.0, Identity=75%"; Hit description =Putative spermine/spermidine synthase
  Pfam annotation: Domain name=Methyltransf_11; Domain location=65-168; Score=55.5; E_value=1.9e-13; Accession=PF08241.3; Description =Methyltransferase domain
  Pfam annotation: Domain name=Methyltransf_12; Domain location=65-166; Score=10.6; E_value=0.045; Accession=PF08242.3; Description =Methyltransferase domain
  Pfam annotation: Domain name=Spermine_synth; Domain location=418-658; Score=-104.3; E_value=0.045; Accession=PF01564.8; Description =Sperminespermidine synthase
  Pfam annotation: Domain name=TPMT; Domain location=22-207; Score= -83.7; E_value=0.098; Accession=PF05724.2; Description=Thiopurine S -methyltransferase (TPMT)
  Pfam module annotation: Pfam domain module=Methyltransf _11::Methyltransf_12::Spermine_synth::TPMT; Domain location=65 -168::65-166::418-658::22-207
MGSKGKKKGSPEDILETLGDFTSKENWDKFFTLRGDSFEWYAEWPNLRDPLLSLLKTVPLPLQLLVPGCGNSRLSEHLYDAGHTAITNIDFSKVVISDMLRRNVRDRPLMRWRIMDMTAMQFEDESFGAVIDKGGLDALMEPELGPKLGNQYLSEVKRVLKPGGKFVCLTLAESHTFYFPLLLLKDSWYKVSGLHEALQNENQIREKYSSGSNLLYSVEDLQEELTKLSQGRRLQLTLGGQGYSTFSYRAVILDAEEQASPFTYHCGVFIVPKTRAREWLFYSEEGQWMVVRSSEAARLIMVYLDASHSDTSMEEIQKDLSPLVTQLAPAENENGAKIPSVTSSLTGSIIVEDVIYENVDSEVSCIFPSRELVFRRLVFERAANLVQSEALLKDEQSPTKLVSETGRKKNNASSKSRKSGSQRHSIGASSQLTVYHGYVASSYHTGIISGFTLISSYMENVASSGKMASLGAGLLSMFLHGCIPFLEIETVELDPMIVDIARDYFSFVEDKRLKVHVADGIQFVREIDSSGAPQIHGKSNDPSNTESALNASSTVSHAGVKVTKVDIIIVDVDSSDPSSGLTCPAPDFLDESFLETVKDKLSEDGLFVVNLVSRSQAIKDMALSKMKKVFSHLFCLQLDEDVNEVHFALKSESCIEDSCFSEASLKLHKLLEFKHPEIGQNIINATKKIRHLK

SEQ ID NO: 176506 - protein, 217 aa, Glycine max
  Coding DNA Sequence Number=SeqID_84821
  Gene Ontology: Mol. function=phosphoprotein phosphatase activity; Cellular component=cytoplasm; Biological process=negative regulation of tyrosine phosphorylation of Stat3 protein
  Homolog annotation: Hit_ID=Q3EBH9; Match level="QueryCoverage=69%, HitCoverage=56%, E-value=1e-86, Identity=96%"; Hit description =Serine/threonine protein phosphatase
  Subcellular localization annotation: CTP_CleavageSite=29; ConfidenceScore=5.35e-01
MAMAAAMAPPSLTRHATAIRWRFFRKPLRNSAMAPPWPPFNNTGPWWNWVVSPCWIVESVGADDPTVESEIFCLHGGLSPSIETLDNIRNFDRVQEVPHEGPMCDLLWSDPDDRCGWGISPRGAGYTFGQDISEQFNHTNNLKLIARAHQLVMEGYNWGHDQKVVTIFSAPNYCYRCGNMASILEVDDCKGHTFIQFEPAPRRGEPDVTRRTPDYFL

SEQ ID NO: 176507 - protein, 259 aa, Glycine max
  Coding DNA Sequence Number=SeqID_84822
  Gene Ontology: Mol. function=phosphoprotein phosphatase activity; Cellular component=cytoplasm; Biological process=negative regulation of tyrosine phosphorylation of Stat3 protein
  Homolog annotation: Hit_ID=A3C4N5; Match level="QueryCoverage=55%, HitCoverage=45%, E-value=9e-72, Identity=89%"; Hit description =Serine/threonine-protein phosphatase PP2A-4 catalytic subunit
  Pfam annotation: Domain name=Metallophos; Domain location=131-255; Score=72.0; E_value=1.9e-18; Accession=PF00149.19; Description =Calcineurin-like phosphoesterase
MALGRNRKRQVTMPTYSCPLCDHEEESINHLIFNCTMTRRLWWEPLRWVNRVGPFSTDPKNHFLQFTQWNNKASINNKWKFLWLALSFSIWHHRNAMIFKNQPFDPGKVRVLCDKAKEILMEESNVQPVKSPVTICGDIHGQFHDLAELFRIGGKCPDTNYLFMGDYVDRGYYSVETVTLLVALKVRYRQRITILRGNHESRQITQVYGFYDECLRKYGSANVWKIFTDLFDYFPLTALVQGSLFDSMILGTLSMLACI

SEQ ID NO: 176508 - protein, 110 aa, Glycine max
  Coding DNA Sequence Number=SeqID_84823
MEPSQILSLRTTTTDPDHVKVIQWDDFQHDLARLASLSSALHEANEKKRNLQYKLEPLIQWLEGKRVWSRGECELEWGMESRSVFDYENSWRKEIELGKGDECNCIYLSR

SEQ ID NO: 176509 - protein, 345 aa, Glycine max
  Coding DNA Sequence Number=SeqID_84824
  Gene Ontology: Mol. function=zinc ion binding; Cellular component =intracellular
  Homolog annotation: Hit_ID=A7QHM4; Match level="QueryCoverage=37%, HitCoverage=31%, E-value=8e-59, Identity=83%"; Hit description =Chromosome chr5 scaffold_98, whole genome shotgun sequence
  Pfam annotation: Domain name=PUB; Domain location=248-333; Score =115.7; E_value=1.4e-31; Accession=PF09409.1; Description=PUB domain
MGSVYKLLLGDSIDENQDGVFNECGINNEEDAAHLFFNCSKILPVWWESVSWSNISGVFPQTPRHHFLQHGFGRPSGVRSQRWQIWWIALSWSIWQHRNGIIFSNDSFNGSKLMEDAIFLCLSWFKNLERREFALARSCWKQSGLKKRMRGNGLAQLVNLLPPIFLLALKKVEKEEEKRAREKIKKKLEEDKAERRRRLGLPPEEPSAAKPSPAPIVEEKKSFVPVRPATKAEQMRECLRSLKQNHKEDDARVKRAFQTLLTYVGNVARNPDEEKFRKIRLSNQSFQDRVGSLKGGIEFLEICGFEKIDGGEFLFLPRDKVEMAVLNSAGSELDSAIKNPFFGVL

SEQ ID NO: 176510 - protein, 573 aa, Glycine max
  Coding DNA Sequence Number=SeqID_84825
  Homolog annotation: Hit_ID=A7P069; Match level="QueryCoverage=100%, HitCoverage=100%, E-value=0.0, Identity=72%"; Hit description =Chromosome chr6 scaffold_3, whole genome shotgun sequence
MSSNSSRTEPIAQNIIKLISNLCFSVFVFSVLIFTVIAITYHPPDPWLESTPALTNLFTQSQNATFRIDSSVLKTGEDLAPSPQDPPLPSPPPSASAVTEAVIEKSEQQIANSTANSTADSTDSTDAALPSPPACDGTINCSNPRVRIAIQRFNLRAFKSIAFFDYQPPVNGSVAGECDVAWRFRNKRERSWRKYRDFRRFKIAVTDDCRYKVVHAGGWHSGANARRNMTRSGAARGGKTLPPRASARDDEINDTIPTLGSETNFRNGKYLYYSRGGDYCKGMNHYLWSFLCGLGEAMFLNRTFVMDLSVCLASTYNPSNKDEEGKDFRYYFDFEHLKETASIVEEGEFLRDWKNWDKTHLKKKIPVRKVVNHKVTPMQLKKDKSTIIWRQFDAPEPENYWYRVCEGEAAKNIQRPWHAVWKSKRLMNIVTEISGRLDWDFDAVHVVRGEKAQNKELWPHLDYDTSPDVLVEKLKWMVQPWRHLYIATNEPYYNYFDKLRSNYKVHLLDDYKELWGNTSEWYNETTLLNNGKPVEFDGYMRVAVDTEVFYRGKTRVETFYNLTKDCKDGVNTC

SEQ ID NO: 176511 - protein, 82 aa, Glycine max
  Coding DNA Sequence Number=SeqID_84826
MGLILAWRWWERRVSIESKEQKKLTEELVEDRGMGRVVADRGPLEEAKGRGGIGLTTKEVEELGGRDVQGEGEGVVGDESER

SEQ ID NO: 176512 - protein, 668 aa, Glycine max
  Coding DNA Sequence Number=SeqID_84827
  Gene Ontology: Mol. function=binding; Cellular component=nuclear pore; Biological process=protein import into nucleus, docking
  Homolog annotation: Hit_ID=A7P079; Match level="QueryCoverage=97%, HitCoverage=57%, E-value=0.0, Identity=82%"; Hit description =Chromosome chr6 scaffold_3, whole genome shotgun sequence
  Pfam annotation: Domain name=Adaptin_N; Domain location=33-569; Score= -169.1; E_value=0.032; Accession=PF01602.11; Description=Adaptin N terminal region
  Pfam annotation: Domain name=Arm; Domain location=445-488; Score =10.7; E_value=0.48; Accession=PF00514.14; Description=Armadillobeta -catenin-like repeat
  Pfam annotation: Domain name=Arm; Domain location=492-530; Score =13.0; E_value=0.25; Accession=PF00514.14; Description=Armadillobeta -catenin-like repeat
  Pfam annotation: Domain name=HEAT; Domain location=135-171; Score =18.1; E_value=0.034; Accession=PF02985.13; Description=HEAT repeat
  Pfam annotation: Domain name=HEAT; Domain location=176-214; Score =18.0; E_value=0.035; Accession=PF02985.13; Description=HEAT repeat
  Pfam annotation: Domain name=HEAT; Domain location=224-260; Score =2.9; E_value=9.8; Accession=PF02985.13; Description=HEAT repeat
  Pfam annotation: Domain name=HEAT; Domain location=370-406; Score =10.3; E_value=0.79; Accession=PF02985.13; Description=HEAT repeat
  Pfam annotation: Domain name=HEAT; Domain location=412-447; Score =19.8; E_value=0.01; Accession=PF02985.13; Description=HEAT repeat
  Pfam annotation: Domain name=HEAT; Domain location=453-490; Score =11.7; E_value=0.48; Accession=PF02985.13; Description=HEAT repeat
  Pfam annotation: Domain name=HEAT; Domain location=496-532; Score =15.1; E_value=0.15; Accession=PF02985.13; Description=HEAT repeat
  Pfam annotation: Domain name=HEAT_PBS; Domain location=391-416; Score= 6.2; E_value=12; Accession=PF03130.7; Description=PBS lyase HEAT-like repeat
  Pfam annotation: Domain name=HEAT_PBS; Domain location=432-469; Score= 12.9; E_value=1.2; Accession=PF03130.7; Description=PBS lyase HEAT -like repeat
  Pfam annotation: Domain name=HEAT_PBS; Domain location=517-553; Score= 5.7; E_value=15; Accession=PF03130.7; Description=PBS lyase HEAT-like repeat
  Pfam annotation: Domain name=IBN_N; Domain location=39-111; Score =12.2; E_value=0.0055; Accession=PF03810.10; Description=Importin -beta N-terminal domain
  Pfam module annotation: Pfam domain module=Adaptin_N::Arm::Arm::HEAT:: HEAT::HEAT::HEAT::HEAT::HEAT::HEAT::HEAT_PBS::HEAT_PBS::HEAT_PBS::IBN_ N; Domain location=33-569::445-488::492-530::135-171::176-214::224 -260::370-406:...
  Pfam module annotation: Domain location=:412-447::453-490::496 -532::391-416::432-469::517-553::39-111
MDSEVQQSQVAAILGADPSPFETLISHLMSSSNEQRSHAEALFNLCKQTDPDSLSLKLAHLLHSSPHEEARAMSAILLRKQLTRDDSYLWPRLSPHTQSSLKSLLLSSIQKENIKSISKKLCDTISELASGILPDNAWPELLPFMFQCVSSDSPKLQESAFLIFAQLSQYIGDSLTPHIKHLHDIFLQCLTNASVNPDVRIAALNAVINFIQCLSGSADRDRFQDLLPAMMRTLTEALNSGQEATAQEALELLIELAGTEPRFLRRQLVDVVGAMLQIAEAESLEEGTRHLAIEFVITLAEARERAPGMMRKLPQFISRLFAILMKMLLDIEDDPAWHSAETEDEDAGETSNYSVGQECLDRLSISLGGNTIVPVASEQLPAYLAAPEWQKRHAALIALAQIAEGCSKVMIKNLEQVVAMVLNSFPDQHPRVRWAAINAIGQLSTDLGPDLQVKYHQGVLPALAGAMDDFQNPRVQAHAASAVLNFSENCTPDILTPYLDGIVSKLLVLLQNGKQMVQEGALTALASVADSSQEHFQKYYDAVMPYLKAILVNATDKSNRMLRAKSMECISLVGMAVGKEKFRADAKQVMEVLMSLQVSQMETDDPTTSYMLQAWARLCKCLGQDFLPYMEFVMPPLLQSASLKPDVTITSADSDNEIEDSDDERSQL

SEQ ID NO: 176513 - protein, 617 aa, Glycine max
  Coding DNA Sequence Number=SeqID_84828
  Gene Ontology: Mol. function=binding; Cellular component=nucleus; Biological process=activation of protein kinase C
  Homolog annotation: Hit_ID=A7QE77; Match level="QueryCoverage=90%, HitCoverage=99%, E-value=0.0, Identity=66%"; Hit description =Chromosome chr4 scaffold_83, whole genome shotgun sequence
  Pfam annotation: Domain name=PPR; Domain location=146-180; Score =13.6; E_value=0.19; Accession=PF01535.11; Description=PPR repeat
  Pfam annotation: Domain name=PPR; Domain location=208-242; Score =38.2; E_value=3e-08; Accession=PF01535.11; Description=PPR repeat
  Pfam annotation: Domain name=PPR; Domain location=311-345; Score =40.4; E_value=6.3e-09; Accession=PF01535.11; Description=PPR repeat
  Pfam annotation: Domain name=PPR; Domain location=346-380; Score =11.0; E_value=0.39; Accession=PF01535.11; Description=PPR repeat
  Pfam annotation: Domain name=PPR; Domain location=382-416; Score=1.8; E_value=4.8; Accession=PF01535.11; Description=PPR repeat
  Pfam annotation: Domain name=PPR; Domain location=448-482; Score=7.5; E_value=1; Accession=PF01535.11; Description=PPR repeat
  Pfam annotation: Domain name=PPR; Domain location=75-109; Score=29.4; E_value=1.3e-05; Accession=PF01535.11; Description=PPR repeat
  Pfam module annotation: Pfam domain module=PPR::PPR::PPR::PPR::PPR::PP R::PPR; Domain location=146-180::208-242::311-345::346-380::382 -416::448-482::75-109
MVVRRVLEWEVVRILERCSSLNQAKEVHAQIYIKNLQQSSYVLTKLLRLVTALPHVPLHSYPRLLFSQLHTPNPFAWTALIRAYALRGPLSQALSFYSSMRKRRVSPISFTFSALFSACAAVRHSALGAQLHAQTLLLGGFSSDLYVNNAVIDMYVKCGSLRCARMVFDEMPERDVISWTGLIVAYTRIGDMRAARDLFDGLPVKDMVTWTAMVTGYAQNAMPMDALEVFRRLRDEGVEIDEVTLVGVISACAQLGASKYANWIRDIAESSGFGVGDNVLVGSALIDMYSKCGNVEEAYDVFKGMRERNVFSYSSMIVGFAIHGRARAAIKLFYDMLETGVKPNHVTFVGVLTACSHAGLVDQGQQLFASMEKCYGVAPTAELYACMTDLLSRAGYLEKALQLVETMPMESDGAVWGALLGASHVHGNPDVAEIASKRLFELEPDNIGNYLLLSNTYASAGRWDDVSKVRKLLREKNLKKNPGWSWVEAKNGMIHKFVAGDVSHPKINEIKKELNDLLERLKGIGYQPNLSSLPYGINDREKRLLLMAHSEKLALAFGLLSTDVGSTIKIMKNLRICEDCHIVMCGASKVTGRKIVVRDNTRFHHFLNGACSCSNFW

SEQ ID NO: 176514 - protein, 172 aa, Glycine max
  Coding DNA Sequence Number=SeqID_84829
  Gene Ontology: Mol. function=metal ion binding; Biological process =metal ion transport
  Homolog annotation: Hit_ID=A7QDL0; Match level="QueryCoverage=61%, HitCoverage=79%, E-value=2e-34, Identity=59%"; Hit description =Chromosome chr10 scaffold_81, whole genome shotgun sequence
MRMQKVTVMGWADQKKVLKTVRKTGRRAELWPYPYNPEYHALARHYGNGNYFASAKPSSSYNYYKHGYSYGEDFGYYHKPIGAAIIDEKAMSMFSDDNPHACSIIYLSWKLSREKYLTTVHSCHTTSTVTCTSVATARGRSTPHTHDGRRDVRHKPIGKTLNKKEAFRARAF

SEQ ID NO: 176515 - protein, 342 aa, Glycine max
  Coding DNA Sequence Number=SeqID_84830
  Homolog annotation: Hit_ID=A7QDK9; Match level="QueryCoverage=96%, HitCoverage=85%, E-value=1e-121, Identity=66%"; Hit description =Chromosome chr10 scaffold_81, whole genome shotgun sequence
  Pfam annotation: Domain name=DUF676; Domain location=1-195; Score =166.7; E_value=6.1e-47; Accession=PF05057.5; Description=Protein of unknown function (DUF676)
MLEKVYLYHLERISSSNTYTKTFSGIDGAGKRLADEVLQVVKKTKNLKRISFLAHSLGGLFARYAIAVLYSLDTYSRDQPGNLANSVTGNSQGTSLSRGGMIAGLEPINFITLATPHLGVRGKKQLPFLLGVPILEKLAAPIAPFFVGQTGSQLFLTDGKPDKPPLLLRMASDSDDGKFLITGYLLQSHSLSAKDESLYPEMDVAVPPRKSLDGYKHVVDVEYCPPVPSDGPKFPPKAVKAKKAAQNAPNTQNTVEYHEIVEVTDVPLKPLIFLTDEMIQGLQQLGWKKVDVSFHSAFWPFFAHNNIHVKNEWLHNAGVGVIAHVADSLRQQEASSILPANL

SEQ ID NO: 176516 - protein, 1270 aa, Glycine max
  Coding DNA Sequence Number=SeqID_84831
  Gene Ontology: Mol. function=actin binding; Cellular component =cytoskeleton
  Homolog annotation: Hit_ID=A7QDK4; Match level="QueryCoverage=98%, HitCoverage=91%, E-value=9e-79, Identity=42%"; Hit description =Chromosome chr10 scaffold_81, whole genome shotgun sequence
MTTASRSHRLMVQVQNIEASLPALEKAVLAQTSHIHLAYTAGCEWHPRMKAARNHFIYNDLPHFIMDSYEECRDPPRVHLLDKFDTGGPGSCFRRYSDPTFFKRVSADSDESYSGKTEKARKSHKSKKKRSRRNGDILRSEQRHSTSGRMQSISSAISGQTSSSQTASTIDMAMKSDLENYSNSFDSKSGAGYIECVFHPSNSMQSDEPDYKEPSSTRLKQKADTLSSVSHHIDDSISHDSLEKQVASSSFGVTWDEKEEIVESKSQTCDRNKTPERLVEKHDSNMHVKEAVTITNIDYNHILFTEENNLKPVRNRAQTDDIDSEPDNYVDALNTIESESENDIDYITKREVQQLSSRVTCGMIENGVSEAPPNLMDNNLSDVVFQTDYTVLLNEEQGHLADSLQENHVLDLLSKPNASNLGYVSPSDDLDRENMTRDTASLNKEPFRDLPDSLQDIPPLTSEPHVSNLGPVSPSDVLYSEEMTRDTICFNKEMFGNLPDSLQEISPLTSEPHASNLGLGNPSDVPYGEEMTRDTVFFNKETFGNLPNLQEIPPPTVEPHTSNLGPVNPSNSPHSEEMTTDTVSLNKEMLANLPNSLQETPALTLEPLASNLAFVSPSDISVSKEIAKNIADSHPSKTPACEQVPRPSENSVLDNSVCTDSYIGSSTVNDTVSAPIETDISFSGSKNSNLPDEEAGKINNNICKSEETHRESLADHSVRFWTNGGLLGLEPSKPPDFNKSTSLGQGSLSTKSETDGGSHHNSMQKSNGYKEEWESSEEVAEQILKEPNSRFLTSGHNDDQACVSEKATGNSQQSNGFGQTERDNLGEIRVIAPGSILPSTPDTKDSTEPNQGNGENSSRVFGLSRRLLINSFQRKVSFDEKSEHYNSLKSVILDQSGQNGIVGPSLPETTSSKEKVGSGYPIKSLPPSPPLEHMKISFHPVSGLETSKLKLRFPDGSNHHESVNDMFPSFQLVPEASLPLDGSVSHSDDDDTFCRSSPYISDDGQSPRSDYNSDQWESDETPESSDQGVHDSPCRRSSTESVSNDDTNAKSGHGTCTMNGVEHSLSRPLLDFPSYDNVNPALEKESKKHSKCNNAVMSHSHAEPAQPPPPPPLPPTQWRVSKPQLDMTSGTQYCMSEDAEHIGDHSLPDSTILQQPRVTQVEQIQINHDDHESYDNIIYKLKDKLDQQKLKGQKEANQLRMGKEIDEREDFLYQIRTKAFNLRPTVSGKSNDTTGSTANVKVTAILEKANAIRQVVASDDGEDDDNWSDT

SEQ ID NO: 176517 - protein, 135 aa, Glycine max
  Coding DNA Sequence Number=SeqID_84832
  Pfam annotation: Domain name=Collagen; Domain location=24-81; Score= -18.7; E_value=0.0037; Accession=PF01391.9; Description=Collagen triple helix repeat (20 copies)
MQRLPERRVRRKGDTWQHLGRALRTGATGSAAAAGASGRVGYPGATGRAGDPGATGRAGDPGATQLGLRPNWVAPGYPTRPDAPAATALPVAPVRRARPKCCHVSPLRRTRLSERRFVVQKQTHEVNNFKTDPFR

SEQ ID NO: 176518 - protein, 1172 aa, Glycine max
  Coding DNA Sequence Number=SeqID_84833
  Gene Ontology: Mol. function=hydrolase activity; Cellular component =nucleus; Biological process=metabolic process
  Homolog annotation: Hit_ID=A7QDH6; Match level="QueryCoverage=66%, HitCoverage=95%, E-value=0.0, Identity=48%"; Hit description =Chromosome chr10 scaffold_81, whole genome shotgun sequence
  Pfam annotation: Domain name=PPR; Domain location=422-456; Score=2.4; E_value=4; Accession=PF01535.11; Description=PPR repeat
  Pfam annotation: Domain name=PPR; Domain location=488-522; Score =25.5; E_value=0.00019; Accession=PF01535.11; Description=PPR repeat
  Pfam annotation: Domain name=PPR; Domain location=523-557; Score=0.5; E_value=6.8; Accession=PF01535.11; Description=PPR repeat
  Pfam annotation: Domain name=PPR; Domain location=558-591; Score =16.5; E_value=0.085; Accession=PF01535.11; Description=PPR repeat
  Pfam annotation: Domain name=PPR; Domain location=664-698; Score =50.3; E_value=6.8e-12; Accession=PF01535.11; Description=PPR repeat
  Pfam annotation: Domain name=PPR; Domain location=722-755; Score =33.4; E_value=8e-07; Accession=PF01535.11; Description=PPR repeat
  Pfam annotation: Domain name=PPR; Domain location=820-854; Score =33.6; E_value=7.2e-07; Accession=PF01535.11; Description=PPR repeat
  Pfam annotation: Domain name=PPR; Domain location=855-889; Score=1.2; E_value=5.6; Accession=PF01535.11; Description=PPR repeat
  Pfam annotation: Domain name=PPR; Domain location=957-991; Score =12.7; E_value=0.25; Accession=PF01535.11; Description=PPR repeat
  Pfam annotation: Domain name=SLEI_Leptospira; Domain location=678 -690; Score=11.4; E_value=0.49; Accession=PF07620.2; Description=SLEI
  Pfam annotation: Domain name=SLEI_Leptospira; Domain location=736 -748; Score=4.6; E_value=23; Accession=PF07620.2; Description=SLEI
  Pfam annotation: Domain name=zf-C3HC4; Domain location=181-276; Score= 16.1; E_value=0.0013; Accession=PF00097.16; Description=Zinc finger, C3HC4 type (RING finger)
  Pfam module annotation: Pfam domain module=PPR::PPR::PPR::PPR::PPR::PP R::PPR::PPR::PPR::SLEI_Leptospira::SLEI_Leptospira::zf-C3HC4; Domain location=422-456::488-522::523-557::558-591::664-698::722-755::820 -854::855-889::...
  Pfam module annotation: Domain location=957-991::678-690::736 -748::181-276
MDQAKSKGSGEILDHVDERVDEDFNQLVEGNAIDAGGGHSLGEGVNVSGEDGTSEEMCNDLRLNRELKEGSQEVNDQNMGDPQEINDTLHGVDQGTSYSSRNLVSWEVPETCVVVDPSTQIECVNGDNRKLEAKPNESGLNKVSMKVTNGVSETDKNSCVIDINCHSCDGFSENLEGEMICRICHLASGQPLEAADVGTASSATTNTDLIQLGCACKDELGIVHSHCAEAWFKLKGNRHLVGFPSEVLANGLVSSGCELRTLKNLKAVGWGLCEICGETAKNVSDVTDNGFIEEWNDTRFMDSDNTSSRRQSRTTCLSPSNLDLSCGSSVGVSATLSETTHNNVIADKNTEICKFCEMGDLRNAMELLSWCLHCYWYLTNYNNSVVTELREHYGCPLTECCYVSCGAAIAITRSQKSELELNTYCFVLQLCTQRKSLEDGKRVHSIITSDGMAIDEVLGAKLVFMYVNCGDLIKGRRIFDGILNDKVFLWNLLMSEYAKIGNYRETVGLFEKLQKLGVRGDSYTFTCILKCFAALAKVMECKRVHGYVLKLGFGSYNAVVNSLIAAYFKCGEAESARILFDELSDRDMLNLGVDVDSVTVVNVLVTCANVGNLTLGRILHAYGVKVGFSGDAMFNNTLLDMYSKCGKLNGANEVFVKMGETTIVSWTSIIAAHVREGLHDEALRLFDKMQSKGLSPDIYAVTSVVHACACSNSLDKGRESIVSWNTMIGGYSQNSLPNETLELFLDMQKQSKPDDITMACVLPACAGLAALEKGREIHGHILRKGYFSDLHVACALVDMYVKCGFLAQQLFDMIPNKDMILWTVMIAGYGMHGFGKEAISTFDKIRIAGIEPEESSFTSILYACTHSEFLREGWKFFDSTRSECNIEPKLEHYAYMVDLLIRSGNLSRTYKFIETMPIKPDAAIWGALLSGCRIHHDVELAEKVPEHIFELEPEKTRYYVLLANVYAKAKKWEEVKKLQRRISKCGLKKDQGCSWIEVQGKFNNFVAGDTSHPQAKRIDSLLRKLRMKMNREGYSNKMRTVRVTKNLRVCGDCHEMGKFMSKTTGREILLRDSNRFHHFKDGLCSCRGFWTHYRLGYKVMAKKVYVEVIAIVSVESVIEATVFVVTSEATLCPNFVCEVMLFMDDLSKHLYLDWKNIAAEICKWGSDVTFFL

SEQ ID NO: 176519 - protein, 231 aa, Glycine max
  Coding DNA Sequence Number=SeqID_84834
MEDLDLETQHKHTGIIFNWASSFSMIICFDMESEDAVIYNGSLNMLSSHVTWSWSCSLFTFLVIESFMDGSRVAQSLDSLWFYTNILTCRDEPEASLVESAPLIQAKECPKRDLQKPITPLQHESQNVENLSPRCHKFEEVMKTMVPSRETKKRETRKRRKWHKLGLYETNVVHGGLDLRFDFDVFDVESWEYQIQMLNIQRQTKMPPFDNDVAMKQHLKSWAYAVACTVR

SEQ ID NO: 176520 - protein, 327 aa, Glycine max
  Coding DNA Sequence Number=SeqID_84835
  Gene Ontology: Mol. function=molecular_function; Cellular component =membrane; Biological process=auxin mediated signaling pathway
  Homolog annotation: Hit_ID=A7QJ00; Match level="QueryCoverage=87%, HitCoverage=96%, E-value=3e-85, Identity=51%"; Hit description =Chromosome chr2 scaffold_105, whole genome shotgun sequence
  Pfam annotation: Domain name=DUF6; Domain location=61-173; Score =22.5; E_value=0.0015; Accession=PF00892.11; Description=Integral membrane protein DUF6
MAVDNDEGIAAIVVDGGDDHGVGIEYVVLLKGPEPQKQNSIAEMKNCDEWKPFLVMIAIDFSLTMVNILLKKVLQEGMNHLVFITYRLSVATIFLAPIGYFKERASVTQYFFLLGIQYTSATFACAFVNMVPVITFIMALPFGLETVNIKCKGGKAKILGTFVCIGGALLLTLYKGKALFDGSHHQSAVAMRSAMDQASSTTRTTQKWTIGSKIGKRYPCQYSSTAIMTFFGAMQAAILGFSTGSSNLSSGPVFTAAFSPLVQIMSGMIDIPFLHEQLHLGSVVGSMLVMIGLYILLWGKSKDMMQNNGATKFAQEVEETKEQEPQV

SEQ ID NO: 176521 - protein, 87 aa, Glycine max
  Coding DNA Sequence Number=SeqID_84836
  Subcellular localization annotation: CTP_CleavageSite=27; ConfidenceScore=5.01e-01
MAKNPRHITPFTIYKYPARVKYSQAKRTSLVKSTVLRLYKLKLALETVKRQYENLLATRREFISLSNHVKENKDVKIEKVGAGNFYG

SEQ ID NO: 176522 - protein, 643 aa, Glycine max
  Coding DNA Sequence Number=SeqID_84837
  Gene Ontology: Mol. function=catalytic activity; Biological process =cellular metabolic process
  Homolog annotation: Hit_ID=Q8S4X1; Match level="QueryCoverage=91%, HitCoverage=89%, E-value=0.0, Identity=74%"; Hit description=UOS1
  Pfam annotation: Domain name=ADH_zinc_N; Domain location=125-272; Score=-16.7; E_value=0.019; Accession=PF00107.17; Description=Zinc -binding dehydrogenase
  Pfam annotation: Domain name=CIA30; Domain location=252-469; Score =192.7; E_value=9.4e-55; Accession=PF08547.3; Description=Complex I intermediate-associated pro
  Pfam annotation: Domain name=Epimerase; Domain location=129-352; Score=-57.1; E_value=0.0065; Accession=PF01370.12; Description=NAD dependent epimerasedehydratase family
  Pfam annotation: Domain name=NmrA; Domain location=129-358; Score= -109.3; E_value=0.061; Accession=PF05368.4; Description=NmrA-like family
  Pfam annotation: Domain name=TrkA_N; Domain location=129-273; Score= -3.7; E_value=0.016; Accession=PF02254.9; Description=TrkA-N domain
  Pfam annotation: Domain name=adh_short; Domain location=127-251; Score=-54.2; E_value=0.045; Accession=PF00106.16; Description=short chain dehydrogenase
  Pfam module annotation: Pfam domain module=ADH_zinc_N::CIA30::Epimeras e::NmrA::TrkA_N::adh_short; Domain location=125-272::252-469::129 -352::129-358::129-273::127-251
  Subcellular localization annotation: CTP_CleavageSite=74; ConfidenceScore=5.33e-01
MEAFYTTLSSPASTSVLNFQGSELPRRKLCKKSSHTILASPTLPKPFLQIYGRPQTLLYRSTRLSSGAHRVTISAEAGRQNWDFGRFVKTLFFFNGFPSPAKFFDFLVEKLSDPSPSEVVNTMGTSDIVLVAGATGGVGRRVVDILRKKGIPVRVLVRNEEKARRMLGSDVDLVIGDITKDSTLIPEYFKGVKKVINAASVIVGPKEGDTPDRAKYSQIKGDSPEKVEYIGMRNLIKAVKDNLGLRREKLLFGFEGNNYRQLPWGALDDVVMGGVSESTFQIDPSGGENGGPTGIFKVQVLFLQQTMVALQVSELRASPGAALKLCLGDLLVMGSNLETASLHMQGRVFTIGFQNFSEPENLSAYDGLEFRLKGDGRRYKIIVRTSSDWDALGYTAGFDTEKGKWQSVVPFSSLRPVFRARTVSDAPPFDPSIVQNSLQLMFSKFEYDGKLNETFVEGPFELPVSSIHAYIIKDPITPRFVHVSSAGVTRPERPGLDLSKQPPAVRLNKELDYILTFKLKGEDLLRESGIPYVIVRPCALTEEPAGADLIFDQGDNITGKISREEIALMCVAALDSPYACDKTFEVKSVIPFSEPFTVDPANPPPEKDYDGGSDVAFEMETNLMRDDAEVGNCDKDVYGSMQS

SEQ ID NO: 176523 - protein, 460 aa, Glycine max
  Coding DNA Sequence Number=SeqID_84838
  Gene Ontology: Mol. function=metal ion binding; Biological process =double fertilization forming a zygote and endosperm
  Homolog annotation: Hit_ID=A7QDG4; Match level="QueryCoverage=96%, HitCoverage=97%, E-value=1e-127, Identity=55%"; Hit description =Chromosome chr10 scaffold_81, whole genome shotgun sequence
  Pfam annotation: Domain name=DUF641; Domain location=57-192; Score =224.2; E_value=3.1e-64; Accession=PF04859.3; Description=Plant protein of unknown function (DUF641)
  Subcellular localization annotation: CTP_CleavageSite=28; ConfidenceScore=5.15e-01
METMKPKSALNNRSKKLAKTFQKVISLRSATKLASNNGICMLNSHLKVKEDLFTDQNNKPHQGNNKNRAVMEALIARLFAGVTTIKAAYAELQMAQHPYNNDSIQAADQAVVDELRAISELKRRFLKKELDLSPHVTIMLAEIQEQQSLMKTYEITIKRLEAEVDFKDNNISSLKKHLDDCVNFNKSIEKKLNSSGSLSLFDNLTLSSLSPTHFVHFLHHTLRSVRSFSKVMMAEMESAHWDLEAAVKFIHSNAVFTKPTHQTFAFESFVCITMFEGFNYPNFNVAEDKILHKQGAQSLYFDKFKKVKSLNPKQYLTHNPNSSFSKFLKSKYLQVVHAKMECSFFGNLNQRKVVNSGGYPESSFFVAFAEMAKRVWTLHCLALSFQDDDVTVFQIKKNTRFSEVYMESVTEEPVSHSGESSDSSSGELRVGFTVVPGFKIGKTVIQSQVYLSLVGSPATS

SEQ ID NO: 176524 - protein, 133 aa, Glycine max
  Coding DNA Sequence Number=SeqID_84839
MARSAHDLNALSARTASGDVVPINLEIEATCWRNNTARRRREQDTEGSSHTSPPLSPHHAEMDGEQARRVKLEDFSNTATPQFFTSIARPEVQAANISYPHSLIQLIQGNLFHGLPSEDPYAHLASYIEICNT

SEQ ID NO: 176525 - protein, 588 aa, Glycine max
  Coding DNA Sequence Number=SeqID_84840
  Gene Ontology: Mol. function=oxidoreductase activity, acting on single donors with incorporation of molecular oxygen, incorporation of two atoms of oxygen; Cellular component=chloroplast; Biological process=abscisic ...
  Gene Ontology: Biological process=acid biosynthetic process
  Homolog annotation: Hit_ID=Q3KRR4; Match level="QueryCoverage=95%, HitCoverage=95%, E-value=0.0, Identity=78%"; Hit description=9-cis -epoxycarotenoid dioxygenase 2
  Pfam annotation: Domain name=RPE65; Domain location=99-583; Score =801.0; E_value=6.9e-238; Accession=PF03055.6; Description=Retinal pigment epithelial membrane protein
  Subcellular localization annotation: CTP_CleavageSite=44; ConfidenceScore=5.49e-01
MAALNSSTWAKPQFHHPLSSSSSLLTDMGFPTRFPKKPIGEVVNCALHSPPVTHFPNQPFTKTLQITKEPTYPPAERPQWNPFQKAAAKALDMFESALLSRELSQPLPKTTDPRVQIAGNFAPVPEHPVQHSLPVIGTIPDAVNGVYLRNGANPLFHPKAGHHLFDGDGMVHAVKINHGTASYACRFTETQRLMQEHALGKPVFPKAIGELHGHSGIARLMLFYARGLCGIVDHRSGAGSANAGLVFFNGKLLAMSEDDLPYELRITASGDLETIGRYSFHDQLNSSMIAHPKVDPISGELFTLSYDVTSKYLKYFRFSPEEEKKSPDVEIPLGAATMTHDFAITENFVVIPDQKVVFKLGEMIKGGSPVIYDDEKKSRFGILPKYASDASSIVWVESPDTFFFHFWNAWEERETDEVVVIGSCMTPPDSIFKDTEESLKSVLTEIRLNIRSGKSTRRVVVEEMNLEAGMVNRNRLGRKTRFAYLCIAEPWPKVSGFAKVDLESGEVKRHEYGERRFGGEPFFLPTRGENGNEDEGYVMAFVHDEVTWQSELQILNALDLKLEATIMLPSRVPYGFHGTFVEAMDLPQ

SEQ ID NO: 176526 - protein, 469 aa, Glycine max
  Coding DNA Sequence Number=SeqID_84841
  Gene Ontology: Mol. function=pyruvate dehydrogenase (acetyl -transferring) activity; Cellular component=chloroplast; Biological process=metabolic process
  Homolog annotation: Hit_ID=A7PZ40; Match level="QueryCoverage=65%, HitCoverage=75%, E-value=1e-161, Identity=93%"; Hit description =Chromosome chr4 scaffold_39, whole genome shotgun sequence
  Pfam annotation: Domain name=Transket_pyr; Domain location=147-325; Score=240.4; E_value=4.1e-69; Accession=PF02779.15; Description =Transketolase, pyrimidine binding dom
  Pfam annotation: Domain name=Transketolase_C; Domain location=338 -460; Score=172.5; E_value=1.1e-48; Accession=PF02780.11; Description= Transketolase, C-terminal domain
  Pfam module annotation: Pfam domain module=Transket_pyr::Transketolase _C; Domain location=147-325::338-460
  Subcellular localization annotation: CTP_CleavageSite=42; ConfidenceScore=5.64e-01
MATLFQGLGVVNPSLSSSNSNNFLLPSRTSLSERKDGIFVVRSDARVSSKVLKAGARKHELLVTNAVATKEGSSAASTSKSGYCYMFMSNHSCASPSNATTHCPMIPAIHLILAKISNNIHTMFIFVLKSQDSYRFSFTIPNVHKRHELLLFEALREGLEEEMERDPCVCVMGEDVGHYGGSYKVTKGLATKFGDLRVLDTPIAENSFTGMGIGAAMTGLRPVVEGMNMGFLLLAFNQISNNCGMLHYTSGGQFKIPIVIRGPGGVGRQLGAEHSQRLESYFQSIPGIQMVACSTPYNAKGLMKAAIRSENPVILFEHVLLYNLKERIPDEEYVLSLEEAEMVRPGEHVTILTYSRMRYHVMQAAKTLVNKGYDPEVIDIRSLKPFDLHTIGNSVKKTHRVLIVEECMRTGGIGASLTAAITENFHDYLDAPIVCLSSQDVPTPYAGTLEEWTVVQPAQIVTAVEQLCK

SEQ ID NO: 176527 - protein, 209 aa, Glycine max
  Coding DNA Sequence Number=SeqID_84842
  Gene Ontology: Mol. function=transporter activity; Cellular component= integral to membrane; Biological process=nodulation
  Homolog annotation: Hit_ID=P08995; Match level="QueryCoverage=86%, HitCoverage=66%, E-value=1e-68, Identity=75%"; Hit description =Nodulin-26
  Pfam annotation: Domain name=MIP; Domain location=30-204; Score =161.5; E_value=2.3e-45; Accession=PF00230.11; Description=Major intrinsic protein
MADYSARTESCEVVVNVTKDTSKTMEPSDSFVSVPFLQKLVAEVVGTYFLIFAGCASVVVNKNNDNVVTLPGIAIAWGLVVTVLVYTVGHISGAHFNPAVTIAFASTRRFPLMQVPAYVAAQLLGSTLASGTLKLLFMGKHDQFSGTLPNGTNLQAFVFEFIITFLLMFVISGVATDNRADSMKNVTWVRSSVIKLINEVESVHRGILE

SEQ ID NO: 176528 - protein, 98 aa, Glycine max
  Coding DNA Sequence Number=SeqID_84843
  Homolog annotation: Hit_ID=A7QDF3; Match level="QueryCoverage=77%, HitCoverage=81%, E-value=5e-12, Identity=48%"; Hit description =Chromosome chr10 scaffold_81, whole genome shotgun sequence
MVLKSKAEFLILLVLVVCQPSCGLGEDWSTRRLSRHNNKVIPPSCGELVLKSQCSENSKCRWCTSEDLDDMCFSKSEALRLPHQETAVRSVNNTDGAW

SEQ ID NO: 176529 - protein, 104 aa, Glycine max
  Coding DNA Sequence Number=SeqID_84844
  Gene Ontology: Mol. function=transporter activity; Cellular component= integral to membrane; Biological process=nodulation
  Homolog annotation: Hit_ID=P08995; Match level="QueryCoverage=94%, HitCoverage=36%, E-value=5e-39, Identity=82%"; Hit description =Nodulin-26
  Pfam annotation: Domain name=MIP; Domain location=2-77; Score=-99.5; E_value=0.0028; Accession=PF00230.11; Description=Major intrinsic protein
MTRRNGERHDNTEVGELAGIAIGSTILLNVIIGGPVTGASMNPVRSLGPAIVHGEYRGIWIYLLAPVVGAIAGALVYNTIRYTDKPLREITKSASFLKGRGGST

SEQ ID NO: 176530 - protein, 270 aa, Glycine max
  Coding DNA Sequence Number=SeqID_84845
  Gene Ontology: Mol. function=transporter activity; Cellular component= integral to membrane; Biological process=transport
  Homolog annotation: Hit_ID=Q6QIL2; Match level="QueryCoverage=98%, HitCoverage=98%, E-value=1e-109, Identity=76%"; Hit description=NIP2
  Pfam annotation: Domain name=MIP; Domain location=30-244; Score =299.2; E_value=8.1e-87; Accession=PF00230.11; Description=Major intrinsic protein
MDENSATNGTHEVVLDVNRDVSRTTQASRSCVNVSFLQKLVAEVVGTYFLIFAGSASVVVNKNNNNVVTLPGISIVWGLVVMVLVYSVGHISGAHFNPAVTIAFASTKRFPLKQVPVYVVAQVVGSTLASGTLRLLFSGKEAQFSGTLPSGSNLQAFVIEFLITFFLMFVVSGVATDNRAIGELAGIAVGSTVLLNVMFAGPITGASMNPARSIGPAIVHKEYRGIWIYLVSPTLGAVAGAWVYNSIRYTDKPLREITKSASFLKGVASR

SEQ ID NO: 176531 - protein, 445 aa, Glycine max
  Coding DNA Sequence Number=SeqID_84846
  Homolog annotation: Hit_ID=A7QDF0; Match level="QueryCoverage=64%, HitCoverage=56%, E-value=3e-74, Identity=48%"; Hit description =Chromosome chr10 scaffold_81, whole genome shotgun sequence
  Pfam annotation: Domain name=Seipin; Domain location=185-405; Score =280.9; E_value=2.5e-81; Accession=PF06775.5; Description=Putative adipose-regulatory protein (
MESSFSGPNNQNDDVFLDALPHCPFHHCSGAADKSPESSSSSSILSDPNPPSPPPATTIRRRSTRRNSPVRETTNTGSSHNSTTGNVTNLRSDRNLGTSNGNENFPEKCDSNREKVRPFQSPSVGTEEGNEESTLTTAENEDGVTDSADSAVEFTQGWFKEHKSLWNVAFRCGWGFLRSMYICCILFGLLVSSLVVSGFLVRWLVEEPFQMRQVLNFDYTKQSPVAFVPVMSCDGVGGAHDSEKGIAVREWMGRRVIPANQKVQVTVSLVVPESEYNTNLGIFQIRVDFLSSDGKTIWSSNQPCMLKFTSEPIRLITTFLKIVPLVTGYISETQTLNVKMRGFVEGDVPTSCLKVTLEQRAEYSPGAGIPQMYDSSVVIESELPLFKRIIWHGKICIFLWITMMAFMMELLLVLVCCLPIIIPRTRQSSGAARVTGTQNNLQAPN

SEQ ID NO: 176532 - protein, 105 aa, Glycine max
  Coding DNA Sequence Number=SeqID_84847
  Gene Ontology: Mol. function=sequence-specific DNA binding; Cellular component=nucleus; Biological process=regulation of transcription, DNA-dependent
  Homolog annotation: Hit_ID=Q56NI3; Match level="QueryCoverage=88%, HitCoverage=33%, E-value=6e-16, Identity=56%"; Hit description=MADS box protein M7
  Pfam annotation: Domain name=K-box; Domain location=15-102; Score= -4.7; E_value=0.0011; Accession=PF01486.8; Description=K-box region
MDVKASIERYKKASSDLSTGGQSASEANAQDKKNLTTILKKKAYEEISSIIPIFGKNVLNRSQMMGEGLSTMNGKDLKNLETKLEKGISRIRSKKVFLVTRSFFL

SEQ ID NO: 176533 - protein, 500 aa, Glycine max
  Coding DNA Sequence Number=SeqID_84848
  Gene Ontology: Mol. function=hydrolase activity, acting on ester bonds; Cellular component=nucleus; Biological process=lipid metabolic process
  Homolog annotation: Hit_ID=A7QV59; Match level="QueryCoverage=74%, HitCoverage=96%, E-value=1e-163, Identity=73%"; Hit description =Chromosome undetermined scaffold_186, whole genome shotgun sequence
  Pfam annotation: Domain name=Lipase_GDSL; Domain location=152-480; Score=271.7; E_value=1.5e-78; Accession=PF00657.13; Description=GDSL- like LipaseAcylhydrolase
MGLVISYPYPYPTFGYQEKPEPEPIPGDSGERKLTDGYGSVVVGSEVSGSDIVAVGTNGEEVEVVVCGERRDDIEEPLWGQWRRRNNGDTFHGGNNEGRHKHKPSEGNHDDATPFLAPMAALYLPISMLALIVVVSLGLWSGVQGAPQVPCYFIFGDSLVDNGNNNQLQSLARADYLPYGIDFPGGPSGRFSNGKTTVDAIAELLGFDDYIPPYADASGDAILKGVNYASAAAGIREETGQQLGGRISFSGQVQNYQSTVSQVVNLLGNEDSAANYLSKCIYSIGLGSNDYLNNYFMPQFYSSSRQYSPDEYADVLIQAYTEQLKTLYNYGARKMVLFGIGQIGCSPNELAQNSPDGKTCVEKINSANQIFNNKLKGLTDQFNNQLPDARVIYVNSYGIFQDIISNPSAYANNMNSQSSVDMNQSSGFSVTNAGCCGVGRNNGQITCLPMQTPCQNRREYLFWDAFHPTEAGNVVVAQRAYSAQSASDAYPVDIQRLAQI

SEQ ID NO: 176534 - protein, 372 aa, Glycine max
  Coding DNA Sequence Number=SeqID_84849
  Gene Ontology: Mol. function=nucleotidyltransferase activity; Cellular component=ribosome; Biological process=metabolic process
  Homolog annotation: Hit_ID=Q2PEV6; Match level="QueryCoverage=93%, HitCoverage=51%, E-value=1e-128, Identity=66%"; Hit description =Putative uncharacterized protein
  Pfam annotation: Domain name=PRC; Domain location=181-274; Score =58.6; E_value=2.1e-14; Accession=PF05239.7; Description=PRC-barrel domain
  Pfam annotation: Domain name=RimM; Domain location=86-175; Score =110.5; E_value=5.1e-30; Accession=PF01782.9; Description=RimM N -terminal domain
  Pfam module annotation: Pfam domain module=PRC::RimM; Domain location= 181-274::86-175
  Subcellular localization annotation: CTP_CleavageSite=64; ConfidenceScore=5.60e-01
MQIQALPPALQRPFQPPLSLGFPFKPYFLTPTKHAPWHSTNNSFVLYSRFLHAVKFRRSFATVTATTDEAVIDDSYTTNNERGFVNIGYISSVHGIQGEIRVKPATDFPRLRFSTPGRRWLKSKVLGGESVQEVELEEGREHPALKSWILKFRGIDTVEQAKMLIGATLLVTDEDRPELEEGEFYTHDLIGMRVFMKENGKLVGTVVNVFNSGANDLLQIVLDSSFDMLDKSGKSRSAEDASDQLVLVPFVEAIVPDVDMKKREMHITPPKGLLELNLRFDERSKKERRQLEWKERKKFQKHLIAAKKKLIEMEQKHVFHGFQYGEKDQWSLLSDQIVGVNSKLLQEALQSLERPAKRQVNITTTKMKACSH

SEQ ID NO: 176535 - protein, 469 aa, Glycine max
  Coding DNA Sequence Number=SeqID_84850
  Gene Ontology: Mol. function=ATP-dependent peptidase activity; Cellular component=integral to membrane; Biological process=ATP -dependent proteolysis
  Homolog annotation: Hit_ID=A7P797; Match level="QueryCoverage=98%, HitCoverage=98%, E-value=1e-103, Identity=44%"; Hit description =Chromosome chr9 scaffold_7, whole genome shotgun sequence
  Pfam annotation: Domain name=DUF81; Domain location=65-439; Score= -21.6; E_value=0.00013; Accession=PF01925.10; Description=Domain of unknown function DUF81
  Pfam annotation: Domain name=FtsX; Domain location=219-415; Score= -39.4; E_value=0.1; Accession=PF02687.12; Description=Predicted permease
  Pfam annotation: Domain name=Voltage_CLC; Domain location=16-409; Score=-168.5; E_value=0.013; Accession=PF00654.11; Description =Voltage gated chloride channel
  Pfam module annotation: Pfam domain module=DUF81::FtsX::Voltage_CLC; Domain location=65-439::219-415::16-409
MAMHVLSQRWDVKWVAGKVLIIALLLPVTVSAKNTTSESNEITGVGTGYHAKVFYQHTWPSMKYGWKIIVGTIVGFLGSAFGNVGGVGGGGIFVPMLTLIIGFDAKSAIAISKCMITGGATATVFYNLRQRHPTLDLPVIDYDLALLFQPMLMLGISIGVSFNVIFPDWMLTTLLIISFTGISVKSFFKGVDTWKQETLMMKEASKNSLTDGRGGSTCIATRQLSLQNIGNPEDDAHYIKTIDPVKDNTNQSRKKNYTTTCSGVYWVINLLQVPIAVGMSSYQAMRLYKGQRIIASKGDQQTHWRVLQLIVFCACGILAGTIAGLLGLGGGFILAPLFLGLGIPPQILHGNHSNWGFFSTKVASATSILAMAFSASIAVVEYYLLKRFPISYALYFVAVATAAALVGQHLVRKVIAMLGRASVIIFILTLTLCVSAVLLGGVGVANMIKRIENKEYMGFGNLCTYKVKE

SEQ ID NO: 176536 - protein, 18 aa, Glycine max
  Coding DNA Sequence Number=SeqID_84851
TVEAGGYAGKGYSRHVQR

SEQ ID NO: 176537 - protein, 351 aa, Glycine max
  Coding DNA Sequence Number=SeqID_84852
  Gene Ontology: Mol. function=serine-type peptidase activity; Cellular component=extracellular region; Biological process=proteolysis
  Homolog annotation: Hit_ID=Q8S3I7; Match level="QueryCoverage=100%, HitCoverage=63%, E-value=1e-104, Identity=57%"; Hit description=D1 protease-like protein
  Pfam annotation: Domain name=PDZ; Domain location=1-80; Score=29.7; E_ value=1e-05; Accession=PF00595.15; Description=PDZ domain (Also known as DHR or GLGF)
  Pfam annotation: Domain name=Peptidase_S41; Domain location=115-331; Score=142.7; E_value=1e-39; Accession=PF03572.9; Description =Peptidase family S41B
  Pfam module annotation: Pfam domain module=PDZ::Peptidase_S41; Domain location=1-80::115-331
MARYDMTGVGINLKEVPDENGDLRLEVLGIILDGPAHSAGVRQGDEILAVNNMEVKGKSAFEVSSLLQGPNGTSVTIQVKHGNCGPVESIEVQRQLVARTPVFYRLEQLDNGVTSVGYIRLKEFNALARKDLVIAMKRLQDMGASYFILDLRDNLGGLVQAGIEIAKLFLNEGDTVTKGGHPYLLNEIGRKARIPNHSTLDDPFTDSPQPPQALSLKGFIASNSQPFLGRMVEVDSCLHVDVIYTVGRDPQLQKAIVTDTSPLIQAPIVVASALHDNCRAVLVGKRTYGKGLIQSVFELDDGSGVVITVGKYVTPNHKDINGNGIEPDFQKLPAWDDISRHLKKCSMSQQG

SEQ ID NO: 176538 - protein, 209 aa, Glycine max
  Coding DNA Sequence Number=SeqID_84853
  Gene Ontology: Mol. function=serine-type peptidase activity; Biological process=proteolysis
  Homolog annotation: Hit_ID=A7QQK1; Match level="QueryCoverage=62%, HitCoverage=32%, E-value=2e-30, Identity=50%"; Hit description =Chromosome undetermined scaffold_143, whole genome shotgun sequence
  Subcellular localization annotation: CTP_CleavageSite=48; ConfidenceScore=5.36e-01
MSGYVCLKLSPPPTCLSKHPRLPIPLVRNTLLGAALSFGLVFSFPSVSASQICRDVEPIQETLQTAPEVVTNEGLVEEAWQIVNDTFLDTGRHRWSQDTWQLKREAILSNSIQTRSKAHHIIKRMLSSLADPYTRFLSPDEVIFHVSFLLCLLITSISVGKSHISASIPVVQLICLLVISSLCVSPSPVLASRHLWKGSKLRIEPNSIL

SEQ ID NO: 176539 - protein, 87 aa, Glycine max
  Coding DNA Sequence Number=SeqID_84854
MATYPDAFPEDSTSEVIDRRPDLEMPKGTQQKSLDLIGNKAIGGQQVGVSSLGTYGNKSYHRFWCFIPAMTVQSLGVLVVRGDGLSL

SEQ ID NO: 176540 - protein, 43 aa, Glycine max
  Coding DNA Sequence Number=SeqID_84855
MTEKGFKYTLSIMSFESQWLSFTTANWHCCGSALIISLKPQSQ

SEQ ID NO: 176541 - protein, 202 aa, Glycine max
  Coding DNA Sequence Number=SeqID_84856
MGPTRLQPERKSVSRFRSEVAKGRGYCFGEEVADEVERFEAGEGGEARRNVAGEVEVLERGGMGPTRLFWERSRTTRLRHTAATTAERVELMRLVVRLRVVRETMRQRMAGKGPEREAEGRLTAVMVAVRGSQVTPRHRHGLAAEESQEERAFSGSESYRLASKRKRLSWVRERESAGEERESRGTAKQTRKSCQRSERYFG

SEQ ID NO: 176542 - protein, 764 aa, Glycine max
  Coding DNA Sequence Number=SeqID_84857
  Gene Ontology: Mol. function=nucleic acid binding
  Homolog annotation: Hit_ID=Q2HTD6; Match level="QueryCoverage=18%, HitCoverage=30%, E-value=6e-40, Identity=52%"; Hit description=RNA -binding region RNP-1 (RNA recognition motif); Calcium-binding EF- hand
  Pfam annotation: Domain name=RRM_1; Domain location=665-719; Score =10.8; E_value=0.015; Accession=PF00076.13; Description=RNA recognition motif. (a.k.a. RRM, RB
  Subcellular localization annotation: CTP_CleavageSite=23; ConfidenceScore=5.40e-01
MATPPRSPPNSDNPPEVTSKRTRQSTKLRYLTTRSLYHPRPIVNVNPTTSRGSGPHKDKFLSYLGVVRKFDIPEGDDAKKKVMSIVATRWRQFKSSLTSKFVYADNEGQQKSDPIVKYGVHPATWAEFAKSRQTPSWQEKRKQRQHEAELTENPSLTEDPPSPISRQLKWKMARTKCFGQMTFAAAQQISEKIDSLEEQATQGSFVPHGRDDILNTAIGRAEHPGRVRVAGAGVTISQYFGKSSRASSTSPPSITQQQLANIIGGLKDEIQKEVEEEHKLQQEAWRRALEEQHKPSLDLMKQELMGAVKVELSHIASHQSAPIEPPEGSCIAPEPKEVPQESSDVGDNLMGLYVVDEDQNTLLVALGKVYPSTCTIHTVPYADEVTRVSIISVYLADAKVLLPTSEPPPKSVGNVERGTISGVDDPLGELVKNLFVVYQKLIELAWEEAKFGIPNSKNGFFMTHADVTEIIVGDKCLNISILQLWIAMQKIATTVEGKADRAAPRWTEVGSHVQPGAYECGYYVMHWMWCIVSGGLKNEWTRWFCDRTPLDKDTITTLRKKWATYFLQKQWKTHLFCFVKSVYDLQGRLMCYKQDWIGGLTAGFREHEYEDSAAKVAGKDQLAEAEKSDIATEFGDDEQKLCFIDEDEKEKHDELVALPPYGSEVFIGGLPRDVWEDDLRELCEPMGDILLVRLVKDRDTGEHKRLFRRYITGNLRLFIGNVPKSWTQHDFRNVDEGVGPGVETIELIKACPKSSDDQDCHDTT

SEQ ID NO: 176543 - protein, 80 aa, Glycine max
  Coding DNA Sequence Number=SeqID_84858
MSALLVARSTWTTGLSAPGGLVDKDHRREALRVRFTANGEADASEGGGGEEGGGGGGGEEGEGGGGEAGGNAMILFDKLC

SEQ ID NO: 176544 - protein, 78 aa, Glycine max
  Coding DNA Sequence Number=SeqID_84859
KDALPPQDERTPSPPPQRDDSALMTEVLSELRGLHTYVGERFDSLDNRFELNCHHQKGGDCRSKDFEIVKAKTLPLMF

SEQ ID NO: 176545 - protein, 193 aa, Glycine max
  Coding DNA Sequence Number=SeqID_84860
  Homolog annotation: Hit_ID=A7PC97; Match level="QueryCoverage=63%, HitCoverage=66%, E-value=4e-21, Identity=44%"; Hit description =Chromosome chr2 scaffold_11, whole genome shotgun sequence
MSTYQEYEPECRTGKRLVSRIKWGLVKTLNFPSLKSTEFPPIYQNTKLAKALNHINGFFLNFRWGVNFPRNFGSKMLSLTMNKIGLERVGERKENNNKKKKRKDGSEIDLQLLKGMCFWMGKDLEIMEKENREMKRLLDEMKLGRNNRLEESKGGGRKLSESNGEVQRWRSYKSERQEEEKKVQQPNKVFCIH

SEQ ID NO: 176546 - protein, 173 aa, Glycine max
  Coding DNA Sequence Number=SeqID_84861
MSRSRASSSRWTSVNEELGQLLANVPELTIEEHEEWRELANMMQNVAAPPEAFFQTFHATDQDVLDGVWHLVDKDGNYHNVVYNKDLDQPVIVAGWTALRDFYQLTGDHLVSLHHYVVCPDHSQDDTLYIIKCQDVPSSMYYFFKDKGWTHLHLENVAECWLVFNHWRKTLKI

SEQ ID NO: 176547 - protein, 299 aa, Glycine max
  Coding DNA Sequence Number=SeqID_84862
MADLAGGSAHAMIPLSAEEYNACLDRLKALIANLAAAQLHSIVTLDFIVSKLDLILLKQHISIPSSSSINNHHAEKEVPSDTMEELVSVGSLELSSEVPPLPITHGAAQARCFALTTNTTATTTATRSPTTTSSSTAVPLTATASTTTTVGAVCTLWRVMFGRQGLGRANHYSYLSLPLVAFSSDHATTVSLQFGEFPSWLAPIGAAVRAVGVSMSHNQAKKRHRDRIDALWRRTLSASSGVSMADLAGGSAHATIPLSAEEYNANSKDAGISVFASKFIPETSDELLASGVEDVGVIL

SEQ ID NO: 176548 - protein, 145 aa, Glycine max
  Coding DNA Sequence Number=SeqID_84863
MSLATFFGKLQEHEMELMRLHQHEENDKKKKGIALKALSSIHEESDKEDLNEQNNLEEDDDFSLFKKGEDSSLVPKSYECDQLGHLRVDRPICKRRMEKPDKKTFKDKKGKKVHITWVDNDMDSSSDLENEIVNLGLMAKDYESE

SEQ ID NO: 176549 - protein, 447 aa, Glycine max
  Coding DNA Sequence Number=SeqID_84864
  Gene Ontology: Mol. function=nucleic acid binding; Cellular component= intracellular; Biological process=regulation of transcription
  Homolog annotation: Hit_ID=A5AFC2; Match level="QueryCoverage=88%, HitCoverage=97%, E-value=1e-140, Identity=66%"; Hit description =Putative uncharacterized protein
  Pfam annotation: Domain name=RS4NT; Domain location=103-140; Score =13.1; E_value=0.044; Accession=PF08071.3; Description=RS4NT (NUC023) domain
  Pfam annotation: Domain name=zf-C2H2; Domain location=118-140; Score =21.6; E_value=0.0029; Accession=PF00096.17; Description=Zinc finger, C2H2 type
  Pfam annotation: Domain name=zf-C2H2; Domain location=145-166; Score =17.5; E_value=0.052; Accession=PF00096.17; Description=Zinc finger, C2H2 type
  Pfam annotation: Domain name=zf-C2H2; Domain location=42-64; Score =22.6; E_value=0.0015; Accession=PF00096.17; Description=Zinc finger, C2H2 type
  Pfam module annotation: Pfam domain module=RS4NT::zf-C2H2::zf -C2H2::zf-C2H2; Domain location=103-140::118-140::145-166::42-64
MDEGEIMTNIAFPQNLTASAASNPEAQVIALSPKTLMATNRFLCETCGKGFQRDQNLQLHRRGHNLPWKLKQRTGKEARKRVYVCPEKSCVHHDPSRALGDLTGIKKHFCRKHGEKKWKCEKCSKRYAVQSDWKAHSKTCGTREYKCDCGTIFSRRDSFITHRAFCDALAEETARVNAASDINTSLGGNIGYNIMGTSLGPNMATHFPSIFKPISSTDETSNQTSRGLPLWMGQTSSQAQETMVNTNFREIHQLGSATSSSGTMYGGNSILQYSNLPPSNNYQLSWVFGTKISNSSNNQELTTNTTTTTSLPIGNSSVPSLYCSQHQPQQTCSSANMSATALLQKAAQIGATSSDPSWLGSLGLKCGNSQGQDGNNNKYSDMYGSSLVLTTLGSEADNSACELSQMHPHKRRHVLNEESGGGQTRDFLGVGVQNHLPHFINQGVDLI

SEQ ID NO: 176550 - protein, 339 aa, Glycine max
  Coding DNA Sequence Number=SeqID_84865
MGARMGTEGSNAKAGVNPSGEEDGVDVLPTVGLYVQQDHSTHLVALGKIYEEGSTIHSVAYADDMALDTFIAWPTQLVKLVSHEIMSNDVEADDPLRGLIISLCDIYDKPIELLFDGTKFGILDVDASVFLTYFDINEIISGLDKWSSSLGHGFVYRFLEPKSIHNAKNRHGECQRYIETWVKESQRGVYLGAYLNHSAINTLKTTLHGHSGQVAPKWIEVKIHVQTRGYECGYYVMHWMWNIVSGELKTDWTMDQCFMSDQPAHFAGQYEPEDIDSADDSPIDINTNENEAMSNFTKCVIIGKRGLHMLLNTGNPYSGLFVENYEALTSYCPSLTATL

SEQ ID NO: 176551 - protein, 95 aa, Glycine max
  Coding DNA Sequence Number=SeqID_84866
MSFAKRNLGWEILLFLFCQHFSKLILFRIKLRLLFFATQENWLISIHSYVINGNEKQDLEIWANGSLTTKEALYEPSWYLIYLYAQSAIIISLRD

SEQ ID NO: 176552 - protein, 224 aa, Glycine max
  Coding DNA Sequence Number=SeqID_84867
PIPLKIIEATRSNTRSMCSTDVCDIVIVGSGPVGIIITHARGVIPYRRGASHGGGSASFGIDAPTRKKRKKKGWQKRIDQSGEVELGCTGLSYLGMGGRSEVEVRKHAPCLGHGSEVFPQNLPWILVGVQHESPSWGAQLGRNGLMVWVSMEGNINLLLSKPGESSVPVSPLELAIKFINVLEMNVILVRSNPFSKAKREESEVESPLVVDWLQYNAYLRPSAK

SEQ ID NO: 176553 - protein, 32 aa, Glycine max
  Coding DNA Sequence Number=SeqID_84868
MSEEVDMNEENEDETGVNEEHVDCSDAFNTSE

SEQ ID NO: 176554 - protein, 121 aa, Glycine max
  Coding DNA Sequence Number=SeqID_84869
MHFSDYLASVVQIYVVLGQCAPDYMDWFYMISYPFIRSTQPEDPPKHPLVMQDETYVELDMPEYPVVAAAMEEAPVHVPSDVEQPRHAVEACQTIVERLEWLLNLRIVTKGTETYMSCKTI

SEQ ID NO: 176555 - protein, 208 aa, Glycine max
  Coding DNA Sequence Number=SeqID_84870
MEEKYWAPTIFYLLPSLLCSSVAATTTVAPIAVASIAATTTAIVVSGFLSFLRYLWGQREAAVVAEDALNVDDATKEVFQHPEEVGVDAQGFPGRSRDTSVLTVYVDHVAIIVWNEEERPELKLSSHGRKVQKFRRSVAKIEGLVAATGLSPLIALGEVTITLDDVASLLHLPIIGTFHSFDTLHVDKAVLMLVELLEVSGDEARAEI

SEQ ID NO: 176556 - protein, 153 aa, Glycine max
  Coding DNA Sequence Number=SeqID_84871
  Homolog annotation: Hit_ID=Q2HV28; Match level="QueryCoverage=49%, HitCoverage=43%, E-value=8e-26, Identity=78%"; Hit description=C2
MGNTFLNLQPIVSVARLRDILRVSSIETTLRKVIPDGENYLVRERNTNCVNGEVVQNVWLRLRGVKYGELELTIKFQADGREVYLGLIYLCFLGSRMLGSTAFPCLTSGSSWLRTEDCLVIAYIIPDLLKGTYLGKILPKRIQMSLRINWRHH

SEQ ID NO: 176557 - protein, 104 aa, Glycine max
  Coding DNA Sequence Number=SeqID_84872
MVALIVGNEEAEREVAVVMERGDDGVDCSLDFFRGTCGRGGGGGRGRREVAVEPVAEAVVVEEGGGSGDGERGGDGVDFWFGEEGGGGGDGGRGDDGVDCSLDF

SEQ ID NO: 176558 - protein, 152 aa, Glycine max
  Coding DNA Sequence Number=SeqID_84873
MGLEFGNSKSEDEAMERVLDGEDRRNNEVKKEQSKDNDDGNMAPKRREKPQVESRNKGKDGANLMDPQIEKWGDNIRPILEPRDKGENESKQWWEKERDTRWKSLNNISLWHGSRRCNYEYTITIGKIGEGARVPQLGLKAIRVMGKQEGSN

SEQ ID NO: 176559 - protein, 44 aa, Glycine max
  Coding DNA Sequence Number=SeqID_84874
MVQRAPPQERVEDGVVGEDGGGEAKALGEVGNSEDRFFVKHNRG

SEQ ID NO: 176560 - protein, 90 aa, Glycine max
  Coding DNA Sequence Number=SeqID_84875
MQQRTNKPSQNQMKLKSFRQRGRELKDSYLHRGKKGRRQQCEEEGRRQQRGGRQRQRETRGVNKKGLFFPMCQTRLQERRETWQMREMTL

SEQ ID NO: 176561 - protein, 226 aa, Glycine max
  Coding DNA Sequence Number=SeqID_84876
  Homolog annotation: Hit_ID=A2Q6B4; Match level="QueryCoverage=64%, HitCoverage=59%, E-value=2e-14, Identity=32%"; Hit description =Ribosomal protein L33; Nucleic acid-binding, OB-fold
  Pfam annotation: Domain name=DUF223; Domain location=98-194; Score= -10.7; E_value=0.03; Accession=PF02721.5; Description=Domain of unknown function DUF223
MSQIIEEMEVTCAKWPIFSLVDKFLLGFAFPPLLGLTVVLQFSFAEVDWEKLRVSDYKVMPRVADKIKLIDGSREALKLSVRITDLWFIGIPGKTEQVEMVVVDSDGDEIHVVCKQDQLKSRKADLKENFTYVMHNFKVIKNDGKFKVCDHEYKLCFTGVTVVRQCDMEQLPFRKFRFVSFSSVIAGDFKIGLLVDVIGMVDEVVFRYVSSKNTRVVLNLKDLSGQ

SEQ ID NO: 176562 - protein, 60 aa, Glycine max
  Coding DNA Sequence Number=SeqID_84877
  Homolog annotation: Hit_ID=Q2HUC0; Match level="QueryCoverage=76%, HitCoverage=13%, E-value=1e-09, Identity=67%"; Hit description=Mak16 protein
MTKLTNAAGSTDDEEEEAIDRSRAKRKMALSSKKLEKNGLDSKSKKTRVLVEVIPIIVFN

SEQ ID NO: 176563 - protein, 144 aa, Glycine max
  Coding DNA Sequence Number=SeqID_84878
  Subcellular localization annotation: CTP_CleavageSite=41; ConfidenceScore=5.36e-01
MAESSKKRKGSSSSAAAAGHRRHRPSEAPTTPIHPSLSSPRSSTLFSSDDQRLRQGAPFEGTIVDDWKFDYSSHDAHRMVCNDQAEMTSRLLAGSLTFDNRIMHYIIVRILLPRSSNLAQASEEDLILMWAFLTGCQIGWAHLV

SEQ ID NO: 176564 - protein, 252 aa, Glycine max
  Coding DNA Sequence Number=SeqID_84879
MTVRLRDNSNCDILITVWEDYAIQLHDAIDKNLLLQEPLVVMLTLGKIKDATDKYPLSVQNIKFGSKLYVNANITKIHEFRQSQSNMVEKFLQNAQVVSIGEINNLRQDCYCLTVGTVDEIIIDAPWSYDSCPNCTTTFDPSKGGSAFRSCHTSVIDTVPRMEHNGDKGNFLLWDATCIKLFGKTAGECRDELIADGDDIKVFPTCVDEILSKTWAVRFKFRSQLRQSSVLDMSEELHHIQSLIPPWVEGNN

SEQ ID NO: 176565 - protein, 461 aa, Glycine max
  Coding DNA Sequence Number=SeqID_84880
  Gene Ontology: Mol. function=transferase activity, transferring glycosyl groups; Cellular component=integral to membrane; Biological process=metabolic process
  Homolog annotation: Hit_ID=Q53UH2; Match level="QueryCoverage=94%, HitCoverage=93%, E-value=1e-143, Identity=56%"; Hit description =Glucosyltransferase
  Pfam annotation: Domain name=UDPGT; Domain location=3-457; Score= -136.5; E_value=0.00099; Accession=PF00201.9; Description=UDP -glucoronosyl and UDP-glucosyl transferase
MESRPLHIAMYPWLAMGHQTAFLHLCNKLAIRGHKISFITPPKAQAKLEAFNLHPNSITFVTITVPHVEGLPPDAQTTADVTYPLQPQIMTAMDLTKDDIETLLSGLKPDLVFYDFTHWMPALAKSLGIKAVHYCTASSVMVGYTLPPARYHQGTNLIESDLMEPPEGYPDSSIKLHAHEARAFAAKRKDTFGSNVLFYDRQFIALNEADVLAYRTCREIEGPYLDYIEKQFNKPVLATGPVILDPPTSDLEEKFSTWLGGFEPGSVVYCCFGSECTLGPNQFQELVLGLELTGMPFLAAVKAPLGFETVESAMPEGFEERVKGRGFVYGGWVLQQLILAHPSVGCFITHCGSGSLSEALVNKCQLVLLPNVGDQILNARMMGNNLEVGVEVEKGDEDGMYTRESVCKAVSIVMDGENETSKRVRGNHARIRELLLNKDLESSYVDSFCMRLQEIVEGIDL

SEQ ID NO: 176566 - protein, 117 aa, Glycine max
  Coding DNA Sequence Number=SeqID_84881
MDAISKQFEELDVCGKVTLKSKLQKIVYHDQNSMCALPEKVKTKGAQKKQMIKQQRSMKPDSSYWDYVDALHYVQNNNSLMKCCASSSEQPKPKRNMPMLDQFHSCIHDFIENIVDV

SEQ ID NO: 176567 - protein, 178 aa, Glycine max
  Coding DNA Sequence Number=SeqID_84882
  Gene Ontology: Cellular component=nucleus; Biological process =multicellular organismal development
  Homolog annotation: Hit_ID=A7PJC7; Match level="QueryCoverage=80%, HitCoverage=47%, E-value=2e-32, Identity=47%"; Hit description =Chromosome chr12 scaffold_18, whole genome shotgun sequence
  Pfam annotation: Domain name=DUF260; Domain location=4-104; Score =121.7; E_value=2.1e-33; Accession=PF03195.5; Description=Protein of unknown function DUF260
MHPACAACKHQRKKCSENCILEPYFPSNRSREFYAVHKVFGVSNITKLVKNAKEEDRRKVVDSLIWEACCRQRDPIQGPYGEYTKVYNEYKKVLDEIKRFRSQNQLLQIPSLGFKSVQDLIACNGTKGEHKASVNNASNYLHGKKNEFQNIRPEVVIPFQQHSQPYYITVLLKGMFGG

SEQ ID NO: 176568 - protein, 216 aa, Glycine max
  Coding DNA Sequence Number=SeqID_84883
  Homolog annotation: Hit_ID=A7P5X6; Match level="QueryCoverage=41%, HitCoverage=16%, E-value=2e-11, Identity=33%"; Hit description =Chromosome chr4 scaffold_6, whole genome shotgun sequence
MDVVTTYLFDYLDIDICMKLSEGYNLSNNAYSRKEYSLWTKAIMSHVASNFNNLIAGFVVKNEELNETYKYSECMRNSYEVAQGVCPDSIYEGLDGPSDSINSYYLPHNHGVLNYDHLVLKVLEHVNECTGPLDDEDKEDQGLQMQMFHGNQEQFKTQEEKLKNTSRFKKKDEFKNQDSRIKLQESRSRFKIQDSRIKRRHNQEDQDSRLKNKEKT

SEQ ID NO: 176569 - protein, 145 aa, Glycine max
  Coding DNA Sequence Number=SeqID_84884
  Subcellular localization annotation: CTP_CleavageSite=32; ConfidenceScore=5.01e-01
MAEPSKKRKGTSSRSQRHFKAHETPIPSTIPSGSLFSSEEQRLRWSLTSPYSDLTQLPSEGVPFEGALIDDWKFDFSVHDARRLVCTNQTDMTGRLLAGSLAFESRILHYLIVRILLPRSSNLAQVSSSSSLCQKLSKVFWFSKP

SEQ ID NO: 176570 - protein, 78 aa, Glycine max
  Coding DNA Sequence Number=SeqID_84885
GYHGMDGNFEGLSYDEPEEDADAELMRRSNEAEERVILLSKKLERDSFFLDGGYDVMRTWQGLREGTFKRTWRTYDKG

SEQ ID NO: 176571 - protein, 63 aa, Glycine max
  Coding DNA Sequence Number=SeqID_84886
MKLKECLDNHVTRLVVLLLYMAKIKEPRATSRRLCSMYGSQIFVNSDIKEIVDFKDRLSTSCE

SEQ ID NO: 176572 - protein, 62 aa, Glycine max
  Coding DNA Sequence Number=SeqID_84887
MALTGKQLLFLIERAGGEGRQLENVSNYHDGYVEDPRSQGFGGSRNHADQGAVADSHESTCS

SEQ ID NO: 176573 - protein, 285 aa, Glycine max
  Coding DNA Sequence Number=SeqID_84888
  Gene Ontology: Mol. function=transcription factor activity; Cellular component=nucleus; Biological process=embryonic development ending in seed dormancy
  Homolog annotation: Hit_ID=A7PJE1; Match level="QueryCoverage=95%, HitCoverage=95%, E-value=3e-40, Identity=54%"; Hit description =Chromosome chr12 scaffold_18, whole genome shotgun sequence
  Pfam annotation: Domain name=TCP; Domain location=6-210; Score=141.4; E_value=2.5e-39; Accession=PF03634.4; Description=TCP family transcription factor
MRTGVGDIVQVEGGHIVRSTGRKDRHSKVYTSKGPRDRRVRLSAHTAIEFYDVQDRLGYDRPSKAVDWLIKKAKTSIDRLAELPPWHPPTHEEEKQNDAAGSSGIIAIAQQQQQHEQQSESCEDLGLSLHCFQDHPGLIHWQSQQTGAHQTPPSNEHQIRTLFAGSTPGGFENHYQRSVTWNNEATTTDHVNRLGFILNSQPFIGQGSTSAYAQSGGTLQSSFSFPMTSPSELHRPQPVNQPSIFDSRFVSDGLADFCIPDRIQGVEENHGVASNRPSSSPSSIH

SEQ ID NO: 176574 - protein, 190 aa, Glycine max
  Coding DNA Sequence Number=SeqID_84889
MPMIVIMTKCGSGVGDRDKGIDDNGGGSVTMVGGDDSDVVIRHGNEVGMGMGIVSPIPYPDSPTYPRTHTRYPTGLSLLSHPGTRWDGFGRIPTSTGFLIMSSGDDDKYSIVNSNGVGDDDGDNDIDENGGDGNIRDNGGDKMMVIVILVVLDLYEAANWGHSSVSTFPNLDLEDKSSFKGKDMILRYWV

SEQ ID NO: 176575 - protein, 319 aa, Glycine max
  Coding DNA Sequence Number=SeqID_84890
  Gene Ontology: Mol. function=oxidoreductase activity; Cellular component=extracellular region; Biological process=lignin catabolic process
  Homolog annotation: Hit_ID=P93366; Match level="QueryCoverage=92%, HitCoverage=52%, E-value=1e-140, Identity=80%"; Hit description =Diphenol oxidase
  Pfam annotation: Domain name=Copper-bind; Domain location=200-288; Score=-9.7; E_value=0.0095; Accession=PF00127.11; Description=Copper binding proteins, plastocyanin
  Pfam annotation: Domain name=Cu-oxidase; Domain location=151-301; Score=220.3; E_value=4.5e-63; Accession=PF00394.13; Description =Multicopper oxidase
  Pfam annotation: Domain name=Cu-oxidase_3; Domain location=25-140; Score=222.1; E_value=1.3e-63; Accession=PF07732.6; Description =Multicopper oxidase
  Pfam module annotation: Pfam domain module=Copper-bind::Cu -oxidase::Cu-oxidase_3; Domain location=200-288::151-301::25-140
MAAFGIQIMLLLAAFLLPLSVEAMVVQKNTTRLGSTKPIVTINGKFPGPTIYAREDDTVLVKVVNQVKYNVSIHWHGVRQLRTGWADGPAYITQCPILPSQAYVYNFTLTGQRGTLWWHAHILWLRATVHGALVILPKLGVPYPFPKPNMEQVIILSEWWKSDTEAVINEALKSGLAPNASDAHTINGHPGPIQGYASQGGYKLDVQPGKTYLLRIINAALNEELFFKIAGHELTVVEVDAVYTKPLKTDTIVIAPGQTTNVLLTTKHATGKYLVAASPFMDAPIAVDNKTATATLHYLGTLGSTITTLTSMPPKNATP

SEQ ID NO: 176576 - protein, 97 aa, Glycine max
  Coding DNA Sequence Number=SeqID_84891
  Gene Ontology: Mol. function=protein serine/threonine kinase activity; Biological process=protein amino acid phosphorylation
  Homolog annotation: Hit_ID=Q6UY57; Match level="QueryCoverage=48%, HitCoverage=6%, E-value=2e-14, Identity=74%"; Hit description=Lectin- like receptor kinase 1;1
SVGVARVGVPLHVVTPSVVPPHRCSSPHHDSSFSLPLAASLVATIIVGVELAPEYINGGRASKESNIYSFGVVALEIACGKRIYQDREFNVPLVNWV

SEQ ID NO: 176577 - protein, 102 aa, Glycine max
  Coding DNA Sequence Number=SeqID_84892
MEAEKLWRRLEKLSLEEMDKDGFTFDVEDDDTLTTIIVFVLCQGAIEERKEGQEARSRLERRSQVKRRGAQMRACKERRKGNVMGQLLVLMLRIWVKQTKPE

SEQ ID NO: 176578 - protein, 456 aa, Glycine max
  Coding DNA Sequence Number=SeqID_84893
MSTISDSTLGIGGSDSGGSIQQPMVEREVVLIGDSLSEERLMNFKNVGEGSFEPRAGIKSPLASMEDQSSLVTTIMCLPPWENPVTDEAVGKDDCGEVRVSSSPHGKVKGGGARKGNDGGLEETSRSWHRRGGDMPSPFPCVTGFEEDEYPIMCPAPDGTYYFYVYQCMFEVLHLTLPLNDFQCALLSFYKKMFEFDSNAFRRFKDHFFKVNVTSFISNGLPLMYEESGEPHFPFYWQSNPTKFKSFEEHLMSLEERVGLVDGDVPPPLVSVNEPSKGGGDSIEARLTHPGLLMLSRLHLVCLFLQLPRGNAVKRLEQPDYARSQRLPLFFEPLASHRTIAAIANVSNPIAPPPLSTQVVSVSLPSAPAIFAPSSVMFSPVSFVAPSLLSAGLTMIGVVTSMPHLPSVVPPLAPIVLNSEMPSSSSQNGSKHKEAMNRIASLEEEVAKWRVTARIV

SEQ ID NO: 176579 - protein, 43 aa, Glycine max
  Coding DNA Sequence Number=SeqID_84894
MVLRSWNSPLRRCSSYWLPQFPILVEQSSPQKAYLVYKKEKST

SEQ ID NO: 176580 - protein, 117 aa, Glycine max
  Coding DNA Sequence Number=SeqID_84895
MVVSPQYAGEFFLPQAFGFVKFNVQGFKGDLVHYFSLAVCLRMLDRGLGFELNVFVSYNGTVESIPAYESMATSKNLTCPGAFGNGPSMSIPYMAKGQGELMLWRLSGGTRGTSGNS

SEQ ID NO: 176581 - protein, 197 aa, Glycine max
  Coding DNA Sequence Number=SeqID_84896
  Homolog annotation: Hit_ID=Q69F85; Match level="QueryCoverage=27%, HitCoverage=2%, E-value=1e-07, Identity=49%"; Hit description=Gag -pol polyprotein
MEDYPISPESVISTPSKISMSTVDVKPLRSLPSITLIDRDLKGINPINQDDHMVVSIVIANFMVAKVLIDQESSTNILYWKIFQRFCWRKSGNKRLCEYDDPLQLGQALEEFHSKVALYPPVREPSKPHSLFGGSNNQVMSIVEEFLIRTLTVYETTMGNPNDTFNVDPRDDTIDKGLKPIEEFVKLQLGPKPEQYI

SEQ ID NO: 176582 - protein, 128 aa, Glycine max
  Coding DNA Sequence Number=SeqID_84897
MKTGRERGSKAREAGQNWKVQYSCMWMWEWWWSKRGDEEEEDARRKKKGLVEIKGGGGSGEPIEERGGGGERGGEDSVDGVVEGRGGEEANDGGEEGGRGGGGGGGDVANDATLSSPGQPSTLVSTGP

SEQ ID NO: 176583 - protein, 63 aa, Glycine max
  Coding DNA Sequence Number=SeqID_84898
MWRSFPFFIPMTRCIINCGRLRGGGHNPLFEDLPSESGSGAATVRYGLISNDTHETRCKCKAV

SEQ ID NO: 176584 - protein, 150 aa, Glycine max
  Coding DNA Sequence Number=SeqID_84899
MTSEAARQIINRTDSLEEESAQGSFVAHRRQDVLTTAIRRPEHPGCQVLRRGAFLLRIQDKGHTSKLKLECEIFNLLCELFVRERLQPSTASPSPTPPAHEDNEEEAIVGRDCRSKDLRRRRGMRKNVLWTIATSSLGRFWRASGLSGAT

SEQ ID NO: 176585 - protein, 163 aa, Glycine max
  Coding DNA Sequence Number=SeqID_84900
MMNSEEHTSTYTFLSKTTQDFPTCEQSNKERELHIRDPIIAHTKGRQNGSIKLSQPKRIKSSLELSMSQLPAKKKEHANNVKNMVTIEEVASQKYLMKKLIKLVELKVRDFTCFEPLKLLAPFDAILPRKGPITRTMSMRLQEDWARVAEEGPRVLMNLRVDF

SEQ ID NO: 176586 - protein, 898 aa, Glycine max
  Coding DNA Sequence Number=SeqID_84901
  Gene Ontology: Mol. function=kinase activity; Cellular component =intracellular; Biological process=DNA mediated transformation
  Homolog annotation: Hit_ID=A7PJE3; Match level="QueryCoverage=53%, HitCoverage=74%, E-value=1e-128, Identity=55%"; Hit description =Chromosome chr12 scaffold_18, whole genome shotgun sequence
  Pfam annotation: Domain name=Bromodomain; Domain location=531-620; Score=116.6; E_value=7.4e-32; Accession=PF00439.16; Description =Bromodomain
MASEPMVGGDDEAREKQRFGERKVYTRRKVKKDPNAVASTTENNGTATSTVTNDNSVSNSTVQKSNTGEAAEAKSKGDNVSTQALAQPVVLPEDGNLAQPQVVSGLEDGNLGQPQLEDQNMVQTEVGSGLEDGNKAQPRGEDQNMAQTQEGSRLENENRAQPQGEDQNLAQTQVNSRLEDGDTAQLQLEDQNMVQSQSEDQNMVQPQSEDQNMVHPQSEDQNMAQPQSEDQNTAQPRLGDQNTAQLQGNSKLEDENMAQPQVSSRSEDANTAQPQVSSKLGGRKSPQPEVNSRLEDGNLPRPRVNSSLDGNTVQPLVVLVSDDSCSRQPDEPSNLNVQLQDDGPSSPIHQQEAVPSSRDLTLGNGVVEPQWRDRIKINLASKSKQQMRELRWKLERELGIVRCLVNRIEVKQRPVGGYGNSNVLIDSGINNVGGAKRAHSEVASAGVPREPASTRPLHQLSLSMLENSQGICETVEKEKRTPKANQFYRNSEFLLAKDKFPPAESNKKSKLNWKKQGGGEMGHGFGMGSKFFKSCSSLLEKLMKHKHGWVFNAPVDVEALGLHDYFTIITHPMDLGTVKSRLNKNWYKSPKEFAEDVRLTFRNAMTYNPPGQDVHIMAEQLSKIFEDRWAIIESDYNREMRYGFDYGAVAPALSPLSRRVSAFTPPPLDMRRILNRSESMTQTPRLMSITPSSRTPAPKKPKAKDPHKRDMTFEEKQKLSTNLQSLPSEKLDAIVQIIKKRNSALNQHDDEIEVDIDSVDAETLWELDRFVTNYKKSLSKNKRKAELAQARAEALQQNAIQKSQAPAMAEIPKETLTGELLRIRMKGIFPNPCLRKGEIKQIMGVGQAVQAAPAVILDLLQVILIVTVPQHLDLRQGRKGPECAPSALLPFHSEEECL

SEQ ID NO: 176587 - protein, 193 aa, Glycine max
  Coding DNA Sequence Number=SeqID_84902
  Homolog annotation: Hit_ID=Q2AA10; Match level="QueryCoverage=52%, HitCoverage=26%, E-value=1e-13, Identity=43%"; Hit description =Putative uncharacterized protein
MAQPPSRERTLREMATPDFTYESLCIQYPDKVSVMPLSIFNSLSLGPLQSTDVVIHLADRSVAYPAGFIEDVLVRVARTKIDVYASTLSIEFGDIVVHFNILDAMKHPSEDHSIFRAEIIDQIVDDYMFDFDSVLHGRKHPFLSDLHTCHSLCIESESEFEFDPVFDFYAENESEFESGSDFLGVVPLDVDFL

SEQ ID NO: 176588 - protein, 163 aa, Glycine max
  Coding DNA Sequence Number=SeqID_84903
MPRKIKVLIDAILPRKGPITRTMSKRLQEDWARAAEEGPRVLMNLRISELLLSTKFRALLSLSLHSSPSSSKLLSMASYGEAKESIDEEDPRPTSSNGACITYSGVVAASKFCKNFLIHSALHLLQVALISKSMGIKSPTVDLLCIQESRAAIIQFKRTMNAQ

SEQ ID NO: 176589 - protein, 32 aa, Glycine max
  Coding DNA Sequence Number=SeqID_84904
  Homolog annotation: Hit_ID=A5BAT3; Match level="QueryCoverage=100%, HitCoverage=8%, E-value=9e-09, Identity=87%"; Hit description =Putative uncharacterized protein
MENGQAPGLFAKFLHEHGIVAQYTMPGSPDQN

SEQ ID NO: 176590 - protein, 555 aa, Glycine max
  Coding DNA Sequence Number=SeqID_84905
  Gene Ontology: Mol. function=endonuclease activity; Cellular component=cytoplasm; Biological process=sperm axoneme assembly
  Homolog annotation: Hit_ID=Q4YV31; Match level="QueryCoverage=79%, HitCoverage=24%, E-value=8e-17, Identity=23%"; Hit description=MAEBL, putative
MASEQMHRRGNSNRVIEREVHVETHRKESIADPLLIRGGSGNIVKDKEVEERRRGRESGGGVQHVRKFETKGEEKKRLGEEAELEGITRVVVERECNKEEKQRSMPRGNVEAQKARSMERTREEAKGREQTETKGQIMKGGGEEQGRRREENKQSNLEEISKYSEAQQKTMKAIEGAKERYERAQQEASEASKERNGQANEGAEEGRRESGGDVHGVAKFETKGEEKKDSVGKAELEGRTRVVVRRDWNKEEKQRCKPRWEVEVEKARPMEKTEEEARTEQAGTKGQIKKMTGSVWLQDLEKGISPDTSFLVRAFNFLCRAEAQEKVKERNERAKKAANEVAKERNKQTTKGKDVTREKGQQGKLKTENGTQDNAANEVAKERNKQTTKGKDDTIRSVDHITTPLAGKTKVTASTTAQYVEEKSAQAKNATVGSMEKTTEDAKGREKAGTKGQIKKGCDEEQGRTREKTGEENKQSNLEEISKHKAEAQQKAMNAIEGAKERYERAKTKTTSKASKERNVKANEGAEGGRREAESGGGVHHVAKFEEKKTSVGKA

SEQ ID NO: 176591 - protein, 353 aa, Glycine max
  Coding DNA Sequence Number=SeqID_84906
  Gene Ontology: Biological process=intracellular signaling cascade
  Homolog annotation: Hit_ID=Q3LSN2; Match level="QueryCoverage=92%, HitCoverage=87%, E-value=1e-165, Identity=78%"; Hit description =Putative uncharacterized protein
  Pfam annotation: Domain name=DUF231; Domain location=197-351; Score =261.1; E_value=2.4e-75; Accession=PF03005.6; Description=Arabidopsis proteins of unknown function
MGLPLVHALFLTLFLLCLQTKAEDFGATRKLAGTCNLFSGKWVYDASNPLYDPSTCPFIDPQFNCQKHGRSDKLYQKYRWMPFSCPLPRFNGLNFLQRYSGKKIMFVGDSLSLNQFNSLACMLHAWVPKSRSTFSQRDALSKVAFEDYGLELYLYRTAYLVDLDREKVGRVLKLDSIKNGDSWMGMDVLVFNTWHWWTHTGSSQPWDYVQVNNKLFKDMNRFLAYYKGLTTWAKWVQRNVNPAKTKVFFLGISPVHYQGKDWNRPTKSCMGETQPFFGLKYPAGTPMAWRVVSKVLNKITKPVYFLDVTTLSQYRKDAHPEGYSGVMAVDCSHWCLPGLPDTWNELLSAVLSG

SEQ ID NO: 176592 - protein, 75 aa, Glycine max
  Coding DNA Sequence Number=SeqID_84907
MASCASYFVGLTGIQSVVNDSAKQKHIDIVKAIRRGASLGCFTGTWGFVGTKSLVKSATIDGGSEDGLKEKARLN

SEQ ID NO: 176593 - protein, 106 aa, Glycine max
  Coding DNA Sequence Number=SeqID_84908
MRSFSKLIYERIQEEFEARLSQARSDVASSVGESQLTPLDPTEEQRLRSRNWVAAAGPKHKGRLYGTGDLAHTYKCINDSFMQHTQGSSSRIEDVAEINRLREELR

SEQ ID NO: 176594 - protein, 78 aa, Glycine max
  Coding DNA Sequence Number=SeqID_84909
MGGLLIELPSGNSKGYIYLGCYTENKIGHISCGSVQVEGTSTWLFKENKGGYIPCGSLACKGFYKVERNLQNRWLLVD

SEQ ID NO: 176595 - protein, 120 aa, Glycine max
  Coding DNA Sequence Number=SeqID_84910
  Gene Ontology: Cellular component=endoplasmic reticulum
  Homolog annotation: Hit_ID=A7NV05; Match level="QueryCoverage=43%, HitCoverage=13%, E-value=2e-14, Identity=75%"; Hit description =Chromosome chr18 scaffold_1, whole genome shotgun sequence
MLLYLHTVTETKLVIDTSRAKTMCINFDVRFNALLCSILNLDAMDMNEEQHLDVAWGLDVGMGRCRTNHDEDQANLCLMTKSYEYNEEKSVRKKWYIDSGCSKHMTGDVSKFTTISPKKN

SEQ ID NO: 176596 - protein, 174 aa, Glycine max
  Coding DNA Sequence Number=SeqID_84911
MFDQQEAVSPAKPPESPDEEVEDPLYLMTLTIPQLFLKPLQVMWDATIFGVFNQNFPLYIKHEDLSEIAHGDQCLSISVIQLWILGHWQMVVILPKENLVVWFCSLHNRPDNYLKGIINSALKGLDDTPQPKSKAVVRWIVVKYFNEVRPLEAERFKALCIQWAQYYLKVRNQT

SEQ ID NO: 176597 - protein, 318 aa, Glycine max
  Coding DNA Sequence Number=SeqID_84912
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=Q9ZT82; Match level="QueryCoverage=89%, HitCoverage=16%, E-value=1e-146, Identity=89%"; Hit description =Putative glucan synthase component
  Pfam annotation: Domain name=Glucan_synthase; Domain location=1-318; Score=-74.0; E_value=0.00045; Accession=PF02364.6; Description=1,3 -beta-glucan synthase component
MRPFGLLMLMRKPLEGMRRSITLFLLSMTNSCRRSVEIYRVKLPGPLKLGEGKPENQNHAIIFTRGDAVQTIDMNQDNYFEEALKMRNLLEEYRSYYGIRKPTILGVREHIFTGSVSSLAWFMSAQETSFVTLGQRVLANPLKVRMHYGHPDVFDRFWFLTRGGISKASRVINISEDIFAGFNCTLRGGNVTHHEYIQVGKGRDVGLNQVSMFEAKVASGNGEQVLSRDVYRLGHRLDFFRMLSFFYTTVGFFFNTMVVVLTVYAFLWGRLYLALSGVEKSMESNSNDNKALGTILNQQFIIQLGLFTALSNDCREFP

SEQ ID NO: 176598 - protein, 379 aa, Glycine max
  Coding DNA Sequence Number=SeqID_84913
  Gene Ontology: Mol. function=magnesium ion binding; Cellular component=membrane; Biological process=metabolic process
  Homolog annotation: Hit_ID=Q1XBU4; Match level="QueryCoverage=39%, HitCoverage=29%, E-value=5e-25, Identity=35%"; Hit description =Monoterpene synthase 2
  Pfam annotation: Domain name=Terpene_synth_C; Domain location=251 -373; Score=-39.3; E_value=0.0024; Accession=PF03936.7; Description =Terpene synthase family, metal binding domain
SIRVSSSSATNKNKLEAHLWPHGMDGDSGLEGVESRGAGEMVGGGRGPSGPRARETALINDNGYKACTSQQISGLSPEMKQLSRNGAGSPRIRFARDSNSYKYSLTEAHCKQTEFQGHGERQTRKSIEHCGASTGTMIRRCEDFDVKVEGLATDEAKMGRGEFHNGIFKMIHLGLGASGFSHCSMKAPMLSLGIRGLRQPSKSFINVNQHSNLVIERMVHALELPAHWKVPWFEVKWHVKQYKKEKHMDPNLLELAKLNFNLIHAKLQMEVKELSRSFLCAAGVAFEPKYKSERKWLTKVITFVPVIDDVYDIYTSFEELKPFTMAFERLPVKPEEGEDGVKSSCSLCMLGPLSIKSSNLLLEILPPCISCFLFLRISS

SEQ ID NO: 176599 - protein, 356 aa, Glycine max
  Coding DNA Sequence Number=SeqID_84914
  Gene Ontology: Mol. function=protein binding; Cellular component =mitochondrion; Biological process=protein complex assembly
  Homolog annotation: Hit_ID=A7QPN5; Match level="QueryCoverage=60%, HitCoverage=87%, E-value=1e-93, Identity=76%"; Hit description =Chromosome chr10 scaffold_138, whole genome shotgun sequence
  Pfam annotation: Domain name=ATP11; Domain location=106-352; Score =292.0; E_value=1.2e-84; Accession=PF06644.2; Description=ATP11 protein
MPAAEAVELRAIGRRRIEVDPVAVDEFNGSQWCDVKVRCCSWSASVVLGEVRCGGHGGLGERHCLGEKGYFRKYGMPQTKIGSRHSSTPQVPFFSSFSNSAMQRVSPTSTIWRTIVSKARKNVFFINDPFAARSFSAVPVVAAAKKLHQPEIPSDFQKWGSVGFCRTSKFASGFNPLQPKPLDSIVDVHRLKDRYPEDIASVWDDYHIGRGHIGATMKAKLYHLLEHRASECRYFVIPLWRGSGYTTMFVQVQTPHMIFTGLEDYKARGTQAAPYFTLTFYTEFAESKDLVLIRGDVVFTSKLTDPEAKWLLETAQSFYLNDARYKLVERFNRQTHDFEFKDVLQNEVANEGKEEE

SEQ ID NO: 176600 - protein, 277 aa, Glycine max
  Coding DNA Sequence Number=SeqID_84915
  Homolog annotation: Hit_ID=A7PJ55; Match level="QueryCoverage=89%, HitCoverage=53%, E-value=1e-73, Identity=53%"; Hit description =Chromosome chr12 scaffold_18, whole genome shotgun sequence
  Pfam annotation: Domain name=UPF0089; Domain location=12-250; Score= -107.7; E_value=0.012; Accession=PF03007.7; Description =Uncharacterised protein family (UPF0089)
MDQFYDEVQEPVSPHGHYFNSSVICSYVFGFLEMAVPIDDSQTIPLLEDVFLPINPRFSSIMVRDQAGKMRWKRVQVNPEEHVKVPRFPECNSAELYEQYFDDYVTRILNERTPQNKPLWEIHLIKYPTSSAAGTIIFKFHHSLGDGYSLMGALLSCLQRTDDPSLPLTFPSNSQHAKKNMFKLHSVISSLFSSMLDFGSSIIKTRMIEDDKTPIRSGYEGTKPKYFTLSNISLSLDHIKAIKSNLGVICLDGKETVRVSSLKKFLKTLVRDALRSI

SEQ ID NO: 176601 - protein, 103 aa, Glycine max
  Coding DNA Sequence Number=SeqID_84916
MQKDEANEIKFKGLEDYELRRCPTYCWYKEGSLFEDDDAFDPHLERIKNEAGGDESGEEDFDFVVDKDDEGSPTNDSGVDDFDDSDSGDEKEASDFCLPLLSL

SEQ ID NO: 176602 - protein, 90 aa, Glycine max
  Coding DNA Sequence Number=SeqID_84917
MAARKLFLKFECELQDTLKVELGSDNPFGLEGQHCIAPLILGSCYVHPALLLGHPANSEVAKLPFSNYSSGNFPEKLFPELFRKNLLPEE

SEQ ID NO: 176603 - protein, 217 aa, Glycine max
  Coding DNA Sequence Number=SeqID_84918
  Subcellular localization annotation: CTP_CleavageSite=29; ConfidenceScore=5.03e-01
MPKHSLPPQATVSPAAASFAWTPLSFEMRAGGAEKNGERGLTARLPEDPLWVLPELPEEHFPETFRKKCSFGRNQTFSGRTLLPETFRKKVSSGNIMARTRGLGRAIGRVVGRDRPADEDAADVPERRRPTASARRLRVHQMTAEGRDMAEDVADMTDDVPEQPTEAPEMRVDAQGADSGEGSDGDDAAEGFPGGPRDPSVLTSFAEHVAHAVWSGQ

SEQ ID NO: 176604 - protein, 61 aa, Glycine max
  Coding DNA Sequence Number=SeqID_84919
MKVDQENCIKPKLFHGNLTSTKPWNGGREEAERPRGATAAAAHDAMEEEAQFTVNEREKEP

SEQ ID NO: 176605 - protein, 234 aa, Glycine max
  Coding DNA Sequence Number=SeqID_84920
  Gene Ontology: Mol. function=protein binding; Biological process =regulation of transcription
  Homolog annotation: Hit_ID=A7Q7B7; Match level="QueryCoverage=32%, HitCoverage=22%, E-value=2e-29, Identity=80%"; Hit description =Chromosome chr18 scaffold_59, whole genome shotgun sequence
  Pfam annotation: Domain name=F-box; Domain location=35-90; Score =19.1; E_value=0.016; Accession=PF00646.24; Description=F-box domain
LSLRALSRALLLLNQLPLIAKRKRREDQPPVIQNSRWASLPLELLGDVINRLEASESTWPGRKHVVACVAMCKSWREMCKEIVSSPEFCGKITFPVSLKQDKWLPLHTLAACGEFYLLDSLLKHNVDINVLKNEDSGPLKESTSLIEHRKWDGLYCLPSEKSEIVSDEYLPTNDPKSNNNINDEAAELVKLTEQSLLLKKRTNQTKPRPIVVRLDDGDVAPISVKRPEPMDDIV

SEQ ID NO: 176606 - protein, 34 aa, Glycine max
  Coding DNA Sequence Number=SeqID_84921
GGADKDYKECLNVADLEVQLLQSKKGRPREEDLR

SEQ ID NO: 176607 - protein, 74 aa, Glycine max
  Coding DNA Sequence Number=SeqID_84922
MDVRIKWWDLILDVAGVVYQSISFNECHRPGIFSGGGRQRRRGEGRHHPLGNKPRKKELHHQELSWIRSLKRML

SEQ ID NO: 176608 - protein, 173 aa, Glycine max
  Coding DNA Sequence Number=SeqID_84923
  Homolog annotation: Hit_ID=A7P2W0; Match level="QueryCoverage=21%, HitCoverage=9%, E-value=4e-07, Identity=72%"; Hit description =Chromosome chr1 scaffold_5, whole genome shotgun sequence
MDMLAFSGCDHDCDSREEEELTRMRTVSTSISGASYYTGTFNTVNRSPDGSHSSCHIIKQLPEESRTCDGELMVEMILEENFCLMERSLLTQWQMMWNSQIIRKNGRIKFLVDILLGLKFSMSGNFVQIVENLWIIKGIDLEYVNKELGGSSTLDKDIKAQGHAFVTSREYMC

SEQ ID NO: 176609 - protein, 159 aa, Glycine max
  Coding DNA Sequence Number=SeqID_84924
  Gene Ontology: Mol. function=sequence-specific DNA binding; Cellular component=nucleus; Biological process=regulation of transcription, DNA-dependent
  Homolog annotation: Hit_ID=A7Q2Q8; Match level="QueryCoverage=73%, HitCoverage=59%, E-value=1e-26, Identity=56%"; Hit description =Chromosome chr1 scaffold_46, whole genome shotgun sequence
MGWVAMLYLAVVPALNRKHVLPSPKPNFKRENYIKEEDEIFNVDRDAVRYITYRTKDSADAAIVAGLDPTFGITVNSKTVQVLWATYPLAMWREGVGNSRNKGSMSKLVRAEVPLSKHGRGNRLASPIGNTKRSKDSSGSSVLEVSFKGREIVAYDDIL

SEQ ID NO: 176610 - protein, 121 aa, Glycine max
  Coding DNA Sequence Number=SeqID_84925
MQFASLAVESRVKERENFVEYIDPSEKIPARSKERSVQATTASKTEHNTALKDSRLQSNWRILVRHQTSQPSFDSRKAFTGSIIEHAENIKPTTRQQSSASSQDSGSQSSKPVSRFKMQRR

SEQ ID NO: 176611 - protein, 118 aa, Glycine max
  Coding DNA Sequence Number=SeqID_84926
MIYNKSNNQLGGQHKNTNERRKRKMIEEGEKKDERKKKYLCRRKLADWRCQKKKKVTLGGEGGGGEGSWAEGRRRVAGAKRERDGRRCRKGGGRSSVLGGRGEKGGLVRGRGKGKSEK

SEQ ID NO: 176612 - protein, 422 aa, Glycine max
  Coding DNA Sequence Number=SeqID_84927
  Gene Ontology: Mol. function=metal ion binding; Cellular component =cytoplasm; Biological process=protein amino acid methylation
  Homolog annotation: Hit_ID=A7PJ71; Match level="QueryCoverage=79%, HitCoverage=62%, E-value=1e-83, Identity=51%"; Hit description =Chromosome chr12 scaffold_18, whole genome shotgun sequence
MPAQKRSFPDAPNDHHRHAKYHHQEEEEEEEDNYKSDDSPPEDKSDDDLECHGAVVDDVYEKQDNFVKLKLGFSSIHKFFVAMRNNECPACRTHCASRRSLRDDPNYDALIAALYPNIEKYEIEELQFCEEDKNRNKQASIAKVAQRQSEALVKRRRDTPGSFVTRSQRNQQNVLSRRQNQVIDNQGSEDNEDENDNNEKDSSSTDERCTELRQRRRKRQTRGRPSQPSSSTASPDGGCIESDMDIRISSRPVSKPQKLTWGGGGFRSHTRHGSGNGSNSKSSRSSRMAKLVDYLRSLNENTDELDVHLILLSLDKQSTPSLQQPHLCCRPTLSVKHLCEYVAHQTPLPVEEVEILAVKGCCSTVCDKSFDETSSSDELTTLVIDPSKDELETLQGHESLAGIKSKCISKREHLILAYRRKE

SEQ ID NO: 176613 - protein, 183 aa, Glycine max
  Coding DNA Sequence Number=SeqID_84928
MANQTTIVGVVVVVMRAHIGALFLVAIFIGMQNPELARGVSKEANFSLAIPTILASLGSIPRRVVMKPARVPTAGLLAGMYKWTVCPVMAPAASTAPDLELKHAELIGGVGVAGVIVGGVGGAIVGKVLVPEGVIGKHVAGDVVDGGGAAGEELPWWDWDVYVPQGFLEGEKLVRGLKLEFVF

SEQ ID NO: 176614 - protein, 104 aa, Glycine max
  Coding DNA Sequence Number=SeqID_84929
MSKIRFRNEIESVRGRCSGGVGWMEVVTPWWQQRLILAHRVTWRFSMQSLSGSHTALNVLRVASSGGQTETSLTSSHSAPYMLQLLTHTHHHPLSARHLSSSNH

SEQ ID NO: 176615 - protein, 298 aa, Glycine max
  Coding DNA Sequence Number=SeqID_84930
  Homolog annotation: Hit_ID=A2Q4P8; Match level="QueryCoverage=17%, HitCoverage=22%, E-value=1e-10, Identity=62%"; Hit description=IMP dehydrogenase/GMP reductase, related
  Pfam annotation: Domain name=DUF1723; Domain location=1-50; Score =38.1; E_value=3.1e-08; Accession=PF08330.1; Description=Protein of unknown function (DUF1723)
TGDLGVISAFVERWHKETSSFHLPVEELAITLDDVASLLHLPIISAFHSFEPLHVDEAVIMLMELEEVSNEKARAETTQCHGAYSGSYAWGAAALVHMYDQLNDASKSTGRQLAGYITLLQCWIYKHFPNVHESMTDERYDETSQRAYRWLTMKAYMKELTASSYRTRIDALVIPDVCWMPYGDHRRVRAFDLISCFQANYMDWFFGISHPFITPTRAVDQPRHPLVPQHEAYVEPDIPEDACEAIAERLERVLNLRMVTAGTELHDIMEDCLRIARGVTSDGNDYVRAQRRRRTNHS

SEQ ID NO: 176616 - protein, 92 aa, Glycine max
  Coding DNA Sequence Number=SeqID_84931
MQVEMAIGTEEEDARGERTPTNTKKKKKRKKRKKRGAGGRRSAAKVEKGGKGGSGGGGGCETEEEEAQWETQEGETQLGAFSTTFNFFSKYA

SEQ ID NO: 176617 - protein, 191 aa, Glycine max
  Coding DNA Sequence Number=SeqID_84932
  Gene Ontology: Mol. function=RNA-directed DNA polymerase activity; Biological process=regulation of transcription, DNA-dependent
  Homolog annotation: Hit_ID=A7PYY2; Match level="QueryCoverage=97%, HitCoverage=18%, E-value=6e-19, Identity=36%"; Hit description =Chromosome chr4 scaffold_39, whole genome shotgun sequence
MDRNILDSLFLNIHFHGLDMKQESIPVALIYRMQYKVMNTCASRVLLQPQKGETTLFITDMTKANVSLKRIIKWDEVTLPEKWVMEKATPSDPRPAPIIEKIKQDNSGKVEITFNRRNSFSSRIEASRSEYESARRSFSVRTKSRSNPQHTLLWNLMMLSDNFSIDKETLRKDFYSPENEPQRRWFFQHYK

SEQ ID NO: 176618 - protein, 368 aa, Glycine max
  Coding DNA Sequence Number=SeqID_84933
MSIVPPTEAVDVQLGDRIEDMMRDLGQEGFRQAHTPLYDKLETDSKKPLYLGCTTFTRLLGFVEMRNCPTCEVSRYKVKYDECSDDPVTNNDFPTKTKEEEEEDKLKEYSNNRFCYACLPMREQTPQVGFGVDSTNSFFQFCSLDVIIKSTTLGNSPCPQGDTLQTMATKVIPGSQGLLRQNALSSAPARSAETTGMHVHETMILSKNPGPSSNNAMSRYLPCLACWVGYGPDSEKSSRVTNLVKQLELLLQWVQAMKGTHHTEEILLLDGQKKQQEGARVVNSGLHDQDLDGRTSLSMKRKPALTVVEEGKRGSNGHRVVTEHVKGKTGTTVDVVAALERCGDRVGMVVGAVSVGDGLGLSDGGSGM

SEQ ID NO: 176619 - protein, 152 aa, Glycine max
  Coding DNA Sequence Number=SeqID_84934
MHCIFKALVQLTIPSGIQALVRVEIESIEFMSAEAVAVWYGIIDSTHELNSTGNLITQTQHNATQLVTDRRTRKRSFHAMRECVRCLYLRVDWDCERGLLDAMRNGERTGLASDATRNADLGAEHDRNIDLAAADAIFWIGIVRDRRRVLRS

SEQ ID NO: 176620 - protein, 159 aa, Glycine max
  Coding DNA Sequence Number=SeqID_84935
  Gene Ontology: Mol. function=protein dimerization activity
  Homolog annotation: Hit_ID=Q7XE06; Match level="QueryCoverage=77%, HitCoverage=21%, E-value=5e-15, Identity=35%"; Hit description=HAT family dimerisation domain containing protein
MENISFSPEGIYPISSPINESPSPSPSPIDQTCSPIQVDLAPSPSPINVDHTPSPHEDEVNNVEAQGGICRLKNKIWQHFKKIKVNGLDKAECKYWMKGQTFLIPKVIQGKQELGAGTYDAERAREKLAKAIIMHEYPLSIVDHLGFRRYSTALQPVFQ

SEQ ID NO: 176621 - protein, 309 aa, Glycine max
  Coding DNA Sequence Number=SeqID_84936
  Homolog annotation: Hit_ID=A5AMM5; Match level="QueryCoverage=62%, HitCoverage=22%, E-value=9e-08, Identity=25%"; Hit description =Putative uncharacterized protein
  Subcellular localization annotation: CTP_CleavageSite=73; ConfidenceScore=5.76e-01
MAESSKKRKGSSAFASASRAHRSGATSASTTPIPPSLSSSPVFSSDEQQKRYSNLFSSRSIIDPKFIDMEFFSAETFDCIQAFQNLVPFHDLTKLPSDGVPFEVGLTGRLLAGSLAFESRILHYLIVRILLPRSSNLAQVSEEDLIIMWAFHTGRQLDWAHLVRYRMHKALRLNAPLPYPQLVTLFFHHFQIPLDSEPYVPIKRSFLIGAAVIASFGYRKELDGSWVKKGAPPADDEGNQPVEDNSSLLRKLLEKFDGLQTFVGDKFDNMELQVDMRFDAMESRITKVEEDVSFIRTCFDPPPPPPSSS

SEQ ID NO: 176622 - protein, 178 aa, Glycine max
  Coding DNA Sequence Number=SeqID_84937
MIIVLYETRRPLVFHGSNDRKGFEADNSRHSEGVDIEASCSDNVETVMKPKHCMLEKRKEYSLITLLGYSWVDDEVGSFYSRNSDKVFLKKKKPNPNPDPLGPSGKHLPRPKEEKVLAAGVSLSEAYALSEGSARDVLAQRATSLLSESFVSSRAQRAQPVKPNFTNSANLAKRPFRI

SEQ ID NO: 176623 - protein, 66 aa, Glycine max
  Coding DNA Sequence Number=SeqID_84938
  Subcellular localization annotation: CTP_CleavageSite=41; ConfidenceScore=5.00e-01
MTFQTSCPSTPPTPTKIVMTNTTSFDDGERLLKKVLPWPSMCTREGSLEYSGGKLSKEVEDASFAE

SEQ ID NO: 176624 - protein, 30 aa, Glycine max
  Coding DNA Sequence Number=SeqID_84939
MKIGKDEWDVKVRAVLERATGGVEKALLGV

SEQ ID NO: 176625 - protein, 87 aa, Glycine max
  Coding DNA Sequence Number=SeqID_84940
MGVQIAPRPTWALQKAVASGGSNLARLGELGGNHLPYFAINRGGSEEEKAEALPKRFRNVFREEFREGFDCSSTFFIRSSSFSDLQR

SEQ ID NO: 176626 - protein, 75 aa, Glycine max
  Coding DNA Sequence Number=SeqID_84941
MAREYEKPKELSNLYLYLFLFEYENFGEDGGTATRALALRAKGEEGGLFFDVSCNKIFFLYLRNNDVVRYFYKKT

SEQ ID NO: 176627 - protein, 164 aa, Glycine max
  Coding DNA Sequence Number=SeqID_84942
MRRERGEFITIELTSKLKKSTATRSLESRKLKVSHSLMVGCLGEEKENALRERCVPVSSSMRFFIVIHLFICSLEHKFKIITGSKHNNTQRGDQSGSRCFARILQPYGINIGLKEYSNPVTPKAYTPKTPSGPLPPDSGPTPKTILHADTAHELYNTHDLTLVF

SEQ ID NO: 176628 - protein, 74 aa, Glycine max
  Coding DNA Sequence Number=SeqID_84943
MVKMVSRKRKSTASRPQEPYNTTRFIFEAAWEKYSQNVHSRNILPERNVILYGTKYDEFRRELEKRCWHKSLTR

SEQ ID NO: 176629 - protein, 182 aa, Glycine max
  Coding DNA Sequence Number=SeqID_84944
MKQDLRVVGNHALHNDGGGRRVVETQWAKFQGLSPTGKSETDELSFSPAIGILHWLSLFVSSAIQTKVLPREEPSSARVKVDIVYCSGRRCSSGGSCRRKVKRFFRGFQRKKVKNILSRDAAEERCLPRIPRKNLWNLLPQATCSARGRTCGTFFRKVHVLLAEEPAEPSSAGYLSFSRKKL

SEQ ID NO: 176630 - protein, 188 aa, Glycine max
  Coding DNA Sequence Number=SeqID_84945
  Gene Ontology: Mol. function=two-component response regulator activity; Cellular component=nucleus; Biological process=two -component signal transduction system (phosphorelay)
  Homolog annotation: Hit_ID=A7P3W0; Match level="QueryCoverage=71%, HitCoverage=33%, E-value=5e-20, Identity=38%"; Hit description =Chromosome chr1 scaffold_5, whole genome shotgun sequence
MSLDDATSTVMKAIAYGACDYWIKPLHQNQFKIMWMWQHNSSNSQESDPDVCYAPPGKKSRLVWQGELHHHQFVKAVNVMQVGLDKAQPKRTLEVMNIPGLTEEHVASRLQKYRLNLKKSNKEVVQQDEMSLPNCIESRGRNYPSSYLDASIPSLFPKFSFYIPNSTGCRRWGKEAATFQQEEVAADH

SEQ ID NO: 176631 - protein, 60 aa, Glycine max
  Coding DNA Sequence Number=SeqID_84946
MGNRASNQLGPMILDFAKGAKSSMKVVKLKKSLREEKVQTQIYTGSVTPLCLRPVLKQPA

SEQ ID NO: 176632 - protein, 123 aa, Glycine max
  Coding DNA Sequence Number=SeqID_84947
MVAELGHQTVELSTLVTRAANDKSSNLKHAKVYPTEARNGILDNKIDYLENKIKMVEGELREAAAIEAALYSVVADHMALTTRLIALESKTFSCFTLAVVLLTIKDKLFQDKAIAGNTHLRWT

SEQ ID NO: 176633 - protein, 212 aa, Glycine max
  Coding DNA Sequence Number=SeqID_84948
MKKDDTCFFLQKQSPNYNEKVEVELHPLAGNQLSSGVSHDVLRFLSNSTRVLASTKGLILCKHATSHTPIELFICNPSTKTWLPIPTPQEVQNRFNVADPTMVLLESSYDGCGDDYMVFHLELEITTDWSSNYPCKILKPKEGLWKTMETSFFASGRNMKFNMPVCCNRAIHFISNCGPYLTKRSSFFNPYLCHFLQSREWHLNNAKGAKRC

SEQ ID NO: 176634 - protein, 92 aa, Glycine max
  Coding DNA Sequence Number=SeqID_84949
MGGHHQQHCQWMEAESESKEGTWGLEEKEESWEWEEREELRQIDLHGIVLQTISQTSHAVVFATLTGDLWCKGRVRQGQQGHRLGQQWFLPL

SEQ ID NO: 176635 - protein, 125 aa, Glycine max
  Coding DNA Sequence Number=SeqID_84950
MDTSEPYTGAMRGTVHEPRANLGADQKVDPWVLVPIAFRGLHVLVFRGLHALTFRGLHVLAFRGLHVLAFRGLHALTFRGLHVLTFRGPHVLASEGYTPSPSKDYTSSPSEDCKSSPLEGYTPSP

SEQ ID NO: 176636 - protein, 205 aa, Glycine max
  Coding DNA Sequence Number=SeqID_84951
  Gene Ontology: Mol. function=prephenate dehydratase activity; Cellular component=cytoplasm; Biological process=L-phenylalanine biosynthetic process
  Homolog annotation: Hit_ID=A7R059; Match level="QueryCoverage=52%, HitCoverage=26%, E-value=4e-41, Identity=72%"; Hit description =Chromosome chr10 scaffold_297, whole genome shotgun sequence
  Pfam annotation: Domain name=DUF1442; Domain location=1-140; Score= -29.6; E_value=2.6e-05; Accession=PF07279.2; Description=Protein of unknown function (DUF1442)
  Pfam annotation: Domain name=PDT; Domain location=64-179; Score=38.5; E_value=8.8e-13; Accession=PF00800.9; Description=Prephenate dehydratase
  Pfam module annotation: Pfam domain module=DUF1442::PDT; Domain location=1-140::64-179
  Subcellular localization annotation: CTP_CleavageSite=47; ConfidenceScore=5.11e-01
MAAGWNSQLVVETWSQGGRITTSVGLAVARSHTCGRHVCVVSNERVRSKYVERIGKVGVMMDIMGLPGAYTEDAALKAYPKCETVPCEDFETSFKAVESWLVDKVVLPIKSSIGGSINRNYDLLLGHKLYIVGEVQLLINHCLLGLPGVRKEDLKAVMSHPQDEDVNITHFLILARDPRIPRNDMAYKIVRDTRVVNHDDGGEQV

SEQ ID NO: 176637 - protein, 98 aa, Glycine max
  Coding DNA Sequence Number=SeqID_84952
MYQSCLNQGQASDQSNTKSRYPKPLNLMDFQGLISEIENEGVVFDTLTFESLSPMINLAYIKKNCWNPADPSITFPGAHCTRARAAAPDTPPPSHPPS

SEQ ID NO: 176638 - protein, 131 aa, Glycine max
  Coding DNA Sequence Number=SeqID_84953
MAHGRQALTFNKDYGVAPVEVRTEVRYPWRGIEMLDFEIRAHFLHHIVIQIGAIVSNDLPRESVPTNQLPLYESDHYTPRDIGVGSRFDPFGEIIYCHENEAMTVRSLGFDGPYDVYPPHGKRPRGGHVIQ

SEQ ID NO: 176639 - protein, 47 aa, Glycine max
  Coding DNA Sequence Number=SeqID_84954
MSRVYDCGDDKERGIGAAGASDGSWRRWPAVAVVEDIPFHFFNDSAI

SEQ ID NO: 176640 - protein, 105 aa, Glycine max
  Coding DNA Sequence Number=SeqID_84955
MIPDFLTVGSSSNFVWISLSENGALSAIPTEGNCAEWPKAVLSPIIIEGNSAEQPKETCVWTNEREQERPLSNAKRNRRRAHDRCMLCMFVGGALALSDVPCVGK

SEQ ID NO: 176641 - protein, 206 aa, Glycine max
  Coding DNA Sequence Number=SeqID_84956
MSSHLHIVNRKAIQLRIVEEMGVQNYKCNLKQKGRGEVKDKKVNKCSSINHCPTGTNGLRVGLGDVDKGVVVIPETKASWCDDDRKGRWWLDGTRVVEPLKDVGLNNGSILGFKKSPFSNGLGLELLLNNHEDSIGKGLVGRDHSFNVWEVATNHTSGPLVVSAQQIGPPTSNASDFNDSTFIDGETVRMFRRLNYVGQYIKGREK

SEQ ID NO: 176642 - protein, 127 aa, Glycine max
  Coding DNA Sequence Number=SeqID_84957
MEPLKDVGLNNGSILGFNKSPFSNGLGLELLLNNHEESIGKGLVGRDHSFNVWEVATNHTSAQQIGPPTSNAGDFNDSTFIDGETARMFRRLNSVGQYIKGKVKITDVAPLELVGLGSSSSMKSFVS

SEQ ID NO: 176643 - protein, 86 aa, Glycine max
  Coding DNA Sequence Number=SeqID_84958
MIEDRRKNEERAKNGEKSSRICSRKRLGSVTKAPRLGFSLGKHVFSPKTAEMHSLRVKDQFTQLPSPIYCQNGEVLATQRLLEEDF

SEQ ID NO: 176644 - protein, 151 aa, Glycine max
  Coding DNA Sequence Number=SeqID_84959
NVADLYGLHNNACFDFQNVARLYGLYNDGIEGALWLSPNRMVSTNIVPFYAVIHVSGLNVVPYWSGRWYVSCGATIAINTHRWKTNLFLKLVKVATIGNYCYVLRTSSLSGNPMIKMAVALVVVVDIVADVDTDDGQSKRLRGDDANNDDN

SEQ ID NO: 176645 - protein, 91 aa, Glycine max
  Coding DNA Sequence Number=SeqID_84960
MKERIKGFFSIESLRWNMRIPLRLKCSSWCGDSVTSNGGSWCPLVVVGGGEEGVRVWISLSELVSLSRSPLLALSAIILAQHNSLSGWNLR

SEQ ID NO: 176646 - protein, 72 aa, Glycine max
  Coding DNA Sequence Number=SeqID_84961
MTSSSVNAIVYYNGTITSTKHGSTFERGSPKIVQLDNRMSLDALKQAIVNKISLPNAIVSNTMDAYCTMMRM

SEQ ID NO: 176647 - protein, 63 aa, Glycine max
  Coding DNA Sequence Number=SeqID_84962
MFLLVWGFDGKQRQFMVATGGHGWWRRRYRVWISLSETNLLSESLLFVLSAIIRAKCNSLYAN

SEQ ID NO: 176648 - protein, 238 aa, Glycine max
  Coding DNA Sequence Number=SeqID_84963
MAAKRIGPHSDVGYQRCICAHGLSYVHCPGLSPNCSLTSSSMGFGPLLEVLLHGSISNSSSKMAWYMVRAQIRGLSFMLMTWSTFNHCGVRLSKLPGGRIRVGNFIFGCTVETIAPSSLSVFLPIKEKYDVYASTTSCLYSFAYEAKEWTGMRDLEHHEACDDDGDNHGVVLVHGVDTLEVVTCAFVVGIAIYLNLSLYLFFCPHHDSYANSLGVLQGPTVFCIVIDTMMVSTVFGRI

SEQ ID NO: 176649 - protein, 101 aa, Glycine max
  Coding DNA Sequence Number=SeqID_84964
MEIVLLKYYHIAKIVIDNFECFKMYYIPRESNNRVYLLSKLANTKKVGHLKTIIQETLQTLIIDAKEVMGTLSCHQIGARCQEFADVPHTSPDNLHSISSP

SEQ ID NO: 176650 - protein, 43 aa, Glycine max
  Coding DNA Sequence Number=SeqID_84965
MYFREENSSRGASVTLPRCFRERIREGFPSFFTVLRSFFILQR

SEQ ID NO: 176651 - protein, 48 aa, Glycine max
  Coding DNA Sequence Number=SeqID_84966
MQGSHMSNHENKRNDMFIYDAMKRCLCMLEIKCGSDLIRTDLWSKNAG

SEQ ID NO: 176652 - protein, 44 aa, Glycine max
  Coding DNA Sequence Number=SeqID_84967
MGLPGLKEHSNPMTPKAYTPKSLSRLLPPDSGPIPKIILAHRHC

SEQ ID NO: 176653 - protein, 227 aa, Glycine max
  Coding DNA Sequence Number=SeqID_84968
  Homolog annotation: Hit_ID=UPI0000503967; Match level="QueryCoverage =85%, HitCoverage=53%, E-value=6e-07, Identity=28%"; Hit description =UPI0000503967 related cluster
QFPILNPFWEPMNCVFVHASSTYEFGAMRSDCLVQFSILNLFRNPMNCIFVHASSTHEFGAMRSDCLVQFSILNLFRNPMNCIFVHASSTHEFGAMRSDCLVQFSILNLFRRPINCVFVHASSTHEFGAMRTTRSDCLVQFSILNPFSEPMNCIFVHVSSTHEFGAMRSDCLVQFSILNLFRNPMNCIFVHASSTHEFGAMRSDCLVQFSILNLFRSPMNCIFGGIL

SEQ ID NO: 176654 - protein, 44 aa, Glycine max
  Coding DNA Sequence Number=SeqID_84969
MAKWMNITDMGYVIASRNLYPNVTSYQSIVSQRLSAEGSLKQFT

SEQ ID NO: 176655 - protein, 152 aa, Glycine max
  Coding DNA Sequence Number=SeqID_84970
MAPTRHPLDPNKSNRALGFPALITGLCQSFGVPVAPSKRQVQGDAPQAADAPPPHQAGPAESFDTEQYLRHLVRQQAANHRAHVQTHDCLYQMSLSLQSQGFTSFPCPTPDQFRAEVAWPGDWPEAPDEADEAREDEEMTGLLDFLGGSGAT

SEQ ID NO: 176656 - protein, 184 aa, Glycine max
  Coding DNA Sequence Number=SeqID_84971
MASFSQIQSQLQPQMQSQGLALPPEPEVGPLGARVSTKESCVDPSGNDPETSNLDKCGLYIEENLSRLVALGRLYEGSIAVHNISLLHGQVKVGVEMIKDAEAPISVPTDEVMLDATMLGVFNQDFPLYIKHEDLSEIAHSGQCLSISVIQLWILHLTETSIRAGNSDVYGFLEPQSIQRSGQP

SEQ ID NO: 176657 - protein, 321 aa, Glycine max
  Coding DNA Sequence Number=SeqID_84972
MAELEDAAGRHHHQRPQRHFSVFEEGLLTLDDGLGDTLYGGVALLHIAHQPAGLLQFLRHGAAVVQSGPPEQVGIDLVQAGLRHRAAVGHDAPARAPFVDEHVRHHIDRCLPVIAATRLGVQIADERAGLAQRVVGAVQRPPQAGDVVLGEPVDLPAHDIQRQSAQRRVDAGRVQLQRQALRQIARGQARHIQLLHQAQRRQPFAVIRRGGEIGAQGIAQVRGRRAQIAILVERIDDEFGQQPVARPEPVVAQLQRQLFAHRHGRAGPLAEVVVFAVATGRNGIVARVFGRGGGRFQGDLRVLARWCFGFGRITDGGRGGS

SEQ ID NO: 176658 - protein, 193 aa, Glycine max
  Coding DNA Sequence Number=SeqID_84973
  Gene Ontology: Biological process=transposition, DNA-mediated
  Homolog annotation: Hit_ID=Q1J7G7; Match level="QueryCoverage=17%, HitCoverage=47%, E-value=1e-11, Identity=100%"; Hit description =Transposase
MVKVGTSYVPINVSSSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLVQHPSQSNISLSAACDTRKKASSSSLCGIFFARSGMARSLHLLGGGREDRASEEAEADGGWGRAKQAAARGAELSKQ

SEQ ID NO: 176659 - protein, 105 aa, Glycine max
  Coding DNA Sequence Number=SeqID_84974
MGEVEEVQEQMKADTEALKEQMATMIEAMMNIKEIIEGPQYHPQPHLLHSIMGKNPHAMAEMGNFDHLEERLRAIEEGRDYAFTDIEELFLVPKSGHSQVQGAEL

SEQ ID NO: 176660 - protein, 226 aa, Glycine max
  Coding DNA Sequence Number=SeqID_84975
  Homolog annotation: Hit_ID=A7WEM4; Match level="QueryCoverage=84%, HitCoverage=18%, E-value=3e-39, Identity=50%"; Hit description =Chloramphenicol O-acetyltransferase
MIASGRAARASSGMISGVGLASAKITGSGAMAQEDVRAVDDLCKGALVGVARIALLFRVQVGTAGMDHALAVEGQDVLRLQAQLHQHVHAGNAGCAHARGRQLHFLDLLAGDRHGVEHGRADDDRRAVLVVMEHRNLHALAELALDHEAFRRLDVFQVDATEGRLQRGDDVDQLVRVGFIHFDVEHIDAGELLEQHALAFHHRLAGQRADVAQAQHRGAVGDHRHQ

SEQ ID NO: 176661 - protein, 98 aa, Glycine max
  Coding DNA Sequence Number=SeqID_84976
MVTGNRLVPTACFYKSEANLEKKKKATPTECKEVPHPLVPSRKDKERHLVRFLDIFKKLEITLPFGKALQQMPLYAKFLKDMLTKKNRYIHSDRIIVE

SEQ ID NO: 176662 - protein, 81 aa, Glycine max
  Coding DNA Sequence Number=SeqID_84977
MRTDSTELHHQVSIRCGSNAFQDYFDDAKESRVKQIPKIRESSFKNQELRKFQRFKNQESRTIKIKIQDSRFKNQEKTQSR

SEQ ID NO: 176663 - protein, 93 aa, Glycine max
  Coding DNA Sequence Number=SeqID_84978
MGDTEGPPKCFAGVYHQLLALQWHIRGKARSRLDGDDDKSDEQKAQVNQRTSISSESKNIHLKRIKNKSRVQESRRKPTHKNQDQDSRLKIQE

SEQ ID NO: 176664 - protein, 359 aa, Glycine max
  Coding DNA Sequence Number=SeqID_84979
MVPPPTTTACAAPRLGRDLRVRLHGLLLVLNPLLHLSSVPALVSARMTVLGAECREACAGRHADQSFDARHRHHPGAGPHPQLPPGGGAVAPVAVGPVDADPAHRGGAGRAAVRPHHPHRAADGGGRGLHAAGRRPAGGLPRRHCRGQRHRQRRARPGVGGGAAVAGRAPVAAGVDGLPPGASAGGAEGARHAVGAGLRPGARRRRGLRADRRRSAARRPALPAADVRQLPAADPRGASAGAIQGAAALGRHGRRGARVDGASEQRAPVHRMGLPAEPHPLHAGLRGRTPDHHRGDGGVRFRGGGIAGNRGRRGGAERHRAAAADRPRGRTLDRAGDGAQPQPAAGGRGAGGDAAAVSG

SEQ ID NO: 176665 - protein, 87 aa, Glycine max
  Coding DNA Sequence Number=SeqID_84980
METKPGAKESPAQKILVGNQEGDRFMCYIVWSENLYHDCSLTVNGSSFLGDPSVPSSEGKDKNFYPRLRFMANELRFWLERLVEGWT

SEQ ID NO: 176666 - protein, 120 aa, Glycine max
  Coding DNA Sequence Number=SeqID_84981
MDHEDPFTHLSTFMELCNTMGASDENVEVVYLRDFLFSLAECNSGSKQALDSALRGLDQVDRSTSSTISTRWIIENTPSSSSSTSSKMHILVPLTFLLDVLLKTIMWIIQMRIHNKKKLN

SEQ ID NO: 176667 - protein, 97 aa, Glycine max
  Coding DNA Sequence Number=SeqID_84982
MVGYTPSSFVDLERGKSDHPALMNTKTGANEEELGNRLPVCRNVPFYGRAKARLTGALSKGGKMRGVANNVYLWKTSGKPKETGQNENSKFGSCIYG

SEQ ID NO: 176668 - protein, 117 aa, Glycine max
  Coding DNA Sequence Number=SeqID_84983
MTRGNPSDLQPFDPEIDRTFHRLVRYHFVPFDHPEHSITDEFVHSVIGDFEHPDFEHYNFEHSENMAQPPPRERTLREMTAPDFTYESLCIQYPDEDVPYVLKTGLIHLLPKFHGLA

SEQ ID NO: 176669 - protein, 177 aa, Glycine max
  Coding DNA Sequence Number=SeqID_84984
  Homolog annotation: Hit_ID=A7UQU7; Match level="QueryCoverage=63%, HitCoverage=20%, E-value=3e-17, Identity=43%"; Hit description=IMP dehydrogenase/GMP reductase, putative
  Pfam annotation: Domain name=DUF1723; Domain location=90-139; Score =48.3; E_value=2.7e-11; Accession=PF08330.1; Description=Protein of unknown function (DUF1723)
DTGAATPADTGTQAIEDELEGFLGGPRDPSVLTEYADHVVGSVWTGDEHPELKLSSHGRKVHSLGRHVPAIEGLVAGTGLSPLIACSIDTGEWGLLSSFVERWHRETSSFHLPMGEVTITLDDVASLLHLPVVGDLHAFQPVHVDDVVQMLVELLMVTAEAARAETAQCRGPYVHLQ

SEQ ID NO: 176670 - protein, 253 aa, Glycine max
  Coding DNA Sequence Number=SeqID_84985
RAGRRVAARHASRVRTPHPRPGSLGRRAAGGSPARAGDADSRGRGAAQDRHPGGRADGAGAPSYPQFGRGRRGGAAHRHRPQPGAHAGGRLDRAPAPPRAEGADRRHPAGDFDRQDGRHGGAAGAGQGGPAVLLRASGAVDAAQSGALPLHDAGHRQAGAGQPGRRPRPRALCAGRGRAAGAADHLRRRPVDGAHPGRPARIHALCAGAVRAQRFARRRARRRGQGPGGGLAALVHGGGGLPSRDVGVAGRAQ

SEQ ID NO: 176671 - protein, 70 aa, Glycine max
  Coding DNA Sequence Number=SeqID_84986
MENCIKQSPAWLQTRGWRTHEPKRNAWGSEKRLRMENCTKQSLRMAPNSKVGGHMNEKAIHVAPKKVENG

SEQ ID NO: 176672 - protein, 305 aa, Glycine max
  Coding DNA Sequence Number=SeqID_84987
  Gene Ontology: Mol. function=hydrolase activity; Biological process =pyrroloquinoline quinone biosynthetic process
  Homolog annotation: Hit_ID=P27504; Match level="QueryCoverage=100%, HitCoverage=99%, E-value=1e-174, Identity=94%"; Hit description =Coenzyme PQQ synthesis protein B
  Pfam annotation: Domain name=Lactamase_B; Domain location=38-269; Score=0.2; E_value=0.068; Accession=PF00753.18; Description=Metallo -beta-lactamase superfamily
MFIKVLGSAAGGGFPQWNCNCANCQGLRNGTIQATARTQSSIIVSDNGKEWVLCNASPDISQQIAHTPELNKQGVLRGTHIGGIILTDSQIDHTTGLLSLREGCPHQVWCTPEVHEDLSTGFPIFTMLRHWNGGLIHHPVTPLNSFTVDACPDLQFTAVPIASNAPPYSPFRDRPLPGHNVALFIENRRNGQTLFYAPGLGEPDEALLPWLKKADCLLIDGTVWQDDELQAAGVGRNTGRDMGHLALGDEHGMMALLASLPAKRKILIHINNTNPILNEQSPQRKALTQQGIEVSWDGMPITLQD

SEQ ID NO: 176673 - protein, 38 aa, Glycine max
  Coding DNA Sequence Number=SeqID_84988
MWTTTGEKLAAQLAQASKVASSRSNSLLEESSGGPKLA

SEQ ID NO: 176674 - protein, 381 aa, Glycine max
  Coding DNA Sequence Number=SeqID_84989
  Homolog annotation: Hit_ID=A5BZH4; Match level="QueryCoverage=23%, HitCoverage=14%, E-value=3e-07, Identity=37%"; Hit description =Putative uncharacterized protein
  Pfam annotation: Domain name=zf-CCHC; Domain location=199-216; Score =8.2; E_value=0.087; Accession=PF00098.14; Description=Zinc knuckle
MSHHSSSVNGEGTSHKDPLSRILDELSSLKLWKEKIERKEKGKETVEINQDEREKIREEERRKILKELRKEKHATYSSHESCKSLSKELRDYYEGRHRLHLRPHSHRRKKERKPQEANINLPYFYGKDNVEAYLNWEIRVEQQFKRKSTLKSYGSYSYPKKDQGLGILGATPSKPKDDKGKTIEKQPPKASMQEKTSSIKCFKCLGRGYITSQCPTKKTMTMRGQDIYSCQDEATTSPSFSESEEAKREESSEEIYPQEEGQPLMVKEECKETLVSIATPLGLEVIPQLKELLGKGLVRTSLIPYALLVPKRGVPTNPKRIKVIPEWSTPSSVEERTLEFQEPLDLRSNPFQGGGNDAILPSKGIRYKTSRRLDQRCKRRP

SEQ ID NO: 176675 - protein, 479 aa, Glycine max
  Coding DNA Sequence Number=SeqID_84990
  Gene Ontology: Mol. function=inorganic phosphate transmembrane transporter activity; Cellular component=integral to membrane; Biological process=phosphate transport
  Homolog annotation: Hit_ID=Q8GSG4; Match level="QueryCoverage=100%, HitCoverage=100%, E-value=0.0, Identity=75%"; Hit description =Phosphate transporter PT4
  Pfam annotation: Domain name=MFS_1; Domain location=25-406; Score =52.6; E_value=1.3e-12; Accession=PF07690.7; Description=Major Facilitator Superfamily
  Pfam annotation: Domain name=Sugar_tr; Domain location=20-457; Score =93.7; E_value=5.9e-25; Accession=PF00083.15; Description=Sugar (and other) transporter
  Pfam module annotation: Pfam domain module=MFS_1::Sugar_tr; Domain location=25-406::20-457
MALEVLEALDSARTQWYHVTAIVIAGMGFFTDAYDLFCISTVSKLLGRLYYFDPSTPNLPGKLPLSVNNMVTGVAIVGTLTGQLIFGWLGDKLGRKKVYGITLILMVICAICSGLSFGATPKSVMGTLCFFRFWLGFGIGGDYPLSATIMSEYANKRTRGAFIAAVFAMQGVGIIFAAMMTYYWRMKMPETGRYTAIIEGNAKQAAADMAKVLDIEIQAEQDKLAEFNASNNYPLWSNEFFQRHGRHLIGTMSSWFLLDIAFYSQNLTQKDIFPAIGLIDKDYQMDAIKEVFETSRAMFVIALLGTFPGYWFTVFFIEKIGRYKIQLIGFFMMSFFMFVIGVKYDYLKNEGKGYFALLYGLTFFFANFGPNSTTFVLPAELFPTRVRSTCHALSAAAGKAGALVGVFGIQCLTVGGESYKIKKVMIILAVTNLLGFFSSFLVTETKGRSLEEISGEDGRESELTPTPNNRVQGSRTETM

SEQ ID NO: 176676 - protein, 243 aa, Glycine max
  Coding DNA Sequence Number=SeqID_84991
  Gene Ontology: Mol. function=glutamine-tRNA ligase activity; Cellular component=cytoplasm; Biological process=tRNA aminoacylation for protein translation
  Homolog annotation: Hit_ID=P52780; Match level="QueryCoverage=23%, HitCoverage=7%, E-value=2e-21, Identity=87%"; Hit description =Glutaminyl-tRNA synthetase
MYQSCLNQSQASKHSNTKSRCPKPLNLMDFLGLRSEIETKHINITSIIIKTLKLNGNLAKLPIISPKTPYPRKSREKEVHPNLKFRSPTRRDALHDSENALLSRFGAEMMAKGWSFVGASMVEEEEGEKQPTESEKNLTFETLKSFLGLRAISLTPDEIKEHREKKLNSPWRDMPISESLKLFEDMKNGSIEEGKATLRMKQDMQSDNYNILPHTLMLETNGVSIQVMIMHIALWILKRISHI

SEQ ID NO: 176677 - protein, 50 aa, Glycine max
  Coding DNA Sequence Number=SeqID_84992
MAGVGSSSYKGNDNILFCFHCKSKTTTFINGWQLRSGGLALLCQNCGFFN

SEQ ID NO: 176678 - protein, 91 aa, Glycine max
  Coding DNA Sequence Number=SeqID_84993
  Gene Ontology: Mol. function=kinase activity
  Homolog annotation: Hit_ID=Q2HTJ1; Match level="QueryCoverage=94%, HitCoverage=22%, E-value=5e-17, Identity=47%"; Hit description =Putative uncharacterized protein
MEVIAIVVGQNLKLEPLKPEKKAMWRREMNCLLSVCDYILEFSSTAQYLEDGTIVEEILDSFQDTEFWYAEQGTISGNSTQSRGGSFRRIV

SEQ ID NO: 176679 - protein, 75 aa, Glycine max
  Coding DNA Sequence Number=SeqID_84994
MLAVGARLCRQPQPPSLTLRYIMLFALIHKHSRSSSRFPVSLKPRVYRDLAVNCGVCPHPRDLVRRLVLWRHRAS

SEQ ID NO: 176680 - protein, 243 aa, Glycine max
  Coding DNA Sequence Number=SeqID_84995
  Gene Ontology: Mol. function=S-(hydroxymethyl)glutathione dehydrogenase activity; Cellular component=cytoplasm; Biological process=metabolic process
  Homolog annotation: Hit_ID=P93629; Match level="QueryCoverage=20%, HitCoverage=13%, E-value=1e-17, Identity=86%"; Hit description =Alcohol dehydrogenase class-3 (EC 1.1.1.1) (Alcohol dehydrogenase class-III) ...
  Homolog annotation: Hit description=(S-(hydroxymethyl)glutathione dehydrogenase)
LGVVWNTAKLESGSIVAIFGLGTVGLAVAEGAKTVGASQVIGIDIDNKKFDIGFVGGAGVIGFLCPPWTSGCPDCCHWATRTPWSCAYLNGAHWQMVVILPKENLVCALKGHDDTPQPKSKAGARWIVVKCRHGKKIRTRGYPSKSISTLTGNTRVDRVWVRVFPNNQKSGTGTGQGWGYSIPNEYGDKIINFNPSNIGYGYGNMLESRDRELGRQYPSPPRPIVMSTRVRKMSFGRIILALE

SEQ ID NO: 176681 - protein, 424 aa, Glycine max
  Coding DNA Sequence Number=SeqID_84996
  Gene Ontology: Mol. function=binding; Cellular component=nucleus
  Homolog annotation: Hit_ID=A7QWW8; Match level="QueryCoverage=57%, HitCoverage=21%, E-value=3e-63, Identity=48%"; Hit description =Chromosome chr13 scaffold_210, whole genome shotgun sequence
MPASPSENRTRWRKRKRDSQISRRHQKHEEEEDDNNKNPNAEEDIAERDYDLEDQTHHNHPNSQPYMETKVLSDHGVQISQFPTVIKRSVNHPHSSVTAIVALEHALEFGQNKAPSTLVAPILENVSHDHLQALSSVPFDSFAFDGDSSFVITSPPILEGRGVVSATKLRLLVSYQAFFKGTKAAKRLHLKEHLVLDGSGNLFKLAAPMECKGIVGGDDQVIPRDANYTGPSSRFCILRPKLITAYCRAQASEILKSKEKNPQEADNLVTDSQNVAEAYNLVNDSQNFGDADQLVNDSQNLVDADKVDSTKEEKIEDVKVFSSVTTKASEGCEDIVFNPIVFTEFKLAGSPKFIQELCTLEVSPMDGQTLTEALHAHGINVFYIGKDLLRKTEDHDFAPALSHFLNCLFGSCQAPGGKVLANST

SEQ ID NO: 176682 - protein, 80 aa, Glycine max
  Coding DNA Sequence Number=SeqID_84997
  Homolog annotation: Hit_ID=Q153F8; Match level="QueryCoverage=58%, HitCoverage=13%, E-value=8e-13, Identity=74%"; Hit description =Pectin acetylesterase
MAKERKDSTVKMVNGKESVTTNFKGLLASKASQRSPQNGLFINSCFAHCQSERQDTWFADNSPVIGNKNIHLEKNSKTFT

SEQ ID NO: 176683 - protein, 15 aa, Glycine max
  Coding DNA Sequence Number=SeqID_84998
MTSPAIGESSTGNSE

SEQ ID NO: 176684 - protein, 91 aa, Glycine max
  Coding DNA Sequence Number=SeqID_84999
ITPARHPVDLKKFNRVLELPALIMGLCQFYGVPVAPSKVIRPPTNRAFIKKYYAPRQAQGETPQQPRDGRQRATNALPPPVEFTTTHPQKG

SEQ ID NO: 176685 - protein, 41 aa, Glycine max
  Coding DNA Sequence Number=SeqID_85000
NPVIDSAAMESKPIESATAGTVSGVQIAVVGIFSAASSSSY

SEQ ID NO: 176686 - protein, 34 aa, Glycine max
  Coding DNA Sequence Number=SeqID_85001
MVKKEYKEDQGVPTDPKRIKVIPKWPTPPSIKEI

SEQ ID NO: 176687 - protein, 73 aa, Glycine max
  Coding DNA Sequence Number=SeqID_85002
  Subcellular localization annotation: CTP_CleavageSite=45; ConfidenceScore=5.13e-01
MTTTTHQQLLLMDGESFTGSVQFTVQFTFVLVVLPQPLGLKMHTRDETTPSTTSWVEWMSYRSSQQHPWLKTR

SEQ ID NO: 176688 - protein, 110 aa, Glycine max
  Coding DNA Sequence Number=SeqID_85003
MAPKKLSVKRSRRDAATEGTNAAPEFDSYHFWSAVHQQRFEAIKGWSFHRERRVQLREDEYTDFQEEIAHRHWTSLVTPMAKFDPKVVLEFYANAWPTEEGVRDMCSWVR

SEQ ID NO: 176689 - protein, 103 aa, Glycine max
  Coding DNA Sequence Number=SeqID_85004
  Gene Ontology: Mol. function=acetyl-CoA carboxylase activity; Cellular component=acetyl-CoA carboxylase complex; Biological process=fatty acid biosynthetic process
  Homolog annotation: Hit_ID=P49158; Match level="QueryCoverage=95%, HitCoverage=50%, E-value=1e-24, Identity=98%"; Hit description =Acetyl-coenzyme A carboxylase carboxyl transferase subunit beta
MDSLGPIENTSLREDPKILTDIEKKIHRDLDYLEMEGFFSSDLNTVSKNDDDHYISDRIELSIDSGTWNPMDEDMVSLDPIEFHSEEEPYKDRIDSYQENGIN

SEQ ID NO: 176690 - protein, 93 aa, Glycine max
  Coding DNA Sequence Number=SeqID_85005
  Subcellular localization annotation: CTP_CleavageSite=63; ConfidenceScore=5.10e-01
VCDIYPRIEYANSQTKYAKYSDSKSIQMPKLRRISIMRVMSKMTATTTKSISLKPLGRDGTVRRHLVEKIPIVVPRYTVKPLAMVTLESTDQR

SEQ ID NO: 176691 - protein, 74 aa, Glycine max
  Coding DNA Sequence Number=SeqID_85006
MAQPPPRERTLREMDAPDFTYESLCIQYPNEGEDPHKHLKEFHIVCSTMKPPDVQEDLIFLKAFPHSLEGVAKD

SEQ ID NO: 176692 - protein, 89 aa, Glycine max
  Coding DNA Sequence Number=SeqID_85007
MIRGDTLRLSAPFCHPEAAGPMTSRDQVWSFCTHDTRRYLMVIRTLLSSRGGGPDDKQRPSLGHSAPMIRGDTLWLFAPILLLSVRQNA

SEQ ID NO: 176693 - protein, 54 aa, Glycine max
  Coding DNA Sequence Number=SeqID_85008
SSSSFLSKAILGGEAPYSLAYSLVDAQRSSLHRSSTSKLPSSGIRAQELQVGAP

SEQ ID NO: 176694 - protein, 274 aa, Glycine max
  Coding DNA Sequence Number=SeqID_85009
FYANLYNSDGPSPKQARVRGHLVKIDADNLNVFLETPVVLAEGETLPTYSRYCRLPLDPREIEAALCIPGRGFILNAEGHSGRILRKDLTTLAQVWSVLSYSNLTPTSHTSDLIVERARLNFGLVSRMDMNIGALIYGQMTSIAQSNSSRLGFPALITALCRARGVVSDNLTFECLSPIINLAYIRKNCWNPDDLTVSIRGARRTKARPTELLSTFAAPTPASTSATPSVPAQSDSQRFEAMLQSIHQGQIILLQSLQVGASPGFIPSVEQFLE

SEQ ID NO: 176695 - protein, 131 aa, Glycine max
  Coding DNA Sequence Number=SeqID_85010
MGSRALLLQRGHPLFRLLQSIGENKTSPLSRTSCHWVDRVRLPSCSSNCYCLIEHSNPFSSIGEEASIREPIQPKANKDLWQGNLFHSFRLFYILKGSFLLLHLRLSGLSPVTSCRVCLVCVSVESKPFHL

SEQ ID NO: 176696 - protein, 61 aa, Glycine max
  Coding DNA Sequence Number=SeqID_85011
MASRKRKEPSTPTQFDEFKEELERRHWDEELTDFGDGNIDVAIVKEFYVNLLDPEDKSPKQ

SEQ ID NO: 176697 - protein, 151 aa, Glycine max
  Coding DNA Sequence Number=SeqID_85012
AAIGASCKESGLESSWASFHSRNGSECTQDQTSYSLAAPFPEKGRDEGIVRSRSCDESNIVRSRILRTTGPRPRSPLRRTIYRSEELSVLNVERLSGACGHSFLACSNPKHARGGYYAHRALASPPELRYRFAQLLRLPRILNHHVAAKAS

SEQ ID NO: 176698 - protein, 128 aa, Glycine max
  Coding DNA Sequence Number=SeqID_85013
MRRQNLVIPHPFAIQTQSCPMARRDKLWSFCTLLSSRGGGPDDMRRQIMVSLHPFAIQTQSCPMVRRDKLWSFCTLLSSRGGGPDDMRRQIMVILHPSSIAADKPVDTRRFTSSSALTRFVILTFESC

SEQ ID NO: 176699 - protein, 107 aa, Glycine max
  Coding DNA Sequence Number=SeqID_85014
  Subcellular localization annotation: CTP_CleavageSite=65; ConfidenceScore=5.05e-01
TYQGNPCGVYPDLSSFTGSGVYPDLSSFIGSGVYPDLSSFTGSGVIQTFVACIKRSAPLIKVILVASTLTYLLSLEVASTRTYLPSPEVASTLTYLPSPEVASSKYP

SEQ ID NO: 176700 - protein, 86 aa, Glycine max
  Coding DNA Sequence Number=SeqID_85015
  Subcellular localization annotation: CTP_CleavageSite=79; ConfidenceScore=5.12e-01
MMKQQPSNSGVLMTPRKKPARGSLFYTVGGWGYGQGSGAVQQQRKARWAQNAIIGRLGSMESSVGHGPRDCTRSSEWTMQQMGFGS

SEQ ID NO: 176701 - protein, 189 aa, Glycine max
  Coding DNA Sequence Number=SeqID_85016
  Homolog annotation: Hit_ID=Q6UUU1; Match level="QueryCoverage=39%, HitCoverage=51%, E-value=5e-24, Identity=74%"; Hit description =Putative uncharacterized protein
DGPLLREFNTEEELEKIASELERVDDATRARMSEVILSKRKDEPTRYEIFMNDGNTLLTPTLKLSETVSKYIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGGGDFLEDARKILNRE

SEQ ID NO: 176702 - protein, 122 aa, Glycine max
  Coding DNA Sequence Number=SeqID_85017
MAIVSKPSEERLRQEAFAKRNTPGISTRKTLEEDELYSLDWDSELCMSRVSREIKVQVPKSFERFCCVKICRDQSLKQEPASWNGKLNPLLDLPYKYLIGNWSDSKVLDSTGLSCRAFTRNR

SEQ ID NO: 176703 - protein, 102 aa, Glycine max
  Coding DNA Sequence Number=SeqID_85018
MAKFDPEIVLEFYANAWPTEEGVREMRSWVRGQWIPFDADALSQFLGDLLVLEEGQECELSQRRNRADGFDKEAIAQLLCISGQDFARTATGRQVCHPPGTL

SEQ ID NO: 176704 - protein, 445 aa, Glycine max
  Coding DNA Sequence Number=SeqID_85019
  Gene Ontology: Mol. function=protein serine/threonine kinase activity; Cellular component=plasma membrane; Biological process =protein amino acid phosphorylation
  Homolog annotation: Hit_ID=A7QZS3; Match level="QueryCoverage=91%, HitCoverage=98%, E-value=1e-157, Identity=63%"; Hit description =Chromosome chr13 scaffold_286, whole genome shotgun sequence
  Pfam annotation: Domain name=Pkinase; Domain location=84-395; Score =103.1; E_value=8.3e-28; Accession=PF00069.16; Description=Protein kinase domain
  Pfam annotation: Domain name=Pkinase_Tyr; Domain location=84-280; Score=-100.6; E_value=3e-06; Accession=PF07714.8; Description =Protein tyrosine kinase
  Pfam module annotation: Pfam domain module=Pkinase::Pkinase_Tyr; Domain location=84-395::84-280
MGDKLASLAFLFKDMYWVEESGASSLVAVVVVVGDRAMLEMEKDFDSKLKIQGNSSSSNGAGNVQRSKSFAFRAPQENYTIQDFELGKIYGVGSYSKVVRAKKKDTGIVYALKIMDKKFITKENKTAYVKLERIVLDQLDHPGIVRLYFTFQTHFLYKGRLSENEARFYAAEVIDALEYIHNLGVIHRDIKPENLLLTAEGHIKIADFGSVKPMQDSQITVLPNAASDDKACTFVGTAAYVPPEDLDPSRRPGAGPDGYAILKSHPFFKGVDWDNLRAQIPPKLAPEPGTQSPASDDVHDSSWSPSHIGDGSAASVRQPDGATSSEGTGHITRLASIDSFDSKWQQFLEPGESVLMISMVKKLQKLTSKKVQLILTNKPKLIYVDPSKLIVKGNIIWSDNPNDLSIQVASPSNFKICTPKKVMSFEDAKQRAWQWKKAIEGLQNR

SEQ ID NO: 176705 - protein, 412 aa, Glycine max
  Coding DNA Sequence Number=SeqID_85020
  Gene Ontology: Mol. function=nucleic acid binding; Cellular component= ribonucleoprotein complex; Biological process=ribosome biogenesis and assembly
  Homolog annotation: Hit_ID=A7PHT9; Match level="QueryCoverage=95%, HitCoverage=95%, E-value=1e-147, Identity=75%"; Hit description =Chromosome chr13 scaffold_17, whole genome shotgun sequence
  Pfam annotation: Domain name=BING4CT; Domain location=232-312; Score =197.2; E_value=4.1e-56; Accession=PF08149.2; Description=BING4CT (NUC141) domain
  Pfam annotation: Domain name=WD40; Domain location=147-185; Score =39.4; E_value=1.3e-08; Accession=PF00400.23; Description=WD domain, G-beta repeat
  Pfam module annotation: Pfam domain module=BING4CT::WD40; Domain location=232-312::147-185
MGEIKENVPLPKTKPSTEQDVTDELDLRMKKYLRGEGANLEGLKDKKLKGQLAAKEDLYGKSAKAAAKAEKEHGPVLRLQFLENHFLLASINKFGQLRYQDVTMGSMVGNFRTGLGRTNVMQVNPFNGVVSLGHSGGTVTMWKPTSASPLVKMLCHHGPVSALAFHSNGLLMATAGKDKKIKLWDLRKFEVLQTLPGHANTLDFSQKGLLACGNGSLIQILRDVSGTQNYSKYMTHSMVKGYQIGKLVFRPYEDVLGIGHSMGWSSILTPGAGEPNFDSWVANPFETSKQRREKEIRSLLDKLPPETIMLDPSKIGTVKPRRERPTKQEREAEIEAGVEAAKGMKLKKKTKGRNKPGKRVQKKQEAVSRVKRPYLEQKIQEEESISRKKQKTSEDVELPKSLQRFARKKASS

SEQ ID NO: 176706 - protein, 349 aa, Glycine max
  Coding DNA Sequence Number=SeqID_85021
  Gene Ontology: Cellular component=Golgi apparatus; Biological process= biosynthetic process
  Homolog annotation: Hit_ID=A5B8M2; Match level="QueryCoverage=89%, HitCoverage=31%, E-value=1e-118, Identity=66%"; Hit description =Putative uncharacterized protein
MSDKELFNSICGIAIFLVCGPELDLVALGPKRLTPEILGHMTIDPQSLMLVTVIRNLQKLGYVFKIFAVGHGKARSIWENIGGGISPLSAKHQGLIDWSIFEGIIVDSLEAKVAISSVMQDPFCSVPLIWIIQEDSLSSRLPVYEQMGWEHIVSHWRSAFSRAGVVVFPDFTYPMLYSELDTGNFFVIPGSPVDVWAAESYSKTHAKDQLRELSGFGKNDMLVLVVGSSVFYDNLSWDYAVAMHSVGPLLTKYARRNGATDSFKFVFLCGNSTDGYDDALQGVALRMGLPHGSIRHYGLNGDVNSVLLMADIILYGSAQEVQGFPPLLIRAMTFEIPVVVPDFPVLKKY

SEQ ID NO: 176707 - protein, 148 aa, Glycine max
  Coding DNA Sequence Number=SeqID_85022
MERGQLWSRNEAQVWGTFEAYPLEESYRHQLARHLCEINNYSYKTVDPNLPSSSQRPKESYPTDRIIPENTDDGQIRTEFYVPEPVFQKAEDLADDYSSLNRDWEDYNAQLMEDLLHKKKYRYHHPTSDGWKTAVQRCVGEQLYRGVL

SEQ ID NO: 176708 - protein, 376 aa, Glycine max
  Coding DNA Sequence Number=SeqID_85023
  Gene Ontology: Mol. function=phosphorus-oxygen lyase activity; Cellular component=integrator complex; Biological process=snRNA processing
  Homolog annotation: Hit_ID=A7PQZ1; Match level="QueryCoverage=91%, HitCoverage=38%, E-value=3e-93, Identity=49%"; Hit description =Chromosome chr6 scaffold_25, whole genome shotgun sequence
QAFESLQPSLRPPFSLSILTPDQYALLNRAILHGVLTEPHLANTHIKHLHAIVADAHATFLSLLLNAVLQLYPKLLHSVKTQLLRLTEEMLRVLGIGYDAVLLFLLRQIAAADCTDANLSLCSELLTLFLKQFEPLLEGAPHVLSSALYTFLRVLSDKFRVSIEKLEILKRREIHLCVKIVREEFRLCLKIGRDFIRLLQDLAHVPEFKAILQDIVFNPSVFNVFGFKDRDKEFVIVDIVRFICCAHHPPNEIIQSDIFPRWVLIGWLLTCRSKQVEESVKLALFYDWLFYDERMDGIMNIKPAVLLMVHSVPKFINVTCALLEFLSHLVDRYDVGRKGVIVKGSEKVVIRWEGWKLLRDFCQKDSCYLLIHNGHL

SEQ ID NO: 176709 - protein, 100 aa, Glycine max
  Coding DNA Sequence Number=SeqID_85024
MGPKSTLRLMRTLGPFLVSLTQSSWSILSNALAGFVIIKKGEIIEASFMMMNQAILMMPKDQVIDSRLIQDFKIKHQESNPRFKIQEKKSRSNKSRLHIG

SEQ ID NO: 176710 - protein, 72 aa, Glycine max
  Coding DNA Sequence Number=SeqID_85025
MRGLHVLTIRGLHALTSRGLHVLALRGLPALALGTSYPHLQRTPCPHFQRATRPRHQRTACPHLRRATRPHL

SEQ ID NO: 176711 - protein, 62 aa, Glycine max
  Coding DNA Sequence Number=SeqID_85026
DSPQISASPHQLDLAPYASGPYNAQWNAPRLLHDKHTLCSSRILREMKVVFVIGSAVDRLCG

SEQ ID NO: 176712 - protein, 129 aa, Glycine max
  Coding DNA Sequence Number=SeqID_85027
MAPTRHPLDLDKSNRALGFPSLITGLCQSFGVPVAPTKVIRPPITRAFIEKYCTQRQAQDEPQHAEPGLRFFFMPYSRPVQGRGRMVPGDWPEAQAGEAPPEAPGDGEEAHEDEEMADLLDFLGGSGDT

SEQ ID NO: 176713 - protein, 310 aa, Glycine max
  Coding DNA Sequence Number=SeqID_85028
MSAPEPSPRVREKEENRLGPALGRDRRGCINYNPTLAIRQLGYPMRGAPTEESMSPFLVRDLSAGNSKTIQRGGKDQELRGIRNGIIGGYHEWLKVRIRGLDWLAKLKVVSEENFEAPEEDEEVQALKSELGKAKLAKEKFKLAATHVRKKCAGLREENAITARALERETKRARKEDELKLRREERDQSRAHSMVLKEGVDCLFKVQKKLVSAFMRDRDQHVSYHRQVRRRVRSGTAHEHRIADEYAQVYAEKEARGRVIDSLHQEATMWMDRFALTLNGSQELPRLLAKAKAMADTYSAPEEIHGLLGY

SEQ ID NO: 176714 - protein, 133 aa, Glycine max
  Coding DNA Sequence Number=SeqID_85029
MQSLQSMGPPSIMSMDEFDTQVAWPGAQPSPSGEGGASTAQEPEPEEPTAAVEGEDELTPPKTFYFDAGVHMAQEEETSTDQIPKPSSIPIPDDSMPATPTSELEQPIPQDSPIAQVLDLYEHAQEQSQEQDI

SEQ ID NO: 176715 - protein, 104 aa, Glycine max
  Coding DNA Sequence Number=SeqID_85030
MQRLTSSSTPLSFRDGESDDMRRYPSGYPYKMISVNPDRRSQVAGGNTPSGYPYTHSSTTPTCEKSISMRRRSIWNFNIFMPSRVLLLGFALVAGRVKIQVERN

SEQ ID NO: 176716 - protein, 48 aa, Glycine max
  Coding DNA Sequence Number=SeqID_85031
MHTHTHAYCVVNRGRIILSYFWVGAKHEQQNQPRYLGTDAIGDGVTTD

SEQ ID NO: 176717 - protein, 40 aa, Glycine max
  Coding DNA Sequence Number=SeqID_85032
MSRNFTNCLTMSAKYLEVVKRGSHPNNGWSPDEIRELMKH

SEQ ID NO: 176718 - protein, 25 aa, Glycine max
  Coding DNA Sequence Number=SeqID_85033
MAKRTLCAKPKCHSDEAELSAPCCG

SEQ ID NO: 176719 - protein, 109 aa, Glycine max
  Coding DNA Sequence Number=SeqID_85034
  Homolog annotation: Hit_ID=Q6WAY6; Match level="QueryCoverage=53%, HitCoverage=10%, E-value=4e-07, Identity=46%"; Hit description =Putative uncharacterized protein
MAPSTEDVKKAMQGLFAVLQLSMWGWFHTFFSKKVGPSIRYKVTARCPNVPWMGTWGCINYNPVLAIRQLGYPMRGAPLDESITPFITRGFSDPNARVLQGVRKAWDAA

SEQ ID NO: 176720 - protein, 45 aa, Glycine max
  Coding DNA Sequence Number=SeqID_85035
MYLATGNRLHPLYCLEFLILKSPFASVATHHHDHHQNIKANCIYR

SEQ ID NO: 176721 - protein, 49 aa, Glycine max
  Coding DNA Sequence Number=SeqID_85036
MVTINKGRILGVGKIGTNSSNSIEKVLLVEALSIACLALVNYVKEHTHH

SEQ ID NO: 176722 - protein, 96 aa, Glycine max
  Coding DNA Sequence Number=SeqID_85037
MGAKYLEAVKQKVACHQTMSPDEIRIPCLDSRRAYGSRKIYPLPQIWGSGTNWEQRKRFKASPPTQSCFLQKQPPSGGTSSKAQVGLVAICTPFFY

SEQ ID NO: 176723 - protein, 78 aa, Glycine max
  Coding DNA Sequence Number=SeqID_85038
ELGCFHLKQEIAQKPLEGPRFDNYYLHPVATYPSAGGRRETRGMRVPRKEYARSRHQRFFEENVRKTGKDAIYELLSE

SEQ ID NO: 176724 - protein, 72 aa, Glycine max
  Coding DNA Sequence Number=SeqID_85039
MHENKWHGACLLFAPIWEPIGKYLGARLTGALSKGGKMRGVATNEGISTSHVDKSGALAPTYPPSKRKSDLR

SEQ ID NO: 176725 - protein, 133 aa, Glycine max
  Coding DNA Sequence Number=SeqID_85040
LGGIDGNPMLRGTRIRAMWEYVSSVEGGQLGMVDLCVICGCGESTCTIARSPPSTTYDGVVPGDMSRGSGDLGDVRRAPGNQPIKEQRPQSKEACVVAGQLWILSDIWNMASGNRLPRASGNRLPMGVIDYQA

SEQ ID NO: 176726 - protein, 51 aa, Glycine max
  Coding DNA Sequence Number=SeqID_85041
MTCGGTLWLSVPLSTRDGEFDDMEGFYFRHPETFKSDDVQDSSLLGRDDRV

SEQ ID NO: 176727 - protein, 175 aa, Glycine max
  Coding DNA Sequence Number=SeqID_85042
APSNSMARTRFTAAFRVHKNIIEVLLTYHRQWRPYYPTYVLFDYNGTKHFVKVCKYGTRCFFADGLKEFRRTHGINDSVIIRFFAASKDTSFEVDIMGPILRQTCRRPVVTTRRHIFTADVTQDMIEHTNPLVLPATALNFLFGSKKYVPVQRPSGRRNQWQSTVHNGLPSVADP

SEQ ID NO: 176728 - protein, 162 aa, Glycine max
  Coding DNA Sequence Number=SeqID_85043
  Homolog annotation: Hit_ID=A5AWV0; Match level="QueryCoverage=75%, HitCoverage=8%, E-value=3e-10, Identity=31%"; Hit description =Putative uncharacterized protein
MRLGNSDVYGFLEPQCIQKSLQSQFESESYIKNWMQSSKWDVYLGAYLNGAHWQMVIILPKENLVVRFCSLHNRPDNYLKGIINSALKELNDTPQPKSKAAGAKWIVVKCNKQKGSTECGYYVMHWMSTIILGSFRNNWEMTTGIRHIEGASHPVGKLLSQS

SEQ ID NO: 176729 - protein, 129 aa, Glycine max
  Coding DNA Sequence Number=SeqID_85044
MTTLAQTWSVLSYYDLAPTSHTSDVNLDRARLIYGLHISQIAQSSTSRLGFPALITSLCDIQGVVSDTLIFESLSPAINLAYVKKNCWNPADPSITFPRTRRTRTRASASASEAPLPTQPLSQPSSQRP

SEQ ID NO: 176730 - protein, 36 aa, Glycine max
  Coding DNA Sequence Number=SeqID_85045
MGRWCVNNFQLFSDEEIANIYLMAKFMNDPSTNEKL

SEQ ID NO: 176731 - protein, 201 aa, Glycine max
  Coding DNA Sequence Number=SeqID_85046
WATGDGVLMPGLVEMEYLLCAIARPPPSTIYDGVVPEDMSRGSGDLGDVKRAPGIQPIKEQKCTRQGGLRGSWPANYLGDNYMKKMPTGNRLPESKSLEKDILTIAMAAQLIHDRVVMECLEGVWETLEGNERCQFRGIVRLTATSLVSSSEEDPEGDPEELSPEPAMDAPDLPEDDEDPLPDVDSPEDIMPAPEANSTEE

SEQ ID NO: 176732 - protein, 169 aa, Glycine max
  Coding DNA Sequence Number=SeqID_85047
MKQIASRKTISINIPLATIARSHMDPSMDVDSPFKAHSNQSSQSHLAYVEYSTIGGIFAQMYALNQAITYPPSLHTSRTIDILMASSSDYNGQDTVDHSDNIQVLHQQQQARLEQQAMYDTAKINEVLIYLTISSVVHEDEVPEVSYIASNAAKANEVIPTGPSEPVSK

SEQ ID NO: 176733 - protein, 78 aa, Glycine max
  Coding DNA Sequence Number=SeqID_85048
MAENSPNFPFALRHTLSKDPPTTEWSIQFGHQSKDEESGKASILRPHAKREISALSAVGAFSQAKRETGAKPNFTYSR

SEQ ID NO: 176734 - protein, 243 aa, Glycine max
  Coding DNA Sequence Number=SeqID_85049
  Gene Ontology: Mol. function=protein serine/threonine kinase activity; Biological process=protein amino acid phosphorylation
  Homolog annotation: Hit_ID=Q9LDC1; Match level="QueryCoverage=30%, HitCoverage=12%, E-value=1e-29, Identity=84%"; Hit description=CRK1 protein
MHKIYKLCGSPSDEYWKKSKLPNATLFKPREPYKRRIRETFKDFLPSALPLIDTLLAIDPVERKTASDALRSEEPSVAFAIQILDGTPLCPGGKIPMSVSQAKFEQQDNCYWIPMTRDKFVSKHVDDKKEKKLKKVEDKMLGWAIVDLKVDMRWEKLQKGIGLEIVKQLASVGIKMVLTTRNEERGLQARETLKALGSSHLGLFHQGESIIFFYLTISLYSKSSTDAEDAGFDDVIVEDQIDK

SEQ ID NO: 176735 - protein, 104 aa, Glycine max
  Coding DNA Sequence Number=SeqID_85050
  Subcellular localization annotation: CTP_CleavageSite=48; ConfidenceScore=5.30e-01
MFWGETGQKHKNKSIISKVGLNTHRSGIRKVPGRFGKKTTKNTKVGVNLSNTGGALRKLHLEHYRRGVNLSITGCIQESSSRSLWVAITSILLKKAFEASVMLP

SEQ ID NO: 176736 - protein, 299 aa, Glycine max
  Coding DNA Sequence Number=SeqID_85051
  Homolog annotation: Hit_ID=Q6WAY6; Match level="QueryCoverage=56%, HitCoverage=35%, E-value=3e-10, Identity=26%"; Hit description =Putative uncharacterized protein
MVEEFEEILGCPLGGRKPYLFSGFYPSLARISKIVKILAQELDQGKQVENGVVGVPRKCSEAKARALASQEEWASFIDVLALLIFGVVLFPNVDGLVDLAAISAFLAFHDRKESSVVAILANLYDAFDRRCEKNSVRIVCCMPTVYEGRIEILVSCGGFPNVLLTGMRGFNSPNAGVLQGVHKAWEMVQKKDKELRGSSNGAVGGYHRWLKAYVQGLDWLPRLRATKEVEVEAPEESEEVQALKMELEKAQAVKEKFKSTAVRIQNENAELRDVNIATAKALEQETKRARKEEHGRNKF

SEQ ID NO: 176737 - protein, 240 aa, Glycine max
  Coding DNA Sequence Number=SeqID_85052
MTQELVARGDTLRLSAPRHSVTPSVIGEQRPMWSSAPFPEMSAPSGGDFFKSHKLSRQIMVILHPFAIQTQSCLMARRDKLWSFCTLFSSRGGGPDDMRRQIIIILHPFAIQTQSCPMARRDKLWSFCTLLSSRGGRPDDMRRQITVIPHPFAIQTQSCRMAHRDKLWSFCTLLSSRGGGPDDMRRQIMVIPHPFAIQTQSCPMARRDKLWSFCTLLSSRGGGPDDMQRQIMVIPHPFAI

SEQ ID NO: 176738 - protein, 88 aa, Glycine max
  Coding DNA Sequence Number=SeqID_85053
MDNPWVSPHVIELDRLWLAKTSLARLWMTKLKTGADNHKVCLRATGPLGHDSEIEAFSRSRSEDADISGKGVDDHIGLCVSTCSLGSS

SEQ ID NO: 176739 - protein, 143 aa, Glycine max
  Coding DNA Sequence Number=SeqID_85054
MGLNQAYVFKERFIESRSSMEVTGFQKLGQKMNRVTSLLCLLPVEAITSKIILMMPKNQELSKFQRIRSQKASRIKFQIIKIQEQSSFKIQDSRTIKIKIQDSRFKNQEKTQFSGNRLSEGSNRLPVASIIFKTNLQSCNRLP

SEQ ID NO: 176740 - protein, 137 aa, Glycine max
  Coding DNA Sequence Number=SeqID_85055
MRKAWKSSCNLLLKEVNQNYTTWIWHGELKDMQSGSQSKLFDVEIGDRDEDTTKDKDHEALEGPMTRGKLKQAQHVIETWGQMSYRMSRHHASEHADYMCPYEQIKQVNNTRELFTQFGATSPTSGGYQAREEIHSQ

SEQ ID NO: 176741 - protein, 72 aa, Glycine max
  Coding DNA Sequence Number=SeqID_85056
MYDPSKCGSNAFQGYFDDAKESRVKQSFRQRFKNQVSSFMIQDSRIKNNQDQDSRLKTQDSRFKNQEKTQSR

SEQ ID NO: 176742 - protein, 49 aa, Glycine max
  Coding DNA Sequence Number=SeqID_85057
MCFREENPSRGASVPLPRHFRKRFCGDSSSFFVRSSSFFGLQPFSFLLL

SEQ ID NO: 176743 - protein, 70 aa, Glycine max
  Coding DNA Sequence Number=SeqID_85058
MDPNNDFERVSKQTVYETPNDNNDEQIISYLMQSYPVRALARRLQVDWARDPRKGPRVLMSLRVDFEPMG

SEQ ID NO: 176744 - protein, 160 aa, Glycine max
  Coding DNA Sequence Number=SeqID_85059
MRASGNRLPRGCNRLPGLKRGLEHCGGLWLCNSSLASGNRLPSLCNRLPEMKSLKIPFYLHIVIVMAAQLIRDRVEMECLEGAWETLEGNTRCRFRGTIRFTATSLVHPDEPARTLQRTVEWILPTPTPYRLVEPVQVIEVTSSEEDLEEDLEELPPEPA

SEQ ID NO: 176745 - protein, 102 aa, Glycine max
  Coding DNA Sequence Number=SeqID_85060
  Homolog annotation: Hit_ID=A5ZYV5; Match level="QueryCoverage=65%, HitCoverage=69%, E-value=8e-16, Identity=68%"; Hit description =Putative uncharacterized protein
LRWRAKKPPSGGPEPSVRYHSGRARILTLCQDLRAEGQSQVTEACKGFLGPDGDWPSSAKAEGSLTARPTRRAGTKVGLSDPTVPSGRAVAQRIKVTLGITG

SEQ ID NO: 176746 - protein, 156 aa, Glycine max
  Coding DNA Sequence Number=SeqID_85061
MRSFPLDTVKKVVKKRESEKGWRGLNEPPPPLLLFHAYSCPSSIPFVRESESIPAFLGTSQHGLDVESHIPASVVSSFPRVRATKPLLPRFSALTPASYGSKAVFFAGSKARSISSISRSSLGKQHKQRKQQRESALALLFLRSLIAAANYSFSGR

SEQ ID NO: 176747 - protein, 136 aa, Glycine max
  Coding DNA Sequence Number=SeqID_85062
MANNVSEVNEEGPIGEAGAGTGAGKGVRAEAGNCGRCGVEVDGAEGSGKVDEEGEEAPGATEVGGASDLLPLAFLGPLNVTIGSSRFQQLFFIYAKLMAGLRLSKDLESDVTPLALHKVVIKAGNPSLEESCWEMI

SEQ ID NO: 176748 - protein, 169 aa, Glycine max
  Coding DNA Sequence Number=SeqID_85063
MVTSEPYTGAMKGTMHKPQGYTPSPWVLVPITLRGLHVLAFRGLTHVLLTRGLHALTSRGLHVLALRGLHALTLGTSYPHHQLRGLHVLALRGLHVLIIRGLHALTSRGLHVLALRGLHALTLGLHVLALRGLHVLTIRGLHALTSRGLRVLALRGLHALTLGTSYPHR

SEQ ID NO: 176749 - protein, 86 aa, Glycine max
  Coding DNA Sequence Number=SeqID_85064
MTGLRRSKVRLSETTPLDLHNAVIRAGNLSLEVLEWAIEIIWPEIIAPMFISKRETRPKISLALSTVKPEVCDVGAKLEYERTLHT

SEQ ID NO: 176750 - protein, 116 aa, Glycine max
  Coding DNA Sequence Number=SeqID_85065
  Homolog annotation: Hit_ID=Q1J7G7; Match level="QueryCoverage=31%, HitCoverage=52%, E-value=1e-07, Identity=70%"; Hit description =Transposase
  Subcellular localization annotation: CTP_CleavageSite=78; ConfidenceScore=5.56e-01
MVFLKVLQWRLFLSAVPPVQLLTGWCVTAKSTARTSALASVAVTLRVTTTPAALNAPLQGASHSPFRLRNCWEGRSVRASSLLRQLAKGGCAARRLSWVTPGFSQSRRCKTTASEL

SEQ ID NO: 176751 - protein, 389 aa, Glycine max
  Coding DNA Sequence Number=SeqID_85066
  Gene Ontology: Mol. function=transporter activity; Cellular component= integral to membrane; Biological process=transport
  Homolog annotation: Hit_ID=A6TDI9; Match level="QueryCoverage=52%, HitCoverage=49%, E-value=1e-108, Identity=95%"; Hit description =Putative galactoside permease
  Pfam annotation: Domain name=LacY_symp; Domain location=168-389; Score=-27.0; E_value=3.6e-17; Accession=PF01306.10; Description=LacY protonsugar symporter
LAGNIAIVFVTVGHIAVIERIRIDLRLTAGAFHPLSAAYRRQMPGRKMQTERAAIAGGQQRFHRVVLALLIIRNIAGNVLVQAFAVGQHAGQRQQFRRSRMASGLSSENMLTTKLFQPWARAVSSIESVISTENGVVTVSSASTPMVLGVARAPRIFFADSARDTVISETLASFATSFRDAMVITPEVGLKAGDTGIIYAVLSVSALFAQICYGFIQDKLGLRKNLLWYITVLLILSGPAYLLFGYLLKINVLLGSIFGGIYIGLTFNGGIGVLESYTERVARQSQFEFGKARMWGSLGWAVATFFAGLLFNINPQLNFAVASCSGLVFFMLLARLKVSSAPHAMQEAVSGGKVTLEDALRLLTLPRFWALVFFVVGTCIYGVYDQQFP

SEQ ID NO: 176752 - protein, 384 aa, Glycine max
  Coding DNA Sequence Number=SeqID_85067
  Homolog annotation: Hit_ID=Q6WAY6; Match level="QueryCoverage=37%, HitCoverage=24%, E-value=3e-08, Identity=28%"; Hit description =Putative uncharacterized protein
LAPTIEEFEGILGCPLGGRQPYLLARFYASMERIAKVVKILEQELDRVKEDRDGVIGIPRKCLKEKAEALANQGEWTSFIDILALLVFGTILFPNVDGLVDLATINTFLAYHHSKESLVIAILADAYDTFDLRCKKSSQKAVRLPYEGCTIRGSHHAFHHQWHHQQLSQVLKSRTQGITWLPKLRSLSGKEAEILEESEEVQALKTKLQKTRVVKDKLKTTVARIRNECDELKDVNLTTEQVLWGSSNELKLRRGKSDESRMKSMVLEAKLKACQRSKRSLMEQLSKTKENMFIIIYQYKEMMNLAATYGQMLEDEWAKVLALQIEREARERMIELLHREAMKWMNRFTLTLNESQEFRRLLSRAKAVTDMYSAPDKVHSLFDY

SEQ ID NO: 176753 - protein, 159 aa, Glycine max
  Coding DNA Sequence Number=SeqID_85068
MIMRGQDIYSSQDEATTSPSSSESEKAKGEESSEEIYPQEEGQPLVVKEKCKEVSVSSKSLAKKETHFTIKTNIKETFPLRQPPHFLFCKKELASIATPLGLEFIPQVKKLLDEGLVCKSLNPCALLVPKIGIIDMKIQKKMPKKWAFRTYLTSTYQAT

SEQ ID NO: 176754 - protein, 66 aa, Glycine max
  Coding DNA Sequence Number=SeqID_85069
MVGYAPSSFADLVFARKKIEVGLKRGKFNHPTLMNEKTGANEEGQDEGETHAVTAIPIRPSFPPTQ

SEQ ID NO: 176755 - protein, 247 aa, Glycine max
  Coding DNA Sequence Number=SeqID_85070
MSHHSSSVNGEEKIERKEKGKERVEINQDERQQIREEERRKILKELRKEKHASYSSHDSCKILSEELHDYYEGRHRSHLIPHYHRREKERNPQEANINLPYIHGKDNVEAYLDWEIRVEQQLKRNSSSKSYGSHSYPKKDQGIVRHQIPKIGDMMNVLSGATLFCKITHAPNIFMIRVHRELLGSDQGVPTDPMRIKVIPQWPTPPSIRKIWGFHDLTNFYKRCREKKPIVSRTSGFEVKSFPRVRG

SEQ ID NO: 176756 - protein, 147 aa, Glycine max
  Coding DNA Sequence Number=SeqID_85071
  Homolog annotation: Hit_ID=Q2HTA0; Match level="QueryCoverage=54%, HitCoverage=12%, E-value=5e-13, Identity=48%"; Hit description=IMP dehydrogenase/GMP reductase, related
  Pfam annotation: Domain name=DUF1723; Domain location=30-79; Score =50.9; E_value=4.5e-12; Accession=PF08330.1; Description=Protein of unknown function (DUF1723)
MHSLGMPVPAIEGLVAGTGLSPLIVCLIDTSDRGLLSLFVERWYREASSFHLPVGEVTITLDDVASLLHLPVVGDLHVFQPVHVDDVVQMLVELLMVTAEAVRAETAQCHGPAGYTSTFPQSWSPLLIRTMMRIHRVPVCGLLQRRS

SEQ ID NO: 176757 - protein, 103 aa, Glycine max
  Coding DNA Sequence Number=SeqID_85072
ESERSTASPDKELERSVASPTGESERATASPDMESERSAASPTGESRGATTSLDGESKMIIKGGDGELLQAQEKVWAQEEQPCWVLPLKVELQVMLLAQGTAP

SEQ ID NO: 176758 - protein, 63 aa, Glycine max
  Coding DNA Sequence Number=SeqID_85073
MSVKNLVGRLGVHDKTNHTLVSQVTLTRLNGALKPGVFTPKAYTPKSPSGPLPHNSGPTQKIF

SEQ ID NO: 176759 - protein, 91 aa, Glycine max
  Coding DNA Sequence Number=SeqID_85074
  Homolog annotation: Hit_ID=Q1J7G7; Match level="QueryCoverage=62%, HitCoverage=81%, E-value=5e-10, Identity=57%"; Hit description =Transposase
  Subcellular localization annotation: CTP_CleavageSite=63; ConfidenceScore=5.44e-01
VLQWLLFLSAVPPVQLLTGWCVTAKAPARTSALASVAVTPARNHHTPPRLMRRYRARPIRHSGCATVGKGDRCGPLRYYASWRKGDVLQGD

SEQ ID NO: 176760 - protein, 220 aa, Glycine max
  Coding DNA Sequence Number=SeqID_85075
ADTVVSDGKQRPSLVILHPRYAEIPYGYLHPFARQTQLCPMASRDQRPSLVILHPRYAETPYGYLHPFARQTQLCPMASRDQVWSFCTQDTRRHLTVICTPLLGRHSCVRWQAETKFGHSAPKIRGDTLRLSAPFCHPEAAGPMTSRDQRLTQSSAPFVPPGTTKSFTCGNFMVTRDSRQPRGAKLVSYTDFRGPLLDDMRPFFGPCEVLGTIIRQFVKS

SEQ ID NO: 176761 - protein, 111 aa, Glycine max
  Coding DNA Sequence Number=SeqID_85076
MAKGVRNGHNLSPHVIGLSASGCKRGRMTIICLCMPSDSIISGWQKVCGMTIIFLRMSSSSPPLDDKRHRMTIICLCVPSDTIVSGWQKGQYDRDCGAADKSEALPPTYPQ

SEQ ID NO: 176762 - protein, 288 aa, Glycine max
  Coding DNA Sequence Number=SeqID_85077
  Homolog annotation: Hit_ID=Q6WAY6; Match level="QueryCoverage=64%, HitCoverage=33%, E-value=3e-09, Identity=29%"; Hit description =Putative uncharacterized protein
MGTRGCINYNPVLAIRQLGYPMRGAPSKEGLIPFITRGFNSTNVGVLQRVHKAWEMSQRKDKELRRSSNGPIGGYHRWLKAYAQNLDWLPSLRTTKGMEGETSEEDKGRVKEKFKSAAVRIRKENAELRDVNIATTKALEQETKRARALWGSNSELKLRREERDQSRVDDFILKDELRVCLRFKKSLSQWLCETETNMLAIIGKYQEELNLATAHKHKVADEYARVYAEKEARGRVIDSLHQEATMWMDRFALTLNGSQELPQLLEKAKAMADTYSAPEEIHGLLRYC

SEQ ID NO: 176763 - protein, 78 aa, Glycine max
  Coding DNA Sequence Number=SeqID_85078
  Homolog annotation: Hit_ID=A5BI19; Match level="QueryCoverage=56%, HitCoverage=12%, E-value=5e-10, Identity=59%"; Hit description =Putative uncharacterized protein
MIWVPKGSFIKTGIRGPKKVWDTLKKSWYIDSRYSKHMMGDASKFTYISPKNSGHVTYGDNNKGRILGVRKLGVFLEQ

SEQ ID NO: 176764 - protein, 106 aa, Glycine max
  Coding DNA Sequence Number=SeqID_85079
MYKTKGVEPNPKGASNALEVLTQCNPDASSIGACRPTIFFINGFLCFLEDEWQRNGERKRERRRHFKEKMSLEEARHHRRPWIRAWRKNEMNEGRGREEHEILCSK

SEQ ID NO: 176765 - protein, 291 aa, Glycine max
  Coding DNA Sequence Number=SeqID_85080
  Homolog annotation: Hit_ID=UPI00016621D1; Match level="QueryCoverage =46%, HitCoverage=40%, E-value=9e-12, Identity=35%"; Hit description =UPI00016621D1 related cluster
ILAFRGLHAPAFRGLHVLTISGLHALTFRGLHVFTFRGLHVLAFRGLHALAFRGLHVLTIRGLHVLTFRGLHILTFRGLDVLAFRGLHALAIRGLYVLTFRGLHVLNFRVLHVLAFRGLCVLTFSGLHIHALREGGYHAATMHIGARFHSCHCKETSADHAHRLGTLTQIWMTLLCNILPSDCNADLPLRKYQLVCVVSTYGLRPQGTQWTRRSPTGPWGFQLWLQASVSPTGCPSTPERSCHREIRIAPVRHPVDSEKSNRVLGFPALITGLGQFYEVPAAPSKVIRPPY

SEQ ID NO: 176766 - protein, 393 aa, Glycine max
  Coding DNA Sequence Number=SeqID_85081
  Gene Ontology: Mol. function=motor activity; Cellular component=cell projection
  Homolog annotation: Hit_ID=P15305; Match level="QueryCoverage=68%, HitCoverage=88%, E-value=9e-20, Identity=24%"; Hit description =Dynein heavy chain
MSLPAEDYMSSSSEDYTSSPSEGHTPSPLEDYTSSPRLERAAHPRFQRTTRPRLQRTTRPHLQRAARLRLQRAARPHLQTTTRPHLALRGLHALVFRGQHVLAFRRLRTLTFRGLRVLAFRELHVLTFRGLHVLAFKGPHALTFRGLHVVTFRGLHVFAFRGLHILTFKGLHALTFKGLHVLAFRGLHALAIRGLHILAFRGLHILALRGLHVLTFRGKHVFTFRRLHALAFRGLHTLNFRGLHVLAFKGLHVLACRGLHVLAFRGPHALTFRALHVVTFRGLHVLAFRGLHTLAFKGLHAITFRGLHVLTFRGLHALAIRGLHTLAFRGLHVLAFRGQHVLAFRGLHALTFRGLHVLTFRGQHVLAFRGLHVLAFRGSHSLAFRGLHVLTSP

SEQ ID NO: 176767 - protein, 126 aa, Glycine max
  Coding DNA Sequence Number=SeqID_85082
MGLSQAPSLKKRFYQVKRQAFRKGSNNEPIGGYCRWLKAHMQDLDWLPSLRTTKGVEVEAPEEDEEVQALREELEQAQSVKERFKSAALKIRKENAELRDVNKATTKALERETKRARRVEYGRNKF

SEQ ID NO: 176768 - protein, 408 aa, Glycine max
  Coding DNA Sequence Number=SeqID_85083
MASRKRKAPSTPTQARFDRSRFISQEAWERYTDIVVPRKLLPERNVVVYYTEFDEFKEELERRHWDEELNDFVDGDIGVAIVKEFYANLYDPEDKSPKQGQTHLWHHHEDGYECGSDSRSLESLSPAINLAYIKKNCWNLDDPTVTFRGHRKTRGKRSKAPSTLAPSDAPTPSSSIVPPSSSTQIPVIPQAPPQIPLPAPLSTGLSDFIFTPMEEFDTQMACPRDQPSSSRGGGASVAQEPVTDEPPAPAEEETTPDHTPQPSPSSASTPEETQPSALDHNEDHHRRSRTMDWMHEFEDDEGHVKKRLSHEVPKVTVELSSADGLSVHPPLSAASACLHEGESGRASASRSHAKHEIIVLSIAALASHLKEVSLAIREEVFSKKLLKEVFSKKLLKEVFSRNLFKEAT

SEQ ID NO: 176769 - protein, 98 aa, Glycine max
  Coding DNA Sequence Number=SeqID_85084
MTRTHPMVRRRRSTFYPRTMKVMRPSLKNFIRGYIYFGCYTENKRGYISCGSVQVEGTSTWLFKENKGRYISCGSLACKGFYKVERNLKNRWLLGDWM

SEQ ID NO: 176770 - protein, 322 aa, Glycine max
  Coding DNA Sequence Number=SeqID_85085
MMQSYPPRVLDRRLQEDWARAAKQDPGVLMNLRHPFQASYPRLILVVNLLLPWLIQDEATTSPSSSESEEAKGEESSEEIYPQEEGQPLMTNIKEASPLRQPPHLLLCKKTLVSTATPLGFEVIPQVNELLDEGLVCINRHQIPKISDMMNVLKVTTLFCKISHAPNIFMIHVHRDSLGSDQRVPTDPKRIKVIPDWPTSLSIREIWGCHDLTNFYKRFVPYLSILVAPLIELVRNYVPLREDVHERGVEGRIPEYEEPQDLRSNPFQGGGDDAILPPRVLDRRLQEDWARAAKQGPGVLMNLRVDVLSPWAKVGSTLLCKY

SEQ ID NO: 176771 - protein, 79 aa, Glycine max
  Coding DNA Sequence Number=SeqID_85086
MKMTEIEAVSMLWVVETEGDKEKEQGQNRTDAKIEEQRQIQQVLDEYAQVFSEPKSLPPNRANHFTAEAKGLASVPKEE

SEQ ID NO: 176772 - protein, 128 aa, Glycine max
  Coding DNA Sequence Number=SeqID_85087
THLLLEVASPLSLPFSIPLPFIFQEAKESIDEEDPRPTSSNGAYINSTLLFSRFGKPENFRKIFAKEEEEEVQEDVQRDSKVVKEYVEKLFVKIVSKSLKNASQGLAFIDSSSLVKKTIRRVITFRKI

SEQ ID NO: 176773 - protein, 54 aa, Glycine max
  Coding DNA Sequence Number=SeqID_85088
MAWKIEGRKGEKLNFEVSLTRLSFIKVVTSVTHVSIYSLGIFQGYVKGILAYSL

SEQ ID NO: 176774 - protein, 196 aa, Glycine max
  Coding DNA Sequence Number=SeqID_85089
  Homolog annotation: Hit_ID=A5C8K0; Match level="QueryCoverage=97%, HitCoverage=12%, E-value=1e-24, Identity=32%"; Hit description =Putative uncharacterized protein
MQIFIQSIDPSAWNAIVKGAFIPTKEVNSELVPKEWDEMKDERCKSAKEIRKMLEVTLEGTMDNGETISKLQTRFTHIVNHLLGHGKTFKDDELNIKILNYLTRTWEPKITTIKESNDLASMSMKALFEKLLAYEHELIQQSHVEETKKNRKGIAVKVNSSKEDCQESSSDDKDEENLSLMVKKLENSQRSKIENL

SEQ ID NO: 176775 - protein, 103 aa, Glycine max
  Coding DNA Sequence Number=SeqID_85090
  Homolog annotation: Hit_ID=A5C0G9; Match level="QueryCoverage=72%, HitCoverage=19%, E-value=4e-11, Identity=40%"; Hit description =Putative uncharacterized protein
MEKSDKKTLKYKKGKKAYITWEDNDMDSSSDLENEIVNLSLMAKDYESEEDDSLKKSWYIDSGCSKHMTRDASKFTHISLKNSGHMTYDETTKIKPQIMLNAF

SEQ ID NO: 176776 - protein, 320 aa, Glycine max
  Coding DNA Sequence Number=SeqID_85091
  Gene Ontology: Mol. function=arginine decarboxylase activity; Biological process=spermidine biosynthetic process
  Homolog annotation: Hit_ID=Q83Q93; Match level="QueryCoverage=53%, HitCoverage=25%, E-value=3e-83, Identity=88%"; Hit description =Biosynthetic arginine decarboxylase
  Pfam annotation: Domain name=Orn_DAP_Arg_deC; Domain location=1-107; Score=90.5; E_value=5.3e-24; Accession=PF00278.13; Description =Pyridoxal-dependent decarboxylase, C-terminal sheet domain
MADKIYVNFSLFQSMPDAWGIDQLFPVMPLEGLNKSPERRAVLLDITCDSDGAIDHYVDGDGIATTMPMPEYDPENPPMLGFFMVGAYQEILGNMHNLFGDTEAVDVFVFPDGSVEVELSDEGDTVADMLQYVQLDPNTLLTQFRDQVKNTGLDAELQQQFLEEFEAGLYGGCAKQPEYNTRTALSTEVATRWGSDVHSTVKGVPAERVDSHPDEIVLINYSGQYQTGFDQRYSIRNSDLEYAVRDANFNSLPITRRYNNSTGKWQYAIAARVGTQYQLYVRNYSHSVDYEIVATVDGLDVLSGKAGSLNNNGYIVPAGG

SEQ ID NO: 176777 - protein, 233 aa, Glycine max
  Coding DNA Sequence Number=SeqID_85092
MTLLLSNILPSDRNADIPLQKYRLGSCPQDTQWTQRSPIGPWDFQLWLRASVSPTGCPFPPARSHHHDIGIVPTRHPVDPEEPNRALGFPALVTGLSVSPTGCPFPPARGSAHKTPSGPGGAQQGPGISSSGYGPLSILQGAHSPQQGITRARHSVDPEKSNRVLELPALITGLCQFYGVPVAPSKVIRPPTNRAFIKKYCAPRQAQGKTPQQRATDAPPPPLEFTSAHPQKG

SEQ ID NO: 176778 - protein, 219 aa, Glycine max
  Coding DNA Sequence Number=SeqID_85093
  Gene Ontology: Mol. function=motor activity; Cellular component=cell projection
  Homolog annotation: Hit_ID=UPI00016621D1; Match level="QueryCoverage =90%, HitCoverage=40%, E-value=1e-25, Identity=38%"; Hit description =UPI00016621D1 related cluster
RTTSPHLQRATRPAFRGLHVLTIRGLHVLTFRGLHVLTFRGLHILTFRGLHVLAFRGLHALAIRGLHVLTFRGLHVLTFRGLHALTFRGLHILAFKGLHTLAFRGLHVLTFRGLHVLTFRGLHALTFRGLHVLTFRGLHALAFRGLYILTIRELNVLAFRGLQALAFRGLHVLTFRGLHVLTFRGLHALTFRGLHILTFRGLHVLAFRGLHTLAIRGQH

SEQ ID NO: 176779 - protein, 261 aa, Glycine max
  Coding DNA Sequence Number=SeqID_85094
  Gene Ontology: Mol. function=transporter activity; Cellular component= integral to membrane; Biological process=transport
  Homolog annotation: Hit_ID=A6THJ8; Match level="QueryCoverage=100%, HitCoverage=88%, E-value=1e-136, Identity=91%"; Hit description =Putative SN-glycerol-3-phosphate transport system permease
  Pfam annotation: Domain name=BPD_transp_1; Domain location=56-257; Score=68.5; E_value=2.3e-17; Accession=PF00528.13; Description =Binding-protein-dependent transport s
MCCLALLWVSPFIWMLATSFSATTFGEDMASLLPRLPLTLDNFRDAWDSADWLSLYANTLIFTFGTFFVQLLTITTAGYVFACHEFRGKKMLFLLFLVQLMIMPVVMMVPNMLTLKTFGLLNTLTGVMMPYFTSAFGVFLMRQAFLAIPKELEEAALMEGCRWWQVLFRVLLPMSWPSVLAFATVSITYHWNEYLWPLMMLNDPDKQVLTVGLVSFAMGAESGGQWGTIGAGTLMVCLPLMLAFILFQKQFLRSFGFSGIK

SEQ ID NO: 176780 - protein, 103 aa, Glycine max
  Coding DNA Sequence Number=SeqID_85095
FSCPTPDQFRAEVAWPGDWPKAQAGEAPPEAPGDGEEAHEDEEMADCLTSWEGVETRDWEIPRFMVNAVKFPGRPKWTRMNAQIDKRTYFGNIGLIKNRGNES

SEQ ID NO: 176781 - protein, 80 aa, Glycine max
  Coding DNA Sequence Number=SeqID_85096
MKQNAIITCLLQGMLSQRALRGRARAGLTGALSKGGKMRGVATNEGISTSHVDKSGAFAPMYPPSKRKSDLRSSFLCVNQ

SEQ ID NO: 176782 - protein, 96 aa, Glycine max
  Coding DNA Sequence Number=SeqID_85097
MRGIVHKPQRATRPRLQRTTHPHLQRTTHPRLEDYTSSPSEGYTPSPSEDYTPSPSEGYTSLTIRGLHASSPSKGLHALAIRGLNVLIFRGLHPRL

SEQ ID NO: 176783 - protein, 107 aa, Glycine max
  Coding DNA Sequence Number=SeqID_85098
MSSIVAGIATYKTPSGPEEVHRALGFPTLITGSVSPTGRPSPSKGHARKTLSGPEEFRQVLELPALITGLCQFYGVPVAPSKVISPSTNRAFIKKYCAPRQAQGETP

SEQ ID NO: 176784 - protein, 80 aa, Glycine max
  Coding DNA Sequence Number=SeqID_85099
  Subcellular localization annotation: CTP_CleavageSite=30; ConfidenceScore=5.02e-01
MYLLLFSVTTAQVDVPSTCTTKDVPSNVLRQSSQAVSPLKHCEGETKDISDEQGLETRKLRKLLAKEEEEEVQEDVQKVV

SEQ ID NO: 176785 - protein, 178 aa, Glycine max
  Coding DNA Sequence Number=SeqID_85100
  Homolog annotation: Hit_ID=A2Q4L4; Match level="QueryCoverage=75%, HitCoverage=17%, E-value=2e-11, Identity=28%"; Hit description=RNA -directed DNA polymerase
MTNANYPQESLHSVSNGNLRTFNAALLGKWRWDLFHKHEEPWAKLLDSKYGGWRALEEGKTANQDSIWWKDLISILHQQQNSAIRKETGWIVGGGDKFIFWEDPWLDTAMPLWEKYPSTGWEWNLTWRRDLFESELLLADTFIGEDKWIWKHGHSGHYSSKSGYDLIWRELRRVNPEF

SEQ ID NO: 176786 - protein, 113 aa, Glycine max
  Coding DNA Sequence Number=SeqID_85101
DDSDDDDYKISNSYVEDSFDEEEDIDDISDTDEEGGSGIAFWESASNYSNINWSHPDEEDIYGFDMGSTFNIGQELFVGMEFESKNALQQYVMKVHQTFKVVESKSQKYVVAA

SEQ ID NO: 176787 - protein, 108 aa, Glycine max
  Coding DNA Sequence Number=SeqID_85102
MAPRKLASKRSRKDATAEGTSAAPEFDSHRFRSAEHQQRFKAIKGWSFHRERHVQLRDDEYTDFQEEIARRRWMLLVTPMAKFDPDIVLEFYANAWPTEEGARDLRSW

SEQ ID NO: 176788 - protein, 144 aa, Glycine max
  Coding DNA Sequence Number=SeqID_85103
RRNLGKERVPERVGIDFGSALWFALRLLGRSSSFTFCLSSSLSQTGLRFRDCNHIVEFVFVEFVSATYRLSSKKTRKGKSPGKGGKRFWKSIVVGFKTPREAIEGDLFVFFSRCQVPLGICILKVMDLSHLMLRDVFLKSNKLV

SEQ ID NO: 176789 - protein, 80 aa, Glycine max
  Coding DNA Sequence Number=SeqID_85104
ELALPPKPEVGPSATCVNTKKSCVDPSGNDPNKGELEKCGLDVEENPPHLVALGRLYDESTTVHNIPLGNDQVKVGVGEV

SEQ ID NO: 176790 - protein, 124 aa, Glycine max
  Coding DNA Sequence Number=SeqID_85105
  Subcellular localization annotation: CTP_CleavageSite=58; ConfidenceScore=5.44e-01
MACPLTYVPKEPSWTSLNKSSASLAFTQRSRAMSWFLLYSMLPLMKKLAANLLNILLSLSEASGGCYLLSTYCLISKYQGLPSRSSSTRQQCAGLPRHQNSIYGRSPCGVSWNMDAKVVNASAI

SEQ ID NO: 176791 - protein, 29 aa, Glycine max
  Coding DNA Sequence Number=SeqID_85106
MELEEGIWESEGVEAETGGDRSGLRLKQE

SEQ ID NO: 176792 - protein, 118 aa, Glycine max
  Coding DNA Sequence Number=SeqID_85107
QSSIVESFSSSRADPLDWEIKEEGVETRVVITERAGWTKSVSYLCFPLISDKSPETIQKSKGSRLAQSVKFRDVAEIEKRSFLQKVVASGGSNLARLGELGGKLLPYFAINRREVKKK

SEQ ID NO: 176793 - protein, 54 aa, Glycine max
  Coding DNA Sequence Number=SeqID_85108
MPCTNPKRAFAKRDIQWLSARKNPEEDELSSSLSAPLQVIKRTASAHPLSETSD

SEQ ID NO: 176794 - protein, 278 aa, Glycine max
  Coding DNA Sequence Number=SeqID_85109
TYQGNPCGVYPDLSSFTGSGIIQNSVTCIKRFVPSKDHISSEEHQWRFEEIKDWSFLKERRVQLAEGKYIEFQTEIAKRHWTQLAEPMPKYDPAIVMEFYANACPTEEGVTDKCSKVRGQWIPYNTDATNQFLGNPLILEEGQQCEYTARRGQTIGFDEEAIDQLLCFPEHDFVWSMARKWLRIMQTKMTTLTQIWMTFLLNNILLSDHNSNLTLPKCQLVYNIMEHITVHVAQLIQMLSISLLVQQQEQDQQHQPAADALPPPPPHQPPSLESISAP

SEQ ID NO: 176795 - protein, 145 aa, Glycine max
  Coding DNA Sequence Number=SeqID_85110
MATVQHLVMDNKMRRPIIYRTKPYLNKTFKEATKAIKVSIANQKNTNASIKNLEVQVGQLAKHLSKHGSGSFLVTTQDNDKKNNKEGVEKENEKNDEVVTSEKVEEKVMAPKKLTSKRARKTTVGEGSSTTPPVENEFAGHRFRS

SEQ ID NO: 176796 - protein, 54 aa, Glycine max
  Coding DNA Sequence Number=SeqID_85111
MEIFIQSIDPGAWNAIIKGRFIPNEELNEEDAGFQEKDYALEDDIKAKELEQSK

SEQ ID NO: 176797 - protein, 162 aa, Glycine max
  Coding DNA Sequence Number=SeqID_85112
MTTLTQTWMTLLLSNVLPSDHNSDLPLLKCQLVYAILTRMSVHVAQVIADAIYLFAVIRPPITRAFVEKYYTPRLAQGDAPQATDSPPPPHQADPVGSLGIERYLQHLVRQQEANHRGQPQSVGAGFHSFCMPYSRAVWDSGRMAQRLARGPGRGGAHRIPR

SEQ ID NO: 176798 - protein, 93 aa, Glycine max
  Coding DNA Sequence Number=SeqID_85113
MPFCGRARRGSRVRFPKEERCAESPPTFICGKRWKNRRKPVIKNIQSLGVVFTFEEGGHFKAFDLKNDPFYLVRKRLKRSVKARQKRKKRNRY

SEQ ID NO: 176799 - protein, 368 aa, Glycine max
  Coding DNA Sequence Number=SeqID_85114
  Gene Ontology: Mol. function=binding; Cellular component =mitochondrial inner membrane; Biological process=metabolic process
  Homolog annotation: Hit_ID=A7QPS9; Match level="QueryCoverage=100%, HitCoverage=80%, E-value=2e-79, Identity=35%"; Hit description =Chromosome chr10 scaffold_138, whole genome shotgun sequence
  Pfam annotation: Domain name=PPR; Domain location=18-52; Score=1.2; E_ value=5.6; Accession=PF01535.11; Description=PPR repeat
  Pfam annotation: Domain name=PPR; Domain location=235-269; Score =39.8; E_value=9.5e-09; Accession=PF01535.11; Description=PPR repeat
  Pfam annotation: Domain name=PPR; Domain location=325-359; Score=1.8; E_value=4.7; Accession=PF01535.11; Description=PPR repeat
  Pfam annotation: Domain name=PPR; Domain location=84-118; Score=38.4; E_value=2.6e-08; Accession=PF01535.11; Description=PPR repeat
  Pfam module annotation: Pfam domain module=PPR::PPR::PPR::PPR; Domain location=18-52::235-269::325-359::84-118
ALLVFNEMCLLGVKSNEFTFPSVLKACSMKRDLNMGRKVHGMAVVIGFESDGFVVNILVVMYAKCCLLADSRRLFGGIVEQNVVSWNAMFSCYVQSESCGEAVGSFKEMVRSGIGPNEFSISIILNACARLQDGSLERTDIAHPDVVSWNAVIGLLLVVFFTIACATMGFKELGRQLHSSLIKMDADSDLFAAVGVQDADIKPDPFICSFLLNVCGNLFAYADRAFSEIPNRGIVSWSAMIGGYAQHGHGKEALQLFNQMLRDGVTQPYYFGKLNEAVELVNSIPFEADGSVWGALLGAARIHKNIELGQKAAEMLFDLEPEKSGTHVLLANIYASAGIWENVAKVRKLMKDNKVKKEPGMSWNEIKD

SEQ ID NO: 176800 - protein, 129 aa, Glycine max
  Coding DNA Sequence Number=SeqID_85115
MSPSPLGSHNHSQTHLKLSEQLPLQALVSADLHIAKSLKTLWNLNLSLSRITRHVLYTKVSHIHRLTSTRLQLLPQVLPLRWTRLTHVQSKHSFPPYGLPPKYTPPNVAHAPDDNVDNSAPVPIESQQP

SEQ ID NO: 176801 - protein, 110 aa, Glycine max
  Coding DNA Sequence Number=SeqID_85116
MSSALSNQLAWASTACLVSTNKLLFDPKITKTEKKNKEKKNQATTKPQGESSSIDSPSPKQPLTIDSMAGKGGVGNRPPRRTLGDYAYQQGPKHYKSILIPPFSNKVVEL

SEQ ID NO: 176802 - protein, 121 aa, Glycine max
  Coding DNA Sequence Number=SeqID_85117
MEAGSLSFNEEEGVSPPRIALDKKLEEDALMEEKKERRGEHEIEGIKEGEKWNFEAYENPSTFPWISGPIYLESSIQCPCGVGLHHSLHLGKDLTSNPEVRSENPFPGHLLMKEHGFSPTQ

SEQ ID NO: 176803 - protein, 63 aa, Glycine max
  Coding DNA Sequence Number=SeqID_85118
MFFHMKDFYVTKEPSSVSSYGTTLFRMFIRKKELSYMTSWKIVCGSLRERPMLEVLGRDVDCA

SEQ ID NO: 176804 - protein, 76 aa, Glycine max
  Coding DNA Sequence Number=SeqID_85119
MVNKPFETSEGTQGTIVPKDNLLEYPNCPSHNSRPIWALQKIPPEGGCFWRKQPCSPGRAKLAWASWAASISPILL

SEQ ID NO: 176805 - protein, 274 aa, Glycine max
  Coding DNA Sequence Number=SeqID_85120
MVPSMWTIEVKRMFMEGVLLGAPSSIADAPNNFPLFQYCPPVKFDGRTSSVTFNGRSREEEGGEGGGGRGGGRGSSKLVVQNHLRQLPLHVTLLLSIKSAASLARTHCQGMLQALPELAVKGVEGGGGGRNKGGDCSELVGVEGEGEGGTMGGGCSELVVQNHLRQLPLHEQGGEEGERGGRKKGEGEWQEGGEGGHTMAVAASLVSTCCLRKQIYATLLNWGHNDERWLWTIGTIGSSKKLRDRLECASAATLVASKSGQDIVAFIYHDLTQQ

SEQ ID NO: 176806 - protein, 38 aa, Glycine max
  Coding DNA Sequence Number=SeqID_85121
ECPETHLQNLRTNLWGLRNRPHMQRASLHQNNNRVKEE

SEQ ID NO: 176807 - protein, 58 aa, Glycine max
  Coding DNA Sequence Number=SeqID_85122
  Gene Ontology: Mol. function=structural constituent of ribosome; Cellular component=ribonucleoprotein complex; Biological process =translation
  Homolog annotation: Hit_ID=P26871; Match level="QueryCoverage=100%, HitCoverage=46%, E-value=4e-24, Identity=93%"; Hit description =Mitochondrial ribosomal protein S12
  Pfam annotation: Domain name=Ribosomal_S12; Domain location=1-58; Score=38.2; E_value=2.9e-08; Accession=PF00164.16; Description =Ribosomal protein S12
CLRVSTRTPKKPNSALRKIAKVRLTNRKEIIAYIPGEGHNLQEHSVVMVRGGRAKDLP

SEQ ID NO: 176808 - protein, 145 aa, Glycine max
  Coding DNA Sequence Number=SeqID_85123
MQRALRSKTPLPYPHLITLFLRHFDVLLDSETFVQVKRSFSNGAGVVTSFGYRKERDGSWVKKDIPAQAAKDRSPSPPPQRDDSSSLMKSILDRLDGLHTYVGERFDTLESRIDTQFADMDTHIDRLEEDVSFIRQCFDLPPPPS

SEQ ID NO: 176809 - protein, 56 aa, Glycine max
  Coding DNA Sequence Number=SeqID_85124
MAIFADMVEKCIEVFMDDFFFFGSSFDCCLENLECCVGPEKRQNLPCYLLCWQGFE

SEQ ID NO: 176810 - protein, 73 aa, Glycine max
  Coding DNA Sequence Number=SeqID_85125
MAGFRPDRCGEAGADHAHQHDYLTQIWMTLLLSNVLPSDHNSDLPLPKCQLVYAILTRMSVHVAQEWRLLGTL

SEQ ID NO: 176811 - protein, 346 aa, Glycine max
  Coding DNA Sequence Number=SeqID_85126
  Homolog annotation: Hit_ID=Q6Z8F0; Match level="QueryCoverage=18%, HitCoverage=58%, E-value=5e-21, Identity=79%"; Hit description =Putative uncharacterized protein P0459B01.18
SGHDGALTLSGAPFQGTWARSATEDASPDYNSDAEGDRFSWWAFPGSLAVTKGILRVAPPDLRSRWERACTQRVVDGSRTDRLARDWSRAWLIHHFITAKSAMNPDFNQPRGGCSREVSIHPAQQHCYMFALGKRCVTPRQACPRPNGFGRNLRSKTRWFTGFCNSHQVSHFATFFIDARAEISVAESHCIAGVCVVARTRSGRTGRRGHPLPPDGIDNDPSAGSPTETLLRLLLPLNDKVQWTSHNVAGSEPLTSPQSEHFTGPFNSARSDGRLRSRSLTELTRQIAPPTKNGHAPPPIESRKSSQSVNPYYVWTCLATILPPEPKDFDFSYGASGVLKQHPLIL

SEQ ID NO: 176812 - protein, 84 aa, Glycine max
  Coding DNA Sequence Number=SeqID_85127
MKVEKSWHIDSGCSKHMAGDASKIIHISPKDSEYVIYGDNKQSRLPLMCNRLPATELLKFNLKRHDPSKYNCVIDYQKPVIDYQ

SEQ ID NO: 176813 - protein, 117 aa, Glycine max
  Coding DNA Sequence Number=SeqID_85128
MAYERGGDFLEDARKILNREAFPPGGSLVRSPVPAFRFTGVIPLLWPRLSHSTPDTQFRVGSSLQAGLYARTPRFSPTAAPYPAKLKGQVLVTALLQASYLGSRVGSSENLRKPPCR

SEQ ID NO: 176814 - protein, 104 aa, Glycine max
  Coding DNA Sequence Number=SeqID_85129
MATARWALKHPVYGIVILRLGIYTDRPNVSKTTFLNEKLYTVPEFQQTLLTTTKHESGDPTVMWLRMPPDSCVTVTKSGVVDKSRAFAPTYPQFVMRNSDLRSS

SEQ ID NO: 176815 - protein, 79 aa, Glycine max
  Coding DNA Sequence Number=SeqID_85130
MELASKEVYPNLKFEVPQCRGALHDSENGFLSRFGAEMFLWFQSLAFLCTHRGQFSKVGNIYIKTLKMKPRAWFRGWFC

SEQ ID NO: 176816 - protein, 115 aa, Glycine max
  Coding DNA Sequence Number=SeqID_85131
MPPHQAPSRPDKSNRALGFLALITGLCQSFGVPVTPNKVIRPPITRAFIEKYCTPRQAQGDAPQGADAPPPPRQADPAEPLGMERYLQHLVRQQAANHRGQVQIHKCLYSFSHSQ

SEQ ID NO: 176817 - protein, 178 aa, Glycine max
  Coding DNA Sequence Number=SeqID_85132
MSHHSSSVNGEEAKGEESSESEEAKGEESSEEIYPQEDGQPLVVKKKCKEVSVSSKRLAKKETHFTIKTNIKENFPLRQPPHFLFCKKTLVSTATPLGLEVIPQVKELLDEGLVRKSFNPCALLVPKIGIIWHQIPTISDMMNVLSVATLFCKISHAPNIFMIDVHRDSLGRCSYGTP

SEQ ID NO: 176818 - protein, 80 aa, Glycine max
  Coding DNA Sequence Number=SeqID_85133
MTSPSKQEAGQTESEKDDVATYPSAGGRRETRGMRVPRKEYARSRHQRLFEENVGKTGKDAIYELLSERFGSCIYARGRY

SEQ ID NO: 176819 - protein, 111 aa, Glycine max
  Coding DNA Sequence Number=SeqID_85134
MCNVTGCRKKAQAIQKQNTAPHVLSHGGYDFLEQKLMEEKKKKRLEEATQSRSTDIIVDPPSPIRRHMKWKMASQLSFVVDGRQDVLTATIGRLEYPSRVLAAGVVVTIKQ

SEQ ID NO: 176820 - protein, 84 aa, Glycine max
  Coding DNA Sequence Number=SeqID_85135
  Homolog annotation: Hit_ID=A0PAV3; Match level="QueryCoverage=45%, HitCoverage=17%, E-value=5e-07, Identity=76%"; Hit description =Restriction endonuclease
MVKVGTSYVPINVSFSPKVGPGLPGINRDTRIYLFCEVIFRHRCSSGFCFYQLSPPVQLLTGWCVPAKAPPDISAHKSCCHYAS

SEQ ID NO: 176821 - protein, 191 aa, Glycine max
  Coding DNA Sequence Number=SeqID_85136
  Homolog annotation: Hit_ID=Q84VI1; Match level="QueryCoverage=98%, HitCoverage=27%, E-value=1e-71, Identity=76%"; Hit description =Envelope-like protein
MASSPKETSASGSPAVPSSPHQEQPEFNIQPIQIIPGQASVPEKLIPRRQQGVKIAENPSLATSSREVDKEMDKKIRSIVSSILKDASVPEADEDVPTSSTPNVSVPDVEKDVPTSSGPNAEGLSSPSKERSTEEDDQATKETPAPRAPEPAPGDLIDLEEVESDEEPIANRLAPGVAERLQSRKGKLPSR

SEQ ID NO: 176822 - protein, 158 aa, Glycine max
  Coding DNA Sequence Number=SeqID_85137
  Homolog annotation: Hit_ID=O69421; Match level="QueryCoverage=17%, HitCoverage=28%, E-value=1e-07, Identity=100%"; Hit description=InsA protein
  Pfam annotation: Domain name=Ins_element1; Domain location=38-94; Score=-17.0; E_value=0.0057; Accession=PF03811.4; Description =Insertion element protein
  Subcellular localization annotation: CTP_CleavageSite=67; ConfidenceScore=5.72e-01
MVKVGTSYVPINVSFSAKSWPRASPVFIRRKSASGAPVASVSISCPSCSATDGVVRNGKSTRRTSALASVAVTLRVTTTPAALNAPLQGASHSPFRLRNCWEGRSVRASSLLRQLAKGGCAARRLSWIGRRSNYYKLVSVHWPKGTCDSTMARPGRSR

SEQ ID NO: 176823 - protein, 92 aa, Glycine max
  Coding DNA Sequence Number=SeqID_85138
MAEIERKYCYAIRPLGPSRMFLQKAVASGGSNLARLGELGGKLLPYFPSRGASVTFPCVILRRFSTVLRRSSSFFGLQPSCRNHVGNQKEVK

SEQ ID NO: 176824 - protein, 35 aa, Glycine max
  Coding DNA Sequence Number=SeqID_85139
MANQQATKTKAKGSKIPWICMYIAKIPHKNIQMFR

SEQ ID NO: 176825 - protein, 241 aa, Glycine max
  Coding DNA Sequence Number=SeqID_85140
  Gene Ontology: Mol. function=unspecific monooxygenase activity
  Homolog annotation: Hit_ID=Q5CEG7; Match level="QueryCoverage=37%, HitCoverage=84%, E-value=7e-36, Identity=82%"; Hit description =Senescence-associated protein
  Subcellular localization annotation: CTP_CleavageSite=37; ConfidenceScore=5.56e-01
MNAWLPQASYPCGNFSDTSSFKFRRTKGSIGHAFTVRIRTGNQNQTSFYPFVPHEISVLVELILGHLRYLLTDVPPQPNSPPDNVFRPDRPAEADLGSKKRGSAPLPIHGIKAPKGPFPIVPDGTRRPALARKQLEQSTDSDGFGTGTPVPSPQSQSFSRGYGSILPTSLAYIVPSTRGCSPWRRDAVMSTTGRGRHSVLRIFKGRRGRTGHHATCGALPAAGPYLRLSRFQGGQAVKQKR

SEQ ID NO: 176826 - protein, 80 aa, Glycine max
  Coding DNA Sequence Number=SeqID_85141
MCPNMALSWSYSLVLKDQRRKLATSHKFILPHLPEVRMKDEQIQDTYGAALQKREEPNQDPTTEDTGNPTQLNQKTPKDW

SEQ ID NO: 176827 - protein, 586 aa, Glycine max
  Coding DNA Sequence Number=SeqID_85142
  Gene Ontology: Mol. function=pyruvate kinase activity; Cellular component=chloroplast; Biological process=glycolysis
  Homolog annotation: Hit_ID=A5BTB0; Match level="QueryCoverage=45%, HitCoverage=46%, E-value=1e-113, Identity=78%"; Hit description =Pyruvate kinase
  Pfam annotation: Domain name=PK; Domain location=116-407; Score=97.1; E_value=5.3e-27; Accession=PF00224.12; Description=Pyruvate kinase, barrel domain
MATPSPLQPLKTTIHHQPPLHLYYPPQDLFPSLPCPHPSPQPILKSSSLSQKLTHLCPSTQKLKSHYTRMEPFRKNHIDIQLLCNDETPHSYVCALWFLKQLDVYFLLFDGWVVDACQLFDDIGWVADATSARPFIKWFCSGAIRSKYLAHAQPNPHEMLPQHPTFHDSAYPKRMLDKRVAILFCATWTCVLFGKGGMMSMVVKSKTKDSVKYEVVDGGKLKSRGNCATLPSITEKDWDDITFGVDNKVDFYVVSFVKDAEFVHELKNYLKSCGADIHVIVKIESAESIPNFHSIITASNGAMVARGDLGTELPIEEVPLLQGEIINLCHTMGKAVIVATNMLDSMIVHPTPTRTEVSNIAIVVREGSDGIMLSGETAHGKFPLKVVQVMHTVALWTEATIPSGKMPPNIGQVLKNHMSEMFAYHATMMSNTLGTSIIVSTGTGFMAQVVFLDHILIVTDRVTATENGLPPHKATPLFDKLAFEKTQQALGGHVPILLLGAASSPRLVEEICFSYTGINNLVLHFICCSSVDGAVRGLGGDDELDEGHRLGAHQIHWRQVSKEPIHFPGNGSSAPDLRKPFCFPLS

SEQ ID NO: 176828 - protein, 605 aa, Glycine max
  Coding DNA Sequence Number=SeqID_85143
  Gene Ontology: Mol. function=hydrolase activity; Cellular component =membrane; Biological process=proton transport
  Homolog annotation: Hit_ID=Q6L3J7; Match level="QueryCoverage=100%, HitCoverage=89%, E-value=0.0, Identity=64%"; Hit description=V-type ATPase 116kDa subunit family protein
  Pfam annotation: Domain name=V_ATPase_I; Domain location=1-603; Score= 180.8; E_value=3.6e-51; Accession=PF01496.10; Description=V-type ATPase 116kDa subunit family
MSRKLRFFEDQINKAGLMSSPSVLQTDIYLEDLEIQLAEHEHELIEMNSNSEKLRQSYNELLEFKIVLQKACRFLVSSHGNAFSEERELEENVFSNGDYIETPFLFEQEMRHAPSDQSGLRFISGIICKSKVLRFERMLFRATRGNMLFNHALADEQIMDPISTEMVEKIVFVVFFSGEQARTKILKICDAFGANCYPVPEDISKQRQITSEEIQQLKWQATGTAPISCSAYKVSSRLADLEATLDAGIRHRNKALASVGGHLTKWMDMEALQRATFDSSSQVGIIFHSMDALESPPTYFRTNSFTSPYQEIVDAYGVARYQEANPAVYTTIIFPFLFAVMFGDWGHGICLLLGALVLIARQSKLSTQLASIGKLFSSQLAGKSFRVAFSKLSQDEDVHSAGCGAHELGNSFKLFQCSFLWQFAGYKFVPQMIFLNCLFGYLSLLIVVKWCTGSQADLYHVMIYMFLSPFDNLGENQLFWGQRPLQVVLLLLAVIAVPWMLFPKPFILKKLHNEVPLLPPLFQGRTYGVLNNSEVDLELEPDSARQHHEEFNFSEVFVHQMIHSIEFVLGSVSNTASYLRLWALSLAHSELSTVFYEKVLLLAWG

SEQ ID NO: 176829 - protein, 119 aa, Glycine max
  Coding DNA Sequence Number=SeqID_85144
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=53%, HitCoverage=63%, E-value=7e-30, Identity=98%"; Hit description=LacZ protein
MDSNLVNPKLQAKKRDPLESTCRHASLALAVVLQRRDWENPGVTQLNRLAAHPFASWRNSEEARTDRPSQQLRSLNGEWDAPCSGALSAAGVVVTRSVTATLASADVRRCFCRYAPPRQ

SEQ ID NO: 176830 - protein, 508 aa, Glycine max
  Coding DNA Sequence Number=SeqID_85145
  Gene Ontology: Mol. function=transcription factor activity; Cellular component=nucleus; Biological process=regulation of transcription, DNA-dependent
  Homolog annotation: Hit_ID=A5AWA3; Match level="QueryCoverage=100%, HitCoverage=100%, E-value=2e-94, Identity=41%"; Hit description =Putative uncharacterized protein
  Pfam annotation: Domain name=AP2; Domain location=264-315; Score =57.1; E_value=6.2e-14; Accession=PF00847.11; Description=AP2 domain
  Subcellular localization annotation: CTP_CleavageSite=46; ConfidenceScore=5.15e-01
MLDLNLNAEWTDSFSNGDSPLPSQKFPEGSRNQMAESGTSNSSVVNADGSSNGGGDEDSCSTRADDVYTTFNFDILKVEGANDVVTKELFPVMSEGAKGHATSSFSARNGFVDLSFDREGGDSEMKMLQPQNQPQTQTQTQQPAKKSRRGPRSRSSQYRGHLLTKLVFELVGGFDTAHAAARAYDRAAIKFRGVDADINFNLSDYEDDLKQVRRIRSNLLDMKLDGAYDLFFHQFLTGQMKNLSKEEFVHILRRQSTGFSRGSSKYRGVTLHKCGRWEARMGQFLGKKYIYLGLFDSEVEAARAYDKAAIKCNGREAVTNFEPSTYEGEMKSAAINEGGGQNLDLNLGIATPGPGPKENWGQLHFPSIPYNTHGGRSSKMETNVNSGIGNPSLKRMVVTEDRPSLWNGMSPNFFPNGERAERIGIDPSKGLPNWAWQTHGQVNATPVPSFSAAASSGFSISATFPSTAIFPTSSMNSIPQSLCFTSSSSPTRNVSEYYYQVKPPQAPP

SEQ ID NO: 176831 - protein, 98 aa, Glycine max
  Coding DNA Sequence Number=SeqID_85146
  Subcellular localization annotation: CTP_CleavageSite=47; ConfidenceScore=5.37e-01
MGQMATQLNQVQSKNSDRLPSQTMQNPKNVSAITLRSGKQIEVSPPVAAPAPEPVKLHSIPEKEDEPTAQKRKLHDHEGANKNFHAGGPSSSSSNLQL

SEQ ID NO: 176832 - protein, 154 aa, Glycine max
  Coding DNA Sequence Number=SeqID_85147
MVKSWNLLRADQRLIFAKSWPRASRYQQGHQDLFILRSDLPSQVLQWLLFLSAVPPCSATDGVVRNGKSTPRTSALASVAVTLRVTTTPAALNAPLQGASHSPFRLRNCWEGRSVRASSLLRQLAKGGCAARRLSWVTPGFSQSRRCKTTASEL

SEQ ID NO: 176833 - protein, 175 aa, Glycine max
  Coding DNA Sequence Number=SeqID_85148
LDFENLPVEDRRTTKNDEESSRNRSRKRIGSVTEARRRTQGGGCRPARLGELGYFYQNAPPSVGTPWKAQNFTDCLTMGVKYLEAVKRRLHATKNEIREMAPKKLPAKRSRKDSTEEGSSVAPQADADFDRHRFQSAEHQQRFETIKGWSFLRERWVQLRDDEFPNFQEEIAHRH

SEQ ID NO: 176834 - protein, 302 aa, Glycine max
  Coding DNA Sequence Number=SeqID_85149
  Homolog annotation: Hit_ID=Q84VI1; Match level="QueryCoverage=100%, HitCoverage=46%, E-value=1e-119, Identity=74%"; Hit description =Envelope-like protein
MATSPKEISASGSPSAPSSPHQEQPEFNIQPIQIIPGQASVPEKLVPRRQQGVKMSENPSLATSPREVDTEMDKKIRSIVSSILKDASVPEADEDVPTSSTPNVSVPDVEKDVPTSSGPNAEEDDQATKETPAPKAPEPAPGDLIDLEEVESDEEPIANKLAPGIAERLQSRKGKTPIKRSGRIKTMAQKKSTPITPTTSRRSKVVIPSKKRKEISSSDSDDDVEPDVSTSKRAKKSGKKVPGNIPDAPLDNISFHSIGNVEKWKYVYQRRLAVERELGRDALDCKETMDLIKAAGLLKTVT

SEQ ID NO: 176835 - protein, 155 aa, Glycine max
  Coding DNA Sequence Number=SeqID_85150
  Homolog annotation: Hit_ID=Q6UUU1; Match level="QueryCoverage=73%, HitCoverage=95%, E-value=3e-37, Identity=61%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGNGGETRQDYKDTRRFPLAAPSCALLFLPFGLPVSFRCYGRVCLIPPPDTQFR

SEQ ID NO: 176836 - protein, 171 aa, Glycine max
  Coding DNA Sequence Number=SeqID_85151
  Homolog annotation: Hit_ID=Q2HS67; Match level="QueryCoverage=92%, HitCoverage=39%, E-value=2e-14, Identity=35%"; Hit description =Cyclin-like F-box; F-box protein interaction domain
  Pfam annotation: Domain name=F-box; Domain location=7-54; Score=36.5; E_value=9.9e-08; Accession=PF00646.24; Description=F-box domain
MRPEKKPWSSLLCNEIIEEILSRLPVKPLIPFKCVCKGWNSLMSEPYFIKLHLSKSAGKDDLEHLQLIKNVCLGSIPEIHMESCDVSSIFHSLQIQAFLFKFANMPGYHLVGSCNGLHCGVSEIPEGYRVCFSNKATRVISRESPTLSFSPGIGRRTLFGFGYDPSSDKYK

SEQ ID NO: 176837 - protein, 148 aa, Glycine max
  Coding DNA Sequence Number=SeqID_85152
  Homolog annotation: Hit_ID=Q6UUU1; Match level="QueryCoverage=72%, HitCoverage=95%, E-value=5e-23, Identity=48%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPGVSPWRLPRALSLFLPFGLPGSFRCYGRVCLIPRLTTQS

SEQ ID NO: 176838 - protein, 82 aa, Glycine max
  Coding DNA Sequence Number=SeqID_85153
MVAGNTTIEKPREEWSEEERRLVQYKLKAKNIITSSLGMDEYFRVSNCKSAKDMWDTLQEYEMELQRLNQHEEMIRRRKELL

SEQ ID NO: 176839 - protein, 223 aa, Glycine max
  Coding DNA Sequence Number=SeqID_85154
MAFLGETSSLTIMNSKLAFIFPNGSIIHNEINVYFQSSTPIPIRVPNACGFQTLKSRMHNTLQLTDKQYLDEIYYWQPFTDAHNQFCFQFMQLKNDDDVNTMVMCNHQFSCVGLIELLCIIGRTLNAILNLLQATMTPTHDALLYYNGKWNMPRQHDFVGYSFAGKNPKNFDIPSGCTIDELKDLIKQVAPQGNPPYGHYEYSDKVIKFEIIELKTDDDMLRS

SEQ ID NO: 176840 - protein, 87 aa, Glycine max
  Coding DNA Sequence Number=SeqID_85155
  Gene Ontology: Mol. function=catalytic activity; Biological process =metabolic process
  Homolog annotation: Hit_ID=Q946Z2; Match level="QueryCoverage=71%, HitCoverage=11%, E-value=2e-21, Identity=80%"; Hit description =Putative acyl-CoA synthetase
MYQHFVVYKKTLLFENRRFLFEPLLIYCAVIPREGSNIDDAEVLRYCKKNLASFKVPEKVFITDSLHKTATGKILRRLVAEHIVSQI

SEQ ID NO: 176841 - protein, 320 aa, Glycine max
  Coding DNA Sequence Number=SeqID_85156
  Homolog annotation: Hit_ID=A5AHQ6; Match level="QueryCoverage=66%, HitCoverage=22%, E-value=6e-07, Identity=21%"; Hit description =Putative uncharacterized protein
  Subcellular localization annotation: CTP_CleavageSite=45; ConfidenceScore=5.69e-01
MAEPSKKRKGSSSTATATAHRRHGPSGAPTAPIPPSLSSPRSSTLFSSDDQRLRYLSQFSSRIILDPKYLNVEFFNDETFDCYQVFQNSGLVDFMSFKLPYYPELVKVFYCNLKIQDGIIMSEVHGTSMVIDQSLFFSLTHLPSQGAPFEGTIVDDWKFDYSSHDARRISTGPHLVRYRMHKALRANAPLPYPHLITLFLRHFQIPLDDEPFVQVKRSFAIGAGAVTSFGYRKDRNGQWLKKDALPPQDERTPSPPPQREDSALMNEVLSELRGLRSYVGDHFDSLDSRFAGMDIRLTQLEEDVGYIRQSFDLPPPPPSS

SEQ ID NO: 176842 - protein, 124 aa, Glycine max
  Coding DNA Sequence Number=SeqID_85157
  Homolog annotation: Hit_ID=A0ST23; Match level="QueryCoverage=20%, HitCoverage=51%, E-value=3e-07, Identity=100%"; Hit description =Putative reverse transcriptase
GKPVVPAALMNRPTRGERRFAYWALAECILAYYVGTDEGEKKGCTGASAEYVIQDIFRFPRSLTRYARSFDCGERKWLTNGAEISWKMPGRYLTGKTIKIPGVSPGGSLVRSPVPAFRFTGVIP

SEQ ID NO: 176843 - protein, 300 aa, Glycine max
  Coding DNA Sequence Number=SeqID_85158
  Gene Ontology: Mol. function=DNA-directed RNA polymerase activity; Cellular component=chloroplast; Biological process=transcription, DNA-dependent
  Homolog annotation: Hit_ID=Q8HVY4; Match level="QueryCoverage=100%, HitCoverage=49%, E-value=1e-155, Identity=84%"; Hit description=DNA -directed RNA polymerase subunit beta'
  Pfam annotation: Domain name=RNA_pol_Rpb1_1; Domain location=5-149; Score=-159.1; E_value=0.018; Accession=PF04997.3; Description=RNA polymerase Rpb1, domain 1
  Pfam annotation: Domain name=RNA_pol_Rpb1_2; Domain location=139-267; Score=176.4; E_value=7.4e-50; Accession=PF00623.11; Description=RNA polymerase Rpb1, domain 2
  Pfam module annotation: Pfam domain module=RNA_pol_Rpb1_1::RNA_pol _Rpb1_2; Domain location=5-149::139-267
MDSSLIEWKELGEEGSPDNENEWEDRKVGRRKNFLVRRIELAKHFLRTNIEPEWMVLCLLPVLPPELRPIIQIDGGKLMSSDINELYRRVIYRNNTLIDLLTTSRSTPGELVMCQEKLVQEAVDTLLDNGIRGQPMRDGPSLSLHRCGLPREIAIELFQTFLIRGLIRKHFASNIGIAKSKIREKEPIVWEILQEVMQGHPVLLNRAPTLHRLGIQAFQPILVEGRAICLHPLVCKGFNADFDGDQMAVHVPLSLEAQAEARLLMFSHTNLLSPAIGDPISVPTQDMLIGLYILTSGNRR

SEQ ID NO: 176844 - protein, 71 aa, Glycine max
  Coding DNA Sequence Number=SeqID_85159
MGPKQVPRGFMGQQQRTQASKGRKGQVKVGKYDIRGQVEGLSKVRFHSEWESIASKVVSQSQGNGGRVLSS

SEQ ID NO: 176845 - protein, 115 aa, Glycine max
  Coding DNA Sequence Number=SeqID_85160
MTRGNPSNLQPFDPEIDRTFHRLVRHSVHPDHSVHFEHFEYSVAGDSEYSDFEHSTTNFHTENMAQPSSRERTLREMAAPDFTYESLCIQYPDEGVPYVLKTGLIHLLPKFHGLA

SEQ ID NO: 176846 - protein, 72 aa, Glycine max
  Coding DNA Sequence Number=SeqID_85161
  Subcellular localization annotation: CTP_CleavageSite=52; ConfidenceScore=5.16e-01
MANARGRTPPFPSCDVAIKRVPQYFPYKFVPSTCMIWLTVLESLFTLTKSPKNSMKLTVFATKHIPNDKIVM

SEQ ID NO: 176847 - protein, 80 aa, Glycine max
  Coding DNA Sequence Number=SeqID_85162
LARHLCEINNYSYRPLNPNLSSSSQRPRDSYPTDRIILQNTNDGQIRTEIYVPEPEFQKVEDLVDDYSALEQTGKTIMLN

SEQ ID NO: 176848 - protein, 129 aa, Glycine max
  Coding DNA Sequence Number=SeqID_85163
  Homolog annotation: Hit_ID=A2Q1D6; Match level="QueryCoverage=65%, HitCoverage=13%, E-value=2e-07, Identity=38%"; Hit description =Ovarian tumour, otubain, related
MDENQWMYDNIMSEEIDMNEKNENEAGVNEEPVDCSDAFNTSRVFATQDDVLQWARSVAYEIEFEAVTVIMRSYPNTGMRGRTLFLLIGCERSDQYRCRKKEFIRRNTGSWKCRCSFKLREKQVVVGQG

SEQ ID NO: 176849 - protein, 70 aa, Glycine max
  Coding DNA Sequence Number=SeqID_85164
MSFNKEEEVSRYGGREGVRSSGMGGGRSCLRTHWSSISFWYPKKATTPAPIANDHLTLTKGSSSKGTLQC

SEQ ID NO: 176850 - protein, 60 aa, Glycine max
  Coding DNA Sequence Number=SeqID_85165
MRTKQSMYEIKNLGYQGLREFAKRNLQWLSARKNPEEDELSSSLSAPLQLIKRTTSSSLS

SEQ ID NO: 176851 - protein, 63 aa, Glycine max
  Coding DNA Sequence Number=SeqID_85166
MSLVVSFSFVSYSFYRPKRGDHALSAIMSGLSEAFTRLAWDFALGAPLGFFEGLLRAKLELAH

SEQ ID NO: 176852 - protein, 68 aa, Glycine max
  Coding DNA Sequence Number=SeqID_85167
AVKPLILCEWGYKKNSQAGEGRHKRIQAVSSLFFWKREKRDTKRIQAKTRKLQKAFGTKKKKKFKEIQ

SEQ ID NO: 176853 - protein, 81 aa, Glycine max
  Coding DNA Sequence Number=SeqID_85168
MKLCSIKLGLSLGGNESTGNDKVKSDQGLPMDPKRIKVILEWPTPPSVEETIPEFQEPMDLRSNPFQEGGNDAILPPKGIG

SEQ ID NO: 176854 - protein, 104 aa, Glycine max
  Coding DNA Sequence Number=SeqID_85169
MDHDEGVVKGFALQPSRVGGAGLWPRAKFRIGWPPPPPRDQFCCQDFANFGFAPRWLSLCLGGGSSCHNMARHKGRDESKRQGLNLSGSWQQGHSATYNTPSRI

SEQ ID NO: 176855 - protein, 124 aa, Glycine max
  Coding DNA Sequence Number=SeqID_85170
MVRTRGLGRALGHVTGRGVGRGDHDDSDDASQCRRPTASARRQQVLVTAVHDEPVVPVPDVETDVFSNDPMAPSDVKDIGADIPADTGAQATKDEHEGFPGGPSDPSVLTQYAGHVACSVWTGE

SEQ ID NO: 176856 - protein, 589 aa, Glycine max
  Coding DNA Sequence Number=SeqID_85171
MGPMLSPRELLGMTESASEGLLLGLRETVDKLLYGMPHLDRGDKKVLNTFVRTSNLIYMCRMIHSVLFNILMPKAFKDKFNPKVKKNPNLYGMLFTQILRLDGVEVSLMDPSSGATQLNGATFVKMGIAKNFPEYVQRHIKKEMIETPLSNVDQTIGTQANPLDLESGVSYQQAQGEQAKPSQPRHKLPIKRKDHPPSSNLQPLSSVKKPRTQPPSDLKKRKSSDSDSDHAPKPKKPTIKIKPFSLNHQLNLYHHLLNLLRTLDLLNQLQIARAEKAMKKKVEAETKKKVVTLEGQASKDIPENFIIESLKTSTKKEELRQTIASDQVPDEVVLEAIKVVFKEDLQKAEFDANVDTKLQPAMVEDAIAKEESKALDVTMLQYVIKVSLQGFDVVAESDTVETNPGTSLDCKASMELLRMFTSMLWKLDWKLGRRSQPQTELELVLVLDENVKLFHGVKGYKLSKGKTSNQAWREKIDIDTQRLDLEMHKIELQKLNLIKLGKEDKPILIPKATCYKGKEKLLEDDKDTPPMALVDVVDMAIKVYNDPLPSQKKYVDAFLDSSSDENFGDVFFCKLEKKEEATIQKGEKK

SEQ ID NO: 176857 - protein, 257 aa, Glycine max
  Coding DNA Sequence Number=SeqID_85172
MGWVSLNCVSKKLFKFDSNVFLHKDHFFKFLTSDVVAYGLPLMFNQEEEPRFMFYWQFDLTSFKSLNEDLLTLLERVDKAILEQLSTLLDVRIILSVSDPLIALDSKVPYLVLFVSETPSSGCPSSLRDLPPTQLNVEAHTPIVAIVSAPPPPLVVPIQEIALAAKVDAPATSTGLVMVHHHCTLAECECGNHECSQDVVSSFFSSPGSSLGCDEKFGYYGGEWTAAPGGSEQGGVLGCKGGQMEGYCSHGLESGAP

SEQ ID NO: 176858 - protein, 43 aa, Glycine max
  Coding DNA Sequence Number=SeqID_85173
MVKEECKEVSREEAPEYQEPLDLRSNPFHGGGDDAILPLKGIV

SEQ ID NO: 176859 - protein, 64 aa, Glycine max
  Coding DNA Sequence Number=SeqID_85174
MESYPARALGRRLQVDWARDPREGPRVLMSLREVSLAIRELLKEVFSKKLLKEVFSRKLLKEAT

SEQ ID NO: 176860 - protein, 136 aa, Glycine max
  Coding DNA Sequence Number=SeqID_85175
VVPLPTSKIQYVRDAVNSFIGWPRHLVKPLSYDSDLNVRKPVEHSGDAKLAGESDPLGELMKILFYVYQNPVEVPWEANQSGLPDIGAKFYITHTDLAEIISGDKCLNIAILQLWTIVYAYMFLIEVGIVGARYAG

SEQ ID NO: 176861 - protein, 293 aa, Glycine max
  Coding DNA Sequence Number=SeqID_85176
  Gene Ontology: Mol. function=hydrolase activity, hydrolyzing O -glycosyl compounds; Cellular component=extracellular region; Biological process=cell wall organization and biogenesis
  Homolog annotation: Hit_ID=A7NSX3; Match level="QueryCoverage=40%, HitCoverage=26%, E-value=3e-35, Identity=58%"; Hit description =Chromosome chr18 scaffold_1, whole genome shotgun sequence
  Pfam annotation: Domain name=Glyco_hydro_9; Domain location=86-291; Score=-255.1; E_value=0.015; Accession=PF00759.10; Description =Glycosyl hydrolase family 9
IPPSSQDNVGSVGVLWVRPTTMWVSTERFPADFGREEKENSDFRQEDDKEKRPVTAIVFTVKKKFSHCGSDKPAPVPGPPGAVDQKYRTALKTAMQFFDDGSQAKLDLSKGMYDVGDNMKFGFSMAFTATVQSWSILEYGDQMDHVGQLDAAQYSLKWITDFLINAHPSENVLYIQCYCVMLMVWDIQSSMSPLLFVVAPGPHRQSCEMWKELQTKVAELPKAKPQKRKLHQGRGGNYYQATPKRITEGQNNVVIIDRMWARLLSSTNLPSFTIAKTVSKEKRQEEANDHVPE

SEQ ID NO: 176862 - protein, 74 aa, Glycine max
  Coding DNA Sequence Number=SeqID_85177
MGVEVLVIKISICRNLPHDRTAKAKSISQSVRLQGRKRAELPLTFIRENVRKTKKRFVDFENKGSGVVYAWGRY

SEQ ID NO: 176863 - protein, 252 aa, Glycine max
  Coding DNA Sequence Number=SeqID_85178
  Gene Ontology: Mol. function=1-acylglycerol-3-phosphate O -acyltransferase activity; Cellular component=integral to membrane; Biological process=phospholipid biosynthetic process
  Homolog annotation: Hit_ID=A7PFR4; Match level="QueryCoverage=78%, HitCoverage=62%, E-value=9e-71, Identity=65%"; Hit description =Chromosome chr11 scaffold_14, whole genome shotgun sequence
  Pfam annotation: Domain name=Acyltransferase; Domain location=168 -251; Score=4.5; E_value=0.00036; Accession=PF01553.12; Description =Acyltransferase
MEVTPLSSPSPIHRLHLRHKEARFLAVPSTLLCTRRGTTTYVHPILRTSHNSPPCSLQAISKKHENVSWLSVSPKLHVQNKFPRDVVVRSELTAAGSAGDGYLLPELKLESKVRGVCFYVVTAFSAIFLFMLMLVGHPSVLLFDRYRRMFHHFVAKVWAALTVAPFYKIEFEGLENLPPPDTPAVYVSNHQSFLDIYTLLTLGRSFKFISKTGIFLFPIIGWAMFLLGVIPLKRMDSRSQLVFFHYYYWNQF

SEQ ID NO: 176864 - protein, 115 aa, Glycine max
  Coding DNA Sequence Number=SeqID_85179
MIELLIKNFVPHCPEALRYAKAYLVESSIKPFSKSFKKYGFNKNKFGRKPSFSKNNKNAFNNNNKSKDKNTGNEVFFPFCGRPNHLAKNCCQRHHQPMSFLEPHTNVVTIVVALS

SEQ ID NO: 176865 - protein, 86 aa, Glycine max
  Coding DNA Sequence Number=SeqID_85180
  Gene Ontology: Mol. function=GTP cyclohydrolase II activity; Cellular component=chloroplast; Biological process=riboflavin biosynthetic process
  Homolog annotation: Hit_ID=Q82M69; Match level="QueryCoverage=100%, HitCoverage=37%, E-value=8e-18, Identity=53%"; Hit description=GTP cyclohydrolase-2
  Pfam annotation: Domain name=GTP_cyclohydro2; Domain location=1-60; Score=-92.2; E_value=0.01; Accession=PF00925.11; Description=GTP cyclohydrolase II
MDTVEANVALGLPVDARTYESAADMLSHFDINSIRLLSNNQEKRTALQSFGITINQQVPLLTTPTTENLKYLQTKSIKLGHLIPDL

SEQ ID NO: 176866 - protein, 185 aa, Glycine max
  Coding DNA Sequence Number=SeqID_85181
  Subcellular localization annotation: CTP_CleavageSite=38; ConfidenceScore=5.32e-01
MGILQKHYGCPGSPGIPFSTKRGVWWPPSLPRPAQLAQASSARPGELGCRRRCQSLHAIRLFVLQIAKRNVYTDNHSGISARQRDSKVNMTDLVSAEDDVNLRVSTGLSATIDEGRKDDVSLCMLSGFSSLQIAKRVYTDNHSGISARQRDSKVSVTDLLSAEDDVNLRVSTGLSAAIDEGRRKT

SEQ ID NO: 176867 - protein, 76 aa, Glycine max
  Coding DNA Sequence Number=SeqID_85182
MLCVIDYNDLGTSTWVVVTENMRRYISCGSVLVEGTSTRLFKENKEGYIPCGSLLVKAFSRLNRNVKDRRSLGDWM

SEQ ID NO: 176868 - protein, 463 aa, Glycine max
  Coding DNA Sequence Number=SeqID_85183
  Homolog annotation: Hit_ID=Q2HW90; Match level="QueryCoverage=99%, HitCoverage=96%, E-value=1e-107, Identity=45%"; Hit description =Putative uncharacterized protein
  Pfam annotation: Domain name=DUF1723; Domain location=31-80; Score =11.5; E_value=0.023; Accession=PF08330.1; Description=Protein of unknown function (DUF1723)
LLRLRELASLVSDPVDFQAHHGKLLRILRVDVEEGCLETLVQFYDPLYHCFTFPDYQLVPTLEEYSYLVGLPVPDKIPFHGFEPTPKPSDIAAALHLKTSIIQANLTSKGGLQGLPTHFLYQQASIFAEAASILAFHSILALLIYGLLFFPNVDNFIDINAIKIFLTKNPVPTLLADTYHSIHDRTQAGRGTISCCAPLLYQWFTFHLPQSRAFKTNDDKLSWPRRIMTLDPSDIVWYQAASDVGEIIVSCGEYPNVPLLGMRGGISYNPLLARRQFGYPIKKKPNNLALTNEFYLNHGDHSNKRERFAQAWSAIRRLNRSQLGKKSDYVHESYTQWVIDRTKSFGLPYRLPRYLSSTIPPSSLPIPFDTKEEFHEQLTKERQEKETWKRRCQELEQENETLKGKIAQQSRELFIQNQRMIEKDDLLRRKDALLHRDARRKRRFVDLFSRAHSDSEDPSTPGV

SEQ ID NO: 176869 - protein, 173 aa, Glycine max
  Coding DNA Sequence Number=SeqID_85184
MKADMDASKEQVTTMMEAMMSMKKIMEANAVAVAATSGVAEVNPTPPSGLNQMNHPTSDMVGIDLGSTGGPHYVQIQNKHAFPPYGLPPNYTPPNVVYTPSENVNNSTPTLIESQQPQSDHAHVSQPMGETHEIPHHNLADFEPCLRYATEGQAIGGIPLQNTLEGPQFLPQP

SEQ ID NO: 176870 - protein, 210 aa, Glycine max
  Coding DNA Sequence Number=SeqID_85185
  Gene Ontology: Mol. function=phosphoprotein phosphatase activity
  Homolog annotation: Hit_ID=Q2HTA0; Match level="QueryCoverage=72%, HitCoverage=23%, E-value=8e-18, Identity=38%"; Hit description=IMP dehydrogenase/GMP reductase, related
  Pfam annotation: Domain name=DUF1723; Domain location=121-170; Score =62.8; E_value=1.2e-15; Accession=PF08330.1; Description=Protein of unknown function (DUF1723)
IVVRTRGLGRALGRIKASAHRQQEAAPIAEDTPVVTKDVHAHAEEAVDDAKGFPGGPHDPSVLTDYGDHVVVIVWNGEEHPELKLSSHGRKVQKFGRLAPKVEGPVAATGLSLLIACSVDTGDRGLISAFVERWHKETSSFHLPVGELTITLDDVAYLLHLPIIGAFHSFETLHVDEAVLMLVELLEVSGEKGRAKTTQYHGAYIRLSWL

SEQ ID NO: 176871 - protein, 120 aa, Glycine max
  Coding DNA Sequence Number=SeqID_85186
MWDATMFGVFNEDFPLYIKHKNLSEIAHGGQSLSISVIQLWILHLTETSMQAGNFDMYGFLERQSIQRSGQSQFESESYMKSWMQSSKCDVYLGAYLNGGHWQMVIILLKETCCLVLLLA

SEQ ID NO: 176872 - protein, 77 aa, Glycine max
  Coding DNA Sequence Number=SeqID_85187
MGESHVTVPGCVAVPIGDTLLSPSYVAYIATGSDNTPLSPALSPLAMAGSAMPPVAMAVSSTKQTPSIIFFGTDPIP

SEQ ID NO: 176873 - protein, 146 aa, Glycine max
  Coding DNA Sequence Number=SeqID_85188
MERSMIDVANGGALGDMTSTEARNLIEKMAFNSQQFSARNDAIVIRGVHEVATNSSASSETKKLEGKLDALVNLVTQLAMNQKSVPVAILCGLCSSTDHQTDLCPSMQQPGAIEQPEAYAANIYNRPPQPQQQNQPQQNNYDLSSN

SEQ ID NO: 176874 - protein, 85 aa, Glycine max
  Coding DNA Sequence Number=SeqID_85189
FDEFKVERRNLHKCLTNLQDGSTYVAVEIKARLCIPCKGFILNAEGQPWKLLRKDLTTLAQTWSVFSYSNLVPTSHTSYLNMDRA

SEQ ID NO: 176875 - protein, 67 aa, Glycine max
  Coding DNA Sequence Number=SeqID_85190
  Subcellular localization annotation: CTP_CleavageSite=35; ConfidenceScore=5.31e-01
MDKYCPVPRVVTSIDVAVASLSSLTSPRAWTSVVRAAYVRLSEVDMFLVSQARSEVSGMCGACAVLS

SEQ ID NO: 176876 - protein, 131 aa, Glycine max
  Coding DNA Sequence Number=SeqID_85191
  Homolog annotation: Hit_ID=A7QL08; Match level="QueryCoverage=29%, HitCoverage=52%, E-value=2e-10, Identity=89%"; Hit description =Chromosome undetermined scaffold_116, whole genome shotgun sequence
MVGAGLKKDLRVSRVVPGGSLNAFLFLLIGVISQRLAMLESVALLGFPHLGSWGRGSSWPLRTADALSPFNPLSEMWQKEKRIHGPTPSSPPRRNYEITPKDAFGIQGSRTDHRTLFKKRNALAIRSQVGQ

SEQ ID NO: 176877 - protein, 222 aa, Glycine max
  Coding DNA Sequence Number=SeqID_85192
  Gene Ontology: Biological process=transposition, DNA-mediated
  Homolog annotation: Hit_ID=Q6UUU1; Match level="QueryCoverage=22%, HitCoverage=34%, E-value=3e-15, Identity=80%"; Hit description =Putative uncharacterized protein
DFYVPINVSFRQKWPRASRYQQGHQDLFILRSDLPSQWLLFLSAVPPVQLLTGWCVTAKAPPDISAGKCSGRVPFAIQAAQLLGRAIGAGLFAITPAGERGMCCKAIKLGNARVFPVTTFRETCRASCINESANARGEAVCVLALAECILAYYVGTDEGVSEVLHVAGEKRLHRCVSRICDTGYIPLPRSLTRYARSFDCASEMAYERAEISWKMPGRYLTG

SEQ ID NO: 176878 - protein, 75 aa, Glycine max
  Coding DNA Sequence Number=SeqID_85193
MNLHGTRADLGSSRIKPCWKIQKIDQEKDGKLAGFKGWAVANFLGLNKNKVEDEMVEGKNHSFWRGQHTKDVKDL

SEQ ID NO: 176879 - protein, 101 aa, Glycine max
  Coding DNA Sequence Number=SeqID_85194
MFKAIQWLTNWNEEDFAELRGVDGDSVLRGMRRRLRTCTVVPGDMSRGSGDLGDVRWGAIAQNQAWPIPTQPGHSQSVRTCDIPKQASSWQSTNKRTKCTK

SEQ ID NO: 176880 - protein, 28 aa, Glycine max
  Coding DNA Sequence Number=SeqID_85195
MVGAGAMIYFTGEVSGSSPGWPSCVKER

SEQ ID NO: 176881 - protein, 59 aa, Glycine max
  Coding DNA Sequence Number=SeqID_85196
MDKSLKKGEDEWREKERRSTKFCASREEKSPEFQEPQDLRSNPFQGGGNDAILPRKSIG

SEQ ID NO: 176882 - protein, 140 aa, Glycine max
  Coding DNA Sequence Number=SeqID_85197
  Subcellular localization annotation: CTP_CleavageSite=76; ConfidenceScore=5.59e-01
KNCWIPTDLAVTIRGARRARARPAKALSTSATPPLARTSAAPSTPSSTDFQRLEAMGVRIAICPLGPSRSFLQKTVASGGSNLARLGELGGKLLPYFAINRGRSEEENGSAFLALLPLLKLLRKIVSVKKIQAEELPLQR

SEQ ID NO: 176883 - protein, 234 aa, Glycine max
  Coding DNA Sequence Number=SeqID_85198
  Gene Ontology: Mol. function=phosphoprotein phosphatase activity
  Homolog annotation: Hit_ID=A7UQU7; Match level="QueryCoverage=56%, HitCoverage=23%, E-value=2e-19, Identity=41%"; Hit description=IMP dehydrogenase/GMP reductase, putative
  Pfam annotation: Domain name=DUF1723; Domain location=151-200; Score =64.3; E_value=4.1e-16; Accession=PF08330.1; Description=Protein of unknown function (DUF1723)
FVGRDRAADEDAGDVPERRRPTASARRLRVHQMTTEGRDMAEDVADMTDDVPEQPTEAPEMRADAQGADSGEGSDGDDAAEGFPGGPRDPSVLTSFAEHVAHAVWSGQERPDLKLVSHGRKLTLIGRPVPEIEGLVAATGLSPLIDCSVITGDPGLISAFVERWHSETSTFHLPVGELTITLDDVSSILHLPITGALHSFHALSTEEARFLLTELLEVSAEEARAETALTRGAY

SEQ ID NO: 176884 - protein, 34 aa, Glycine max
  Coding DNA Sequence Number=SeqID_85199
ATEYSDRLTYENVEVGALHMKFWAKISRAFTIPG

SEQ ID NO: 176885 - protein, 57 aa, Glycine max
  Coding DNA Sequence Number=SeqID_85200
MQRTNRLRILCLNTLEGTSFVVQVEGTSTWVVLLRTREGFYKVIENLKNRWLLGDWT

SEQ ID NO: 176886 - protein, 70 aa, Glycine max
  Coding DNA Sequence Number=SeqID_85201
MTKSKGKDPLEGLGGPMTRARARKTKEALQQVLSILVEYKPKFQGEKSKVGFQALERRESDCNLHFTVNV

SEQ ID NO: 176887 - protein, 106 aa, Glycine max
  Coding DNA Sequence Number=SeqID_85202
  Homolog annotation: Hit_ID=A9P9M2; Match level="QueryCoverage=81%, HitCoverage=66%, E-value=1e-33, Identity=75%"; Hit description =Putative uncharacterized protein
MGLQWLILTYVVATEAAVAILLTLPTPKLLRNRFASLVSLILQPALFIVPFAGFHLLDLYWKNEHRLMCTSEVCTAAERDRYEKSLLVIGNKTFCSMIYIVSKSGL

SEQ ID NO: 176888 - protein, 183 aa, Glycine max
  Coding DNA Sequence Number=SeqID_85203
  Gene Ontology: Mol. function=protein serine/threonine kinase activity; Cellular component=cytoplasm; Biological process=protein amino acid phosphorylation
  Homolog annotation: Hit_ID=A7PHB8; Match level="QueryCoverage=97%, HitCoverage=56%, E-value=3e-41, Identity=51%"; Hit description =Chromosome chr17 scaffold_16, whole genome shotgun sequence
  Pfam annotation: Domain name=Pkinase; Domain location=47-183; Score= -37.5; E_value=2.3e-06; Accession=PF00069.16; Description=Protein kinase domain
  Pfam annotation: Domain name=Pkinase_Tyr; Domain location=47-182; Score=-125.8; E_value=0.00011; Accession=PF07714.8; Description =Protein tyrosine kinase
  Pfam module annotation: Pfam domain module=Pkinase::Pkinase_Tyr; Domain location=47-183::47-182
MALIRRRHPNLRLPILEPTERKPHFSLPLVPPTTKPTTNDDITIDDLEKLVVLGHGNGGTIYKVYHKTTSTTCALKIIHGGTDVTTHRRALVEASILRRATNCPHVVNFYSSFEMPTGDVAILMEYMDGGSLETALAVNGTFSEERLVTVARDVLDGLAYLHAQNIVHLDIKPANILINTQGE

SEQ ID NO: 176889 - protein, 452 aa, Glycine max
  Coding DNA Sequence Number=SeqID_85204
  Gene Ontology: Mol. function=signal transducer activity; Cellular component=nucleus; Biological process=G-protein coupled receptor protein signaling pathway
  Homolog annotation: Hit_ID=A7QU00; Match level="QueryCoverage=94%, HitCoverage=55%, E-value=1e-157, Identity=70%"; Hit description =Chromosome undetermined scaffold_174, whole genome shotgun sequence
  Pfam annotation: Domain name=G-alpha; Domain location=46-429; Score= -15.5; E_value=4.3e-18; Accession=PF00503.11; Description=G-protein alpha subunit
MKHVLKGGLQGPLSRQLPLFNAFRPSQLANVQCPRDTHFWVYEDGSYEEEGQNNIKGNIWGKAKFLYGNKFSAEELQNIKLMIQSNMYKYLSILLEGREQFEEEALAERESTSLEGEGSGQETAADENKLSVYSINQRFKHFSDWLLDIMATGDLEAFFPAATREYAPMVDEIWRDPAVQETYKRREELHNLPNVAKYFLDRAIEISSNEYEPSDKDILYAEGVTQSNGLAFMEFSFDDRSPMSEIYSENINYPPHLTKYQLIRINSKGLRDGCKWLEMFEDVRAIIFCVSLSDYDQMWPTSTGQLRNKLLASKDLFESLVKHPCFKDTPFVLLLNKYDVFEDKINKVPLSICEWFGDFCPVRPHHNNHALAHQAYYYVAMRFKELYYSLTGQKLFVGQTRGRDRTSVDEAFKYIREIIKWDDEKDEDVYEINPEESFYSTEMSSSPFIRQE

SEQ ID NO: 176890 - protein, 473 aa, Glycine max
  Coding DNA Sequence Number=SeqID_85205
  Gene Ontology: Mol. function=dihydroorotate dehydrogenase activity; Cellular component=cytoplasm; Biological process='de novo' pyrimidine base biosynthetic process
  Homolog annotation: Hit_ID=Q9ST36; Match level="QueryCoverage=100%, HitCoverage=100%, E-value=0.0, Identity=76%"; Hit description=JPR ORF1 protein
  Pfam annotation: Domain name=DHO_dh; Domain location=112-409; Score =1.5; E_value=5.1e-10; Accession=PF01180.12; Description =Dihydroorotate dehydrogenase
  Subcellular localization annotation: CTP_CleavageSite=38; ConfidenceScore=5.40e-01
MASLSMTQIRTGNCASGFGLNCAGKVKVGPSRVGFKVFASETQATEPDLSVTVNGLHMPNPFVIGSGPPGTNYTVMKRAFDEGWGAVIAKTEWVCVIVNTDTWSCVVIWELRLKTEEFGVLWPQIFNSSWFRVVDTWMLLVSLDAAKVINVTPRYARLRAGADRSAKGEIIGWENIELISDRPLEIMLKEFKQLKEEYPDRILIASIMEEYNKAAWEELIDRVEQTGVDAFEINFSCPHGMPERKMGAAVGQDCALLEEVCGWINAKATIPVWAKMTPNITDISQPARVALSSGCEGVSAINTIMSVMGINLDTLRPEPCVEGYSTPGGYSAKAVHPIALGKVMSIAKMMKSEFDSENYTLSAIGGVETGGDAAEFILLGANTVQVCTGVMMHGYGLVKKLCLELQDFMKKHNFTSIEDFRGVSLEYFTTHTDLVRRQKEAVQKRKAIKKGLQSDKDWTGDGFVQETESMVSN

SEQ ID NO: 176891 - protein, 1140 aa, Glycine max
  Coding DNA Sequence Number=SeqID_85206
  Gene Ontology: Mol. function=transcription factor activity; Cellular component=nucleus; Biological process=regulation of transcription, DNA-dependent
  Homolog annotation: Hit_ID=A7PHC3; Match level="QueryCoverage=94%, HitCoverage=96%, E-value=0.0, Identity=65%"; Hit description =Chromosome chr17 scaffold_16, whole genome shotgun sequence
  Pfam annotation: Domain name=C1_1; Domain location=165-217; Score= -4.8; E_value=0.1; Accession=PF00130.13; Description=Phorbol estersdiacylglycerol binding
  Pfam annotation: Domain name=C1_3; Domain location=174-204; Score =12.9; E_value=0.016; Accession=PF07649.3; Description=C1-like domain
  Pfam annotation: Domain name=zf-NF-X1; Domain location=289-307; Score= 20.0; E_value=0.0089; Accession=PF01422.8; Description=NF-X1 type zinc finger
  Pfam annotation: Domain name=zf-NF-X1; Domain location=344-363; Score= 25.7; E_value=0.00017; Accession=PF01422.8; Description=NF-X1 type zinc finger
  Pfam annotation: Domain name=zf-NF-X1; Domain location=408-427; Score= 26.2; E_value=0.00012; Accession=PF01422.8; Description=NF-X1 type zinc finger
  Pfam annotation: Domain name=zf-NF-X1; Domain location=466-485; Score= 30.7; E_value=5.4e-06; Accession=PF01422.8; Description=NF-X1 type zinc finger
  Pfam annotation: Domain name=zf-NF-X1; Domain location=564-583; Score= 18.5; E_value=0.026; Accession=PF01422.8; Description=NF-X1 type zinc finger
  Pfam annotation: Domain name=zf-NF-X1; Domain location=621-639; Score= 14.2; E_value=0.18; Accession=PF01422.8; Description=NF-X1 type zinc finger
  Pfam annotation: Domain name=zf-NF-X1; Domain location=674-704; Score= 13.3; E_value=0.23; Accession=PF01422.8; Description=NF-X1 type zinc finger
  Pfam annotation: Domain name=zf-NF-X1; Domain location=713-734; Score= 15.7; E_value=0.12; Accession=PF01422.8; Description=NF-X1 type zinc finger
  Pfam module annotation: Pfam domain module=C1_1::C1_3::zf-NF-X1::zf -NF-X1::zf-NF-X1::zf-NF-X1::zf-NF-X1::zf-NF-X1::zf-NF-X1::zf-NF-X1; Domain location=165-217::174-204::289-307::344-363::408-427::466 -485::564-583::621-639::674-704::713-734
MLPVLPIKGWPLLLCRRGRSNNHGTDAAGSSNQGVAIAALSVSCGRSNIHGHDAGSSNQGVAVAAPPASRGRSNNPRNDAGSSNQGLAVAPPVNRGRSNNQGKDSGPSSQGVAVAALASRGRSNNHGTHRMEKEKDKGNKSGSQVEKGLGVGVRYSSLPQLVQEIQEKLMKGTVECMICYEMVQRSAAVWSCSSCYSIFHLNCIKKWARAPISSDLSLSVEKNHELNWRCPGCQSVKFTSSKEIRYVCFCGKRIDPPSDLYLTPHSCGEPCGKPLQKVLVAGGNRDDLCPHACVLQCHPGPCPPCKAFAPPRLCPCGKKNITTRCSDRQSVLTCGQCCDKLLECGRHRCEHICHVGPCNPCKVPISATCFCSKKTEVFSCGDMSVKGEIEAKGGVFACGSYCLKKLGCGNHVCSEICHPGSCGECEFLPSRVKTCCCGKTRLENERQSCLDPIPTCSKVCGKLLHCGMHSCKEACHVGECPPCLVEVSQKCRCGSTSRTVECYKTTMENEKFLCEKSCGIKKNCGRHRCSERCCPFTNSNHYNTFSGDWAPHFCSMPCGKKLRCGQHSCECLCHSGHCPPCFQTIFNELACACGRTSIPPPLPCGTPPPSCQLPCSVPQPCGHSVSHSCHFGDCPPCSVPVAKECIGGHVVLRNIPCGSKDIRCNHPCGKTRQCGLHACGRTCHPPPCDSQSGVVQGFKAPCGQTCGAPRRSCRHTCMAPCHPSSPCPDIRCEFPVTITCSCGRVTANVPCDGGGSSSNYNADAIHEASIIQTLPAPLQPVDANGKKVPLGQRKLICDDECAKLERKRVLADAFDITAPNLDSLHFSDNSLSSELLSDFFRREPKWVLAVEERCKILVLGKSRGIGTAHGLKVHIFCPMLKEKRDAVRLIADRWKLAVNAAGWEPKRFIVISVTPKSKAPARVIGVKGTTTLNVPLPPAFDPLVDMDPRLVVSFPDLPRDTEINSLVLRFGGECELVWLNDKNALAVFHDPARAATAMRRLDYATVYQGAVLVAPNAGASAASSATNAWGGALPALKGNSWKKAVAQDSGWGDSGVGEEWTAGSVNIQPSVWKKEAPLAASLNRWNVLEQESSSSSSSTTIRADISGKKTENTGEEGGSKEEENLDATSEVVDDWEKAYE

SEQ ID NO: 176892 - protein, 240 aa, Glycine max
  Coding DNA Sequence Number=SeqID_85207
  Subcellular localization annotation: CTP_CleavageSite=51; ConfidenceScore=5.29e-01
MKLTKFGSPSVADGVDVKSYSSKVKSTGISEPLSASEVRLNPSAFVQSVPSSEKEWGKVWEVFIPQSKNKQGQRYGFVRFKGVEDAGWLERQLDNKIYIEGKKLFVNKPKFQRRGKREVGRTGGEVVRVRKVSMNPMEPKQARINSTTSTSMKSYAEAVKHDHKTKEKEITMPLMGKKGPEVPDVSVVIQTGKDKTSWLDNLWVGRLKNRGMFEKAVDEVQEMVGMDVKVSYWGDDTIIL

SEQ ID NO: 176893 - protein, 77 aa, Glycine max
  Coding DNA Sequence Number=SeqID_85208
  Subcellular localization annotation: CTP_CleavageSite=58; ConfidenceScore=5.58e-01
MPISPCGCISWFVSSRHSSTECLSPPARSSGPLLIKLSSRSTTPPGRRRAKHHNSLGMASNRQQMHRRHLQSPSAHP

SEQ ID NO: 176894 - protein, 148 aa, Glycine max
  Coding DNA Sequence Number=SeqID_85209
  Gene Ontology: Mol. function=transferase activity, transferring nitrogenous groups; Cellular component=cytoplasm; Biological process= biosynthetic process
  Homolog annotation: Hit_ID=A6TDZ0; Match level="QueryCoverage=100%, HitCoverage=37%, E-value=1e-72, Identity=89%"; Hit description =Putative aminotransferase
MRIGWIVMPEWLAHQAVIVKQAADLHTNMLSQVITAEYLGMNRLNDQIALIREDYRKKCVALAEALESRLGEHLEFSRPEGGMFLWARFRYPFDTMAWLKKTLENGVVYVPGEAFYNDNPDTRTLRLSYSTVSEAGLLTAVERLAKSL

SEQ ID NO: 176895 - protein, 49 aa, Glycine max
  Coding DNA Sequence Number=SeqID_85210
  Homolog annotation: Hit_ID=A0PAV3; Match level="QueryCoverage=77%, HitCoverage=17%, E-value=5e-07, Identity=76%"; Hit description =Restriction endonuclease
MVKVGTSYVPINVSFSPKVGPGLPGINRDTRIYLFCEVIFRHRCSKVAS

SEQ ID NO: 176896 - protein, 105 aa, Glycine max
  Coding DNA Sequence Number=SeqID_85211
DFDPYPTFTTEGPAFNAMPQPNTAEAPQHCPLQPLHFLVGRLPPIKEKREKLDLIKERLRVVEGFGDFSFVDMAELCLVPDVVIPRISRCQISISARGLLAPRTT

SEQ ID NO: 176897 - protein, 72 aa, Glycine max
  Coding DNA Sequence Number=SeqID_85212
MCSDCLVQSSILAFYSEYQYPTNPKRIKVIPDWPTPPSVDGMSPEYEEPRDLRSNPFQGGGDDAILPPKGIG

SEQ ID NO: 176898 - protein, 28 aa, Glycine max
  Coding DNA Sequence Number=SeqID_85213
MSSPRRAGCLDTKPFHGPVLGRNSTHPS

SEQ ID NO: 176899 - protein, 342 aa, Glycine max
  Coding DNA Sequence Number=SeqID_85214
  Gene Ontology: Mol. function=signal transducer activity; Cellular component=membrane; Biological process=signal transduction
  Homolog annotation: Hit_ID=A4LVV9; Match level="QueryCoverage=97%, HitCoverage=58%, E-value=6e-53, Identity=32%"; Hit description =Methyl-accepting chemotaxis sensory transducer precursor
MTALKRYDNFISDPQDKKLLEADYAAIKSYDELGSSALTLSLSNKKTEARDVLLANQEAIESVQAAIRAHRQFNNELAKQSAAQAATVKKSAVFMLIGIAIAVLAGVVSLGFYIKRNLFKQLGMEPAQLTVIAHNFVEGNLNQKIELPADDKSSVAYSIRVLQRTLDGLVQSLNYVSQQHDEGDIDCTVDQSRFKGGYSEMAAGINKMVAGHIAMNRSAIEVVKAFGEGNLDMPLEQFPGKKAFVNEAIEQVRSNIKRLVNDADDLAHAAVEGRLSTRADASQHQGDFRMIVEGMNSTLDAVVKPLNVTSSYLDNIAKGVIPASITEEYQGDYSLIINNLNT

SEQ ID NO: 176900 - protein, 69 aa, Glycine max
  Coding DNA Sequence Number=SeqID_85215
MLAIISKYQEELNLAMAHEHKVADEYARVYAEKEARGRVIDSLHQEATMWMDRFALTLNRSQELPRLMA

SEQ ID NO: 176901 - protein, 198 aa, Glycine max
  Coding DNA Sequence Number=SeqID_85216
  Gene Ontology: Mol. function=transporter activity; Cellular component= membrane; Biological process=transport
  Homolog annotation: Hit_ID=B0J8U3; Match level="QueryCoverage=46%, HitCoverage=27%, E-value=6e-35, Identity=82%"; Hit description=Inner- membrane translocator
MTIVVIAGRNRSFQRAAAGCAGNCAAIGAVNALAVIDGRHRAASGDAGGDECRGRARTGSDAEYRDPSPISLGALRQAPAGIPGTGHRWCNIRLWLRLYAVGEFPEAARAAGLPVKSFVAGAFVTSGLFGGFAGILSVSYLSGSTTGSGEMLLPVVVTALLGAVFSRRLVPTVTGTLLSVLFVGFWSRLQLLTFPARW

SEQ ID NO: 176902 - protein, 148 aa, Glycine max
  Coding DNA Sequence Number=SeqID_85217
MQTCFSKETKLPTDQSNICFLDEKQCVYWGRRHFISKRPFRGNTGSNKDRRKSLKVYQSHTVRGEKVASAQDFVGNQRERITLGRGFLFCLLGDNSILFRYCLGKDYGELGFWLKACRTAGYDICQGLASGSGIKGMSYIISMIHMQQ

SEQ ID NO: 176903 - protein, 34 aa, Glycine max
  Coding DNA Sequence Number=SeqID_85218
MALSAPSRTGSPFLSLTCKECEGGTLALKNVLFP

SEQ ID NO: 176904 - protein, 110 aa, Glycine max
  Coding DNA Sequence Number=SeqID_85219
ASEPVDTQRLTSSSSPCHPETASPMTCGDTQVVIRTNQLLLISTREVRWQAEIPQVVIRTNTLLLILTREVKWQAEILQVVIRTHTVLLPRPVRSQVACGDTLYGNPHTF

SEQ ID NO: 176905 - protein, 123 aa, Glycine max
  Coding DNA Sequence Number=SeqID_85220
  Homolog annotation: Hit_ID=A5BKB8; Match level="QueryCoverage=73%, HitCoverage=25%, E-value=2e-40, Identity=92%"; Hit description =Putative uncharacterized protein
MPTRGSADVAFRTPLAPYEKSKSLGSGGLFLDSMGGGAWPFLVGGAICLVNSVNERDLSLLNSYVEIIAIVGLQRGIPSKRESSARVDYVPALCTHRPSLLPIEWSGEVFGLRRRERFAARDV

SEQ ID NO: 176906 - protein, 97 aa, Glycine max
  Coding DNA Sequence Number=SeqID_85221
MARSVSAPCPYSRDLYGRELTRLLVVIPKVVISLLKVSRGVSHGKTLHKIKWPNSLKTVPSGVANCRNLPFGERATRDSRDACSTKGIRAESPPTFI

SEQ ID NO: 176907 - protein, 119 aa, Glycine max
  Coding DNA Sequence Number=SeqID_85222
  Homolog annotation: Hit_ID=Q2HW90; Match level="QueryCoverage=72%, HitCoverage=18%, E-value=6e-08, Identity=32%"; Hit description =Putative uncharacterized protein
MGQLQRQAFRKAYGKIWDLTVAEDSTEAIASLAQYYDQPLRCFTFGDFQLTPTVEEFEEILGCPLGGRKPYLFSGFYPSLARISKIVKISTQELDCGKQVENGVVRVLSQPTLRREGDA

SEQ ID NO: 176908 - protein, 68 aa, Glycine max
  Coding DNA Sequence Number=SeqID_85223
  Subcellular localization annotation: CTP_CleavageSite=59; ConfidenceScore=5.01e-01
SNLARLGRAELAWASWAATHLPYFSINRGGTEALPKRFRNVFREESRKGFNRSSTFFIRSSSFFDLQR

SEQ ID NO: 176909 - protein, 104 aa, Glycine max
  Coding DNA Sequence Number=SeqID_85224
MVQGKFVPTLGEALGFHNGGEVCKDAKESDLFCKRERKLSVYNIHFSFAFGFKHLAPLELVGLGSSSPMDSFSSWKMNGSGMEKEEREETPLQGEDESRRSSPP

SEQ ID NO: 176910 - protein, 147 aa, Glycine max
  Coding DNA Sequence Number=SeqID_85225
MSLDFTGHDSKRWGGRQKQGFCSNSLPEDANISRKGADDHNCLCLSIGLGVSKLRGVDNRKVSPHATGLSSRWIAKGVCGLPSGVSACYWTLESLDSKGCLQVTIGCLHMPPDSWVTVTKGGVVDKSRAFAPTYPQFVMRNSDLRSS

SEQ ID NO: 176911 - protein, 186 aa, Glycine max
  Coding DNA Sequence Number=SeqID_85226
MEAGSLSFNKNKPWKENFHHQESVLDKKLREEVNQKERWAWELKEIREKLNFEHNTWEACLRSKEGSFLGKLEEESFLEKRRGERRHHPLENKPWKEKLHHQESALDKKLRWEAPMEEENERERERERKRGAWELKEIREKSTWEASLRSKEGRFLGKLEEERFLEKLEKVASLGSKEESFLEKLE

SEQ ID NO: 176912 - protein, 99 aa, Glycine max
  Coding DNA Sequence Number=SeqID_85227
MTTFKVPNKKLTILMENCLKLLHINGRLRGLVSWLMQGKMKINWVNIIVHIMSKTKRMMLAKMDELMRVDKEDYVELKEFSESISKRLDVMGAPHVDDI

SEQ ID NO: 176913 - protein, 602 aa, Glycine max
  Coding DNA Sequence Number=SeqID_85228
MDIPRTHQDVMKECSTQGQENHCVQGSWKRGSVVPELHRKIIECIREGSTYQEDYEKPYKSHVPKALYGKILNETDGNMKTLEGADDIYYATLVNKLLWEYYVFHVFEGMNEDSKKPIINKPIPLVIEDDIQQKRQKKLAKTIVDEDKDLETFVLAKKGKVQTRKQSPELEEEEEIVAKEQLMKKKHEGSKPFLPVQTKKARPQTIPIKRSQRQISVRLQGSKAKGLSEIEDECPLIIPRKQKVEQQIPISRRSKRLRKATYNPFLPSNEEEDQTNPPPTQAKRPLSSIDTLKFPTLGSTWNKSYRPWEQLAAKEIEHINFGYFFMDKANVSQLGLDGPHWMPNIELHHSYSNHQNGPLLGESNSFNPMVQGDIMKQMYIPDQATTYPLDSTSVEALTSKWCQKKLAQDYPFMIKARKRALRSTSMEKCPTRVRRYNRLTNQGTISIYSKNPEDDLIEHLKKTGPSMKQSGKQSLLMKLSRKLMQKPNDKLLLRERLKQRQKRLDPTNKVDKAPTVPTSHEATSKDTTAITIHTTTFGPTTINFAPSKVMTKVRVKEIIRLVMDNFANKQRDENQEFRRTMQQAITIHFSSLNESFMNLQQA

SEQ ID NO: 176914 - protein, 41 aa, Glycine max
  Coding DNA Sequence Number=SeqID_85229
MGMYACPCCMLVFKKNNVLTNEMQYVHGGCSDHVGYPWWGK

SEQ ID NO: 176915 - protein, 120 aa, Glycine max
  Coding DNA Sequence Number=SeqID_85230
MGEIEEVQERMKDDMEAMMSMKKIMEVNAAAVAATSAVARVREAKSWEVQAAPILCKFRTSMPSCHMACLPTIHHPMFHTLPMRISITLPPYSLRSNNLNLIMHMSLNPWGRHMKYPTTI

SEQ ID NO: 176916 - protein, 81 aa, Glycine max
  Coding DNA Sequence Number=SeqID_85231
  Homolog annotation: Hit_ID=A5B3J2; Match level="QueryCoverage=71%, HitCoverage=13%, E-value=2e-08, Identity=48%"; Hit description =Putative uncharacterized protein
MSDLGRLLKYFGAAIFLKCCTTRDPYSHLATYIEICNTVKLAGLPEDATRLSLFSFSLSGEAKRWLHSFKGNNLKTWDEVV

SEQ ID NO: 176917 - protein, 220 aa, Glycine max
  Coding DNA Sequence Number=SeqID_85232
  Homolog annotation: Hit_ID=Q2HTA0; Match level="QueryCoverage=47%, HitCoverage=15%, E-value=5e-15, Identity=42%"; Hit description=IMP dehydrogenase/GMP reductase, related
  Pfam annotation: Domain name=DUF1723; Domain location=110-159; Score =52.6; E_value=1.4e-12; Accession=PF08330.1; Description=Protein of unknown function (DUF1723)
MVRTIGLGHALGRIIGRALGRQDDHHADDVPQWCRPTAFARRQREAVLVAEDVPEMTEDVPAPGAEGLTGDGAEGSAADDAEGFPGGPHDPSVLISFAEHVAHIIWNGEVFDRGVISTFVERWHKETSSFHLPVGELTITLDDVASLLHLPIIGAFHSFEPLHVDEAIIMLVELLEVSGEEARVEIAQFHGAYVRLLWPQDIYQRRCEARCSLPHTVPFS

SEQ ID NO: 176918 - protein, 77 aa, Glycine max
  Coding DNA Sequence Number=SeqID_85233
MKKQQWKRRCSGRQRRRGERRRHPLGNKPWNKELHHQDEPWIKSLERMLQWRKRKRKRKREGGSTKFKEEKGREFEL

SEQ ID NO: 176919 - protein, 110 aa, Glycine max
  Coding DNA Sequence Number=SeqID_85234
MEAMMSMKKIMEANPVAVVTTNIVAKVNPMPPFGLNQMNHPTSSMVGKDLGSTGGPHDVQIQNEHAFPPYGLPLNYTPPNVAYTPNKNVNNSTPIPIESQQPQTAHAHVS

SEQ ID NO: 176920 - protein, 86 aa, Glycine max
  Coding DNA Sequence Number=SeqID_85235
MEKNEETTMEGKVKLKINGACLRSDKDMARTKGKEPLEGLGGPMARAKTKKAKEALQQVLTMLFEFWPKLQVEKLRIVNCTMFQEE

SEQ ID NO: 176921 - protein, 76 aa, Glycine max
  Coding DNA Sequence Number=SeqID_85236
SRLFRFFRRFPQINVGGDSARIPFVEHASRESRVALPPKGEAPTGAPVEAPDEADEAREDEEMTDLLDFLGGSGAT

SEQ ID NO: 176922 - protein, 76 aa, Glycine max
  Coding DNA Sequence Number=SeqID_85237
MLIDVGNALACACCVCSWRAKCTDLLGSLALALGHVHTLDVVYVRGGRSALIFQGLWHLLWATFIRHGPDVGDKRG

SEQ ID NO: 176923 - protein, 47 aa, Glycine max
  Coding DNA Sequence Number=SeqID_85238
MIWVPKGSSVYTNTHKDPIKFGYLSQKLDYVLSTACLVLVNYVTKAI

SEQ ID NO: 176924 - protein, 78 aa, Glycine max
  Coding DNA Sequence Number=SeqID_85239
MSPRSRASSSRWTSLNEELEELVANVPKHGEWRKMTNRMQNVAAPTEAFFQTVHARDQIFGEVGKVYAAKWKDVLDVI

SEQ ID NO: 176925 - protein, 82 aa, Glycine max
  Coding DNA Sequence Number=SeqID_85240
MGYVGVRELSWRWATGDGGFIRDLWMWKTCCASSPDRHLVPHVMGTPYSYKLEMRRVVPGDMSWGSGDLGDVRWGAIAQNQA

SEQ ID NO: 176926 - protein, 54 aa, Glycine max
  Coding DNA Sequence Number=SeqID_85241
MPFCGRARARLTGALSKGGKVEKSGAFAPTYPPSKRKSDLRSSFLRVNQAILFT

SEQ ID NO: 176927 - protein, 29 aa, Glycine max
  Coding DNA Sequence Number=SeqID_85242
ADEPDFRIDWYQQSKNHREETVICKSPSP

SEQ ID NO: 176928 - protein, 15 aa, Glycine max
  Coding DNA Sequence Number=SeqID_85243
MADEQPRRVTLEDYS

SEQ ID NO: 176929 - protein, 212 aa, Glycine max
  Coding DNA Sequence Number=SeqID_85244
  Subcellular localization annotation: CTP_CleavageSite=63; ConfidenceScore=5.19e-01
MARKLRQDFSISKAKKFRSFSLTLTLLFLPFSSTIEASIKAPNFTHHFYSKSQKEAIFGVVKRTSTLWDFKFQVWVDFFSHDFVGIGCLGDMMGVDGDPVLRGTRIRAMWGYVSSVEELICTIARLPPSTTYDGVVPGDMSRGSGDLGDVRRALGSQPIKEQRPQSKEACVVAGQLWILSDIWNMASGNRLLREVEMASGNRLPRGVIDYQA

SEQ ID NO: 176930 - protein, 138 aa, Glycine max
  Coding DNA Sequence Number=SeqID_85245
  Homolog annotation: Hit_ID=Q5XM22; Match level="QueryCoverage=37%, HitCoverage=29%, E-value=4e-13, Identity=63%"; Hit description =Resistance-like protein HAAS-2
AFHSFETLHVDEAVLMLVELLEVFGEEVRAETTQCHGAYVRLSWLRDIYQSKCDTGHWTVAARAYLLHLLGCILFANKSATHCWIYEHFPSVVESLSNPDYDEMSPRVCQWIATKASSKSLLASTYRKRLDGLTIADV

SEQ ID NO: 176931 - protein, 228 aa, Glycine max
  Coding DNA Sequence Number=SeqID_85246
  Gene Ontology: Mol. function=transcription factor activity; Cellular component=cytoplasm; Biological process=regulation of transcription, DNA-dependent
  Homolog annotation: Hit_ID=P0A9G0; Match level="QueryCoverage=85%, HitCoverage=61%, E-value=1e-103, Identity=93%"; Hit description=HTH -type transcriptional regulator metR
  Pfam annotation: Domain name=LysR_substrate; Domain location=1-171; Score=61.5; E_value=2.9e-15; Accession=PF03466.11; Description=LysR substrate binding domain
MDFKSGVTFDPQPSLQQGELDLVMTSDILPRSGLHYSPMFDYEVRLVLAPDHPLAAKTRITPEDLATETLLIYPVQRSRLDIWRHFLQPAGISPQLKSVDNTLLLIQMVAARMGIAALPHWVVESFERQGLVQTKTLGEGLWSRLYAAVRDGEQRQPITEAFIRSARNHACDHLPFVRSAERPIGDGPTAKPGSPLPNNEARPVRLLLPDGQVDQHAIRDMHVVDDPQ

SEQ ID NO: 176932 - protein, 71 aa, Glycine max
  Coding DNA Sequence Number=SeqID_85247
MYPLLVPQRDVPSNVLRQSSQAVSPMNLCKGETKDISGEEQGLENRKLRKLFGKGRRRKMRRKGFKISQKL

SEQ ID NO: 176933 - protein, 321 aa, Glycine max
  Coding DNA Sequence Number=SeqID_85248
FDEFKEELERRHWDEKLTDFSDNSIDIAIVKEFYANLYEPEDKSRKQVRVRGHLVKFDEDTLNTFLKTPVVLEEGENLCTYSRFALMRPDPQELAAKLCIPGKGFELNVDGQPLKILRKNMTMLAQTWSMDMNLGYLISYQISLIAQHDTSKLVFPALITTLCKARGVQLDSRSLESLSPAINFTYIKKNCWNLDDPTVTFRGPRKARGKRSEAPTTLAPLEAPTPSSSTTSLPPIQTPMLHSMLQSIHRGQSIIMASAAQEPAFEELAAVVAEGEDELTPPKPSYFDAEPSPAPIPDDAIPSAPTPELEQPISQDSPAAQ

SEQ ID NO: 176934 - protein, 117 aa, Glycine max
  Coding DNA Sequence Number=SeqID_85249
LERIDGDPALRGTRIRATWEYVSSVGGGQQGMVGLYVICGCGELSCAIARPPPMVPGDMSRGSGDHGDVRRAPGSQQIKGTMTTKQGGLCGGWPAVNLVLENEVRKLGELLVIDYQG

SEQ ID NO: 176935 - protein, 62 aa, Glycine max
  Coding DNA Sequence Number=SeqID_85250
MVMMRSKSKRVTLGTHAGEENYNGARKSDDVAPCGACRPGIFFINGVLCFLKINGSGMEMEK

SEQ ID NO: 176936 - protein, 31 aa, Glycine max
  Coding DNA Sequence Number=SeqID_85251
MDCSSDYEASWETSAWRERLDGEVDLWDSQS

SEQ ID NO: 176937 - protein, 110 aa, Glycine max
  Coding DNA Sequence Number=SeqID_85252
MKNGGKPSRICLRKHLGSVTEAPRLAFSSRKFFFHPKQLKCIAMGIRDPENNPLLPFYRKNGEEVAAQLAQANWVASSRSNPTSKNTLEGPISKLLFAPLHFDKFTPLLS

SEQ ID NO: 176938 - protein, 630 aa, Glycine max
  Coding DNA Sequence Number=SeqID_85253
  Gene Ontology: Mol. function=catalytic activity; Biological process =metabolic process
  Homolog annotation: Hit_ID=A5BD66; Match level="QueryCoverage=53%, HitCoverage=27%, E-value=2e-75, Identity=50%"; Hit description =Putative uncharacterized protein
  Pfam annotation: Domain name=RRM_1; Domain location=527-598; Score =7.8; E_value=0.028; Accession=PF00076.13; Description=RNA recognition motif. (a.k.a. RRM, RB
MESNARIFKESLIKIPVLWDSVLNLHIFANVNTVIFGLLYNLRGLTGCSPSDLVKQSYFSSTKFRVSNGIIGLPYHVSQGVGCQLRGQNCYVEVSLGFPRSGTDNTLQPNKNSVRNLPKLHVAESPIVGRSDHKGSPDHLLDYDKTFLYPAEAVLVPVLQTSLARSSLRRTYNTVNSFLTWYQSLILAAELDGTIPAWFLFLYSLLKPQFSSAFCSAGNVDCTEDPWTEINGTRTQNSYDSSSNSNSSSISSLSASSSDSDYKTTRPSELEADADSLTCRQSMVSSADQLDSDGPKLGSKRSRTGVTESLSTATNIPVQDAYMSDFGSMEVNNSAITGVGNDPIGSYWDWDDDDRGMEMDIQALLSEFGDFGDFFENDVLPFGERETSIRDRGRDSGRERDGRLRHRVWERDRGREREGRPRERVNTKRATNGYRNDFHQRGFRSNTRRFWRIDDAYLRTQRDSPSRTAYEEQEQQKLDVNNHGAWVEVTRKKKRNEKDNRGRPDGGSHQREEKKVTWRDKADVTTYYFSRFPEGMMEKDMWRIFQKWGKVWEVFISKTKNKLGHRFGFVRFKEVMDEKRLERQLDTNIFIGGVKMFVNSPKVDRGKMIGNRERRILSHGEGATQQKHKA

SEQ ID NO: 176939 - protein, 564 aa, Glycine max
  Coding DNA Sequence Number=SeqID_85254
  Gene Ontology: Mol. function=catalytic activity; Biological process =metabolic process
  Homolog annotation: Hit_ID=A5BD66; Match level="QueryCoverage=90%, HitCoverage=44%, E-value=1e-154, Identity=56%"; Hit description =Putative uncharacterized protein
MGYFNNNSWRWDMRWRRNLFDHESQLAVQFMEEISSVPIQRQPPGTAESQALMLSAPDCGDVNSSPGGVIDVPGQILLPVGFPSFESFNPPPSTSIEECLNKSQDNLNNSMSLCPTNQTQLLYTREFDHIMKAEAMMTFAPEFGAVDTPTCELSTTLFRSPYFPKSRKAKSSNSSSNNYLYGAAPPTSPCTEGSEGKNGMSANTKTGSGKYDASTTSLHSKYYYTFVESRKEKNDKNPATCNDNSITKSEGIPPLSNIGSNAIVKSAIRKTTEGTHEAEHFLLSAKTLLATDITCVTLQASMCRLRHILLSSGNLMPVGLSRSTGVSFLNQLPSDPSMTTDNISGKYDVKKKENIPIRIAGDIDGGMLDGHLNAPVGVWRTLGASKVVKPSNSPNMEVVPSFPHNSFNEEGILSYGLRKPLQELLDGIALLVQQAISFVDLALDADCGDGPYGLLAMQEQWRRGFCCGPSMVHAGCGGSLASSHSLDIAGLELVDPLSADLGPAEKYGILQQLADIKPFLFKNNLIPMLPDTACQGNPPTLPFLKAIAISIPNHMLEEVHTRVL

SEQ ID NO: 176940 - protein, 163 aa, Glycine max
  Coding DNA Sequence Number=SeqID_85255
  Gene Ontology: Mol. function=catalytic activity; Biological process =metabolic process
  Homolog annotation: Hit_ID=A5BD66; Match level="QueryCoverage=84%, HitCoverage=12%, E-value=6e-20, Identity=40%"; Hit description =Putative uncharacterized protein
MSLVRCIPPVSPNDALLAIPISVGSDIKTALKSAFSNLEGPLSVTDWCKGRNQLVDTGSIVDGVSAESSINECRDSSEPMSPSQSSVGGSSSIKGRISNLMDKVDETSQRRSGQDLCSTELEQLSCSRLKPTLIALPFPSILVGLFIVFECIGLGGLDDYDAA

SEQ ID NO: 176941 - protein, 552 aa, Glycine max
  Coding DNA Sequence Number=SeqID_85256
  Gene Ontology: Mol. function=oxidoreductase activity; Cellular component=extracellular region; Biological process=electron transport
  Homolog annotation: Hit_ID=Q00624; Match level="QueryCoverage=99%, HitCoverage=99%, E-value=0.0, Identity=72%"; Hit description=L -ascorbate oxidase homolog precursor
  Pfam annotation: Domain name=Cu-oxidase; Domain location=159-302; Score=186.6; E_value=6.2e-53; Accession=PF00394.13; Description =Multicopper oxidase
  Pfam annotation: Domain name=Cu-oxidase_2; Domain location=381-525; Score=134.4; E_value=3.3e-37; Accession=PF07731.5; Description =Multicopper oxidase
  Pfam annotation: Domain name=Cu-oxidase_3; Domain location=33-149; Score=193.6; E_value=4.9e-55; Accession=PF07732.6; Description =Multicopper oxidase
  Pfam module annotation: Pfam domain module=Cu-oxidase::Cu-oxidase _2::Cu-oxidase_3; Domain location=159-302::381-525::33-149
MKRVMLLVLSCLWIESLLTVVRGEDPYLYFTWNVTYGTISPLGIPQQGIFINGQFPGPNINSTSNNNLVINVFNNLDEPFLFTWNGIQHRKNSWQDGVAGTNCPIPPGTNFTYRIQVKDQIGSYFYYPSTAMHRAAGGFGGLRVNSRLLIPVPYPDPEDEYTVLIGDWYTKSHTILRKLLDSGRSLGRPEGVLINGKTAKGDGKDEPLFTMKPAKTYKYRICNVGLKNSLNYRIQGHSMKLVEMEGSHVVQNMYDSLDVHVGECFSVLVTADKEPKDYYMVASTRFTKTVLIGKGIIRYTNGKGPASPDIPPAPVGWAWSLNQFHTFRWNLTASAARPNPQGSYKYGQINITRTIKLVNSVSKSNGKLRYALNGVSHVDPETPLKLAEYFGISDKVFKYDTIPDNPSPNIGNAVTVQPNVLNITHRNFIEIIFENPEKTIQSYHLDGYSFFVLGIEPGTWTPEKRKSYNLLDAVSRHTVHVFPKCWAAIMLTFDNAGMWNLRSDIAESRYLGQQLYISVLSPEHSLRDEYNMPDSNLLCGLVKNLPKPAPYS

SEQ ID NO: 176942 - protein, 69 aa, Glycine max
  Coding DNA Sequence Number=SeqID_85257
MKRKKMMYREGRTSVKTRGKQSSATMEELWWACNGAKRNGGCKWHLLASSAGGGQRVKDSMSIATHEAH

SEQ ID NO: 176943 - protein, 865 aa, Glycine max
  Coding DNA Sequence Number=SeqID_85258
  Gene Ontology: Mol. function=catalytic activity; Cellular component =mediator complex; Biological process=metabolic process
  Homolog annotation: Hit_ID=A7P090; Match level="QueryCoverage=73%, HitCoverage=75%, E-value=0.0, Identity=71%"; Hit description =Chromosome chr6 scaffold_3, whole genome shotgun sequence
  Pfam annotation: Domain name=TRAP_240kDa; Domain location=1-506; Score=-257.9; E_value=0.00018; Accession=PF06333.3; Description =TRAP240
MPNRYQDDWLKTSANSLQHWEKAPLEPYALQKPITYHVVCPDIDPLTSAAADFFQQLGTVYETCKLGTHSPQGLGNQMEIESAKLSSCGFVLLDCPQSIKIESSNASLVGSVSDYFLSLSNGWDLTSYLKSLSKALRGLKIGSCFSTNPGEGSNSSCLVIYVVCPFPDPTAILQTVIESSVAIGSVAQQSDRERRSSLHSQVVKALSGLTTVDEASASNILVLSGFSIPKLVLQIVTVDAIFRVTSPSVSELVILKETAFTVYSKARRISRGISSDFAQSAFPRSHSVLTQMPSPISGMWKDCVGPRMAGHSLPREGDIDASLRPGTWDNSWQPTRTGGLSCDPSRTGDNFLYDEIRYMFEPLFILAEPGSLENGISVIGSPTSESSKALADDSSGNYAQSTSTAGNAESASSTDGSGSDPETPPSLHCCYGWTEDWRWLVCIWTDSRGELLDCNIFPFGGISSRQDTKGLQCLFVQILQQGCLILQSCDPGLAKPRDFVIARIGGFYELEYLEWQKAIYSVGVSEMKRWPLQLRKSMSDGMSATSNGSSLQQSDISLIPERTLPSSPSPLYSPHTKSTSFMKGSLGQPTARKQLMGGHSMVDNSRGLLHWAQSISFVAVSMDHTLQLVLPADSSTPGLADRVNPGYDRIAAPGLAAIHSFKIGIIAHSWLLAVTFDNETIEEYLCKIKGYVDELASIDVPVRHEECVDALLEGLPSDYAPVVSVIESKKHTPSIVEIEALLYGHETRLALQQRCPFLEVRMVAVPFRTEVLAVVVVSSAEDAAVDNLQTSNVKSVLNMGTLSMFVILVRTSNTWVNPNSKNPAPGHSQPSAMLTNSSSHGNGQVGTTWIPDSRASFHVTGDTEY

SEQ ID NO: 176944 - protein, 192 aa, Glycine max
  Coding DNA Sequence Number=SeqID_85259
MRISICIPCGKKTSEINILEIENSVFVSGNKRNSKFEGSGGKLVNEVYSCSKGIIPKLQGQSVRDAKGGYKSRERSVFTFPIRLNTLNFGVKLQFNHGLESLENRNGFNLALYRKYPVRAELEKSAFEIVDADISSEGLLKLEIMKGVKSINTKNSFKKDLIGLVMPTSLGDTNDEEPMLEILKPSPLPMNI

SEQ ID NO: 176945 - protein, 178 aa, Glycine max
  Coding DNA Sequence Number=SeqID_85260
  Gene Ontology: Mol. function=geranylgeranyl-diphosphate geranylgeranyltransferase activity; Cellular component=chloroplast; Biological process=carotenoid biosynthetic process
  Homolog annotation: Hit_ID=A7P047; Match level="QueryCoverage=30%, HitCoverage=14%, E-value=1e-19, Identity=81%"; Hit description =Chromosome chr6 scaffold_3, whole genome shotgun sequence
  Subcellular localization annotation: CTP_CleavageSite=40; ConfidenceScore=5.24e-01
MDWPRKGIWKDGGSKPCSMINTGSNRKPCCGRRRFGVIIRSEVNVAPKQRGILRLSKQGVPLAVQEVVHRRMDGLVDDPNAVYMSSAILDRWEDRLHDIFNGQPYDMLDAALTDIVSKFPLDIKGHDTKHENGYEESPIQQFSRVISLLLLCGGNCGLNDCSDNGHCPGVCHPNSKCI

SEQ ID NO: 176946 - protein, 471 aa, Glycine max
  Coding DNA Sequence Number=SeqID_85261
  Gene Ontology: Mol. function=Rab GTPase activator activity; Cellular component=intracellular; Biological process=regulation of Rab GTPase activity
  Homolog annotation: Hit_ID=A7QHM3; Match level="QueryCoverage=81%, HitCoverage=90%, E-value=1e-125, Identity=60%"; Hit description =Chromosome chr5 scaffold_98, whole genome shotgun sequence
  Pfam annotation: Domain name=TBC; Domain location=180-395; Score= -29.3; E_value=1.7e-05; Accession=PF00566.9; Description=TBC domain
  Subcellular localization annotation: CTP_CleavageSite=76; ConfidenceScore=5.33e-01
MKKKKQVPEWMNSALWSTPSDHGRFDPPSPPPPPPVSVKEDSRTIPTNQNSSPPPFSSSSVSSPTASADDISRQAQAQAQAQVQLLAELSRKVIDMRELRRVASQGIPDAALRPTLWKLLLGYLPPDRALWFSELTKKRSHQSEITRRMYNSNSNSAAHDIDDAKSDTQTRLLLSRSQITHQDHPLSLGKTSIWNQFFQDTEIIEQIDRDVKRTHPDIDFFSGDSHFAKSNQEALKTILIIFAKLNSGIRYVQGMNEVLAPLFYVFKNDPDEENAAFAEADTFFCFVELLSGFQDNFCQQLDNSICGIRSTITRLSQLLKEHDEELWRHLEVTTEVNPQFYAFRWITLLLTQEFNFADILHIWDVILSDPEGPQLYICNYVLNIIIYMHTKIIKFASHPSFRHFGYSVLGLATTFRYPGFDKLCFLKPLGIACNYSGGWECPQQAAAGLQVLLHVVCLYAKKCISSCLKSS

SEQ ID NO: 176947 - protein, 127 aa, Glycine max
  Coding DNA Sequence Number=SeqID_85262
  Homolog annotation: Hit_ID=A5B4P8; Match level="QueryCoverage=76%, HitCoverage=15%, E-value=1e-33, Identity=73%"; Hit description =Putative uncharacterized protein
MVGFLYVNYQVNLISLLVNNIRDFPFPYQWFTVYQTIYLRVSSYENSEDLKQDVRLLLSPVRLGAQAFSWAAGKLESNGLGLPTSPSSSDVQNRVLQAAAKHESQPSDSEGNQDPVPEPTVPLNQNV

SEQ ID NO: 176948 - protein, 447 aa, Glycine max
  Coding DNA Sequence Number=SeqID_85263
  Gene Ontology: Mol. function=solute:hydrogen antiporter activity; Cellular component=integral to membrane; Biological process =regulation of pH
  Homolog annotation: Hit_ID=A7NY62; Match level="QueryCoverage=83%, HitCoverage=57%, E-value=4e-26, Identity=33%"; Hit description =Chromosome chr6 scaffold_3, whole genome shotgun sequence
MNLNPNGTMFLSITTVDEATHRYMVCLHATPPHIVSDGLWGSGATNRKPVKSFLPLFELQDGKEGMDHCHIGIAITHILCLFNDLVVALVSHTVISFAVISSLLSELQIQNSELGKLALSSALISDILCTIATAIGTAVMITENSNVKDVIRNVLALICLAIFNPLVCRPTMLWIIKHTPEGRAVKDEGPPLGSALVKKLNFLGTTFLLPIFVTINHACLVPSLYCNMQPRDAVSLALILNCKGVVEVGLYCFLYDTNVIDGLASIWSNDFEHNGGSMHCAMHKSYSDEHDNPDAVSAYPCTAIAPPNLIEHDDEEALCIARRAIRNPGMNIVIYNLVFKAEDDEWGQEVDDDELEDVKHAREHNIRYQQIIETEGSQTAAFLSDIVKEHDFFIVGRRHGNGIESPQTDGLTDWSEFPELGAIGDFLASPDLESRASILVVQQQLSP

SEQ ID NO: 176949 - protein, 1048 aa, Glycine max
  Coding DNA Sequence Number=SeqID_85264
  Gene Ontology: Mol. function=receptor activity; Cellular component =chloroplast thylakoid membrane
  Homolog annotation: Hit_ID=A7QAV2; Match level="QueryCoverage=50%, HitCoverage=75%, E-value=1e-117, Identity=47%"; Hit description =Chromosome chr5 scaffold_72, whole genome shotgun sequence
MVLRCAFSFGTNVETTRDKEKKEKRDKEGRDGKRKEKKDKKEKHREKKKDKDKNRDKEKSKTGAAIEKEFPGQAQGPNAGKLHQKEIKPIDKIVLLEDKLTKQFASNNGEKARENNHFFEENKDSKFLLDLERRIRDNDGGAENQLAQKFATAGHRKNEGAVRLVTKGSGTWPDGKERLQDKGIDTRMVDRREIWAESRPVGNITVQNNAGKFHHRVDEMPKSLENNFYKPLEAAVEGKERVKEKKDDKHRDKKKNKEKGKKGHGKDKDRSKEKKKEEKAKENAEHENREQQNKLKESTKAGPLGSNSFTQVSRHIYENSAVGENLKKRKDIESNGIMHANDNWPSKLPTPSPSPSHLTENGRILEPCQISLQNTSDNRLAAASNIKVDNKKRRTNGIIEVLPSAVSSKTPTPTATLPAPVSEASAKPPHPDTKYISQVYSVPKADEWSDFDDQEWLFGSSHSQERKPVVKSSEVGDTLQGSICHKCLHVWCIAGGLIGAVVLTSRDDIVIHLQIRLHKERQPQIPLFGGLHPIRKDLESRCVAEEGVHLASQYGAHSLRNSFAVQATKTVLGSFSSTSESGYLTSTWGYSPVLTDGHHSLSNGEVRHMESYHLSTVPDELADFAEQATEGSNTLVTPAQPETLSAADIMPENFTSSPSSINVDNESLASTKASVGDLVAGFNESFNASINEGQNALRSSLDTATSFVDSIVKTATESVDNTFSKAFSSVDQTGELANKKLTSFSSELTGVTNKAPAVAIDVLRRTIVVVESSLTSGASYVVYLYGSAKELLPAGIRDTVNVYEDKATEILRPVGSATQRIYMAVYSLEKSLGLDPNDPIIPFVVLVGSSATLWAFYWLWTYGGYSGNLSPKSAFELLAEDANAALIDVRSEEMREKDGIPDLRRAARFRYASIIPLEVDGSIRKLLKSGRELDDSLIAAIIRNLKIVKDSSRVIVLDADGTCSKGIARSLRKIGVKASLSIPAEIFAAKLLIYFIKFFAEFSFIGVEELCHGEKNPYLVEGGFYSWMKQGLRIKELKPETALSILNE

SEQ ID NO: 176950 - protein, 163 aa, Glycine max
  Coding DNA Sequence Number=SeqID_85265
  Gene Ontology: Cellular component=cellulose and pectin-containing cell wall
  Homolog annotation: Hit_ID=A7Q726; Match level="QueryCoverage=61%, HitCoverage=85%, E-value=4e-20, Identity=49%"; Hit description =Chromosome chr5 scaffold_58, whole genome shotgun sequence
  Pfam annotation: Domain name=RALF; Domain location=51-109; Score =84.3; E_value=3.9e-22; Accession=PF05498.2; Description=Rapid ALkalinization Factor (RALF)
MSQPRFISMISLCLALVLFYTCNGLPFVDLNFHEVDVMTKRVCTKSIGECLSLTEPEMDSETNRRVLAMQKKYISYDTLKRDMVPCDRAGASYYNCHAIRANPYNRGCEPTPAELSLLLLFTFFNVSKARFCGSKASQHAMSCCSTQDYTNLCSPNSLCSLKS

SEQ ID NO: 176951 - protein, 393 aa, Glycine max
  Coding DNA Sequence Number=SeqID_85266
  Gene Ontology: Mol. function=nucleic acid binding; Cellular component= mitochondrion; Biological process=regulation of transcription
  Homolog annotation: Hit_ID=Q9STI7; Match level="QueryCoverage=84%, HitCoverage=90%, E-value=1e-107, Identity=58%"; Hit description =Putative uncharacterized protein T4C9.80
  Pfam annotation: Domain name=DUF88; Domain location=177-299; Score= -53.9; E_value=0.092; Accession=PF01936.9; Description=Protein of unknown function DUF88
  Pfam annotation: Domain name=zf-C2H2; Domain location=137-160; Score =24.4; E_value=0.00041; Accession=PF00096.17; Description=Zinc finger, C2H2 type
  Pfam module annotation: Pfam domain module=DUF88::zf-C2H2; Domain location=177-299::137-160
MVSYTSYFIYRRAENPLQILKFRSIFFFSLEATCWQTYGTLRHCHSGSERGKNQKLTNRVGLFWDLDNKPPNSIPPYEVANKLRIAASSFGVVRYMVAYANSHTFSHVPQGVRESRKEKELLYRLENKGVIKPNQPYRCKVCGRKFYTNDKLVNHFKQLHESEHTKRMNQIESARGSRRVKLVAKYSMKMEKYKKAASDILTPKVGYGLADELKRAGFWVRTVSDKPQAADQALQSHIVDIMDHRRVECVVLVSDDSDFVDVINEAKMRCLKTVVIGDIDEGFLKRTADTAFSWEEILMGKAKKQAVSVVKNWKDRDILKKLEWTYNPDEDKSNFNLDDTVTEASEDDNIEDTTCDEVDDAYKDDRGSWWELDSDDDATNRQSGKLSGLSVNR

SEQ ID NO: 176952 - protein, 255 aa, Glycine max
  Coding DNA Sequence Number=SeqID_85267
  Homolog annotation: Hit_ID=A7Q9J9; Match level="QueryCoverage=79%, HitCoverage=87%, E-value=1e-81, Identity=68%"; Hit description =Chromosome chr5 scaffold_67, whole genome shotgun sequence
  Pfam annotation: Domain name=DUF1264; Domain location=27-216; Score =383.2; E_value=4.2e-112; Accession=PF06884.2; Description=Protein of unknown function (DUF1264)
MVYSSIQLATSDGTEFVKAQKWRPTKNGEPTTGTYLRDTATSAIQNFAPINKIHQHLCAFHFYSYDMSRQVEAHHFCAHQNEEMRQCLIYDSPEKKARLIGLEYIISENLYLTLPDQEKRLWHSHLYEVKSGLFFMPKVPALIQRPDMETVCTTYGKVFHFWQVDKGHSLPFGIPQLMMALTRDGQIYDHLLQSSAERMGIDYEEERKAREYMTGPVHGIHPLANGGGKGLELRLREVELKHDPSPPSVKARILF

SEQ ID NO: 176953 - protein, 584 aa, Glycine max
  Coding DNA Sequence Number=SeqID_85268
  Homolog annotation: Hit_ID=A7Q9J7; Match level="QueryCoverage=88%, HitCoverage=85%, E-value=0.0, Identity=63%"; Hit description =Chromosome chr5 scaffold_67, whole genome shotgun sequence
  Pfam annotation: Domain name=MACPF; Domain location=37-235; Score =56.3; E_value=1e-13; Accession=PF01823.10; Description=MACPerforin domain
MSELLNQKSAIQGKIPSGYFNALFGLSGDWFRDAHDIKYLAFDGYFISLYYLHLTASHLILQEEVKKSVPAQWDPASLTRFIQTYGTHIIIGMAVGGQDVICVKQNHSSKVPPGDLRRHLENLGDFLFSDLKSPSQQQRNSTPEGKQKVPEVFNRVMQSSTTQFASISEASSKDGLTIICSKRGGDVFKQSHSNWLQTVASNPEAFLFKFVPISSLLTGIPGSGYLSHAINLYLRYKPPPDDLQCFLEFQIPRQWAPMFYDLPLRHQRKKCSSPSLQFGFMFPKLRVSCAQVVSDQKPVVGLRMYLEGRKSDRLAIHVHHLSSLPNTMIHSSSGISLWRGSDDNESSDIFLEPIRWKGFANVCTAVVKHDPNWLHETSGVYIVSGAQLISKGSWPKNVLHLRLLYTHIPNCCIRKSEWDGAPEASRKSSFLTNLSTTFSFTQQSPPQKQAPTVLDSGVYPDGPPVPVRSCKMLKYVDTSEVVRGPHDAPGQVCIDRLLVVIHSFSKLLLFHVYVDTSEVVRGPHDAPGHWLVTAAKLVTEGDHMYIGICLISDDFVQYSIHNEWWLTSATRKLECGYNTALVWC

SEQ ID NO: 176954 - protein, 482 aa, Glycine max
  Coding DNA Sequence Number=SeqID_85269
  Gene Ontology: Mol. function=L-isoleucine transmembrane transporter activity; Cellular component=integral to membrane; Biological process=amino acid transport
  Homolog annotation: Hit_ID=A7Q9N5; Match level="QueryCoverage=86%, HitCoverage=96%, E-value=1e-156, Identity=67%"; Hit description =Chromosome chr5 scaffold_67, whole genome shotgun sequence
  Pfam annotation: Domain name=Aa_trans; Domain location=81-467; Score =171.8; E_value=1.8e-48; Accession=PF01490.9; Description =Transmembrane amino acid transporter protein
  Pfam annotation: Domain name=Spore_permease; Domain location=84-408; Score=-142.6; E_value=0.0041; Accession=PF03845.4; Description=Spore germination protein
  Pfam annotation: Domain name=Trp_Tyr_perm; Domain location=92-461; Score=-268.3; E_value=0.023; Accession=PF03222.4; Description =Tryptophantyrosine permease family
  Pfam module annotation: Pfam domain module=Aa_trans::Spore _permease::Trp_Tyr_perm; Domain location=81-467::84-408::92-461
MWGKILQSIRKSLISLQQKSMNSRKSEEVDSSVTSVSVSLHDGVQWVNCNCCIEENKQCNFDHINASEGANNVHAQRDANANSSFTHAVINMVGMLVGLGQLSTPYAVENGGWSSAFLLMGLGVMCAYSSHILGVCLRKNPKLTSFMDIGKHAFGSKGRNVAATIIYMEIFMSLVSYTISLHDNLITVFLGTNLKLHLPNFSSSQLLTAVAVFIAMPSLWIRDLSSISFLSSVGILMSLLIFLCVAATALLGHVQSNHSIPVLHLHNIPSVSGLYVFGYGGHIVFPELYTAMKDPSKFTKVSIVSFAVVTAIYTTLGFMGAKMFGKDVKSQITLSMPQEHIVTKIALWATVVAPMTKYALEFTPFAIQLEHALPTSMSVRTKMIIRGCVGSFSLLFILTLALSVPYFEHVLSLTGSLVSVAVCLILPSAFYVKICWGQISKPHLLLNLFLIIFGFVLAVMGTISSSQLLLKSLQSHNLRHKE

SEQ ID NO: 176955 - protein, 42 aa, Glycine max
  Coding DNA Sequence Number=SeqID_85270
MAHTDCQSKFKRKPKHLPRRRQKQRRCNNDEEEPPTKKKHQQ

SEQ ID NO: 176956 - protein, 160 aa, Glycine max
  Coding DNA Sequence Number=SeqID_85271
  Homolog annotation: Hit_ID=A7QP57; Match level="QueryCoverage=93%, HitCoverage=81%, E-value=3e-49, Identity=63%"; Hit description =Chromosome chr1 scaffold_136, whole genome shotgun sequence
  Subcellular localization annotation: CTP_CleavageSite=42; ConfidenceScore=5.25e-01
MACRSMLRSSILVEPFQLQPLHFSNRPVRACPFRRGKGVTLRCSSNETPSFQDDQGPPQEAVLKAISEVSKAEGRVGQTTNMVIGGTVSDDSTNEWLTLDQKVNSYPTVRGFTAIGTGGEDFVQAMVVAVESVIQQPIPQANFVTSFASVQLFSCNLAVS

SEQ ID NO: 176957 - protein, 102 aa, Glycine max
  Coding DNA Sequence Number=SeqID_85272
MGCLISSILLCTTRVDSKGMIMAHWNMWMLENDKDILNMCRICIAHLAKDVHAYFEHTMDDFLNLVGGVLDEVVVNQIKDRAEGIDAELDKEFKGLLTKFKI

SEQ ID NO: 176958 - protein, 316 aa, Glycine max
  Coding DNA Sequence Number=SeqID_85273
  Gene Ontology: Mol. function=protein binding; Cellular component =mitochondrial outer membrane translocase complex; Biological process= protein import into mitochondrial outer membrane
  Homolog annotation: Hit_ID=A7P9U5; Match level="QueryCoverage=67%, HitCoverage=84%, E-value=6e-60, Identity=57%"; Hit description =Chromosome chr14 scaffold_9, whole genome shotgun sequence
  Pfam annotation: Domain name=TOM20_plant; Domain location=96-315; Score=283.7; E_value=3.6e-82; Accession=PF06552.3; Description=Plant specific mitochondrial import recep
MEFSQDDFDRLLLFEHTRKTAEANYAENPQDADVRIVLHYTLINLSSFYDLLCSHRTCFVSEFVRFLLEVILCHITTFKIGRTKLRYNAIIIELEFYRVLRITKNLTRWGGALIELSSFQAPRDAKAMIDDALSKLEESLLINPTKHDTLWCLGNANTSYAFLIPDITEAKGYFDKALEYFQKAAEEDPENDLYRKSLQVAVKAPELHMEIHKNGLGLMSNAGSSATSKEKPCLGSSCLKFCGYKASHVSMSLEIASSTNFSWCLSKYCHTIVFHESKKQKSNDFKYDIFGWIILAVGIVAWVGMAKSNIPPPPPR

SEQ ID NO: 176959 - protein, 684 aa, Glycine max
  Coding DNA Sequence Number=SeqID_85274
  Gene Ontology: Mol. function=protein binding; Cellular component =transcription factor complex; Biological process=red or far red light signaling pathway
  Homolog annotation: Hit_ID=A7QP88; Match level="QueryCoverage=54%, HitCoverage=97%, E-value=1e-176, Identity=78%"; Hit description =Chromosome chr1 scaffold_136, whole genome shotgun sequence
  Pfam annotation: Domain name=F-box; Domain location=47-94; Score =26.5; E_value=9.5e-05; Accession=PF00646.24; Description=F-box domain
  Pfam annotation: Domain name=Kelch_1; Domain location=136-185; Score =36.0; E_value=1.4e-07; Accession=PF01344.16; Description=Kelch motif
  Pfam annotation: Domain name=Kelch_1; Domain location=187-233; Score =54.3; E_value=4.2e-13; Accession=PF01344.16; Description=Kelch motif
  Pfam annotation: Domain name=Kelch_1; Domain location=235-282; Score =37.8; E_value=3.9e-08; Accession=PF01344.16; Description=Kelch motif
  Pfam annotation: Domain name=Kelch_2; Domain location=136-185; Score =7.5; E_value=5.6; Accession=PF07646.6; Description=Kelch motif
  Pfam annotation: Domain name=Kelch_2; Domain location=187-233; Score =29.5; E_value=1.2e-05; Accession=PF07646.6; Description=Kelch motif
  Pfam annotation: Domain name=Kelch_2; Domain location=235-282; Score =27.0; E_value=7.2e-05; Accession=PF07646.6; Description=Kelch motif
  Pfam module annotation: Pfam domain module=F-box::Kelch_1::Kelch _1::Kelch_1::Kelch_2::Kelch_2::Kelch_2; Domain location=47-94::136 -185::187-233::235-282::136-185::187-233::235-282
MPGFTVGKKRFIQPNMCFTNLINQDKSTLSQNNHCLFPEALNKDYSPILPGLPDDVAEYCLALVPRSNFPAMGGVCKIWRSFIQSKEFATVRKLAGMLEEWLYFLTTDCEGKESYWEVMDCLGHKCRSLPPMPGPGKAGFQVVVLNGKLLVMAGYSVIEGTAFASAEVYQYDSCLNSWSRLSDMNVSRYDFACAEVNGLVYAVGGYGVNGDSLSSAEVYDPDTDKWALIESLRRPRWGCFACGFEGKLYVMGGRSSFTIGNSKFVDIYNPERHSWCEIKNGCVMVTAHAVLGKKLFCIEWKNQRKLAIFSPEDNSWKMVPVPLTGSSSIGFRFGILDGKLLLFPLEAETAFQTLLYDPNASLGSEWQTCDIRPSELVVEGAENPNAMFGSAQPSSSPFGTPAFGTPSSTPAFGSSLFSTPFSSQQPQPQQQQQQQTPLFQQQQQQQTSSAFGFQNSLAFAAPQSSPFPNAQLTTQMANVAPVPFSLADRDVQTIVDAYKDDPGNPKYAFKHLLFSVTEPQFRVKPAGVSDIMWAEAIGKLQGMESPDRERLWPQLVQGFKDLSQRLKVMRIVEALEEKGCRIPLTKGEAELAEKLATITRKLKGSGAELSRRVQNLLIVSRVKANSNGFGSSVYLPGSTKIHEQSLGDLQEVLQQQLEAIARLGNVLKRDIRDMEIMMTEDTKN

SEQ ID NO: 176960 - protein, 367 aa, Glycine max
  Coding DNA Sequence Number=SeqID_85275
  Gene Ontology: Mol. function=oxidoreductase activity; Biological process=aromatic compound metabolic process
  Homolog annotation: Hit_ID=A7QBS1; Match level="QueryCoverage=97%, HitCoverage=47%, E-value=1e-117, Identity=61%"; Hit description =Chromosome chr1 scaffold_75, whole genome shotgun sequence
MAGMNTGIQDAHNLAWKIASVIKGIAPTSMLNTYEIERKPINWLTFIAVYYCQIALFNTRLSLENYKAAMSVPAALGLDPTVANIVHQFIVDGIGSILPSGLQKVALDGIFGIGRAQVSEFVLNESNPLGSSRLAKLRHIFEEGKSLQLQFPAEDLGFRKYDARALWGCLSNSAIELRYLQGALMPESKDVESPPEVLTGRRRDYTPSAQPGSRLPHIFVRVNPLSEETVSTLDLVSGDKVEFILIIAPVEESYHLAREAFKVAEEQEIFLKVCIFWSTDSVEGLEKGSKAALSPWKNYLDVVEVWSSTSNWWDMCNMTNRGAILVRPDEHIAWRTSSGLAGDPRVEMQRVFSAILGVHGSNKQIHG

SEQ ID NO: 176961 - protein, 652 aa, Glycine max
  Coding DNA Sequence Number=SeqID_85276
  Gene Ontology: Mol. function=metal ion binding; Cellular component =membrane; Biological process=guanosine tetraphosphate metabolic process
  Homolog annotation: Hit_ID=A7QBS9; Match level="QueryCoverage=97%, HitCoverage=98%, E-value=0.0, Identity=61%"; Hit description =Chromosome chr1 scaffold_75, whole genome shotgun sequence
  Pfam annotation: Domain name=Ank; Domain location=17-49; Score=8.6; E_ value=1.9; Accession=PF00023.21; Description=Ankyrin repeat
  Pfam annotation: Domain name=Ank; Domain location=172-204; Score=3.6; E_value=10; Accession=PF00023.21; Description=Ankyrin repeat
  Pfam annotation: Domain name=Ank; Domain location=206-238; Score =25.5; E_value=0.0002; Accession=PF00023.21; Description=Ankyrin repeat
  Pfam annotation: Domain name=Ank; Domain location=239-271; Score =29.4; E_value=1.3e-05; Accession=PF00023.21; Description=Ankyrin repeat
  Pfam annotation: Domain name=Ank; Domain location=273-314; Score =12.4; E_value=0.53; Accession=PF00023.21; Description=Ankyrin repeat
  Pfam annotation: Domain name=Ank; Domain location=321-355; Score =15.2; E_value=0.21; Accession=PF00023.21; Description=Ankyrin repeat
  Pfam annotation: Domain name=Ank; Domain location=99-132; Score=2.1; E_value=16; Accession=PF00023.21; Description=Ankyrin repeat
  Pfam module annotation: Pfam domain module=Ank::Ank::Ank::Ank::Ank::An k::Ank; Domain location=17-49::172-204::206-238::239-271::273 -314::321-355::99-132
MPPYLPLRWESTGEQWWYASPIDCAAANGHYDLVVELLHLDANLLIKLTSLRRIRRLETVWDDEKHFEDVAKCRSQVARNLMLECEAGRAHNSLIRAGYGGWLLYTAASAGDVDFVKELLGKYPALVFGEGEYGVTDILYAAARSNSCEVFELLLRSALSPPQMEDVYERDMMNRAVHAAARGGNWEMLKRLVRNGSGVLGFRDTQGCTVLHTAAARGQVEVVRNLLASFDVVNLTDDQGNTALHIASYGGHLPVVEILILASPSLALFTNHYGDTFLHMAVAGFRSPGFRRLDKHTELMKRLVSGKIVNLRDIINVKNNDGRTALHVSVIDNIQCEQVELLMSVSSIDLNICDADGMTPLDLLKQRARSASSDILIKQMISSGGVSKCLDVVAGNALCTHQKAHVIGGSPGTSFRIPDAEIFLYTGIENSSDATNYDQASVESYSCSNELNNSDSANSPHNKKSNSVNARRSKFRLHWPRRRETKAAASELEDDDDSHDPFSSSRNLEEFPIPLRQRYSQPCSLPNNKRTQPMRTSLPSPSSNVKFSAGLMQGVIQLKPHSAHSTPSPFQELSVSSLSYIKKQKGVEIMGPSCSNRSIDDGTLLLNYKQCSFNKKLMNGYFSFGAQGLAVEDSNSCAKSNSSYKRLSSIVA

SEQ ID NO: 176962 - protein, 89 aa, Glycine max
  Coding DNA Sequence Number=SeqID_85277
MDSGMSWADQWDNNPDPSPASDKDKKGKDGSGKNNKFGKTMLSFKWVKELRKKTQNVEEGPKGGEEEECLWSLIFSAHLVEETGKQLEV

SEQ ID NO: 176963 - protein, 266 aa, Glycine max
  Coding DNA Sequence Number=SeqID_85278
  Gene Ontology: Mol. function=oxidoreductase activity; Cellular component=endoplasmic reticulum membrane; Biological process =metabolic process
  Homolog annotation: Hit_ID=A7QBV9; Match level="QueryCoverage=56%, HitCoverage=35%, E-value=3e-56, Identity=66%"; Hit description =Chromosome chr1 scaffold_75, whole genome shotgun sequence
  Pfam annotation: Domain name=RGS; Domain location=27-142; Score=73.3; E_value=8.2e-19; Accession=PF00615.10; Description=Regulator of G protein signaling domain
MSQALGIPDSGVLAESEPISRIDPNEPLDKLLLNKRFRQSFMAFADSCLAGESVHFFDEVYELSKIPEDDCVKRIYMARHIIEKYIVAGAAMEVNISHRSRQEILSTSNLTRPDLFHNALNEIIQLMRTEDSNVRSNEYELEQITGWNFSPSSLIKFLKWVWVMFLRTPKNLIKEYGSWAMITGFTDGIGKAMAFELASKGLNLLLVGRNPLKLEATSKEIRDGHDVEAVPPSMIKKKKGAIVNIGSGSTVVLPSYPLVTLYAATK

SEQ ID NO: 176964 - protein, 94 aa, Glycine max
  Coding DNA Sequence Number=SeqID_85279
  Homolog annotation: Hit_ID=Q1SKZ9; Match level="QueryCoverage=100%, HitCoverage=19%, E-value=2e-08, Identity=33%"; Hit description=Zinc finger, CCHC-type
MGSGFVLSGSRMGDVSMGNKPLDNGGGNDNRPMKISFRDKVMDNIEKPPVKENLAKIVYEDDNPMKPMVIIEDSVFEGLCAPWKDALMVKHISR

SEQ ID NO: 176965 - protein, 337 aa, Glycine max
  Coding DNA Sequence Number=SeqID_85280
  Homolog annotation: Hit_ID=A6FJQ2; Match level="QueryCoverage=11%, HitCoverage=84%, E-value=1e-10, Identity=92%"; Hit description=50S ribosomal protein L5
MQLRRRSQLVCKRMPGADKPVRARQRMRKEKIPHQAPFAIQAAQLLGRAIGAGLFAITPAGERGMCCKAIKLGNARVFPVTTLMGDVSMGNKPLDNGGGNDNRPMKISFRDKVMDNIEKPPVKENLAKIVYEDDNPMKPMVIIEDSVFEGLCAPWKDALMGIIGKQLGGVKIQLQDVGITLKDLWNGGNWNWDRAAMIWNLLQLDVQVHALDDNSSTWLQRICLADHGARNKEVFSDLVIRVVLVMNQILSLLEIVTKTCNNNKGSSSGNHLNLESTNSTFHGSSFGNPGKAGFGSLIQDNHGHWIMWNFIQHKCKTSSYIPWHWCGLARRISPSNL

SEQ ID NO: 176966 - protein, 215 aa, Glycine max
  Coding DNA Sequence Number=SeqID_85281
  Homolog annotation: Hit_ID=Q8RVQ6; Match level="QueryCoverage=17%, HitCoverage=4%, E-value=6e-11, Identity=91%"; Hit description=SEC6
RYDIFQLMVNLYAERFIQMLRLLSDRANELTNIEILKRMRERNRVRERVREGERYRDSERQRFREGESERVHDRYRARVWDRDRVRVREGRPRERVYTQRAVDDRNNFHRRGPRSNTGRSWWADEDYSPSRIAYVYQKDQSFDADNHGTWVEVTRKKKTKEVTNRDGPGRSSHQQVGQKVTWRDKAGITTFYFSRFPEGMMEKDLWRIFQKWGKV

SEQ ID NO: 176967 - protein, 403 aa, Glycine max
  Coding DNA Sequence Number=SeqID_85282
  Gene Ontology: Mol. function=nucleic acid binding; Cellular component= nucleus; Biological process=multicellular organismal development
  Homolog annotation: Hit_ID=A9XIW7; Match level="QueryCoverage=70%, HitCoverage=47%, E-value=2e-43, Identity=33%"; Hit description =Terminal ear1-like 2 protein
  Pfam annotation: Domain name=RRM_1; Domain location=193-292; Score =12.3; E_value=0.011; Accession=PF00076.13; Description=RNA recognition motif. (a.k.a. RRM, RB
MNENHNDPKQSQHWLTQLMVWCGEGKVENEESSVLPASLREREERMGETGIILSFPGNLDPRAEEFRPNTINIQCQWYPLPPPLPLPLPIPLPPPNLTTSSTRSLLLTPVPLTSHSALRAELQAFGDIRALQTEALRHGILTVHFFDLRHAQSAFAAIRSMQLHFHPNPGLLSAHYVLPNSNSLPDSHNQGTLVIFNLHPNLSSDQLRRLFQPFGTLNLIPFFIIVSELFSFFLLFVVCSIKNPYILGPIKELRDTPWKKNQRFVEFFDIRDAAKALKHMNGKEIDGKQVVIEFSRPGGHTRKFFHHHSKTTVPPLNFNAPRLHSSQKKSPGSPSNSTGSIDAEMGSMSLTGGEVEEQHSSSQGPTRRNLGRKHTTLVVGNTKQQQVPRSRHWKGKQAKKHET

SEQ ID NO: 176968 - protein, 826 aa, Glycine max
  Coding DNA Sequence Number=SeqID_85283
  Gene Ontology: Mol. function=binding; Cellular component=nucleolus; Biological process=ribosome biogenesis and assembly
  Homolog annotation: Hit_ID=A7P464; Match level="QueryCoverage=99%, HitCoverage=99%, E-value=0.0, Identity=72%"; Hit description =Chromosome chr1 scaffold_5, whole genome shotgun sequence
  Pfam annotation: Domain name=NUC130_3NT; Domain location=86-137; Score=79.9; E_value=8.5e-21; Accession=PF08158.3; Description =NUC1303NT domain
  Pfam annotation: Domain name=SDA1; Domain location=447-824; Score =301.3; E_value=1.8e-87; Accession=PF05285.3; Description=SDA1
  Pfam module annotation: Pfam domain module=NUC130_3NT::SDA1; Domain location=86-137::447-824
MDPDGVVAAEALMASGRSSEKLSLPSLQSKMKCDPEGYESELLLLYNQFNSSLELFQKQAAMNFTSISGIGSDPTVAKDLGDRAMFLAHVTPFYPKHLADFPKKLADLLRCAARTLPSGLRCHLAHALILLSNRKIVDIGETLSLFMELQTLGDRTLKKLAFDHVVHSIRRMNQKHKNEAKNRALQNVLFDLLQKEAEEPAKRALVTLCELHRRKVWFDERTANAICTASFHPTSRIMIATLSFLLDYEKIQDDDDDSDNSDSDDEKTESPQVVLSRETVYKASHQGTAASKKKKKAKLQRAIRSMKRHQRVSSDRSKNSYYSPLNHLKDAQGFAEKLFSRLRSCNERFEVKMMILKLIARTVGLHQLILLEFYSFLQKYIQPHQRDITNLLAAVVQACHDMVPPDAVEPLFKQIVNQFVHDRSRPEAITVGINAVREICMRMPLLMNEDLLQDLALYKKSREKAVSIAARSLIGLFREVCPSLLVKKDRGRPIDPKARPKAYGEQNVATDVPDVELLQTAIDNDDEQESDHSDGSACSVSDNDQENDLMSINDDDDNDDENQLCSDDPESDDEAKDSDVISDDDDERSSDDEADVSDADEVKGDDIEDNEQADGEDSDVSEHEEDGDLHSLSDDGLVTKSTMKDSAKKRKFTDFNGQLIAADTSLRALKKLAGRQMGDVIPESNDGILSNEDFKRIKELKAKSEAKNALAQQGLAKSAATKVPSSGQLNLKRVDGTMLEAHIRKKLNKDERLALVRAGREERGKYQARTAVKQNKTGGLSNRQKEHKKKMPLAAKRDKVSRTRIEKKRKNQRSGKQFRGKKAWKQ

SEQ ID NO: 176969 - protein, 738 aa, Glycine max
  Coding DNA Sequence Number=SeqID_85284
  Gene Ontology: Mol. function=protein tyrosine/serine/threonine phosphatase activity; Cellular component=intracellular; Biological process=protein amino acid dephosphorylation
  Homolog annotation: Hit_ID=A7P490; Match level="QueryCoverage=96%, HitCoverage=82%, E-value=0.0, Identity=58%"; Hit description =Chromosome chr1 scaffold_5, whole genome shotgun sequence
  Pfam annotation: Domain name=DSPc; Domain location=109-248; Score =132.4; E_value=1.3e-36; Accession=PF00782.11; Description=Dual specificity phosphatase, catalytic domain
  Pfam annotation: Domain name=Gelsolin; Domain location=275-349; Score= 12.6; E_value=0.024; Accession=PF00626.13; Description=Gelsolin repeat
  Pfam annotation: Domain name=Y_phosphatase; Domain location=33-245; Score=-84.6; E_value=0.076; Accession=PF00102.18; Description =Protein-tyrosine phosphatase
  Pfam module annotation: Pfam domain module=DSPc::Gelsolin::Y _phosphatase; Domain location=109-248::275-349::33-245
  Subcellular localization annotation: CTP_CleavageSite=58; ConfidenceScore=5.41e-01
MLGEAGKKDKAPPGGVAWKTYSRSVSWTDRSPNSRKPPTNSKTRPLLPPLQPLSINKRNVEEWPSAGSDDLGVWPLPQTPRGSSTSSSQQQPTKDFLFKRDKLAFFDKECSRIAEHIYLGSDTVAKNHELLRQNGITHVLNCVGFVCPEYFKGDFVYKTLWLQDSPTEDITSILYDVFDYFEDVREQGGRVLVHCCQGVSRSTALVIAYLMWREGQSFEDAFQFVKTARAVTNPNMGFACQLLQCQKRVHAMPASPNSVLKMYRMAPHSPYDPLHLVPKMVNQPGSQALDSRGAFIVHVPSAIYVWNGKHCDSVMSCNARSAAFQVIRYEGAKGPILTIHEGEEPPGFWIALSIEQRISGDSEKEVVIMEEPSEGMESAVEPVDSGMTTGPRKIDAYDLDFEIFHKALAGGVVPPFSLSDPGSETCLPAREQGWARLRRKFASGLLTSPKFICDADSTPCNDHQPSVSEEAAYEPLSPSSIPPCGSPDSFECYPNREKGSPEAMDFSVHGVASSLPLSPTGTSNPFPCFISCIPKFNSKSPTLSPSSSDYASSFTFSPSSTNWSDLSLVSSRQPSPSGLESAEPFYVKDASFSENSTLLHKDVSSPLEEFSANHTFGGANSNLQLKGSFLSIAERRGNHPPPLMLLPSASESSHVPKNNVVRSLSFSLPELDDNVVKDDDTCKQSDRENKGKWLISDDYIISSGVEPQSEINDKEDRGTELCNKMAELDIEEKGNGMS

SEQ ID NO: 176970 - protein, 1778 aa, Glycine max
  Coding DNA Sequence Number=SeqID_85285
  Gene Ontology: Mol. function=ATP-dependent helicase activity; Cellular component=nucleus; Biological process=mRNA processing
  Homolog annotation: Hit_ID=Q7XI36; Match level="QueryCoverage=95%, HitCoverage=98%, E-value=0.0, Identity=46%"; Hit description =Putative DEAD/H (Asp-Glu-Ala-Asp/His) box polypeptide 8
  Pfam annotation: Domain name=DEAD; Domain location=296-470; Score= -10.9; E_value=0.00028; Accession=PF00270.20; Description=DEADDEAH box helicase
  Pfam annotation: Domain name=DUF1605; Domain location=828-941; Score =65.5; E_value=1.8e-16; Accession=PF07717.7; Description=Domain of unknown function (DUF1605)
  Pfam annotation: Domain name=HA2; Domain location=696-792; Score =76.9; E_value=6.6e-20; Accession=PF04408.14; Description=Helicase associated domain (HA2)
  Pfam annotation: Domain name=Helicase_C; Domain location=543-636; Score=64.4; E_value=3.9e-16; Accession=PF00271.22; Description =Helicase conserved C-terminal domain
  Pfam annotation: Domain name=IBR; Domain location=1636-1701; Score =54.2; E_value=4.3e-13; Accession=PF01485.12; Description=IBR domain
  Pfam annotation: Domain name=IBR; Domain location=1702-1766; Score =0.1; E_value=0.049; Accession=PF01485.12; Description=IBR domain
  Pfam annotation: Domain name=zf-C3HC4; Domain location=1569-1611; Score=28.9; E_value=1.9e-05; Accession=PF00097.16; Description=Zinc finger, C3HC4 type (RING finger)
  Pfam module annotation: Pfam domain module=DEAD::DUF1605::HA2::Helicas e_C::IBR::IBR::zf-C3HC4; Domain location=296-470::828-941::696 -792::543-636::1636-1701::1702-1766::1569-1611
MKKATNPNPFSTPRRHDFHRPPPPTHGCGWTPRPVHHRPYHQWRPRFHPHAARIDRPPEPYFRVELRLGRCPLHRDDVEALIDECRSSHDSFTFYPTDDVAAVLNYRSWEQARDAVVWFWEARLAEKHDFTPALDSNVVVVKDDVDCRLRPVFARHVKGLMMMEEGKEVKFGMDECERLAKEISRLSSSLSKPLRIGTQNELMKKKKGLVDEKNLVERRLKEFESAMQCLLKYLEDGGDDVEGVKVFRFDGGIFFRKYIISSGNYWGEIVGKCHRNCGHKDSKFLDIAWEIGSNVTAIAVAENLDVVAEIATQTGGIFCVFPGLAGISGATGSGKSTQLVQFLADSGVGSDKSIVCTQPRKIAAKAVAQRVQQESSGCYEGQSIKYCSTFLSSREFDSRITFMTDHSLLQHYMSDNNLSGVSCIIIDEAHERSLNTDFLLTLLKSLLCRRVEMRLIIMSATADAKQLSDYFFGCGIFHVLGRSFPVDIKYVPSDCGGDSGSAVVASYVSDVVRMATEIHKTEKEGTILAFLTSQIEVEWACEKFQAASAVALPLHGKLSSDEQFRVFQNYPGKRKVIFSTNLAETSLTIPGVRYVIDSGVVKDSRFDPSSGMSVLKVCWISQSSADQRAGRAGRTEPGVCYRMYLEADYQSMDLNTEPEIRKVHLGVAVLRILALGVKDMQDFDFVDAPSPSSIDMAIRNLIQLGAIELNNNAHDLTSEGWCLVRMGIEPRLGKLILGCFKHGLGREGIILAAVMANASSIFCRVGSEFDKQRSDCLKVQFCHCDGDLFTLLSVYKEWEALPRERKNKWCWENSINAKSIRRCQDTILELETCLEREHDIVTPSYWLWDPCMPSNHDKNLKRVILSSLVENVAMYSGCNQLGYEVAQTGQHVQLHPSCSLLVFAEKPSWVVFGELLSISNQYLVCVCAFDFQSLFNLCPAPLFDVSKMEERKLLMKTLSGLGCILLKRFCGKANCDLLALVSRIRKACMDERIFIEVNVDKNEIHLYATSNEMDIALGLVNGVLEYERKLLRTECMDKFLYHGSGFSPPVALFGSGAEIKHLELEKRSLSVDVCHPNINEIDDRELLMFFEKNTSGCICAVHKFTGNMRDGDRDKWGRIIFMSPDVVRRAAELDGQEFCGSSLKIVPSQLGWDKTFSFPAVKARISWPRRLSRGFAIVKCDIKDVNYILRDFYNLAVGGRYVRCEIGKKSIDSVVINGLDKELSEAEIVDVLRTATSRRILDFFLVRGDAAGNPPCSALEEALLKEIYPFLPKRNPHIIPCRVQVFAPEPKDSFMRALITFDGRLHLEAAKALEQIEGKVLPGCLSWQKIKCQQLFHSSIIFPTPVYHVIKEQLDEVLASFRNLKGNTFSSVDACLECNLGRTVNGSHRVKITANATRTVAEVRRPLEELLRGKTIEHDSLTPVVFQLMLSRDGFSLKNSLQQETGTYILFDRHNLNLRVFGSPNKVALAQEKVIQSLLSLHEEKQLEIHLRGMDLPPDLMKQMIKNFGPDLRGLKERVPGVDLTLNTRRHIVILHGSKELKPRVEEIIFEIARSSHHLVERFENGPSCPICLCEVEDGYRLEGCGHLFCRLCLVEQFESAINNQGTFPVCCTHRDCGDPILLTDLRSLLFGDKLEDLFRASLGAFVATSGGAYRFCPSPDCPSIYRVADPESAGEPFVCGSCYSETCTRCHLEYHPYLSCERYQEFKEDPDSSLKEWCRGKEQVKCCSACGYVIEKVDGCNHVECKCGKHVCWVCLEFFSTSNDCYNHLRTIHLAII

SEQ ID NO: 176971 - protein, 50 aa, Glycine max
  Coding DNA Sequence Number=SeqID_85286
MAMRTECELNRSSNLERSNYRCGTTEAKALLKERKNVWVLSWMPYIGRAM

SEQ ID NO: 176972 - protein, 43 aa, Glycine max
  Coding DNA Sequence Number=SeqID_85287
PEKKELIIVKQSKILFEMAHYLSQAAVEQEVVQKVWQHEHDGE

SEQ ID NO: 176973 - protein, 95 aa, Glycine max
  Coding DNA Sequence Number=SeqID_85288
MVVLLEQKLARIEYEDGNPIKPKVHIADSIFEGLCAGWQQALAGFEILDIGNGYFMVKFDKDDDRKKSSVALQSANANKTKIQINGRGGRGNNSN

SEQ ID NO: 176974 - protein, 219 aa, Glycine max
  Coding DNA Sequence Number=SeqID_85289
MESAISCNVKDCDENVTAPQFKSSSNTGKTRMDQFKRAQIERLERRDYRPNVSGDEDDDGERTEPGISNGEEHVARHIGTGEVPKREKHHARAAAAIALKRRRLVVFLGWKEPLPWCDNKCAKDKNTVHVAQHGGEVRQRCGSKARFDRPATAQCDNKARCDEGAASRLGVTTQRQGEVQAYFKSMAVSYVHMLQRNRAFHKGNSPILIAFTRQEGTTV

SEQ ID NO: 176975 - protein, 42 aa, Glycine max
  Coding DNA Sequence Number=SeqID_85290
GEALLAQAKERNRGAFLAGLRVANGNRTIRLGDPDLVSQMAS

SEQ ID NO: 176976 - protein, 155 aa, Glycine max
  Coding DNA Sequence Number=SeqID_85291
MVSVEASSSKESVGSESEVRGFRDEGSSDLSVFLSQLPPNAVEKEKCLSPPIMLPEYMWVDGEVGTYFSCYNHELDLINVISWLLINDMTDLETCSITLCMVRSNATLLAEFVLMNRDFFYMYDCLFRDLHVKVPFDDFSMGVLWILNVAPTQLH

SEQ ID NO: 176977 - protein, 326 aa, Glycine max
  Coding DNA Sequence Number=SeqID_85292
  Homolog annotation: Hit_ID=Q9LFT4; Match level="QueryCoverage=97%, HitCoverage=98%, E-value=6e-74, Identity=43%"; Hit description =Putative uncharacterized protein F18D22_90
MEELRKLEKVHSMLEFMESRGVSNLDHHSNRFLANFILFLIEPSGDLAINDKCSLLSQLIPTLSSSFLEDAYQHHLDTTKRENSAVMMQLDKMNEKLLQTPYNGKCVFGEKDEWQRETKLLVSCFSNDPVRPLATILEHKGLLTERIREELRLGEEYWALERKLCSALTNKEKILVEDVMKAIHLKSFDYRVLNLLLYQLQGTKVEELHMEFLSISELLVEVADDLYDYEDDVLENNFNILRMFIRIYGPSAAPSMLAKCIGEAEDKYASLQKSLDPHLSLSYQKRCAEATKEGGKVSDHPLGTWSIPTVIQDEELYRLKLKSDIS

SEQ ID NO: 176978 - protein, 88 aa, Glycine max
  Coding DNA Sequence Number=SeqID_85293
MAGMHNGMEECRLMTMEGGRMDSRHTREEKEASMAWVIDVGGMVKASCPSHCIMENSGNNTENAKSNNPNFNAIRVQHQSLSAANILA

SEQ ID NO: 176979 - protein, 132 aa, Glycine max
  Coding DNA Sequence Number=SeqID_85294
MTMLVSLEALAMAGASDVECAMDIEEWERKDLEQYPPPHLLAQEEEEERNNGVYGLPNHNTWECHKEEEHGVTFTNHQEKLDSTIYGNNMVKMHEDESEQITSTIFRESKLSAGLGQSLDLSCFAYNGYIAK

SEQ ID NO: 176980 - protein, 842 aa, Glycine max
  Coding DNA Sequence Number=SeqID_85295
  Gene Ontology: Mol. function=ATPase activity, coupled to transmembrane movement of substances; Cellular component=integral to membrane; Biological process=transport
  Homolog annotation: Hit_ID=Q8VWH7; Match level="QueryCoverage=84%, HitCoverage=96%, E-value=0.0, Identity=58%"; Hit description =Peroxisomal ABC transporter
  Pfam annotation: Domain name=ABC_membrane_2; Domain location=78-359; Score=407.5; E_value=2e-119; Accession=PF06472.6; Description=ABC transporter transmembrane region 2
  Pfam annotation: Domain name=ABC_tran; Domain location=473-652; Score= 111.1; E_value=3.4e-30; Accession=PF00005.18; Description=ABC transporter
  Pfam module annotation: Pfam domain module=ABC_membrane_2::ABC_tran; Domain location=78-359::473-652
MEYIMLKNTIPVREFWRYPTLMRTLLLASGILIAGGTAAYVQSRFRVNKHDLFGHCNGHNNDKEVTEEEVVKGVSAPKKKQKKGLKSLQVLAAILLSGMGKFGARDLLGLVVIAVLRTALSNRLAKVQGFLFRAAFLRRVPLFLRLISENILLCFLLSTIHSTSKYITGTLSLHFRKILTKLIHSHYFENMVYYKISHVDGRITNPEQRIASDVPRFCSELSEIVQDDLTAVTDGLLYTWRLCSYASPKYVVWILVYVLGAGAAIRNFSPSFGKLMSKEQQLEGEYRQLHARLRTHSESIAFYGGERKEETHIQQKFKTLVRHMYSVLHDHWWFGMIQDLLLKYLGATVAVILIIEPFFSGHLRPDSSTLGRADMLSNLRYHTSVIISLFQSLGTLSISARRLNRLSGYADRIYELMAVSRELSLVNEKSSLQRNASRNCIREANYIEFDGVKVVTPTGNVLVDDLTLRVESGSNLLITGPNGSGKSSLFRVLGGLWPLISGHIVKPGIGSDLNNEIFYVPQRPYTAVGTLRDQLIYPLTEDQEIEPLTDRGMVELLKNVDLEYLLDRYPPEREVNWGDELSLGEQQRLGMARLFYHKPKFAILDECTSAVTTDMEERFCAKVRAMGTSCITISHRPALVAFHDVVLSLDGEGGWSVHYKREGSSTEVGIDTMKASETKRQSDAKAVQRAFSMSKKDSAFSNPKAQSYFAEVISSSPSMNHTIPPSVVPQLHCNTRVLPLRVAAMCKVLVSTFCKYALLRPLLVISNSGDHGSDGSGSSQLNGDWAGDNNAGDDGVKVAFSGLVAVVGRGGNGGCDGRERPKQGKHLCDVGVIRDCYLEGRG

SEQ ID NO: 176981 - protein, 395 aa, Glycine max
  Coding DNA Sequence Number=SeqID_85296
  Homolog annotation: Hit_ID=A7R286; Match level="QueryCoverage=76%, HitCoverage=100%, E-value=1e-114, Identity=69%"; Hit description =Chromosome undetermined scaffold_408, whole genome shotgun sequence
MAFTTTDILGTPHPQRITFLERATKLGSFRNSFVEKKERGPLAMDAILFLLHCLRQHRRHEEDSEARGSNGWGEGDAVELEARFEGKVKRNTSRMQRGTPVRKPHTNTSDLLTWSETPPPDSAAAATTRSGQPSDRISKVLHGGQLTDEEAQTLAKSKPCSGYKMKEMTGSGIFAANGEDSASEANSANLNNRTSIRMCQQAMNGISQISFSTDESISPKKPTSIPEVAKQRELSGTMQSDSDTKSKKQISNAKTKELSGNDIFGPPPEIVPRSVAAARTLESKESKDMGEPLPRNLRTSVKVSNPAGGQSNILFGEASVEKTAKKIHNQKFAELTGNNIFQGDVPPGSAEKPLSRAKLREMTGSDIFADGKTEIKDPVRGARKPPGGESSIALV

SEQ ID NO: 176982 - protein, 612 aa, Glycine max
  Coding DNA Sequence Number=SeqID_85297
  Gene Ontology: Mol. function=asparagine synthase (glutamine -hydrolyzing) activity; Cellular component=phagocytic vesicle; Biological process=asparagine biosynthetic process
  Homolog annotation: Hit_ID=Q14SM9; Match level="QueryCoverage=88%, HitCoverage=95%, E-value=0.0, Identity=92%"; Hit description =Asparagine synthetase, type III
  Pfam annotation: Domain name=Asn_synthase; Domain location=255-496; Score=340.3; E_value=3.3e-99; Accession=PF00733.12; Description =Asparagine synthase
  Pfam annotation: Domain name=GATase_2; Domain location=49-207; Score =31.0; E_value=8e-12; Accession=PF00310.12; Description=Glutamine amidotransferases class-II
  Pfam module annotation: Pfam domain module=Asn_synthase::GATase_2; Domain location=255-496::49-207
MPTLHLPALFCSVCDLEIEIYVYVTHLAAVDPRCKCFYFQPPCAESSQCWVASTTLRPSALASSNCLAVEKCRLRHRGPDWSGIDCYEDCYLAHQRLAIVDPTSGDQPLYNEDKTIVVTVNGEIYNHKQLRQKLSSHQFRTGSDCEVIAHLYEEYGEEFVNMLDGMFAFILLDTRDKSFIAARDAIGITPLYLGWGHDGSTWFASEMKALSDDCERFIAFPPGHIYSSKQGGLRRWYNPPWFSEDIPSTPYDPILLRETFERAVVKRLMTDVPFGVLLSGGLDSSLVASVVNRYLAESETARQWGSQLHTFCIGLKGSPDLKAAKEVADYLGTRHHELYFTVQEGIDALEEVIYHIETYDVTTIRASTPMFLMSRKIKALGVKMVLSGEGSDEIFGGYLYFHKAPNKKELHEETCQKIKALHLYDCLRANKSTAAWGVEARVPFLDKEFINVAMSIDPEWKMIRPDLGRIEKWVLRNAFDDDKNPYLPKHILYRQKEQFSDGVGYSWIDGLKDHANKQVTDATMMAANFIYPENTPTTKEGYLYRTIFEKFFPKNSAKATVPGGPSVACSTAKAVEWDASWSKNLDPSGRAALGVHAAAYDGAVDTTKNGPL

SEQ ID NO: 176983 - protein, 425 aa, Glycine max
  Coding DNA Sequence Number=SeqID_85298
  Homolog annotation: Hit_ID=A7R005; Match level="QueryCoverage=90%, HitCoverage=91%, E-value=1e-34, Identity=32%"; Hit description =Chromosome chr7 scaffold_294, whole genome shotgun sequence
  Pfam annotation: Domain name=VQ; Domain location=179-209; Score=49.4; E_value=1.3e-11; Accession=PF05678.5; Description=VQ motif
  Subcellular localization annotation: CTP_CleavageSite=33; ConfidenceScore=5.07e-01
MDSGNSGSMQSSSTAGDEEYDSRADPSLSSSISAFFNSNSHPSAPPQPTTLTNHVGPPFSTQHHHVFDPLSSNYLDPTQRSPQSNQILNLDMVRSKVAARSGPDFSSFIPSSSPHNNNNQAFLLTQLGGGGVNNVGAFPSTTLPPESGGGGLVMNEQVNSSNTNKNMVRNPKKRSRASRRAPTTVLTTDTTNFRAMVQEFTGIPAPPFTSSSSSFPRTRLDLFATSNASSSSIIREQTPSYLLRPFAHKVQAQVPSSIPPPSSFQPMLNNYHHHHHQHNPILSFQSILQPHQLIGSKTQQQPSLEIPPSALGLEELGLNHAHHQNINMRSSSSDGTLSRVNNDNNNMRGPSADWAQAQAQRIDNNDGGLLGSLTGATLNYRSNIVSDQRVKVTNNSDFHGEKGPECVVAVRSEGMVESWINCSSD

SEQ ID NO: 176984 - protein, 398 aa, Glycine max
  Coding DNA Sequence Number=SeqID_85299
  Gene Ontology: Mol. function=transcription regulator activity; Cellular component=nucleus; Biological process=regulation of transcription, DNA-dependent
  Homolog annotation: Hit_ID=A7R730; Match level="QueryCoverage=74%, HitCoverage=67%, E-value=1e-100, Identity=60%"; Hit description =Chromosome undetermined scaffold_1540, whole genome shotgun sequence
  Pfam annotation: Domain name=EIN3; Domain location=3-392; Score =448.8; E_value=7.5e-132; Accession=PF04873.4; Description=Ethylene insensitive 3
MAVINKEIIDEPYEQEECIDYEQLKKRMWKDRVLLQKLKEKREKQEPDVEAKQEASRRKKMSRAQDSVLKYMVKIMEDCNAQGFVYGIIPEKGKPVSSYSDSLREWWKDQIRFDQNAPVAISKYLPVLENDLDISSYIHLLQDLQDSTCTRLSSLCSHARMQHCAPPQRRFPLERGLSPPWWPSGEEVWWGQQGLLAQVHGPPPYRKPHDLKKAWKVSVLAAVIKHISPDFDKLRRLVTQSKTLQDKMTAKDSATWSKVMIQEEAWLGLTDKCLKISASNQEEEDDIAQGLKRKGAFGFGDAALDTMYACQNVEFPQSEDDWMNVAVQNDVSLGEDAGGSGTLEDDPCYWLNSVENLELQAALELLVRDNVDFAPNIPQGQEDAASASDLGTHPPQQG

SEQ ID NO: 176985 - protein, 94 aa, Glycine max
  Coding DNA Sequence Number=SeqID_85300
MADCFLTDVVGIRILPHCRDEWIWKPESSGQYSVRSAYGVLQEFFPYGGNPCLGLTLLELSHRNLGNTSPSMRHVCLTEKVIIDGGAGGWPSHG

SEQ ID NO: 176986 - protein, 533 aa, Glycine max
  Coding DNA Sequence Number=SeqID_85301
  Gene Ontology: Mol. function=secondary active sulfate transmembrane transporter activity; Cellular component=integral to membrane; Biological process=sulfate transport
  Homolog annotation: Hit_ID=A7PL70; Match level="QueryCoverage=82%, HitCoverage=68%, E-value=1e-143, Identity=57%"; Hit description =Chromosome chr7 scaffold_20, whole genome shotgun sequence
  Pfam annotation: Domain name=STAS; Domain location=404-520; Score =108.7; E_value=1.8e-29; Accession=PF01740.12; Description=STAS domain
  Pfam annotation: Domain name=Sulfate_transp; Domain location=91-381; Score=396.0; E_value=5.9e-116; Accession=PF00916.11; Description =Sulfate transporter family
  Pfam module annotation: Pfam domain module=STAS::Sulfate_transp; Domain location=404-520::91-381
  Subcellular localization annotation: CTP_CleavageSite=13; ConfidenceScore=5.02e-01
MGVKRVVLTSSISVMVVTSPIMKAARKEKKNSTEFWRRVMTTSPLQIPGLDNPATILHETSGSDDEAWAIDEFEEVLEVVGVEKEVVGDWFGFLVEYLSDPTIVGFLAAAAVSIGLQQLKGLFGIVNFTNKTGLFSVVKSLWTSFKNQGKRNKKLMWLSHVAPLLSVIVSSVVAYKINFNELQVKDYKVEVLGPIKGGSSNPSSLHQLTFDSQVVGHLIRIGLTIAIISLTGSIAVGRSFASLKGHSIDPNREVVSLGIMNIVGSLTSCYIASGSLSRTAVNYNAGSETMVSNIVMALTVLMSLKFLTGLLYFTPKAILAAIILSAVPGLIDLNKAREIWNVDKMDFLACTGAFLGVLFASAEIGLAIGITISFAKIIITSIQPATAVIGRLPGTDAFGDVEQYPMAVNIPGVLIVSLKSSWLCFANANLVEERIERWVNNAKAKEGRESTFTYVIIDASSLTNIDTAGIASLVELNKNLISRGVKLAIANPRWHVIHKLRLANFVSKIGGRIFLSVGEAVDACVGTKIMVVV

SEQ ID NO: 176987 - protein, 704 aa, Glycine max
  Coding DNA Sequence Number=SeqID_85302
  Gene Ontology: Mol. function=DNA-directed DNA polymerase activity; Cellular component=epsilon DNA polymerase complex; Biological process=nucleobase, nucleoside, nucleotide and nucleic acid metabolic process
  Homolog annotation: Hit_ID=A7PQF7; Match level="QueryCoverage=93%, HitCoverage=29%, E-value=0.0, Identity=79%"; Hit description=DNA polymerase
  Pfam annotation: Domain name=DNA_pol_B; Domain location=45-528; Score= -134.5; E_value=0.00054; Accession=PF00136.12; Description=DNA polymerase family B
MPPSIVTEEVCTACDFNRPGKTCLRKLEWVWRGETFMAKKSDYYALKTQIESEFVDDSEKNNRALSHYSEKSSKSFLDLPKAEQQSRLKERLKKYCQKAYKRVLDKPVTELREAGICMRENPFYVDTVRSFRDRRYEYKGLNKVWKGKLSEAKASGNSIKIQEAQDMVVLYDSLQLAHKCILNSFYGYVMRKGARWYSMEMAGVVTYTGAKIIQNARLLVEKIGKPLELDTDGIWCALPGSFPENFTFKTRDPKKKFTISYPCVMLNVDVAINNSNDQYQTLTDPIRKTYTTRSECSIEFEVDGPYKAMILPASKEEGILIKKRYAVFNDDGTLAELKGFEIKRRGELKLIKVFQAELFDKFLHGSTLEECYSAVASVANGWLDLLDNQGKDIADSELLDYISESSTMSKSFADYGLQKSCAVATARRLADFLGDTMVKDKGLRCQYIVASEPKGTPVSERAVPVAIFETDAEVMKFYVRKWCKVSSDVDIRSIIDWSYYKQRLSSAIQKIITIPAAMQKVANPVPRVVHPDWLHKKVREKEDKFRQRKLVDAFKSMNRNEHSKKHNDSNRVPLVIDDDIVNELEDFGNKDRSSTCRPRPIIRHYEANNERHSGKLNDQDVEQQHNKPLQQKVDKNVDYEGWLQIKKQTWKDILERRKKRSVWDLSPTLEVCGSTVGFCKALDIDYYWGWVSVKFHKKSKFHIG

SEQ ID NO: 176988 - protein, 2258 aa, Glycine max
  Coding DNA Sequence Number=SeqID_85303
  Gene Ontology: Mol. function=binding; Cellular component=ubiquitin ligase complex; Biological process=protein ubiquitination
  Homolog annotation: Hit_ID=A2YAU5; Match level="QueryCoverage=96%, HitCoverage=97%, E-value=0.0, Identity=65%"; Hit description =Putative uncharacterized protein
  Pfam annotation: Domain name=Arm; Domain location=1177-1217; Score =0.2; E_value=10; Accession=PF00514.14; Description=Armadillobeta -catenin-like repeat
  Pfam annotation: Domain name=Arm; Domain location=1318-1359; Score =14.5; E_value=0.16; Accession=PF00514.14; Description=Armadillobeta -catenin-like repeat
  Pfam annotation: Domain name=Arm; Domain location=1403-1441; Score =7.2; E_value=1.3; Accession=PF00514.14; Description=Armadillobeta -catenin-like repeat
  Pfam annotation: Domain name=Arm; Domain location=1487-1527; Score =10.4; E_value=0.53; Accession=PF00514.14; Description=Armadillobeta -catenin-like repeat
  Pfam annotation: Domain name=Arm; Domain location=1528-1568; Score =11.6; E_value=0.37; Accession=PF00514.14; Description=Armadillobeta -catenin-like repeat
  Pfam annotation: Domain name=Arm; Domain location=1570-1610; Score =5.0; E_value=2.6; Accession=PF00514.14; Description=Armadillobeta -catenin-like repeat
  Pfam annotation: Domain name=Arm; Domain location=1654-1696; Score =7.1; E_value=1.4; Accession=PF00514.14; Description=Armadillobeta -catenin-like repeat
  Pfam annotation: Domain name=Arm; Domain location=1802-1844; Score =4.1; E_value=3.3; Accession=PF00514.14; Description=Armadillobeta -catenin-like repeat
  Pfam annotation: Domain name=Arm; Domain location=181-222; Score =27.1; E_value=6.3e-05; Accession=PF00514.14; Description =Armadillobeta-catenin-like repeat
  Pfam annotation: Domain name=Arm; Domain location=1886-1927; Score =10.4; E_value=0.53; Accession=PF00514.14; Description=Armadillobeta -catenin-like repeat
  Pfam annotation: Domain name=Arm; Domain location=1929-1969; Score =22.6; E_value=0.0014; Accession=PF00514.14; Description =Armadillobeta-catenin-like repeat
  Pfam annotation: Domain name=Arm; Domain location=2049-2089; Score =1.2; E_value=7.7; Accession=PF00514.14; Description=Armadillobeta -catenin-like repeat
  Pfam annotation: Domain name=Arm; Domain location=223-263; Score =12.1; E_value=0.32; Accession=PF00514.14; Description=Armadillobeta -catenin-like repeat
  Pfam annotation: Domain name=Arm; Domain location=313-353; Score=5.2; E_value=2.4; Accession=PF00514.14; Description=Armadillobeta-catenin -like repeat
  Pfam annotation: Domain name=Arm; Domain location=355-396; Score =10.9; E_value=0.45; Accession=PF00514.14; Description=Armadillobeta -catenin-like repeat
  Pfam annotation: Domain name=Arm; Domain location=398-447; Score=8.9; E_value=0.81; Accession=PF00514.14; Description=Armadillobeta-catenin- like repeat
  Pfam annotation: Domain name=Arm; Domain location=568-610; Score=0.6; E_value=9.3; Accession=PF00514.14; Description=Armadillobeta-catenin -like repeat
  Pfam annotation: Domain name=Arm; Domain location=612-652; Score =39.8; E_value=9.5e-09; Accession=PF00514.14; Description =Armadillobeta-catenin-like repeat
  Pfam annotation: Domain name=Arm; Domain location=654-694; Score =20.1; E_value=0.0082; Accession=PF00514.14; Description =Armadillobeta-catenin-like repeat
  Pfam annotation: Domain name=Arm; Domain location=733-773; Score=1.6; E_value=6.9; Accession=PF00514.14; Description=Armadillobeta-catenin -like repeat
  Pfam annotation: Domain name=Arm; Domain location=820-858; Score=5.7; E_value=2.1; Accession=PF00514.14; Description=Armadillobeta-catenin -like repeat
  Pfam annotation: Domain name=Arm; Domain location=905-947; Score=2.5; E_value=5.4; Accession=PF00514.14; Description=Armadillobeta-catenin -like repeat
  Pfam annotation: Domain name=C2; Domain location=2139-2219; Score =61.0; E_value=4e-15; Accession=PF00168.21; Description=C2 domain
  Pfam annotation: Domain name=HEAT; Domain location=1184-1219; Score =1.4; E_value=17; Accession=PF02985.13; Description=HEAT repeat
  Pfam annotation: Domain name=HEAT; Domain location=1344-1380; Score =0.2; E_value=25; Accession=PF02985.13; Description=HEAT repeat
  Pfam annotation: Domain name=HEAT; Domain location=1662-1698; Score =11.1; E_value=0.59; Accession=PF02985.13; Description=HEAT repeat
  Pfam annotation: Domain name=HEAT; Domain location=188-224; Score =17.2; E_value=0.061; Accession=PF02985.13; Description=HEAT repeat
  Pfam annotation: Domain name=HEAT; Domain location=229-265; Score =9.7; E_value=0.96; Accession=PF02985.13; Description=HEAT repeat
  Pfam annotation: Domain name=HEAT; Domain location=361-398; Score =5.7; E_value=3.8; Accession=PF02985.13; Description=HEAT repeat
  Pfam annotation: Domain name=HEAT; Domain location=662-696; Score =6.0; E_value=3.4; Accession=PF02985.13; Description=HEAT repeat
  Pfam annotation: Domain name=HEAT; Domain location=739-775; Score =4.2; E_value=6.5; Accession=PF02985.13; Description=HEAT repeat
  Pfam annotation: Domain name=HEAT; Domain location=963-998; Score =1.7; E_value=15; Accession=PF02985.13; Description=HEAT repeat
  Pfam annotation: Domain name=HEAT_PBS; Domain location=1387-1423; Score=12.5; E_value=1.4; Accession=PF03130.7; Description=PBS lyase HEAT-like repeat
  Pfam annotation: Domain name=HEAT_PBS; Domain location=1428-1467; Score=0.8; E_value=79; Accession=PF03130.7; Description=PBS lyase HEAT-like repeat
  Pfam annotation: Domain name=HEAT_PBS; Domain location=1815-1841; Score=3.6; E_value=30; Accession=PF03130.7; Description=PBS lyase HEAT-like repeat
  Pfam annotation: Domain name=HEAT_PBS; Domain location=209-245; Score= 0.3; E_value=95; Accession=PF03130.7; Description=PBS lyase HEAT-like repeat
  Pfam annotation: Domain name=HEAT_PBS; Domain location=383-420; Score= 6.6; E_value=11; Accession=PF03130.7; Description=PBS lyase HEAT-like repeat
  Pfam annotation: Domain name=HEAT_PBS; Domain location=434-462; Score= 3.9; E_value=27; Accession=PF03130.7; Description=PBS lyase HEAT-like repeat
  Pfam annotation: Domain name=HEAT_PBS; Domain location=639-676; Score= 5.6; E_value=15; Accession=PF03130.7; Description=PBS lyase HEAT-like repeat
  Pfam module annotation: Pfam domain module=Arm::Arm::Arm::Arm::Arm::Ar m::Arm::Arm::Arm::Arm::Arm::Arm::Arm::Arm::Arm::Arm::Arm::Arm::Arm::Ar m::Arm::Arm::C2::HEAT::HEAT::HEAT::HEAT::HEAT::HEAT::HEAT::HEAT::HEAT: :HEAT_PBS:...
  Pfam module annotation: Pfam domain module=:HEAT_PBS::HEAT_PBS::HEAT _PBS::HEAT_PBS::HEAT_PBS::HEAT_PBS; Domain location=1177-1217::1318 -1359::1403-1441::1487-1527::1528-1568::1570-1610::1654-1696::1802 -1844::181-222::...
  Pfam module annotation: Domain location=1886-1927::1929-1969::2049 -2089::223-263::313-353::355-396::398-447::568-610::612-652::654 -694::733-773::820-858::905-947::2139-2219::1184-1219::1344 -1380::1662-1698::188-224::...
  Pfam module annotation: Domain location=229-265::361-398::662 -696::739-775::963-998::1387-1423::1428-1467::1815-1841::209-245::383- 420::434-462::639-676
MYKEVDYLFPRDSILSKAVAQANVKAEPMSLQAEAVVGAHYVMKMSVILLHHRKTNRFASQSLKIWRGSSVLVDLLGRVFERKAKLATTLTWRFAASNGSTLAANDMERNGDGKAQDSEALPPHSVLKMGLRERSNSSSMEDPDGTLASVAQCIEQLRQSSSSMQEKEYSLKQLLELIDMRENAFSAVGSHSQAVPVLVSLLRSGSLNVKIQAATVLGSLCKENELRVKVLLGGCIPPLLGLLKSSSAEGQVAAAKTIFAVSQGGAKDHVGSKIFSTEGVVPVLWEQLQKGLKTGNVVDNLLTGALKNLSSSTERFWNATIQAGGVDILIKLLTTGQSSTLANVCFLLACMMMEDASVCSKLLTAEATKQLLKLLGPGNDAPVRAEAAGALKALSAQCKDARKEIANSNGIPALINATIAPSKEFMQGEYAQALQENAMCALANISGGLSYVISSLGQSLESCSSPTQAADTLGALASALMIYDDKAESTRASDPLVVEQTLLEQFKPGLPFLVQERTIEALASLYSNPILSIKLTNSDAKRLLVGLITMAANEVQDELLKSLLTLCNTECSLWLALQGREGVQLLISLLGLSSEQQQECAVSLLCLLSNENDESKWAITAAGGIPPLVQILESGSAKAKEDSATILRNLCDHSEDIRACVESADAVPALLWLLKNGSPNGKEIAAKTLNHLIHKSDTATISQLTALLTSDLPESKVYVLDALRSMLSVVALTDLLREGSAASDAIVTMIKLLSSTKEETQAKSASALAGIFETRKDVRESSIAVKTLWSAMKLLNVESESILMESSRCLAAIFLSIKENKDVAAIARDALLSLVALANSSVLEVAELATCAVANLILDSEIAEKAVAEEVILAATRVLREGTISGKTHAAAAIARLLHCKRQVDYAVTDCVNRAGTVLALVSFLDFAIDGHSSTSEALEALAMLSRSDVTGAHSKPAWAVLAEFPKSISPIVLSIADSTSVLQDKAIEILSRLCKDQPFVLGDSVVTASGCISSIAKRIINSTSKNVKVKIGGAAVLICAAKLNHQRLVEDLNRSNLCANLVQSLVDMLISSQATLDNQGDDSREVISICRHTKEANDGKSNTGTAIISGANLAVWLLSVLACHDEKSKIAIMEAGAIEVLTDRIADCFSQYSQIDYKEDSSMWICALLLAILFQDRDIIRAHATMKSIPALANLLKSEESANRYFAAQSIASLVCNGSRGTLLSVANSGAAGGLISLLGCADSDIQDLLELSDEFSLVHYPDQVALERLFRVDDIRIGATSRKAIPALVDLLKPIPERPGAPFLALGLLTQLSIDCPSNKIVMVEAGALEALSKYLSLGPQDATEEAATDLLGILFSSAEIRRHESAVGAVTQLVAVLRLGGRAARYRAAKALESLFSADHIRNAETARQAVQPLVEILNTGLEREQHAAIAALVRLLSENPSKALAVADVEMNAVDVLCRILSSDCSMDLKGDAAELCSVLFGNTRIRSTMAAARCVEPLVSLLVSEFSPAHHSVVRALDRLVDDEQLAELVAAHGAVIPLVGLLYGRNYVLHEAISRALVKLGKDRPACKMEMVKAGVIESILDILHEAPDYLCAAFAELLRILTNNASIAKGPSAAKVVEPLFMLLTREEFGPDGQHSALQVLVNILEHPQCRADYSLTSHQVIEPLIPLLDSPISAVQQLAAELLSHLLLEEHLQKDPVTQQQRAIKALVSIALIWPNEIAKEGGVIEISKVILQSDPSIPHALWESAASVLASILQFSSEYYLEVPVAVLVRLLRSGLESTVVGALNALLVLESDDGTSAEAMAESGAIEALLELLGSHQCEETAARLLEVLLHNVKIRETKVTKSAILPLSHYLLDPQTQAQQARLLATLALGDLFQNEGLARTSDAVSACRALVNVLEDQPTEEMKVVAICALQNLVMYSRSNKRAVAEAGGVQVILDLIGSSDPETSVQAAMFIKLLFSNHTIQEYASSETVRAITDKGAISNLNSLVSNVDSVSNNKLLHLDNLSLESRVSAIEKDLWATGSVNDEYLKALNSLFSNFPRLRATEPATLSIPHLVTSLKTGSEATQEAALDALFLLRQAWSACPAEVSRAQSIAAADAIPLLQYLIQSGPPRFQEKAEFLLQCLPGTLVVIIKCGNNMKQSVGNPSVFCKLTLGNTPPRQTKVVSTGPNPEWDESFTWSFESPPKGQKLHISCKNKSKMGKSSFGKVTIQIDRVVMLGAVSGEYTLLPESKSGPSRNLEIEFQWSNK

SEQ ID NO: 176989 - protein, 50 aa, Glycine max
  Coding DNA Sequence Number=SeqID_85304
MGEGYCIQPYPCICKEAISGFEPMTNKSPRHNFTAAPELALRKIDLPSFC

SEQ ID NO: 176990 - protein, 470 aa, Glycine max
  Coding DNA Sequence Number=SeqID_85305
  Gene Ontology: Mol. function=DNA-directed DNA polymerase activity; Cellular component=epsilon DNA polymerase complex; Biological process=nucleobase, nucleoside, nucleotide and nucleic acid metabolic process
  Homolog annotation: Hit_ID=A7PQF7; Match level="QueryCoverage=97%, HitCoverage=21%, E-value=1e-168, Identity=62%"; Hit description=DNA polymerase
  Pfam annotation: Domain name=DUF1744; Domain location=109-467; Score =362.7; E_value=6.2e-106; Accession=PF08490.3; Description=Domain of unknown function (DUF1744)
MYISWIVVIKGVYETKVPLEFNAIVQLGCVCKVDKTANKRSLQEPWNLSELHMKTTVECAYLEQSISFFYFYHSISEGRAIYVGYFPALKAITVVVVNPYQNKDLSPTFLERQFHDACQSLSIDSPPRNGINFKLDYVAHVKDAEAVMQRAINGHRFLAGNKLLLNWNATLCCISPMAKSKNCSLKICPFYQTKWLIKTSKNICNTLYMSLTVVPLGNFELDWLIFIADIFFSRALHDNQQVLWISDDGLPDLGGINGEQNCFVDEVQQPVLTYPGAYRNVTVELKIHHLAVNALLKYNLVNEMEGGTLLGFGHELDSGAFSTNDQNGFDESTSCAQAFRVLKQLIQRCLADAVTSGNVYADSILQHLYRWLCSPKSKLHDPALHQLLHKVMQKVFALLLAEFRKLGAMIVFANFTKIVIDTGKYDLSRAKAYCDSLLRTIQSRDLFEWVELEPLQFWCSLLFMDQASLL

SEQ ID NO: 176991 - protein, 333 aa, Glycine max
  Coding DNA Sequence Number=SeqID_85306
  Homolog annotation: Hit_ID=A5BQ09; Match level="QueryCoverage=80%, HitCoverage=74%, E-value=7e-25, Identity=28%"; Hit description =Putative uncharacterized protein
MQFGLRTPEIPDESRISRGSMSIPFRFHESALSMMEYENDRRVRRLSTGPFTLKIIMQTNCPILAHICCVDKFKWPLTKDTVVLRVTTRTYVIALPGLLYALQFPSLCTRPSLRILSDVFTKYGHFQDLRPQKLGGCSMQFNEPGMLESLRPHFEHIAHETLFELGNIPGISRFCMEDHNSSFLRACRMSAITKMIKKSMRLKKMTSSLVEINGTNPLEAHLGRAYAVASTYTRLVDSAEYASLVSCGLGEKLENVVSPLRFGSVDVGYQVWNLNQLGLLSFMSLLGPHVEEEVEYVSHVSSREEWWNAMAEKDQEEAEASAKDEGNEKNMES

SEQ ID NO: 176992 - protein, 192 aa, Glycine max
  Coding DNA Sequence Number=SeqID_85307
  Gene Ontology: Mol. function=oxidoreductase activity; Cellular component=extracellular region; Biological process=lignin catabolic process
  Homolog annotation: Hit_ID=Q94ID0; Match level="QueryCoverage=65%, HitCoverage=23%, E-value=1e-48, Identity=64%"; Hit description =Laccase
  Pfam annotation: Domain name=Cu-oxidase_3; Domain location=8-129; Score=58.3; E_value=2.6e-14; Accession=PF07732.6; Description =Multicopper oxidase
MRRSNPNVWFSSQDIPWEFTEKKCRVVATSRLRSSMVELEHDTQEFDVQSDESMSNVVDAVVDKHGVREPRDPWSDGPENITQCPIQPGTSFTQKVAFTLEEGTLWWHAHSSWTRATVHGVIVILPANGTSYPFPEPYGQETLIIGEWYKGDVMQIINSALATGDEPITSDAYTINGQPGDFYNCSKGTLLS

SEQ ID NO: 176993 - protein, 156 aa, Glycine max
  Coding DNA Sequence Number=SeqID_85308
MEDHNITGACRMSAITKMIMESMRLKTMTSSLVEIKGTNPPESRQGSNYTRLFDSAEFGISISCMSHLGPEVEEEVKHVSERQEWWNIVMADEKEAEEAEASAKDEGNGKKYGVIDYIESRSETRSCMIEVLDSHICVLELCNDLSLIREGTKQMS

SEQ ID NO: 176994 - protein, 498 aa, Glycine max
  Coding DNA Sequence Number=SeqID_85309
  Gene Ontology: Mol. function=alanine-glyoxylate transaminase activity; Cellular component=mitochondrion; Biological process =arginine catabolic process to glutamate
  Homolog annotation: Hit_ID=A7PL38; Match level="QueryCoverage=92%, HitCoverage=92%, E-value=0.0, Identity=82%"; Hit description =Chromosome chr7 scaffold_20, whole genome shotgun sequence
  Pfam annotation: Domain name=Aminotran_3; Domain location=77-435; Score=241.5; E_value=1.9e-69; Accession=PF00202.12; Description =Aminotransferase class-III
MAMVKRSIGVCKRLSGSSSCLSTSTATSDNDIARRLQLPPFDYKPRPYKGPLADEVFAKRKKFLGPSLFHFYQKPLNIVEGKMQYLFDENGRRYLDAFAGIVTISCGHCHPEVLNAIMEQSKLLQHTTTIYLHHAIADFAEALASKVPGNLKVVYFVNSGSEANDLAMLMARLYTGNMGMISLRNAYHGGSSSTIGLTAMNTWKYPIPEGEVHHIMNPDPYRGIFGSDANRYARELQDHIDYGTSGKVAGFIAETIQACIIHPSCLISKLQSGIYSHTHLSVGAGGAVELAPGYLKLVYDIVHKAGGVCIADEVQCGFARTGSHFWGFETQGVIPDIVTMAKGIGNGLPLAAVVTTPEIASVMAQKLQFNTFGGNPVCSAGGLAVLRVLDKEKRQSHCADVGSHLIQRLRSLMQIHDIIGDVRGRGLMVGIEFVTDRKEKTPAKAETTALHERFRELGILVGKGGLHGNVFRIKPPMCFTKDDADFVVDALDYAISKL

SEQ ID NO: 176995 - protein, 124 aa, Glycine max
  Coding DNA Sequence Number=SeqID_85310
MKLKSGELLKHIPWKKTVDPNLPTSSQRPKESYPTDRIIPQNTNDGQIRTEFYIPEPVFQKAEDLADDYSSLDRDWEDYNAQLMEDLLHKKKYCYHHPVYGSLTRSEVQNYNLSLSTRSDYRSD

SEQ ID NO: 176996 - protein, 76 aa, Glycine max
  Coding DNA Sequence Number=SeqID_85311
MQGQFLLVGLGSSSSMDSFASWKMNGERKRERRCHFKEKMSLEEAHHHRRPWIRAWRKKEMNEGRGREEHEILCSK

SEQ ID NO: 176997 - protein, 139 aa, Glycine max
  Coding DNA Sequence Number=SeqID_85312
MAQWSVCAVLLSFLILSVGEGTDVQRCGGRRRHTKYAFVLGVHFGVPQMDEDQWMYESIIPEEVNMGHENEEECGVNEPHVDCSEAFNTSQRMFCGGLDPLLMKMDLWRKKEFVTRDNKTRKCGCPFKLCGKPVDGGQG

SEQ ID NO: 176998 - protein, 237 aa, Glycine max
  Coding DNA Sequence Number=SeqID_85313
  Gene Ontology: Mol. function=oxidoreductase activity, acting on the CH-OH group of donors, NAD or NADP as acceptor; Cellular component =chloroplast; Biological process=amino acid biosynthetic process
  Homolog annotation: Hit_ID=A9PEK1; Match level="QueryCoverage=22%, HitCoverage=8%, E-value=1e-12, Identity=69%"; Hit description =Putative uncharacterized protein
  Pfam annotation: Domain name=Mmp37; Domain location=71-223; Score= -194.3; E_value=0.0094; Accession=PF09139.2; Description =Mitochondrial matrix Mmp37
MELLKCIFERSPNLLERDGDGPFPTCKNLSIEELCIVGINKVDLPATTKHNCLVVNTPTSNTIDVAKHIMMLLAAMARNVAQADASVKAVAMASIKNLKSNKHQYVSWMVHLGRKSLITRVADRIGVGVHFNPFVTWNGKKLKDDKAQKLALQHWIEVRIRNLIVSISYARIQENKEKRMTNVKHLGVDILGTIIYTGSAKIFTLNEIEKATNNFNSSRILGKGGFGLVYKGNLDDG

SEQ ID NO: 176999 - protein, 213 aa, Glycine max
  Coding DNA Sequence Number=SeqID_85314
MVVKRLKVINQDSFVSGWKRDFDSLKTTKASDIGLAVSGQQDDHTGLCVSSNLGSLNDELEDADICGKGADDHIGLCVSSDLGSPNDKVQIIGADDYIGLCMSSDSGSPNDESEHSDIFGKGADDHIGLYVSSDLGSPNNEITVRCLHMSSDLSSPDDKGADNREVRITIRSLCVSLDLPSPDDEGVDNNESSTKETDDHISLYVTTSSLVSD

SEQ ID NO: 177000 - protein, 124 aa, Glycine max
  Coding DNA Sequence Number=SeqID_85315
MEIKRVGKKKTNTRDLYWFDNNPCLHPVPKRPAVLEISFQPCKNPLTSKDPQGMYPPLFSLNNLVDVPSTRTDPQEMEKGDTKEYRRLVLRSFGKGRRETQKEFRRLVLGEFFLAKGEGNEKDE

SEQ ID NO: 177001 - protein, 117 aa, Glycine max
  Coding DNA Sequence Number=SeqID_85316
  Subcellular localization annotation: CTP_CleavageSite=56; ConfidenceScore=5.50e-01
LSSLVTDVWGANTFPARKYNSRTFHLKVRRSRLFRFFRRFPQINVGGDSARIPFVEHASRESRVALPPKGNYRHTILFKESDKLEAAKQKEANSSIPQVHEIIRKSINAYIVSKVVH

SEQ ID NO: 177002 - protein, 156 aa, Glycine max
  Coding DNA Sequence Number=SeqID_85317
MEQIPKISLSDPNFIWGLSFTNVLILDSRIVVFDTSFRTKQRITQCFDQEYKRIPRNEGKGSPSSPRLASSSPGPWNYLLAKQPAHLGELITSRLRHDGGCFKGLEGSTLKGIERKEEEREKEEERRGNEAETLPNRDRDQSLCRLWFCVLRAAVD

SEQ ID NO: 177003 - protein, 79 aa, Glycine max
  Coding DNA Sequence Number=SeqID_85318
  Gene Ontology: Mol. function=aspartic-type endopeptidase activity; Biological process=RNA-dependent DNA replication
  Homolog annotation: Hit_ID=Q5MG92; Match level="QueryCoverage=96%, HitCoverage=5%, E-value=2e-09, Identity=42%"; Hit description =Putative retrotransposon polyprotein
VLERINNNAYRIDRLEEYGVSNTFNIIDLVPFAGVTNLADEGFADLRTNPIQEGRDDAILPRRGPITRAMARRLQEDWA

SEQ ID NO: 177004 - protein, 69 aa, Glycine max
  Coding DNA Sequence Number=SeqID_85319
MEKFEKKRTWHILVKRNCFKKNYNQHGMKMIWVSAKRDNLVYRLKVTKVIKFFEEEVVHRCLLMLIKSH

SEQ ID NO: 177005 - protein, 50 aa, Glycine max
  Coding DNA Sequence Number=SeqID_85320
MRNGHPPLSQGTGTPTQKNPEHGYLNMKKGLFFYVLVDGTGERDYFFQVL

SEQ ID NO: 177006 - protein, 212 aa, Glycine max
  Coding DNA Sequence Number=SeqID_85321
  Homolog annotation: Hit_ID=Q2HW90; Match level="QueryCoverage=50%, HitCoverage=20%, E-value=3e-08, Identity=34%"; Hit description =Putative uncharacterized protein
MERVEKVVKISVQELDRVKQSRNEIVGIPSKHLEGKAKALADQGEWASYVDVLALLIFGVAHFPNVEGLMDQALIDAFLAYHHSKESPIVAILADLYDTFDRRCEKNDTKIFCCTLAIYVWLVSHLFRQESRPTCPLQGHRLCTEKGKVNWEQLLASVVGASHPNSRWGRTREMRNCSCTSSKIAWLEPQSFGAPTWKHLASARGKTRLLPS

SEQ ID NO: 177007 - protein, 317 aa, Glycine max
  Coding DNA Sequence Number=SeqID_85322
PTIEEFEEIPGCPLGGRKPYLSSGCLPSLSRIAAVVKDSARGLDRIKQTRNGIAGLPQKYLEDKARGMANQGDWVPFMYVLALLIFGVVLFPNVDGLIDLAAIDAFLAYHHSKESPVVAILADLFDTFDRRQLGYPMRGAPTEESMSPFLVRDFGAQNSKTIQRIHKAWETPLRKDQELRGIRNGIIGGYHEWLKVHIRSLDWLAKLKVVSEESFEAPEEDEEVQALKSELGKAKFAKEKFKLAATHIRKECAGLREENAITARALEQETKRARKEEYGRNKFRGALWGSNSELKLRREERDQSRAHSMVLKEELIA

SEQ ID NO: 177008 - protein, 84 aa, Glycine max
  Coding DNA Sequence Number=SeqID_85323
  Homolog annotation: Hit_ID=A0ST23; Match level="QueryCoverage=29%, HitCoverage=51%, E-value=3e-07, Identity=100%"; Hit description =Putative reverse transcriptase
LSSLVTGTWGDQAYRYRRPRGGARYQLLFPLVRVNFELGVIMVIAVSFGKPVVPAALMNRPTRGERRFAYWALAECILAYYVGH

SEQ ID NO: 177009 - protein, 153 aa, Glycine max
  Coding DNA Sequence Number=SeqID_85324
MCTKWPRGSLLQRGPGRIKRAEGTSSAPEYDSHRFRSAEHQQRFEAIKGWSFLREQRVQLRDDEYTDFQEEIVRRRWASLVTPMAKFDPDIVLEFYANAWPTEEGVRDMRSWVRGSVDPVRCGCYQPVPRISFSAGRGPGVRVWPEEEPVRWF

SEQ ID NO: 177010 - protein, 76 aa, Glycine max
  Coding DNA Sequence Number=SeqID_85325
  Subcellular localization annotation: CTP_CleavageSite=61; ConfidenceScore=5.34e-01
MVLKCKRSSRAQRTIWAQRTSDAKHNFSALSVTRESRRAQESRPRAKREISLLSETFVSCQAQHTTSAKPKSTYSH

SEQ ID NO: 177011 - protein, 98 aa, Glycine max
  Coding DNA Sequence Number=SeqID_85326
  Homolog annotation: Hit_ID=Q6UUU1; Match level="QueryCoverage=81%, HitCoverage=54%, E-value=2e-32, Identity=85%"; Hit description =Putative uncharacterized protein
MAYERGGDFLEDARKILNREVRGPRQSRFSIGSAPLTSITKSDAQISGGETRQDYKDTRRFPLAAPSCALLFLPFGLPVSFRCYGRVCLIPRPDTQFR

SEQ ID NO: 177012 - protein, 219 aa, Glycine max
  Coding DNA Sequence Number=SeqID_85327
MAPRKLASKRSRKDKAAEGTSSAPEYDSHRLGALNTSSASRPSRDDFQEEIVRRRWASLVTPMAKFDPDIVLQLYANAWPTEEGVRDMRSWVWGQWIPFDADAIGQFLGYPLVLEEGQECEYGQRRNRSDGFEEEAIVQLLCIPGQDFARTAAGRLVRIMHTNMTTLTQIWMTLLLSNIQPNDHNSDLPLPKCQLVYAILTRMSIHVAQLIADAIYIFA

SEQ ID NO: 177013 - protein, 133 aa, Glycine max
  Coding DNA Sequence Number=SeqID_85328
  Gene Ontology: Cellular component=mitochondrion
  Homolog annotation: Hit_ID=Q5M9S2; Match level="QueryCoverage=31%, HitCoverage=38%, E-value=2e-13, Identity=85%"; Hit description =Putative uncharacterized protein orf109c
MVFASSAILPAGLAVWAERVTRSTVPRCEVQVVMIAPGYALAPLTGTPGPANAHSNPGLIRPEVWITRPPSQPSPFCPLGIASGIGADSTSAASCRTGVIQYVVPHVPPLLRSFPILIVKHHEQQDVEVRNSN

SEQ ID NO: 177014 - protein, 154 aa, Glycine max
  Coding DNA Sequence Number=SeqID_85329
  Homolog annotation: Hit_ID=A5BZ02; Match level="QueryCoverage=61%, HitCoverage=20%, E-value=9e-09, Identity=35%"; Hit description =Putative uncharacterized protein
MKVTALKQTSHDMNAHIGKARAAVEELKRFLVANSLEEVNRKLDKFYMVLILRSLHSDFDHVRDQVLVGDQVPSMDSLITRLLRVPHALKEENPADSVETSAMVAPRGRGGGRNSRGGRSGRGGRPQCTLIARGWATLKRIATPFMASLTKLSR

SEQ ID NO: 177015 - protein, 28 aa, Glycine max
  Coding DNA Sequence Number=SeqID_85330
MAEVATSKASGSKVKAKVVEERSRSTIK

SEQ ID NO: 177016 - protein, 91 aa, Glycine max
  Coding DNA Sequence Number=SeqID_85331
  Gene Ontology: Biological process=transposition, DNA-mediated
  Homolog annotation: Hit_ID=Q1J7G7; Match level="QueryCoverage=36%, HitCoverage=47%, E-value=1e-11, Identity=96%"; Hit description =Transposase
MVKVGTSYVPINVSFSPKSWPRASRYQQGHQDLFILRSDLPSQVLQWLLFLSAVPPVQLLTGWCVTAKAPPDISAGKCSGHAARNHHTRRA

SEQ ID NO: 177017 - protein, 143 aa, Glycine max
  Coding DNA Sequence Number=SeqID_85332
ASELVLYTELPRLDIELALELMLPELSTGVAARLHSLAVSVSKWGHLGVEAWEELRQVRIGTHAFMYWSGISVVVDERLRSVDSLVGAATIVKVEQSAHTRKERHLTYSLKRAQVVEVPARTRLSPPVLLIGKLAPPLNVPTP

SEQ ID NO: 177018 - protein, 41 aa, Glycine max
  Coding DNA Sequence Number=SeqID_85333
MTAKKNRSGKAVDKGVEVPYPVETRNNHALRRSVVADATLL

SEQ ID NO: 177019 - protein, 249 aa, Glycine max
  Coding DNA Sequence Number=SeqID_85334
  Pfam annotation: Domain name=zf-CCHC; Domain location=101-118; Score =17.9; E_value=0.003; Accession=PF00098.14; Description=Zinc knuckle
MKREKHASYSSHNSCKSLSEELRDYYKGRHRSHLRPHSHRREKERKPQEANINLSYFHGKDNKDQGQGILGVTPSKPKDDKGKTIEKQAPKASMQEKTSSIECFKCLGRGHITSRCPTTKTMIMRGQDIYSSQDEPTTSPSSSESEEAKGEESSEEIYPQEEGQPLVVKEKCKEALASIATPLGLEFIRQVKKLLDEGLVRKSLNPCALLVPKIGIIRHQVPKITGMMNVLSGATLFCKITRAPNIFME

SEQ ID NO: 177020 - protein, 168 aa, Glycine max
  Coding DNA Sequence Number=SeqID_85335
  Homolog annotation: Hit_ID=A5AK77; Match level="QueryCoverage=55%, HitCoverage=11%, E-value=1e-11, Identity=39%"; Hit description =Putative uncharacterized protein
MTRGNPGDFQPFDPEIDRTFHRLVRHSVHPGHSVHFEHPDHFEYYVAGDSEYSDFEYSTTNFHTENMAQPPPRERALREMAAPDFTYESLCIQYPDEGFPYVLKTGLIHLLPKFHGLASEDPHKHLKEFHIVCSTMKPPDVQEDHIILKAFPHSLKGVTKDWLYYLAP

SEQ ID NO: 177021 - protein, 141 aa, Glycine max
  Coding DNA Sequence Number=SeqID_85336
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=60%, HitCoverage=72%, E-value=3e-24, Identity=69%"; Hit description=LacZ protein
MTVAPLYLSFIGDRREVSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 177022 - protein, 81 aa, Glycine max
  Coding DNA Sequence Number=SeqID_85337
  Subcellular localization annotation: CTP_CleavageSite=27; ConfidenceScore=5.04e-01
MCGRGKLSLGLARFKSRTMLASHSGYRATAKKPASNCFLTSSLIFKDISGLILHNFCLTGEDPGFKGNLCCTMSESRPGMS

SEQ ID NO: 177023 - protein, 408 aa, Glycine max
  Coding DNA Sequence Number=SeqID_85338
  Gene Ontology: Mol. function=DNA binding
  Homolog annotation: Hit_ID=A9I254; Match level="QueryCoverage=52%, HitCoverage=6%, E-value=8e-27, Identity=34%"; Hit description =Filamentous hemagglutinin/adhesin
MGTVSGNVTGAAGDALQAVAVNYLQGLGASQVKTIVSALGEGPQAEAARAAMHAIVGCAGAAGKGSDCSAGALGAGSGAVLNALLGGDASKMAAEEKEVRRNLVGSLVAGIAIASGVSGAEAVFAAINETENNALSVREHQARIQEKAQCNFDTQCEQRVAKKYKEIDNRNRKALTQCASVDVCKAEIEAAAAQLGEYSSRIANLEEKLRSDGGLSASEWEELSILKISASVMLDVDRNAAIKNYLLLGGDQAKQLAWNEIAKTGVAGAAAAVSAVGSNKASVAGVKGGGSPTASMLPKNFGESVLGHNTQIGVRNSKAGTISGAHNRDAFLESVEITGAKVTNKITDVHYPGLVEYSYQLPRTNTNGELIGGYKPISTKRHTIQRSYQIARWRICLTVPQFKPVLCL

SEQ ID NO: 177024 - protein, 195 aa, Glycine max
  Coding DNA Sequence Number=SeqID_85339
  Gene Ontology: Mol. function=transporter activity; Biological process= transport
  Homolog annotation: Hit_ID=A6TA95; Match level="QueryCoverage=61%, HitCoverage=33%, E-value=2e-46, Identity=78%"; Hit description =Putative ABC transporter periplasmic binding protein
MAVKLQKSFAMGFYVTRDHADAVRIVSGKVGSDQARIVSSMYVVVLLRLPFHAAPQGAEDQGDKYFSLNREIIGMKIGGLVVSLTTVFSYSALAEVPQGYPADYQKVVDAGVKEGKVVVYSTTDTKAAGPLIKGFEAQYPGIKVEYNDMNSTELYNRYISEQAAGGGSGDVVWSSSMDTALKLATDYAQEYASPE

SEQ ID NO: 177025 - protein, 142 aa, Glycine max
  Coding DNA Sequence Number=SeqID_85340
MHCCIGFFKEIGGTDGARTRDPLRDRQGNLSFAGFFSLTTLFHAKSAASGAPQAAAALLLHQIEPALMRHYLFIAGANHAQAGARTNDALYMLTCHLIALLAFHRKRQRGLAAGHSEEHFGQNLGIKQSAVQRTFAVVDLET

SEQ ID NO: 177026 - protein, 91 aa, Glycine max
  Coding DNA Sequence Number=SeqID_85341
MALFEMVVESYGSAMVARKCQLVAFALCTTAKPGAFHRNRPWDLGIAFRSHDLKIQHLEDKNPLEGVELSGGYWFTGSMLLACCFPLCNTS

SEQ ID NO: 177027 - protein, 167 aa, Glycine max
  Coding DNA Sequence Number=SeqID_85342
MEILSLPPLASHTTKEYVALKDKIKELMQEGAFANYTYTPNNNRGSYRGRGKGQGSHHGGRGQQSHNHRLEQIDAKLDQVGTSTVRERGGDAESSTPLQREPHFCSELEEINPTNNIHRCRLCRGQSRARQPNDDYDAASSWANLKPRRDEEDKKLDSDSVGHPKGN

SEQ ID NO: 177028 - protein, 543 aa, Glycine max
  Coding DNA Sequence Number=SeqID_85343
  Gene Ontology: Mol. function=protein binding; Cellular component=RCAF complex; Biological process=female meiosis chromosome segregation
  Homolog annotation: Hit_ID=P59259; Match level="QueryCoverage=16%, HitCoverage=85%, E-value=7e-42, Identity=100%"; Hit description =Histone H4
  Pfam annotation: Domain name=CBFD_NFYB_HMF; Domain location=468-531; Score=5.0; E_value=0.055; Accession=PF00808.14; Description=Histone -like transcription factor (CBFNF-Y) and archaeal histone
  Pfam annotation: Domain name=Histone; Domain location=465-534; Score =68.8; E_value=1.8e-17; Accession=PF00125.15; Description=Core histone H2AH2BH3H4
  Pfam annotation: Domain name=TAF; Domain location=468-532; Score= -6.7; E_value=0.024; Accession=PF02969.8; Description=TATA box binding protein associated factor (TAF)
  Pfam module annotation: Pfam domain module=CBFD_NFYB_HMF::Histone::TAF ; Domain location=468-531::465-534::468-532
MEDGAWGTSVIELVEDAGRRVGHVVLAVGSKSMVAELVWKTEATMVTARRKKMGSINNAKVIAKLLDTPSSSLGIFVWDATPFSPPSGPIHGQSSGCPLRLKESLSLLENVHATEKEDDRRQSGPVLVLGAVASKEFSSGIKLALHQRGWVEHWFELALELVIDPVNEEGHSAVQQGIIFFVQSKRGRNRSLAHYALFFEVPYELSHALDKVTGGGIDVLVKHVDAVHVEVVVFVLDEVREGLGGVVDPGVLGAAVADADEDFDVNVGVLVLEARDGFGGDLAQVPGRSENAVGGGTLVVVVAGEGQSDLVLLQEFRRHKHLRERVVERVLPENRQHCAKRPIYGIAIWVLCQKLPSPRCPYILHLCPGHIRINMEYLSPTSPIQMKSLLPSPSYIATKSTVQNALEKPASASEPESYHNTNTDFDSIRFDSVEVLSSSKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 177029 - protein, 121 aa, Glycine max
  Coding DNA Sequence Number=SeqID_85344
MAKLRDSVRSLAGDNGYESGRRKVSEARKKKGFRSKEEEGFWKKLRGFLFGVLALFMESKSLVRTCSNQKERRVFKKEFPGSKKYLRSTKLRQERGLRAIGQFELVYGRVEVEAARVLDLA

SEQ ID NO: 177030 - protein, 66 aa, Glycine max
  Coding DNA Sequence Number=SeqID_85345
  Gene Ontology: Mol. function=two-component sensor activity; Biological process=two-component signal transduction system (phosphorelay)
  Homolog annotation: Hit_ID=Q6WD26; Match level="QueryCoverage=45%, HitCoverage=6%, E-value=4e-09, Identity=96%"; Hit description =Phototropin-like protein
MWLKIGAFALIVCGIYSGILTQRVFLCHGDCGRMQVEVSKHTEGSKEKMLRPNGLPESLIRYDGIG

SEQ ID NO: 177031 - protein, 544 aa, Glycine max
  Coding DNA Sequence Number=SeqID_85346
  Gene Ontology: Mol. function=transferase activity, transferring glycosyl groups; Cellular component=membrane
  Homolog annotation: Hit_ID=A7NZB0; Match level="QueryCoverage=76%, HitCoverage=91%, E-value=0.0, Identity=74%"; Hit description =Chromosome chr6 scaffold_3, whole genome shotgun sequence
  Pfam annotation: Domain name=DUF604; Domain location=264-518; Score =629.5; E_value=2.9e-186; Accession=PF04646.3; Description=Protein of unknown function, DUF604
MYSSSHQRMLHTGSKSLITWLILITIVLYTLYSSNIILFNNDQQDCPTITTNLNEATQENLRVSTYNNTSSKTIATDDESVEKKKPLVEKRPREDNDDDEEEGEEKNKEEEENKSPVVVRLTPKQMSERQDTELKHVVFGIAGSSNLWHIRKEYIKIWWRPKETRGVVWLDKKVRSQSNEGLPDIYISGDTSKFRYTNRQGQRSALRISRVVTETFKLGMKDVRWFVMGDDDTMFMVDNVVRILSKYDHRHFYYIGSSSESHVQNIHFSYAMAYGGGGFAISYPLAQELAKMQDRCIQRYPALYGSDDRIQACMAELGVPLTREPGFHQYDVYGDLLGLLGAHPVSPLVSLHHLDVVQPIFPRMTRVRALRHLMESVNQDSGSIMQQSICYDKQNFWSISVSWGYVVQILRGVLSPRELEMPSRTFLNWYKRADYTAYAFNTRPVAKHPCQKPFVYYMTNTHYDSTTKQVVGVYSRDKSKSPFCRWRMNSPEKITSVVVTKKPDPLRWKKSPRRDCCRILSSRKSTDTLYIWVGNCQEGEVTEL

SEQ ID NO: 177032 - protein, 143 aa, Glycine max
  Coding DNA Sequence Number=SeqID_85347
MYSQSLRARKLVRSGRSRKQDLNAENTRMIRKSDSKADMLVQVYMSFFSISKLVELAKPVSKDTLKSIVSPVESIDEVCNLVGLIKDPMKHLLLRALKETEGRVQLRKARDIGSFGHCLVCCSPLTLLGASGGTAMSPFPHSH

SEQ ID NO: 177033 - protein, 234 aa, Glycine max
  Coding DNA Sequence Number=SeqID_85348
  Homolog annotation: Hit_ID=Q2AA50; Match level="QueryCoverage=90%, HitCoverage=12%, E-value=2e-08, Identity=31%"; Hit description =Retrotransposon gag protein
MELIENMAASDRAILRDRSHVPTKKSLLELSTQDATLAQHKLISRQLEAITKTLNKLPQQLQVVNISHSPVLQVEGCPTCVGTHEPGQCAIQHEPSQEINYMGNPNRQGFQGYYQGNPSGYNNGLPRFNQGRNFNRGSGWRNQGNQYKELRPQPPYQHPSHGPSQQEKPSLSIEEMILSFTQETRAFIQETRANTQKTKAFSQETRAFIQETRSHQKSTYAAIRNLETQLGQLA

SEQ ID NO: 177034 - protein, 47 aa, Glycine max
  Coding DNA Sequence Number=SeqID_85349
MEKVEGLRILKMRVRELFTHGEGERVVKALDLETIFSSLKGGESLRH

SEQ ID NO: 177035 - protein, 163 aa, Glycine max
  Coding DNA Sequence Number=SeqID_85350
MGRVYEGSTVVHNIPLLPGQVKVSVEELTDADAPVPVPTDEVAVSLAKPPPKPDPEVNDPLYLMTLTIPELFLRPYQMVVILPKEHLVVWFCSLHSRPDNYLKGIINSAIKGLDDAPQPKSKASARRIVVKCNRQKGSTEFSYYVMHWMSTIILGTFRNNWEA

SEQ ID NO: 177036 - protein, 76 aa, Glycine max
  Coding DNA Sequence Number=SeqID_85351
MTDKSPVIMREIPGPCWTYPGPKGGLGEVGIMIAGLDVAEQQRHPYLGQGGHVGGHDPHPSPSSSPGVTPSTPTYK

SEQ ID NO: 177037 - protein, 87 aa, Glycine max
  Coding DNA Sequence Number=SeqID_85352
MSRNFTDCLTMGVKFLEAIKRRLHAIKQSQTKLGYGTGFQGCLCFIIVFGYMCVCVCIMRVYYGNLSTIALSLKDPVSVKERRERFL

SEQ ID NO: 177038 - protein, 156 aa, Glycine max
  Coding DNA Sequence Number=SeqID_85353
MMSMKKIMEANAVAVAATRAVAKYERPHDVQIQNKHAFLPYGLPPNYTPPNMAYTPNENVNNSTPILTESQQPQTDRAHVSQTVGETYEIPHHNLADFEPCLGYATKGQVVGAILLQNTLEGPQFCPQQQPLHSTASKIPPIMEGMGKVGSSRGKA

SEQ ID NO: 177039 - protein, 101 aa, Glycine max
  Coding DNA Sequence Number=SeqID_85354
  Homolog annotation: Hit_ID=A5AWR0; Match level="QueryCoverage=87%, HitCoverage=8%, E-value=2e-07, Identity=30%"; Hit description =Putative uncharacterized protein
MASSSSCSSNIQTRPGPIDGDVLWMQPKHVSEHVWNGEPDKKLHIRRAVPTYQGEEQIPEEIVPLLRLSGFYWIMKMGYLKINATLISALEDGGPKHTRFT

SEQ ID NO: 177040 - protein, 221 aa, Glycine max
  Coding DNA Sequence Number=SeqID_85355
  Gene Ontology: Mol. function=aspartic-type endopeptidase activity; Cellular component=small subunit processome; Biological process=DNA integration
  Homolog annotation: Hit_ID=A5BEY3; Match level="QueryCoverage=83%, HitCoverage=17%, E-value=2e-22, Identity=33%"; Hit description =Putative uncharacterized protein
  Pfam annotation: Domain name=zf-CCHC; Domain location=126-143; Score =12.0; E_value=0.023; Accession=PF00098.14; Description=Zinc knuckle
MKVTALKQTSHDMIAHVGKARAAIEELRKFFVADSLEEVNRKLDKFYMVLILRSLHSDFDHVHDQVLAGDQVPSMDSLITRFLRVPHLLKDENPTDGVETSAMVASRGKGGSRNNRGGWSERGGRPHCTYCKRMGHTQENCYSLHGFPDKVAQVSKSKKVESRFSDEEYQEYLKLKSEKPSNQAQSSSVPCFSTACISESIEGSSPWKLDSGASDHISVSL

SEQ ID NO: 177041 - protein, 37 aa, Glycine max
  Coding DNA Sequence Number=SeqID_85356
VLRDGRKERLGSRPIGRHPLPSPGQTESAAAKQPSIL

SEQ ID NO: 177042 - protein, 70 aa, Glycine max
  Coding DNA Sequence Number=SeqID_85357
MEKSDKMNFKGKKEKKGYMTWEDNVINYSIGSWKLEVGSSYWKLKVKNGSWKLEVEVTGSWKLEMKVIGS

SEQ ID NO: 177043 - protein, 91 aa, Glycine max
  Coding DNA Sequence Number=SeqID_85358
MERQSSPLARRDKHGHLPLFEDFNVFRPRLLQSHLPSRDNQVRWHAETNMVICLFSKTSMSFDRDYYSLICLPETIKSVGTQRQTWSSASF

SEQ ID NO: 177044 - protein, 78 aa, Glycine max
  Coding DNA Sequence Number=SeqID_85359
MVGPSGPRVSTKESCVDPSGNDPETGDSDKCGLYMRDQHFTKFLCCLAKHLTETSMRAGNSDVYGFFEPQSIQRSGQS

SEQ ID NO: 177045 - protein, 16 aa, Glycine max
  Coding DNA Sequence Number=SeqID_85360
MDLFGGGVGVCHRLGL

SEQ ID NO: 177046 - protein, 123 aa, Glycine max
  Coding DNA Sequence Number=SeqID_85361
  Homolog annotation: Hit_ID=Q8TGM5; Match level="QueryCoverage=31%, HitCoverage=58%, E-value=8e-08, Identity=74%"; Hit description =Uncharacterized protein ART3
MGPELTGSHVIGLERGSSTILSRRSRPMNPDFNQPRGGCSREVSIHPAQQHCRRALGLMASGATCVQRLDGSRDSAIHTKYRISLRSSSMQEPRYPLPRVIVCKCCVVTTPAGHRLRAPGSRT

SEQ ID NO: 177047 - protein, 175 aa, Glycine max
  Coding DNA Sequence Number=SeqID_85362
MGNTLVDRKKIKNKKSRLFRFFRRFPQINVGGDSARIPFLEHAPAITRRPPAEGKIIYNGLTNEITLTHLGTKFLLHPQTPSQVAKDQLTMKDKRDEEEKLEKQKKKKDSKALSSKAKGKEKEEKDSSEKIVNKENHFATKGDIKRALLLKQSFYLLLSRETSLSTPYLLSLRYS

SEQ ID NO: 177048 - protein, 123 aa, Glycine max
  Coding DNA Sequence Number=SeqID_85363
GSEDEVRGEESSEEVYPHEEGDLLMVRRLLGVKNLATIIEGTIVHILNITPKEGKRIKGLKRVCPLLAGLPLLGNEGHGDPRVEYWNDLKSALGRGTFPPTMKGSLWTQLQRLKQKREYELKK

SEQ ID NO: 177049 - protein, 87 aa, Glycine max
  Coding DNA Sequence Number=SeqID_85364
  Homolog annotation: Hit_ID=A5AL21; Match level="QueryCoverage=78%, HitCoverage=4%, E-value=7e-07, Identity=48%"; Hit description =Putative uncharacterized protein
MESSNAESCYWWKRCCPTMMKALFGFQDLTDIVENGVEVPRDNAPDAQKVGFKELKKQDCKPLVILHQCVDDTHFEKIAGATTAKEA

SEQ ID NO: 177050 - protein, 45 aa, Glycine max
  Coding DNA Sequence Number=SeqID_85365
MAQECFPNEYMMWNCPSSVDRWHESSFSNARNGPKETCLKEIQEG

SEQ ID NO: 177051 - protein, 130 aa, Glycine max
  Coding DNA Sequence Number=SeqID_85366
  Gene Ontology: Mol. function=oxidoreductase activity, acting on NADH or NADPH; Cellular component=chloroplast; Biological process =electron transport
  Homolog annotation: Hit_ID=Q2PMN8; Match level="QueryCoverage=93%, HitCoverage=31%, E-value=4e-59, Identity=88%"; Hit description =NAD(P)H-quinone oxidoreductase chain H, chloroplast (EC 1.6.5.-) (NAD(P)H dehydrogenase, chain H)
  Pfam annotation: Domain name=Complex1_49kDa; Domain location=1-130; Score=-29.3; E_value=1.1e-10; Accession=PF00346.10; Description =Respiratory-chain NADH dehydrogenase,
MLRASGIQWDLRKVDNYECYEEFDWEVQWQKEGDSLARYLVRIGEMMESIKIIQQALEGIPGGPYENLEIRCFDREKEPEWNEFEYRFISKKPSPTFELPKQELYKGKSPQGYNNVFHLNTQVLLEFFKL

SEQ ID NO: 177052 - protein, 144 aa, Glycine max
  Coding DNA Sequence Number=SeqID_85367
  Homolog annotation: Hit_ID=Q2HW90; Match level="QueryCoverage=55%, HitCoverage=16%, E-value=1e-08, Identity=42%"; Hit description =Putative uncharacterized protein
MARIAKVVKVSVQELDRVKQNRDGVVGIPKKHLEEKAKALADQGESASFIDVLALLVFGVILFPNVDGLVDLATIDTFLAYHHNKESLVVAVLADAYDTFDRRCEKSNARIVCCTPSLYVRLVSHIFHHESRPVNPLQGHRMCA

SEQ ID NO: 177053 - protein, 46 aa, Glycine max
  Coding DNA Sequence Number=SeqID_85368
  Gene Ontology: Mol. function=aspartic-type endopeptidase activity; Biological process=DNA integration
  Homolog annotation: Hit_ID=Q10M26; Match level="QueryCoverage=100%, HitCoverage=6%, E-value=1e-12, Identity=57%"; Hit description =Retrotransposon protein, putative, Ty1-copia subclass, expressed
MAAEFIACFEASNHGIWLRNFVTSFNRSTTKSKFIDIKFLVVKERV

SEQ ID NO: 177054 - protein, 57 aa, Glycine max
  Coding DNA Sequence Number=SeqID_85369
MTTGDPPQQKTSQGNEKKKEDQNITQGRTQEYYKRRSTLMGGKSKNRHKEKIQEYST

SEQ ID NO: 177055 - protein, 338 aa, Glycine max
  Coding DNA Sequence Number=SeqID_85370
MTDPLNESISCFLIRVDPWVLEPVASRGLHVFTFRGLHALAIRGLHALTLRGLRVLAFRGLHFLASRGLHVLAFRGLHAHTFKGSCTFTFRGLHVLALKRSCTFAFSKGYTPSPLENFTPSPSEDYMSSTLEDYTFSTSEGYTLTPLVDSTSAPEENLRSSALKCLTETCIPVPGPPLDPGGGPPMQVQPEEEAIMQLLCIPWQDFTRAAAKKRVRIMRTNMTTITQIWMTLLLSNILPSDCNADLPLRKDHTHKDTQWTQRNPTGPRGFLLWLRAPVSPTGCPFPLARSRHHDLGIVPTRHPVDPEKSSRALGSPTLVTGLCQSYRVPVPPSKVTPS

SEQ ID NO: 177056 - protein, 116 aa, Glycine max
  Coding DNA Sequence Number=SeqID_85371
MPYEFQFLKIKDRDTWVATFALKPLHPLNLEQILLLSAKCVLLLCIIFTSSQEQSKSPLGAMWLKGVKTPMVLSRNHDERAKRTYALSLFIATVKILDFPMNVLSGPCHAKRVRPC

SEQ ID NO: 177057 - protein, 172 aa, Glycine max
  Coding DNA Sequence Number=SeqID_85372
  Gene Ontology: Mol. function=transcription factor activity; Cellular component=intracellular; Biological process=regulation of transcription, DNA-dependent
  Homolog annotation: Hit_ID=A4XDN5; Match level="QueryCoverage=95%, HitCoverage=48%, E-value=1e-36, Identity=51%"; Hit description =Transcriptional regulator, LacI family
  Pfam annotation: Domain name=LacI; Domain location=7-32; Score=42.1; E_value=2e-09; Accession=PF00356.12; Description=Bacterial regulatory proteins, lacI fa
MRRSGRPTMNDVAAAAGVSLKTVSRVINAEPNVDAGMAARVQEAIGRLGYHRNALAASLRSGTNDTIAFVAADLSNAFYMGIAAAVSAVATRQRMHVVMASSEEDPVAERRLALDLCQRRVAGLILVPTGTDQSYLEAEAAHGTSVVFLDRPGHGLSADTVLLDNRGGASAA

SEQ ID NO: 177058 - protein, 235 aa, Glycine max
  Coding DNA Sequence Number=SeqID_85373
MRSWVRGQWIPFDADALSQFLGDPLVLEEGQECEFSQRRNMADGFDEEAIAQLLCISGQDFAQTSVGRRVWIMRTNMTILTQIWMMLLLSNVLPSDHNSELPLLKCQLGCHPLDPDKSNRALGQAQGDAPQAADAPPPPHQADPAGSLGMERYLQHLVQIHECLYQLSLSQQGQGFAPFACPTLDQFRVEVAWPGDWPKALTEEAPAGAPDDAEEARIDEVMTDLFGFLGGSGAT

SEQ ID NO: 177059 - protein, 36 aa, Glycine max
  Coding DNA Sequence Number=SeqID_85374
MEVGGWKLEVEKLENGSWKGKSLEVEVASWKLEFEI

SEQ ID NO: 177060 - protein, 243 aa, Glycine max
  Coding DNA Sequence Number=SeqID_85375
MWFRLCKRIFTKGVENLKRGLKFCWWEINSPLLNISEATCPTREVVSDSLTLESLGPAINVSYVKKNCWNLDDLLVTFRGSRKAKGKRSEAPPSFEIPPSSALAPIPSAPSTSTSILPVPLFEFDAQVAWPGAQPSPFGGGGASAAQEPTPEEPAAAAVEGVHMSQKEETSTDQIPEPSLAPIPDDVVPSALASELEQPISQDSPAAQPLEENEHVIGSMTENVSQFVRLIVKECIDRIPVRV

SEQ ID NO: 177061 - protein, 135 aa, Glycine max
  Coding DNA Sequence Number=SeqID_85376
MNEKVKVILWMNALLEPKLLNPRKTINCWQPNPITSLESPSDSFLCVHYCMIGGEMQSCDSNTCALIFEKLYACERTFPLDLMIKSMHFQCKGESSRASASRPRAKHEISALSAASAFSQAQRTTSTKLESTYLR

SEQ ID NO: 177062 - protein, 239 aa, Glycine max
  Coding DNA Sequence Number=SeqID_85377
MEEVAQLGSIDGVIDPPSPVRHHMKWKMAHTKKTWEMTTEAAKEFAAKIGPARGVDHKKSDSTAHGIVQPDAVSVSVIDAISGTCTTSGAFGWSLKSSTKPPENLDPEVDDPLYLMTLTIPELFLRPYQVTWDATMFGVFNLDFLLYIKHEDLFEIAHGGQCLNISVLQLWILPDNYLKGIINSALIGLDDALQPKSKAPARWIVIKCNRQKGSTECSYYVMHWMSTIILGIFRNNWEA

SEQ ID NO: 177063 - protein, 79 aa, Glycine max
  Coding DNA Sequence Number=SeqID_85378
MKKTLVFCGGGAPKGNMTIRVMHEYDLTLKELGGTNPGQFVGEEHGRFGLNSFLQSSQFVGEEKGSFGLFFIHLSHSDR

SEQ ID NO: 177064 - protein, 169 aa, Glycine max
  Coding DNA Sequence Number=SeqID_85379
  Subcellular localization annotation: CTP_CleavageSite=62; ConfidenceScore=5.37e-01
MHKKKEAHSRKARRRPMKTMSQKLSMGRTSRRYMGRKMSITTFYMTWPKSGPTSLKKVSCIKLNKDSKQSIISKGTFIARQLHFIVVNLKAMKVDIRRNMPIPHIDQNDIQQRRQKKLTRTTNEDKAMKTFGLAKKDQRLLREQQGKVQTRKQAQQEIMYEEQQTKKIH

SEQ ID NO: 177065 - protein, 396 aa, Glycine max
  Coding DNA Sequence Number=SeqID_85380
MGSEIYPEVHENPRAFFSSSSLILLEPLAHGSSDWSLPREDCIRKGPVTRAMSKRLQEDWARAPKEGPRILINLRVDFWAHGTRRLQSSFFHLHSAAIDLQKSKDSIDEEDPRPTSSTWSYIMCQRHSEAQDIPIPSSISSSSLFSSEEQCTWYTNLLSSRSIIDPKFIDMDFFYDASFECIQAFQNSNLIPFMSLKLHMVIDQSLFYDLTQLSSEGVPFEADMTGRLLASSLALESRILHYLIVCILLPISSNLAQVSEEDLIVMWAFHTGRQIDWAHLVWYRMHEALRLNAPLPYPHLVTLFLQHFNIPLDSEPYVPIKRSFLIGATVVASFGYRKERDGSWVKKGTQPNDDEGQLPVEGDFSLLQSILDRITKVEEDVTIIRDCLDLPPPPSV

SEQ ID NO: 177066 - protein, 306 aa, Glycine max
  Coding DNA Sequence Number=SeqID_85381
  Gene Ontology: Mol. function=sequence-specific DNA binding; Cellular component=intracellular; Biological process=regulation of transcription, DNA-dependent
  Homolog annotation: Hit_ID=A6VXV3; Match level="QueryCoverage=99%, HitCoverage=98%, E-value=1e-118, Identity=68%"; Hit description=AraC- type transcriptional regulator domain protein
  Pfam annotation: Domain name=AraC_N; Domain location=20-174; Score =234.8; E_value=2e-67; Accession=PF06719.4; Description=AraC-type transcriptional regulator N-te
  Pfam annotation: Domain name=HTH_AraC; Domain location=189-235; Score= 44.1; E_value=4.9e-10; Accession=PF00165.14; Description=Bacterial regulatory helix-turn-helix proteins, araC family
  Pfam annotation: Domain name=HTH_AraC; Domain location=241-285; Score= 25.3; E_value=0.00023; Accession=PF00165.14; Description=Bacterial regulatory helix-turn-helix proteins, araC family
  Pfam module annotation: Pfam domain module=AraC_N::HTH_AraC::HTH _AraC; Domain location=20-174::189-235::241-285
MSDMITLMNRLAVQEGYNLTALPDVRILRSDRPLARTPVLYDPGIVIVCQGSKRGYFGQQTYLYDEQHYLAVSVPVPFVMETDASAAHPLLAIYMHLDFQLVAELMLQIEQHGAPHPPVAPQSMMSSPMDGAVKMAVLRLLEVLANPLEAAILGPARVRELYFRVLTGAQGNAMRAALALQGQFGKIGKALQHIHAAYAEPLTLTQLAMRAGMSVPTFHSHFKAITQMPPMQYVKSVRLHQARMLMVRQQITAAAASYAVGYESPSQFNREFKRLFGLPPAEEIKRMQHHFAIPPAQPASVFVSSH

SEQ ID NO: 177067 - protein, 264 aa, Glycine max
  Coding DNA Sequence Number=SeqID_85382
MAYVITDREKLQAIWEAAKAGDWPAVYAASVDALTDPNHANQPIQGVDIAVYTWIKGAYGVNSNQGAFAHYIRDQTKLQYELRTGHVPDDWETRIQNASDNIAKNFAKTLFGVDLSSDPNAPLPDTPPTSAKVPDIHEVGLIDAGAAASEVFTDASSTGAPNYSPWAGTTLFSYLGDTSFFTEWVATNDTSPFKVESGTYDLIAAAQVSMQMKNLSYVVETLLAGEVPTYLTTLGIGHETIRLAAEAARDFYTESYGSSVTGGG

SEQ ID NO: 177068 - protein, 61 aa, Glycine max
  Coding DNA Sequence Number=SeqID_85383
MLILSEYSTPKTVVNNPSEFNIHRKVERNWKGGLVPSLEEFESRSKGPTTLRAIGLRSTPN

SEQ ID NO: 177069 - protein, 309 aa, Glycine max
  Coding DNA Sequence Number=SeqID_85384
  Homolog annotation: Hit_ID=Q6WAY6; Match level="QueryCoverage=85%, HitCoverage=44%, E-value=2e-17, Identity=28%"; Hit description =Putative uncharacterized protein
NGVGGIPRKCLEEKAETLASQGELVDLAAIDTFLAYHHSKESPVIAVLADAYDTFDLRCEKSSARIVYCTPAFYVWLVSHVFNHESRSVCPLQGHRICVEKDKANWEELLAGMTRASISWFPWWKEGGEGVLCSCEGFPNVPWMGTRGCINYNPMLAIRQLGYPMRGAPSEETIAPFITRGFNEANVKTLQRIYKEWNKAERKDKELSGSSQGVIGSYHKWLKSRTQGITWLPKLKSLSGEEAEMLEESEDVQALKAELENTRVEKKKLKVAITRVRKECDELKDINMTIVEALERETKKAQKEEWSRN

SEQ ID NO: 177070 - protein, 42 aa, Glycine max
  Coding DNA Sequence Number=SeqID_85385
APVSLALARSRRARCDSSGMEKEEREETLLQGEDESRRSSPP

SEQ ID NO: 177071 - protein, 55 aa, Glycine max
  Coding DNA Sequence Number=SeqID_85386
MEQHQIKELSSPNSTKIDLDKRMSKNRRSLQDIMSMRWVSKSNRMQTVIQVPNKV

SEQ ID NO: 177072 - protein, 111 aa, Glycine max
  Coding DNA Sequence Number=SeqID_85387
MERNLLENLMQKLMRRFFLVIHCKARHIECLIGEHYEDASFQDKDTALRQVSKVKDLEQSKEITATLPKDLPKEWKTQKYLSLDNIIGEISKGVSTRSILRILCNNMAFIS

SEQ ID NO: 177073 - protein, 93 aa, Glycine max
  Coding DNA Sequence Number=SeqID_85388
  Subcellular localization annotation: CTP_CleavageSite=33; ConfidenceScore=5.04e-01
MTVKTSDTCSSRKTVTSLSVSGCREQTSRQGASAGVGGCRGWLNYAASEQIVLRVHHMRAIGAGLFAITPAGERGMCCKAIKLGNARVFPVTT

SEQ ID NO: 177074 - protein, 100 aa, Glycine max
  Coding DNA Sequence Number=SeqID_85389
MKEVVDQTLLSTGANGVNRVSEHDVQVIYGPQVEKIANEVKRTEAGSGVAQIRRQRHAAAGRDAAVQRGAAGVIESGGSALSATRLSRFRHERRSTAGSA

SEQ ID NO: 177075 - protein, 117 aa, Glycine max
  Coding DNA Sequence Number=SeqID_85390
IQHHPGHHYCRIGQARLPREGIYRGNAYYLKRLEGCSDDSSTASTYGIDDGQLTKIGNDSHRVDPRASQKIAVSRVNIHYLEGNLTSMGADLYKEVDLPPNFSAGAVEGTDHHGTWL

SEQ ID NO: 177076 - protein, 144 aa, Glycine max
  Coding DNA Sequence Number=SeqID_85391
  Homolog annotation: Hit_ID=Q6UUU1; Match level="QueryCoverage=55%, HitCoverage=54%, E-value=2e-32, Identity=85%"; Hit description =Putative uncharacterized protein
MAYERGGDFLEDARKILNREVRGPRQSRFSIGSAPLTSITKSDAQISGGETRQDYKDTRRFPLAAPSCALLFLPFGLPVSFRCYGRVCLRGRLTLSSGWAVRSKLDCMHEPPVQSDRCALSGNYRLESNPERHAKAPLAAATGN

SEQ ID NO: 177077 - protein, 249 aa, Glycine max
  Coding DNA Sequence Number=SeqID_85392
  Gene Ontology: Mol. function=chloramphenicol O-acetyltransferase activity; Biological process=response to antibiotic
  Homolog annotation: Hit_ID=P62577; Match level="QueryCoverage=83%, HitCoverage=94%, E-value=1e-123, Identity=100%"; Hit description =Chloramphenicol acetyltransferase
  Pfam annotation: Domain name=CAT; Domain location=6-209; Score=521.4; E_value=1e-153; Accession=PF00302.9; Description=Chloramphenicol acetyltransferase
MEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWSEYHDDFRQFLHIYSQDVACYGENLAYFPKGFIENMFFVSANPWVSFTSFDLNVANMDNFFAPVFTMGKYYTQGDKVLMPLAIQVHHAVCDGFHVGRMLNELHSTAMSGRRGVFFRQLLVPRNIYLINKMISEIVWSARNLLL

SEQ ID NO: 177078 - protein, 34 aa, Glycine max
  Coding DNA Sequence Number=SeqID_85393
MLAIIRKYKEELDLATAHEHKVAEEYTRVSQDVP

SEQ ID NO: 177079 - protein, 240 aa, Glycine max
  Coding DNA Sequence Number=SeqID_85394
TPVVVEEGETLCAYSRFALLRPNPQDLAAKLCIPGRGFELNADGQPLKILRKNMTTLAQTWSVLSFSNLIHTSHTYYVTLDRAKLIYGIIMKMDMNVGYLISHQISLIAQHDTSRLGFPALNTALCKARGVQSDSRSLESLSPAINLAYIKKNCWNLDDQIVTFRGHRKARGKRSEVPTTSAPETPAPSSSTTPLPPTQIPVIPPAPLHMPLPAPISAGPSNFIFTPQMLYSMLQSIHRG

SEQ ID NO: 177080 - protein, 168 aa, Glycine max
  Coding DNA Sequence Number=SeqID_85395
MSPTRHPLDPDKSNRALGFLALITGLCQSFGVPVTLSKVIRLPITRAFIEKYYMPRQAHGDAHQAADTPPPLRQANPVGLVGMERYLQHLVQIHECLYQFSLSQQGQGFAPFACPTPEQFGAEVAWPDDWPEAQAGEEPTGSPGEAEEARMDEEMTDLLGFLGGSGAT

SEQ ID NO: 177081 - protein, 196 aa, Glycine max
  Coding DNA Sequence Number=SeqID_85396
  Homolog annotation: Hit_ID=A5BSR3; Match level="QueryCoverage=57%, HitCoverage=34%, E-value=1e-11, Identity=38%"; Hit description =Putative uncharacterized protein
MAEKRKIREEQAAFTEDPSLYLPPSPISRHEKWKSARTKQYGQMTSQAAKEIADKIDSLEEQSRQGSIVPSGRDDILNMAIGRPEHPGRVRGAGIGVTIMQYFGPASRRSTTSSNITVEQLADIIGNLKEEWQRQVEQENIKREEVWMRRVEEEKQRTMDTFKGQIQEAIKLELSQIASQHSAPLQPNDIQVLAAR

SEQ ID NO: 177082 - protein, 23 aa, Glycine max
  Coding DNA Sequence Number=SeqID_85397
MGSRKIHITFLATHMGHCTPKCA

SEQ ID NO: 177083 - protein, 132 aa, Glycine max
  Coding DNA Sequence Number=SeqID_85398
KKKEVETRVVITERAGRTKSVSYLCFPLISDERYLAPFVARYVKSRDVPKIKRKQAYAIRENSVRFFLKKAVDFGGSNLARLGELGGKLLPYFAINRGRSEGRRGSALALLILLKLLRKIISVKKIQAEALP

SEQ ID NO: 177084 - protein, 344 aa, Glycine max
  Coding DNA Sequence Number=SeqID_85399
  Homolog annotation: Hit_ID=UPI00006A2D9E; Match level="QueryCoverage =41%, HitCoverage=78%, E-value=6e-12, Identity=15%"; Hit description =UPI00006A2D9E related cluster
MTGPLHESISCFLIKVDPWVLVPSPSEGCTPSPLEDCTSSPSKGYTPSKDYTSSPSEDYTSSPSEGCTPSLHILAFRGLHALTFRGLHTLDFRGLHVLAFRELHVLAFRGPHALAFRGLHVLTFRGLHVLAFRGLFALTFRGLHVLTFRGQHVLAFRGRATFRGLHILTFRGLHVLTFKGLHVLSFRGLHALNFRGLHILAFRELHGCSPPDIGGRPTTQPEEEAIAQLLYISGQDFAWAAANRQEGVGRGTTTAYGQPAVSNRHTATPSRVHLSSSTKVGAYWAHDRQIVITRPAQDVKEALLGGNLELAVKKLPAKRSRKSTIEKGSSAAPQADTGFDKHRF

SEQ ID NO: 177085 - protein, 226 aa, Glycine max
  Coding DNA Sequence Number=SeqID_85400
  Homolog annotation: Hit_ID=Q84VH5; Match level="QueryCoverage=82%, HitCoverage=31%, E-value=2e-81, Identity=75%"; Hit description =Envelope-like protein
FSPAVINKYLGRPTEGVVDIDVTEHQIAKEITAKQVQHWPKKGKLSAGKLSVKYAILHRIGAANWVPTNHTSTVATESFAVKLPIAFPTVLCGIMLSQHPNMLNHIDSVMKRESPLSLHYKLFEGTHVPDIVSTSGKAAASGAVSKDALIAELKDTCKVLEATIKATTKKKMELELLIKRLSESGIDDEEAAEEEGEAAEEEEEAAEEEEDAAEHTESDDDSEATP

SEQ ID NO: 177086 - protein, 170 aa, Glycine max
  Coding DNA Sequence Number=SeqID_85401
MAQLIADAIYLFAGMAPTRHLLDPDKSNRSLGFPALITGLCQSFGVPVAPSKVIRPPITRAFIEKYCTQRQAQGDAPQAADAPPPHQAGPTGSFDTEQYLRHLSQGFTSFLCPTPDQFRAEVAWPGDWPEARAGEAPAEAPAGAPDEADEAREDEEMTNLLDFLGGNGAT

SEQ ID NO: 177087 - protein, 94 aa, Glycine max
  Coding DNA Sequence Number=SeqID_85402
MNMQMNDRSTWIHPKVKANLLSYPNFVRGPLLDDMRPFFGPCENIPPEGCCFWRKQPGSPGRAELAWASWAATTSPTEALPKRFRNVFREEFRK

SEQ ID NO: 177088 - protein, 105 aa, Glycine max
  Coding DNA Sequence Number=SeqID_85403
  Gene Ontology: Mol. function=sequence-specific DNA binding; Cellular component=nucleus; Biological process=regulation of transcription, DNA-dependent
  Homolog annotation: Hit_ID=A7PI38; Match level="QueryCoverage=95%, HitCoverage=32%, E-value=1e-32, Identity=64%"; Hit description =Chromosome chr13 scaffold_17, whole genome shotgun sequence
  Pfam annotation: Domain name=GATA; Domain location=34-69; Score=67.2; E_value=5.4e-17; Accession=PF00320.18; Description=GATA zinc finger
MVSKKLRKKDIPMLANRIEMKRSSSQESVALRKCLHCEVTKTPQWREGPMGPKTLCNACGVRYRSGRLFAEYRPAASPTFVSSLHSDSHKKVLEIRNRATQVTVR

SEQ ID NO: 177089 - protein, 1075 aa, Glycine max
  Coding DNA Sequence Number=SeqID_85404
  Gene Ontology: Mol. function=nucleotide binding; Cellular component =cytoplasm; Biological process=response to chemical stimulus
  Homolog annotation: Hit_ID=A7NZL0; Match level="QueryCoverage=86%, HitCoverage=100%, E-value=0.0, Identity=82%"; Hit description =Chromosome chr6 scaffold_3, whole genome shotgun sequence
  Pfam annotation: Domain name=Glycos_transf_2; Domain location=322 -485; Score=14.0; E_value=0.0049; Accession=PF00535.17; Description =Glycosyl transferase
  Pfam annotation: Domain name=Lysine_decarbox; Domain location=4-83; Score=62.9; E_value=1.1e-15; Accession=PF03641.5; Description=Lysine decarboxylase family
  Pfam module annotation: Pfam domain module=Glycos_transf_2::Lysine _decarbox; Domain location=322-485::4-83
MMYVLFVCEGGYGTLEELLEVITWAQLGIHDKPVGLLNVDGYYNSLLCFIDKAVEEGFISPKARHIIVSAPSTKELVKKMEEYFPQHERVASKLSWETEQIDYSSNCGMSRADFNLAVKPNYSSAQCEFWLEDIESSTQLCKMGFGRNSTSRSGDYLEGMLNDYVGGRNKLKAQKSAATTKFVAALTCLQFFFAVYATFLLYYMGPSIDLRTKPEFTWATKIAQQWKQLMITPHVIGHYQEAASSLIKEDLLPTTPSQVCENEKIDFMQKKSNDVQMIKIKRELYDEVLNFQSKTIGTETLQELMAMKSKWDLKGPKRPKITVLLNHFKRKTLCAQLDSLLQQTLPFHHVWVLSFGSPNEVSLKRIVDTYNDSRISFISSSYDFKYYGRFQMALQTEADLVYVVDDDMIPGRKMLQILAHVAGTDKYKNSVLGSIGRILPFRQKDFTFPSYRKFRSKEAGLYLPDPAYDITVDKIVQVDFLSSSWFLSADLVKTLFIETPFTFSTGEDLHLSYQLQKYKNAGSFVLPVDPKDKETWGDSEHRLAYVSETTVIFKDVVQVRDDQWWKALSTGYVTQWAAMYPQKIDALFYAHSVDEVKVLAPLLEKFRSTVGKKAYIVVSGGNYCPCEDAARALKWPALVCKERRFKIFDLAVEALSGVSDSEAPVIHAVYTSLKGLIKIHNPSLVISVAEIDPHVRKALKMASETNSNGTTFVLLPSSSVSQVLWMADLRSTALPNWNRMRISVNIITQNRVNSLARLLKSLSNAYYLGDEIPITFNMDSKVDEATIRLVGSFEWPHGTKTLRRRIVQGGLIRAVSESWYPSSDDDFGLLLEDDIEVSPYYYLWIKYALMAYHYDPQVSLPELSSISLYTPKLVEVVKERPKWNATEFFKHIHPNTPYLHQLPCSWGAVFFPKHWREFYVYMNMRFTEDAKANPVQIPKSRTNGWQASWKKFLIDMMYLRGYVSLYPNFPQQASFSTNHMEPGAHISAKDNVVKHNKRDFEVPLMKEDFRNFLPAMKMPPAPRLPSLNLFNQPVSLKGLKAAGAKLGQDVLRCDNATEVVAVDKDTGLPHTCSKF

SEQ ID NO: 177090 - protein, 85 aa, Glycine max
  Coding DNA Sequence Number=SeqID_85405
MDNHSWCYPACIQCHRKTDIQTASFTCGCGKDNDLLVLRYRVEVMVTQNDESSKFLLWDRECAELIGQTADEVNRVKIEVCSGIL

SEQ ID NO: 177091 - protein, 149 aa, Glycine max
  Coding DNA Sequence Number=SeqID_85406
  Homolog annotation: Hit_ID=A0ST23; Match level="QueryCoverage=16%, HitCoverage=51%, E-value=3e-07, Identity=100%"; Hit description =Putative reverse transcriptase
GSTEVQLAIIAKHLGFPNALTGRLPIGWPGRNPDAGAGSPGPAAGTERGDQAYRYRRPRGGARYQLLFPLVRVNFELGVIMVIAVSFGKPVVPAALMNRPTRGERRFAYWALAECILAYYVGTDEGEKKGCTGASAEYVIQDIFRFLAH

SEQ ID NO: 177092 - protein, 355 aa, Glycine max
  Coding DNA Sequence Number=SeqID_85407
  Gene Ontology: Mol. function=4 iron, 4 sulfur cluster binding; Cellular component=integral to membrane; Biological process=protein -chromophore linkage
  Homolog annotation: Hit_ID=P56766; Match level="QueryCoverage=100%, HitCoverage=54%, E-value=0.0, Identity=80%"; Hit description =Photosystem I P700 chlorophyll a apoprotein A1
  Pfam annotation: Domain name=PsaA_PsaB; Domain location=2-355; Score =336.6; E_value=4.3e-98; Accession=PF00223.10; Description =Photosystem I psaApsaB protein
HFSRTIAKGPDTTTWIWNLHADAHDFDSHTNDLEEISRKVFSAHFGQLSIIFLWLSGMYFHGARFSNYEAWLSDPTHIRPSAQVIWRASGITSELQLYCTAIGALVFAALMLFAGWFHYHKAAPKLAWFQDVESMLNHHLTGLLGLGSLSWAGHQIHVSLPINQFLNAAVDPKEIPLPHEFILNRDLLAQLYPSFAEGATPFFTLNWSKYAEFLTFREIRSSNWRTNWGIGHSIKDILEAHKGPFTGQGHKGLYEILTTSWHAQLSINLAMLGSLTIVVAHHMYSMPPYPYLATDYGTQLSLFTHHMWIGGFLIVGAAAHAAIFMVRDYDPTIRYNDLLDRVLRHRDAIISHLNW

SEQ ID NO: 177093 - protein, 76 aa, Glycine max
  Coding DNA Sequence Number=SeqID_85408
MEDLEHQLNQNTRRHYGGNRVGNVGPSISIYYAPQSDIRVKSYDHLTFSRASVVQFRASPYIIGLNRTSESKVMAV

SEQ ID NO: 177094 - protein, 270 aa, Glycine max
  Coding DNA Sequence Number=SeqID_85409
  Homolog annotation: Hit_ID=Q6WAY4; Match level="QueryCoverage=75%, HitCoverage=36%, E-value=1e-22, Identity=32%"; Hit description =Putative uncharacterized protein
MGSSQKPSLKKRFYQVKIKSLEVTSLRELGQLMGQLQRQAFRKAYGKIWDLARVEVSMEPIASLSQYYNQPLRCFTFEDFQLVPTVKEFEEILGCPLGGRKPYLFSGFYPSTTRVAKVVKISAQELDRVKQNRNGVVGVPRKCLEERAKALANQGEWASFIDTLALLIFGVFLFPNMEGLVDLVAIDVFLAFHHGKESPVVAILAMYDTFDRGCRPVYPLQGHRSCAEKRKANWDQLLASMEGHLLIRSLARRKEESGFYLHAKDVQMFP

SEQ ID NO: 177095 - protein, 74 aa, Glycine max
  Coding DNA Sequence Number=SeqID_85410
LGASHGLSEKAQARLTGALFKGGKMHGVATNEGISTSHVDKSRALAPTYPPSKRKSDLRSSSFKGESSDSFYLK

SEQ ID NO: 177096 - protein, 66 aa, Glycine max
  Coding DNA Sequence Number=SeqID_85411
MEQGQIDILIARFPDPNYGVKTKTKLTPMLWVKHPRYFMKELRAFQVLQRDIIWKFRLCQCDRGSV

SEQ ID NO: 177097 - protein, 93 aa, Glycine max
  Coding DNA Sequence Number=SeqID_85412
EELATQLAQASKVASSRSNSLLDEGSGRPNQGKVEDDSYQGLKRMSRTERRQCGHRRSIGMGNKEGPKGRMEPKQVLRGVVGQQQRAQASKGQ

SEQ ID NO: 177098 - protein, 25 aa, Glycine max
  Coding DNA Sequence Number=SeqID_85413
MGVKYLEVVKRGSHPNKLMIPDEIR

SEQ ID NO: 177099 - protein, 390 aa, Glycine max
  Coding DNA Sequence Number=SeqID_85414
  Gene Ontology: Mol. function=hydrolase activity, acting on glycosyl bonds; Cellular component=periplasmic space; Biological process =carbohydrate metabolic process
  Homolog annotation: Hit_ID=A4W560; Match level="QueryCoverage=84%, HitCoverage=48%, E-value=1e-176, Identity=86%"; Hit description =Alpha amylase, catalytic region precursor
  Pfam annotation: Domain name=Alpha-amylase; Domain location=2-383; Score=163.1; E_value=7.7e-46; Accession=PF00128.15; Description =Alpha amylase, catalytic domain
MQEIGTFHGGDLQGLTSKLDYLQQLGVNALWISSPLEQIHGWVGGGTKGDFPHYAYHGYYTQDWTRLDANMGDEADLRQLVDEAHRRGIRVLFDIVMNHAGYATLADMQEFHFGSLYLKGDELKKTLGERWTDWKPASGQSWHSFNDYINFSDKAGWEQWWGKKWIRTDIGDYDNPGFDDFTMSLAFLPDLKTESTIPSGLPNFYRHKPDTAAKEIAGYTPRDYLTHWLSQWVRDYGIDGFRVDTAKHVEPDAWQQLKTQATAALAEWKKANPQKALDDAPFWMTGEAWGHGVMQSDYYRHGFDAMINFDYQDQAAKAVDCLADMDATLAADGGQAAGFQRAELSLLARYPPVPRRRQPGGGTTLTLEQGYGFVRESSADKVMVVWAGQQ

SEQ ID NO: 177100 - protein, 119 aa, Glycine max
  Coding DNA Sequence Number=SeqID_85415
MARTKKTWEMTTEVTKEIAEKIDSFEEQASQGSFVPHGRQDVLIAVIGRPKHPGCVRAAGGGVSIRQYFGSAPWTSCNSSSLPPEKLQQLTQQIRNQLEELITEKVTRQLMASFSQMQS

SEQ ID NO: 177101 - protein, 44 aa, Glycine max
  Coding DNA Sequence Number=SeqID_85416
ERGVKKRKIGLYGTLFGEELSENRRFEVLGMEENVEEALAAQQL

SEQ ID NO: 177102 - protein, 52 aa, Glycine max
  Coding DNA Sequence Number=SeqID_85417
MEHGNSSTTIGLAIGVALAIDFGVGMVAALSHGSGFNLPMGGSTREQIGSIG

SEQ ID NO: 177103 - protein, 94 aa, Glycine max
  Coding DNA Sequence Number=SeqID_85418
  Subcellular localization annotation: CTP_CleavageSite=23; ConfidenceScore=5.19e-01
MGTWGNGSSPSRPGELRLTPKVTGSPRRAGSFTLKSFEGPGKLKASLGELGCWKLNKKTLSPFLFVWLARIKTSVNDSPQTKLGYGTLFLRKPR

SEQ ID NO: 177104 - protein, 118 aa, Glycine max
  Coding DNA Sequence Number=SeqID_85419
MVAITLAKVHQPPFLREYDLNATCACHRDAPGRSIEHCRALKRKVQGLIDMGWLKFEENRVIFNFHRKWVQAIGLFAQATCAPEFGLPRPFNQRLLVLRVGGAAVKQQIKFKTNKFQN

SEQ ID NO: 177105 - protein, 251 aa, Glycine max
  Coding DNA Sequence Number=SeqID_85420
  Gene Ontology: Mol. function=DNA topoisomerase (ATP-hydrolyzing) activity; Cellular component=chromosome; Biological process=DNA unwinding during replication
  Homolog annotation: Hit_ID=Q66CZ3; Match level="QueryCoverage=88%, HitCoverage=24%, E-value=1e-118, Identity=95%"; Hit description=DNA gyrase subunit A
  Pfam annotation: Domain name=DNA_topoisoIV; Domain location=1-244; Score=250.7; E_value=3.2e-72; Accession=PF00521.11; Description=DNA gyrasetopoisomerase IV, subunit A
MAQPFSLRYMLVDGQGNFGSVDGDSAAAMRYTEVRMSKIAHELLADLEKETVDFVPNYDGTEQIPAVMPTKIPNLLVNGSSGIAVGMATNIPPHNLAEVVNGCLAYIDDENISIEGLMEHIPGPDFPTAAIINGRRGIEEAYRTGGGKVYLRARAEVEADAKTGRETIIVHEIPYQVNKARLIEKIAELVKEKRVEGISALRDESDKDGMRIVIEVKRDAVGEGGAEQPVCADATAGHLRHQHGRAASGPA

SEQ ID NO: 177106 - protein, 94 aa, Glycine max
  Coding DNA Sequence Number=SeqID_85421
  Gene Ontology: Mol. function=metal ion binding; Biological process =histone H3-K9 demethylation
  Homolog annotation: Hit_ID=Q6K7P0; Match level="QueryCoverage=53%, HitCoverage=5%, E-value=9e-19, Identity=88%"; Hit description =Putative DNA-binding protein PD3, chloroplast
MFGCFLSLPHFAVFALPAQTFLVALASFGSLNLAVKLPNGSLKPDLGPKTYIAYGFPQELGRGDSVTKLHCDMSDAVCSICLFLSWAVIFKDFF

SEQ ID NO: 177107 - protein, 112 aa, Glycine max
  Coding DNA Sequence Number=SeqID_85422
MPYHNLVDFEPCLGYATEGQPVGGIPLQNTLEDPQYHPQLHPLHSTAGKNPHAMVEMGKLDHLEERLMAIEGGGDYVFANCRNLPFGGRATRDSRDACSTKGIRAESPPTFI

SEQ ID NO: 177108 - protein, 72 aa, Glycine max
  Coding DNA Sequence Number=SeqID_85423
MTNEGEPKVEKSMANKDKKAMLEKAYSAIMLSVSDKRLSDIFRRSRSETRESLVINRHDQRHECNSTTNENR

SEQ ID NO: 177109 - protein, 196 aa, Glycine max
  Coding DNA Sequence Number=SeqID_85424
KCAESPPTFICGKRRKNRRKPVMKNIPDSGVVFTFEEGISTSHVDKSRALAPTYPPSKRKSDLRSSFKRANQAILFTWKEASQVASSGSNCLLEEHPGRPKLRNLTGHVITPFLAFGMLQKLTDCVTILPFDFRHVSELHVLCNKGRQVPRSGQPKAKGHFGAVAGCPGELELAQLGIRGPSWKVNTFNHVAFEDG

SEQ ID NO: 177110 - protein, 107 aa, Glycine max
  Coding DNA Sequence Number=SeqID_85425
MGCDLSMIERRFGVKHLDSFNTTSVDMMICQVWKCRYGGGESDPKEVLGVDNTGDFEGSVSIVSDTIGISNINQWILPQIRFDWYIQYQSTDTFLKEGGFFGSSEQN

SEQ ID NO: 177111 - protein, 46 aa, Glycine max
  Coding DNA Sequence Number=SeqID_85426
MKSKNGLSLKVNLEAKVQATMGNLKIPKVTLWYSTMKYNAILCRTV

SEQ ID NO: 177112 - protein, 74 aa, Glycine max
  Coding DNA Sequence Number=SeqID_85427
MTILVDDKRLLLEGETTMWKRLTLEGEICWVTSVRCTPRISPTGPIIYIQVSGIPMSDTTMKAAQRSINSGGIW

SEQ ID NO: 177113 - protein, 41 aa, Glycine max
  Coding DNA Sequence Number=SeqID_85428
MEFMLKKKIGLSLSLTIEHAGVRGVREILNIMYSRMMHYLF

SEQ ID NO: 177114 - protein, 159 aa, Glycine max
  Coding DNA Sequence Number=SeqID_85429
MIEVSVEAIASLTQYYDQPLRCFTFGDFQLVPIVEEFEEIFGCTLGGRKPYLLSGFYLSVERIAKVVKISAQELDQEALRGEGEGIGGSRGMSFVHRCLGAIGIVLFPNEDGLVDLAAIDAFLAYHHSKESPEMREERHKDCLLDTHSLCMADLTPLSS

SEQ ID NO: 177115 - protein, 87 aa, Glycine max
  Coding DNA Sequence Number=SeqID_85430
  Subcellular localization annotation: CTP_CleavageSite=12; ConfidenceScore=5.07e-01
MAPPLTSSPLSSAASRGTCYVHPTTLLVHPTNSEWAKLPLCNLVIRKNILPNEVPEDVLLEKLPEEGSFGSPPSSFRRTFFRKLFFK

SEQ ID NO: 177116 - protein, 154 aa, Glycine max
  Coding DNA Sequence Number=SeqID_85431
MTTNRGPLRAKGHFGAVGARPGELNHSPEVASSPRRANFLTMKYFDGPGEPNASLGELGSRKTQKKTLLPPSLGHLEIYLKEIENHERAPTLCDKDVVEQSQQPTSFERGDHVSCTQHAYGKNVSMNPCIQHDLEDGIPSQEPNKDINFTKVYP

SEQ ID NO: 177117 - protein, 31 aa, Glycine max
  Coding DNA Sequence Number=SeqID_85432
MRKMQGSCMGEHNMRTMRVECMQLAEQKHAK

SEQ ID NO: 177118 - protein, 168 aa, Glycine max
  Coding DNA Sequence Number=SeqID_85433
MPHHNLVDFEPCLGYATEGQAVGGIPLQKTLEGPQYHPQPHPSHSTTVKNPHAMAKMGKLDHLEERLRAIEGGKEYAFVNLEELFLVPISSPLPSSRYRTLTNLVFTGERIEVGLKKGKFDHPALMNEKTGANEEDENEEGTHVEAVITQPILAPLITHHPVIHKGHP

SEQ ID NO: 177119 - protein, 96 aa, Glycine max
  Coding DNA Sequence Number=SeqID_85434
DLAMIEVFVEAIASLTQYYNQSLRSFNGDFLPWRCSGRQRRIGEGRHHPLGNKPWKKEFHHQECALDKKLEEDALMEEKKERMGEHKIEGIKEGEK

SEQ ID NO: 177120 - protein, 213 aa, Glycine max
  Coding DNA Sequence Number=SeqID_85435
  Subcellular localization annotation: CTP_CleavageSite=58; ConfidenceScore=5.18e-01
MGVDFLTRLFTPYFIFTSTRGRARSSLLLTTINVLTPHDHGFLCGALRGNVTSPKTFEAFNVASPFLGTSLRGVFLYGLTLIFLGEFNLVPHFHIEPTREPSYAWSFLLPKSSSKRSSSICVYILQHSYSLSKPLELVHKLPFIVGGNVPLPKGTLKIIPILYWRIPMNPSFFNKGSPPIEGVPLKAKGSQWNFSLFANMMASKELFNLHFPI

SEQ ID NO: 177121 - protein, 141 aa, Glycine max
  Coding DNA Sequence Number=SeqID_85436
  Homolog annotation: Hit_ID=A2Q1D6; Match level="QueryCoverage=80%, HitCoverage=18%, E-value=6e-11, Identity=35%"; Hit description =Ovarian tumour, otubain, related
  Pfam annotation: Domain name=FAR1; Domain location=46-132; Score= -23.7; E_value=0.021; Accession=PF03101.6; Description=FAR1 family
MSEEIDMNVENEEDAGMKVEHVDCFDAFNTSQLFATYDEVLHRARLMAHEIGFVALIMRSDTNAGVRGWALFLLIACKRNDDYRPKKNDLVRTCTSNGKCGCPFKLGVKLVLGGEEWMAKLIYGTHNHEMTKSFVGHPYAG

SEQ ID NO: 177122 - protein, 71 aa, Glycine max
  Coding DNA Sequence Number=SeqID_85437
MPDNAQRLTSSSAPFVIQGQRVGWWAEIPYGHPRLSSTERNEFDSVRMMGVQIAIRPTWAFQDVPIEGGGF

SEQ ID NO: 177123 - protein, 217 aa, Glycine max
  Coding DNA Sequence Number=SeqID_85438
  Gene Ontology: Mol. function=hydrolase activity, acting on glycosyl bonds; Cellular component=cytoplasm; Biological process=carbohydrate metabolic process
  Homolog annotation: Hit_ID=A4W775; Match level="QueryCoverage=95%, HitCoverage=34%, E-value=4e-90, Identity=77%"; Hit description=Alpha amylase, catalytic region
MRDELSRLYLPAVGILANTDISYDPNHIDAETCMAWMENYRAGLSHQQQLRMFNQLDSHDTARFKSLLGKDVARLPLAVTWLFTWPGVPCIYYGDEVGLDGNNDPFCRKTFPWAPEQQDKVLFSLYQRLAKLRKQSLALRYGGCQVVYAHDNVVVFVRVYQQQRVLVAINRGEACEVVLEYSPLLADKTWKSKEGKATLQDGVLSLPAISAAVWFGS

SEQ ID NO: 177124 - protein, 72 aa, Glycine max
  Coding DNA Sequence Number=SeqID_85439
MSRGSGNLGDVRWGAIAQNQAWPIPTQPGHSQPVRTCDVPKQCLKIETERSVATGNRLPFVCNQLHNVICYW

SEQ ID NO: 177125 - protein, 81 aa, Glycine max
  Coding DNA Sequence Number=SeqID_85440
MYTIRPLEALCCPCLDERLVGQIKSEICGEDTKKKSRAKAQVTFRPTTLTTSLSSSHVGVAATPHLHPSTGGGVRYKREYR

SEQ ID NO: 177126 - protein, 84 aa, Glycine max
  Coding DNA Sequence Number=SeqID_85441
  Gene Ontology: Mol. function=aspartic-type endopeptidase activity; Cellular component=chromatin; Biological process=chromatin assembly or disassembly
  Homolog annotation: Hit_ID=A5AZW8; Match level="QueryCoverage=70%, HitCoverage=25%, E-value=6e-21, Identity=83%"; Hit description =Putative uncharacterized protein
MPTDVEALLVGLKVGGQDGQRGHKFFMTQKKLSPKQARWQDFLAEFDMVSEYKPGRTNQVADALSRKAELAALKLEEVSAVSQH

SEQ ID NO: 177127 - protein, 126 aa, Glycine max
  Coding DNA Sequence Number=SeqID_85442
LCQSFGVPVAPSKVIRSPITRAFIEKYCTQRQAQGGDPQAPDAPPPPPQADPAGSFDTERYLRHLLSLSLQSQGFASFPCPTPDQFRAEVAWPGDWPEAQAAEAPAETLGEPDEAREDEEMSDLLG

SEQ ID NO: 177128 - protein, 82 aa, Glycine max
  Coding DNA Sequence Number=SeqID_85443
  Subcellular localization annotation: CTP_CleavageSite=22; ConfidenceScore=5.31e-01
MTCSRKCAKNHDHVVNVSPSTTANARGRTPPFPSFDVAINRVPRYLPYKCVPSTCMIGLQYLKPLYIGQKSKKHYETDGVRD

SEQ ID NO: 177129 - protein, 146 aa, Glycine max
  Coding DNA Sequence Number=SeqID_85444
MSDHPSSVNGEGTSHKDPLSKILDELSSLKLWKEKLERKEKVKDRVKVNQDERGQIREEERRKILKELRNEKHASYSSHNSCKSLSEEPRDYYEGRHRSHLRPHSHRREKERKPQEANISLPYFHGKDNVEAYLDWEISVEQQLKR

SEQ ID NO: 177130 - protein, 61 aa, Glycine max
  Coding DNA Sequence Number=SeqID_85445
MGHLSDQGVPMNPKRIKVIPEWPTPPSVEGRSPEYEEPRDLRSNPFQGGGNDAILPRKGIG

SEQ ID NO: 177131 - protein, 92 aa, Glycine max
  Coding DNA Sequence Number=SeqID_85446
LACERKKEAEAEREEKTLTSPQGTRKLSFLSGIYLLNVALAQVNYGAEVTFISRGNPDLLIVRDFHLKSLRSALSLWSSNYVPFFSRPHVGE

SEQ ID NO: 177132 - protein, 95 aa, Glycine max
  Coding DNA Sequence Number=SeqID_85447
  Gene Ontology: Mol. function=DNA-directed RNA polymerase activity; Cellular component=chloroplast; Biological process=transcription, DNA-dependent
  Homolog annotation: Hit_ID=Q8HVY4; Match level="QueryCoverage=100%, HitCoverage=26%, E-value=4e-22, Identity=98%"; Hit description=DNA -directed RNA polymerase subunit beta'
GAGAIREQLADLDLRILMDSSLIEWKELGEEGSPDNENEWEDRKEKLVQEAVDTLLDNGIRGQPMRDGHNKVYKSFSDIIEGKEGRFRETLLGKR

SEQ ID NO: 177133 - protein, 79 aa, Glycine max
  Coding DNA Sequence Number=SeqID_85448
EFKIPVTGPECPMSAHPPHLSDEALDPQVSLRQGWKGLLHAEVKMDPMLVMGALKWPQEISQEWQQLPMSSVCRLPPPL

SEQ ID NO: 177134 - protein, 367 aa, Glycine max
  Coding DNA Sequence Number=SeqID_85449
  Gene Ontology: Mol. function=transporter activity; Cellular component= integral to membrane; Biological process=transport
  Homolog annotation: Hit_ID=Q9KGM8; Match level="QueryCoverage=65%, HitCoverage=79%, E-value=4e-61, Identity=47%"; Hit description =Oligopeptide ABC transporter
  Pfam annotation: Domain name=BPD_transp_1; Domain location=167-367; Score=148.2; E_value=2.3e-41; Accession=PF00528.13; Description =Binding-protein-dependent transport s
SVNWKHALRNALIPIVTIVALNFGSLIGGAVVTESVFNWPGIGRLLVDSVKYRDYPVIQGVTLVAVTGVVLMNLVGEIVIGLLNPKISRRPRRRRQIVRFLLGNPSITTGGGLVLLVVLAALFAPLITHWDPIEQDLLNTLQAPSVAHWFGTDDYGRDIFARVIYGARITLFEVSLSVAISMAIGIPLGIISGLAGRKIDALIMWLMDIIFAFPGIVLAILIVSVLGEGLTNMLIAISLFSIPVYARLSRNLTLGLKNMEYIEAAHMLGVRYPRIITHYILRNAIGPLIVQSTLTAGAVVLSAASLSFLGLGVQPPMPEWGTMMSDGRNFLGLNIYVSLFPGLAILITVLGFNLLGDGLRDVMDKRL

SEQ ID NO: 177135 - protein, 35 aa, Glycine max
  Coding DNA Sequence Number=SeqID_85450
MSKCPRSGVSWPQAKDDDECSLDESTTKGSLAKVL

SEQ ID NO: 177136 - protein, 103 aa, Glycine max
  Coding DNA Sequence Number=SeqID_85451
MGFRGFRDTRSNPTRLGELRSPGRAGRQPPPPFSYKKAEGGCSKDPSAPWLCISAVLGEKNCFREENPSRGASVTLPRCFRKQIREGFRPFFIVLHPFFVLQR

SEQ ID NO: 177137 - protein, 60 aa, Glycine max
  Coding DNA Sequence Number=SeqID_85452
MAKKHNQPQAVQATPDFRINTPIAQAIVKWRRKKDDWRRRFKEKMSEAQAHHHRKPWIRA

SEQ ID NO: 177138 - protein, 73 aa, Glycine max
  Coding DNA Sequence Number=SeqID_85453
MVQLSAHCYTKPNIFTSLEVRLAQVVALSLKHSLLSAYCRKIFGVAESAKHRCCTKPQMLIGSYNFKLGLARG

SEQ ID NO: 177139 - protein, 126 aa, Glycine max
  Coding DNA Sequence Number=SeqID_85454
MNKKVKVILWMNALLEPKLLNPRKTMNCWQPNPITILESPSDSFLCVHCCMVKRRLSFELQNVAVRLSSTVGLSAYPSLRAALVCLAQKRIRQQLLQTTRAQNSRAATGLFGEKSPRSRKEEQLVH

SEQ ID NO: 177140 - protein, 112 aa, Glycine max
  Coding DNA Sequence Number=SeqID_85455
MYPPLFSLNNLVDVPSTRTDPQEMYPLLFSVKPKEKGDTKEFRRLVLCSFGKGRRETQKELKRLVLGEFFLAKGEEMKRMNSTSFQGLENQENFWKDFGIKKKKKFKEIQGL

SEQ ID NO: 177141 - protein, 137 aa, Glycine max
  Coding DNA Sequence Number=SeqID_85456
MRGVLIPSPCIKTTLEPFTLKVRRPHLFRFFRRFLQINVGGDSAHFPFLEDAPVSLASPSRRRVGGLVGACALSATLDRLARISEFRLSACLLAQQMDSRSALGGMNPRLANMHNSSFFQILPCAQPREWCAQRMAR

SEQ ID NO: 177142 - protein, 104 aa, Glycine max
  Coding DNA Sequence Number=SeqID_85457
MDPPQAKATKGGFYFFPTYDMKRIFVNAMRLSTTNVPMDLARVLLAFQKNCWIGDRDRSNSLAKKNQKGKNQLCYLMQDRTVLSAERRLRVLGGIGPLNPVLGI

SEQ ID NO: 177143 - protein, 157 aa, Glycine max
  Coding DNA Sequence Number=SeqID_85458
MASRKRARTEDIPSSSNPSPSTAAMEPDAQQAHSLIHMLQSLFRGQLMIVYNQHELDHNRPIISMEQFLEKVAWPEAQLPLERAHKVVPPGPVLARTEPTSVEPQPPVVDPHASPELETLSPPALPLIIIPDDLADEAAAPFDSPSCNIDDGSDFFD

SEQ ID NO: 177144 - protein, 145 aa, Glycine max
  Coding DNA Sequence Number=SeqID_85459
SAECNTPRLSARKTLEEDELYRFAKRTASSHYTHRFSSSAKRERHELSRNSLMCAKRSIRSLDWDSKLCMSRVSRDRKVQVPESFERFCCVKICRDQSLKQEPASWYGQLNPLLDLPWSFNSGNWSDSKVLDSIGLSCRTITRNR

SEQ ID NO: 177145 - protein, 93 aa, Glycine max
  Coding DNA Sequence Number=SeqID_85460
MVQKGRFMKIDIFSPNAHPYMHCFLRLIIIVVLACDENPKTAQVQGPMTKSMTKQSDNTLQQMVSAILDKAQVEKDEGPEALPRILIVVEGPN

SEQ ID NO: 177146 - protein, 273 aa, Glycine max
  Coding DNA Sequence Number=SeqID_85461
MSASPDRDYFSLAQKKELRRSEFLVTNGGYVGAKAPLLSTTPPFAIVTREVEIPKWANEPVDMRRFTSSFALSVILTREVRRHAGYRMVIRTFRQPGANELIDAQRLTSSSALFVILTHGVRGSVWLSAPFVNQQRLTSSSAPFSHPGTASRAFKPDDAWDSSLMGEDDQGQLSYPNFVRGPLSGGMPPSPDRLEGGANSNQAHLGLPRGSNRRRCLLVEATQLAWASWAATTSLFSPINRGKRAEQKYVSMSDFMKILHRSSFVLHRSSVFN

SEQ ID NO: 177147 - protein, 125 aa, Glycine max
  Coding DNA Sequence Number=SeqID_85462
KYIDASIKNLEVQVGQLAKQLSEHGSGSFSATTQVNPKEHCNLITTRWGTVVGLKDNDEKKNKDGVEKENEKNEVMTSEKVVSEEEKKKSNEQTNDKGKAIVNHPPIEHLPYPHALSKKDKERHY

SEQ ID NO: 177148 - protein, 127 aa, Glycine max
  Coding DNA Sequence Number=SeqID_85463
MGASDEDVEVVYLRDFPFSLASKAKTWLQSHPNKSLNTWEEVKEKFLASGSKPQTKMILDASAGGTMMSKSPKKDILIIDSTIASDYQSHHDRALTQRKDKPTSSTISPRWTTENTSSSPSSANFEM

SEQ ID NO: 177149 - protein, 74 aa, Glycine max
  Coding DNA Sequence Number=SeqID_85464
MHQRRPTASERRQREVAPIVEDDPMVTEDVHAHVEEVVDDAEGFLGGPHDPLLDFPCSYFLVQFSFIQICSREI

SEQ ID NO: 177150 - protein, 95 aa, Glycine max
  Coding DNA Sequence Number=SeqID_85465
MATSWAEDTWKPNPPVLLATSGGSVSRQLYWRLRPCAKIAALTGDFRGYHARVQDAHKPFPRELQTATATRREAGNRQFDCIHAGKKEEAVGVSV

SEQ ID NO: 177151 - protein, 120 aa, Glycine max
  Coding DNA Sequence Number=SeqID_85466
MIIVGYLGVSKTSFISSHDARDNELVGMISLAILEVRVRKEDKWFWRQREGLASSSSLTDGGGEWCIHTSDAYEACDLNMLKNNLRLGVPMRYLNFFLKSVKCKQVPKLEGIGRRIGVIP

SEQ ID NO: 177152 - protein, 118 aa, Glycine max
  Coding DNA Sequence Number=SeqID_85467
MGSKIYPKVHENPKAFFISFSPILVQPLGKIASPFASSLSFEEGELRLTHPWAKRASTAKRNFSVLSTTEEFGRASSSRLRAKHEISAPSATIVFSQAQRTTGAKLKSTYSHLARGWR

SEQ ID NO: 177153 - protein, 35 aa, Glycine max
  Coding DNA Sequence Number=SeqID_85468
MEDAKPMKTPIHASQPLSKDESDFNLILKNHIKRL

SEQ ID NO: 177154 - protein, 209 aa, Glycine max
  Coding DNA Sequence Number=SeqID_85469
MERSMIDAASGGALGDMTPAEARNLIEKMASNYQQFSARSDAIVIRAVHKVATNSSSSGETKKLKGKLDALVNLVTQLAMNQKFALVARLCGLCSSADHHTNLCPFVQQSEAIEQPEAYAANIYNRPPQPQQQNQPQQNDISNNRPYIPPPIQQQQQQQPQKQQTVEASSQPSLEELVRQMTMQNMQFQQETRASIQSLTNQMGQLATQ

SEQ ID NO: 177155 - protein, 497 aa, Glycine max
  Coding DNA Sequence Number=SeqID_85470
  Gene Ontology: Mol. function=aspartic-type endopeptidase activity; Biological process=DNA integration
  Homolog annotation: Hit_ID=Q8S8M1; Match level="QueryCoverage=22%, HitCoverage=9%, E-value=4e-09, Identity=33%"; Hit description =Putative retroelement integrase
  Pfam annotation: Domain name=zf-CCHC; Domain location=132-149; Score =21.5; E_value=0.00084; Accession=PF00098.14; Description=Zinc knuckle
MKREKHVSYSSHNSCKSLSEELRDYYEGRHRSHLRPHSHRRENERNPQEVSIKLPYFHGKDNVEANLDWEIRVEQQLKRKSTSKSYGSHSYPKKDQGQGILGVRPSKPKDDKGKTIQKQPLKASMQEKTSSMKCFKCLGRGHITSQCPTKKTMIMRGQDIYSSQDEATTSPSSSKSEEAKWEESSEEICPQEEGQPLMVKEEYKEVSVSSKRLAKKERHFEIKTNIKEISLLRQPPHFLLCKKTLVSIATSLRLEFIPQVKELLDEGLVLKILNPCALLVPKIGIIRHQIPKIGGVMNALGGATLFCKITHAPNIFMICAHRDSLGRVPMNPKRIKVIPEWPAPPSVRKIWGFQDLTNFYKRFAPYFSILVAPLIELVRNHVPSWEDAQEMSFQTLPYFNILNTSVKGRSPEYQEPQDLSSIGARRPRIFFINGFLCFLEDEWQRNGERERERRRHFKEKMSLEEAHLHRRPWIRAWRKKEMNEGRRREEHEILCSK

SEQ ID NO: 177156 - protein, 168 aa, Glycine max
  Coding DNA Sequence Number=SeqID_85471
SEDRPPKQSRVRGHLVKIDADRLNTFLETPVVLAEGETLPTYSKYCRLPTDFKEIEAALCIPGRGFIFNSEGYPWKILRKDLTTLAQVWSVLSYSNLDPTSHTSDLIVDRARLIFSLVSHLDMNIGALISGQMTSIAQSNTSRLGFPALITALCRPEGLSLTALPLSA

SEQ ID NO: 177157 - protein, 38 aa, Glycine max
  Coding DNA Sequence Number=SeqID_85472
MSPPLLCPWLALGEVLRLRVQTFARESPLDLASLCTYR

SEQ ID NO: 177158 - protein, 337 aa, Glycine max
  Coding DNA Sequence Number=SeqID_85473
EMAPRKLSAKRSRRDAAAEGTSATPEFDSHRFRSAEHQQRFEAIKGWSFHRERCVQLRDDEYPDFQEEIARRRWTSLVTPMAKFDPDIVLEFYANAWPTEEGVRDMRSWVRGQWIPFDVDALSQFLGDPLVLEEGQERPLPAVMHTGSGFFPDRCREAGADHAHQHDNLDPDVDDVAAQQCMPPTRHPLDPDKSNRTLGFPALITGLCQSFGVPVTPRKVIRPSITWAFIEKYCTPRQAQGNAPQAADAPPPPHQADPVGSFGTERYLQHLVRRGQGFAPFACPTLDQFRAEVAWLGDWPEAQAGEAPTEAPGDVEEARMDEEMTDLLCFLGGSGAT

SEQ ID NO: 177159 - protein, 117 aa, Glycine max
  Coding DNA Sequence Number=SeqID_85474
MSNVYYPDEQQTPTNTTQHDQFVGDDNSDSTDDDVNMTQENIDIEYSLNDPTIDDLDDYDEQTFLSASSAYQNTGGTYIDIGDPIAWECPHCKAMMWYDERINKDTNKQTKVFIMLF

SEQ ID NO: 177160 - protein, 124 aa, Glycine max
  Coding DNA Sequence Number=SeqID_85475
  Gene Ontology: Mol. function=4 iron, 4 sulfur cluster binding; Cellular component=integral to membrane; Biological process=protein -chromophore linkage
  Homolog annotation: Hit_ID=P56766; Match level="QueryCoverage=66%, HitCoverage=10%, E-value=5e-31, Identity=76%"; Hit description =Photosystem I P700 chlorophyll a apoprotein A1
MDTKYPCFSTRHTAQVQQQGVLFARIRVIRREQLPFSFSLNWSKYAEFLTFRGGLDPVTGGLWLTDIIHHHLAIAILFLIAGHMYRTNWGIGHSIKDILEAHKGPFTGQGHKGLYEPNNVMAFY

SEQ ID NO: 177161 - protein, 59 aa, Glycine max
  Coding DNA Sequence Number=SeqID_85476
MTVKKRLSHGVLKETIELSSSVGLSAHPSLSAASARLAQQKNLAEHQYQGCVLSTRSVR

SEQ ID NO: 177162 - protein, 70 aa, Glycine max
  Coding DNA Sequence Number=SeqID_85477
MQFFTKIGNRVPALRLESAPDRASSIKRLVLIKHHPQIPLVGLNLTKTALRQIYKQLGYRTLIPRENRIN

SEQ ID NO: 177163 - protein, 179 aa, Glycine max
  Coding DNA Sequence Number=SeqID_85478
MEGQPWKLLRKDLTTLAQTWSVFSYSNLAHTSLISDLNTDRARSVYGLITRMDMNIGGLISRQMTMMAQSNSSRLGFPALITSLCRSRGVGSDALTSYENLRLSSRTLDAKLQSLFEGQILIMQSLQELAQQRPIMSVEQFIEKVAWPGARPSFVGDNESFTAQAPQQHELEPEKRSLI

SEQ ID NO: 177164 - protein, 154 aa, Glycine max
  Coding DNA Sequence Number=SeqID_85479
  Gene Ontology: Mol. function=chloramphenicol O-acetyltransferase activity; Biological process=response to antibiotic
  Homolog annotation: Hit_ID=P62577; Match level="QueryCoverage=85%, HitCoverage=59%, E-value=8e-74, Identity=96%"; Hit description =Chloramphenicol acetyltransferase
  Pfam annotation: Domain name=CAT; Domain location=1-128; Score=207.2; E_value=4.1e-59; Accession=PF00302.9; Description=Chloramphenicol acetyltransferase
MGSWLHPCYTVFHEQTETAPFSSLWSEYHDDFRQFLHIYSQDVACYGENLAYFPKGFIENMFFVSANPWVSFTSFDLNVANMDNFFAPVFTMGKYYTQGDKVLMPLAIQVHHAVCDGFHVGRMLNELQQYCDEWAGRGVNFLRQLLVPRNILSD

SEQ ID NO: 177165 - protein, 95 aa, Glycine max
  Coding DNA Sequence Number=SeqID_85480
MAMMVARVMLGYGYKLGMGLSKNNGDKNQPAKGALPCHSSKSFISAGLRHEGQVAAIFEDDSPRRSDLVRPCPPGFRLGNWRVEERPDVYMTSII

SEQ ID NO: 177166 - protein, 130 aa, Glycine max
  Coding DNA Sequence Number=SeqID_85481
MTRVQCKIVRFILVDLQKLAYQNESFLMTEQAKQVFYVQDPCDERHMATPPSSPPPHPESAKPSSSTSKKTRKETRLKSLATRLVGAERPMVHVDPAIGKVDGPHRKKLRTYMGIVARRMLHMIIGNKSM

SEQ ID NO: 177167 - protein, 196 aa, Glycine max
  Coding DNA Sequence Number=SeqID_85482
MASNSQQFSARNDAIVIRGVHEVATNPSASSETKKLEGKLDALVNLVTQLALNQKFVPVARTFVLPCSNLEQLSSLKLMLQIFTIDLLNLSSKINHSTHNYDLSSNRYNPGWRNHPNLRWSSPQQQQQQPAPSFQNVVGPSRPYIPPPIQQQQQPQKQPTVEAPPQSSLEELVRQMTMQNMQFQQETRASIQSLTN

SEQ ID NO: 177168 - protein, 147 aa, Glycine max
  Coding DNA Sequence Number=SeqID_85483
MLHSMMQSLCRGQVIIMQSLQSSCLPSIMSTDEFLTLVAWPRVQPSPSGGGGTSIAQEPMPAEEPMPDAEDEPVPPEPFIFEIDPIAHEEAAAQEPTSPVHISTAPIPEDSQPFAPALELEQPTVQDPPAAPMLDLNEHAEDHPQED

SEQ ID NO: 177169 - protein, 345 aa, Glycine max
  Coding DNA Sequence Number=SeqID_85484
  Gene Ontology: Mol. function=4 iron, 4 sulfur cluster binding; Cellular component=integral to membrane; Biological process =tricarboxylic acid cycle
  Homolog annotation: Hit_ID=Q1H0A3; Match level="QueryCoverage=99%, HitCoverage=39%, E-value=1e-164, Identity=84%"; Hit description =Aconitase
  Pfam annotation: Domain name=Aconitase; Domain location=3-294; Score=- 173.5; E_value=7.3e-06; Accession=PF00330.11; Description=Aconitase family (aconitate hydratase
MPLDMPESVLVRFKGQMQPGITLRDLVNAIPYAAIQEGTLTVGKQGKKNVFNGRVLEIEGLPDLKVEQAFELADASAERSANGCTVLLNKEPVIEFLNSNIVLMQNMIENGYADARTLERRIASMKAWLEKPELLQPDSDAEYAHVIEIDLNEIKEPLVACPNDPDDIKPLSAVVGDKIDEVFIGSCMTNIGHYRAAGKVLEGAGGIPTRLWIAPPTRMDEAQLRAEGVYSTFGVAGARTEVPGCSLCMGNQARVADKATVFSTSTRNFDNRMGKDARVYLGSAELAAVCAKLGRMPSVQEYLDTLGSKLTNTAEIYKYLNFNQMIQYAGSLENVKKIIPIKETV

SEQ ID NO: 177170 - protein, 160 aa, Glycine max
  Coding DNA Sequence Number=SeqID_85485
  Homolog annotation: Hit_ID=Q6UUU1; Match level="QueryCoverage=44%, HitCoverage=46%, E-value=5e-19, Identity=71%"; Hit description =Putative uncharacterized protein
MGRNVSALIGKSVPQIPEKCKDHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGARFPGRCQEDT

SEQ ID NO: 177171 - protein, 53 aa, Glycine max
  Coding DNA Sequence Number=SeqID_85486
MDWRQFQHCSPFDAILPRKGPITRTMSKRLQEDWARAAEEGHRVLMNLRGSIL

SEQ ID NO: 177172 - protein, 106 aa, Glycine max
  Coding DNA Sequence Number=SeqID_85487
MPPISGLNEICCGRCWLSEPSFAKRYILFMALRKRARTKDIPSSSNLPPPTEPMEPDAQQAHPMIPMLQSLFRGQLMIVYNQQELAHNKPVISMEQFLEMVAWLEA

SEQ ID NO: 177173 - protein, 95 aa, Glycine max
  Coding DNA Sequence Number=SeqID_85488
  Subcellular localization annotation: CTP_CleavageSite=40; ConfidenceScore=5.27e-01
MSVSPFGILLVCVDAKSTGKCTGSSSLFNKQAFANRIMIVTESKSMFYSNYKAINALGPLTEQIDAIKDVSLIKDVHVSYAEGSSTKHRCLVSLA

SEQ ID NO: 177174 - protein, 132 aa, Glycine max
  Coding DNA Sequence Number=SeqID_85489
GDIKVAHKALKSQNSQNNSSIPDLVQNSCSLHVYIAVCVSGLQQLALDEIYHFPEKSALKELKDQYFRAGCQDIVSDIVDPAHSVKDITDLCVQYFRAGCQDIVSDIVDPAASILHLTFYLALCIVQPDLIP

SEQ ID NO: 177175 - protein, 227 aa, Glycine max
  Coding DNA Sequence Number=SeqID_85490
MHSKVILMMPKNQELSKFQRFKNLVSRIKIQDSRIKFQESRFKNNQDQVSRLKIQESREDLIKISTNRLRYLLFPLTNIQRTNRLRILCPNTLEGTSFVGTSTWLFKKNKGGYIPCGSLACKGFYKVEKKSQEPQENTRQCLEAEGQVVTWETFKRVFLEKYFLEDVRNKKEMEFLELKALDRRLQVDSARDPREGLRVLMSLRLSSSFFRNLLKEASQGGELSYER

SEQ ID NO: 177176 - protein, 218 aa, Glycine max
  Coding DNA Sequence Number=SeqID_85491
MTRTKKTGQMTSEAAKEIADKIVRFLREVGLTRFLCRPWTSGYTDYCHWATRTPWSCVCYWSRCHDQTILWTGSKDLLHIFIHGSRRPRATNTKNQGPTGGVDHRKSDSRTNVVLQLDAVPVSLPPKPKIGPSVAHVSTKESCVDPSGNDLDTSDSEKCGLYIEENPPHLVALGKLYEGSTIFHNIPLPHDEVKVGVEEVRDVDASFPIPTEEVQLVG

SEQ ID NO: 177177 - protein, 240 aa, Glycine max
  Coding DNA Sequence Number=SeqID_85492
  Subcellular localization annotation: CTP_CleavageSite=58; ConfidenceScore=5.25e-01
MFREENLSRGASVTLPRRFRGRFHEGFPPFFIVLRSFFVVLRSSTDHVFFRFFRRFPRINVGGDSTHFPFLEDAPASHASPSRRRVGCDNNEIYLNVVGGPNYKGNVYRLGTLRKRFSCSKSAPSTSIAPVEDQIEEMHETINKLYAELLEKANKEKTLEEKMLQMMKNHDHQSQEMRQQMQEQNEKIPQQNKQMQRILQHLHIQSIMLTPSLSPTIADGTEHHINDAQIDHPHDMGNDH

SEQ ID NO: 177178 - protein, 494 aa, Glycine max
  Coding DNA Sequence Number=SeqID_85493
  Gene Ontology: Mol. function=protein serine/threonine kinase activity; Cellular component=integral to membrane; Biological process=recognition or rejection of self pollen
  Homolog annotation: Hit_ID=A7R073; Match level="QueryCoverage=84%, HitCoverage=51%, E-value=1e-110, Identity=47%"; Hit description =Chromosome undetermined scaffold_298, whole genome shotgun sequence
  Pfam annotation: Domain name=B_lectin; Domain location=125-235; Score= 99.9; E_value=8e-27; Accession=PF01453.15; Description=D-mannose binding lectin
  Pfam annotation: Domain name=PAN_2; Domain location=391-459; Score =83.3; E_value=7.8e-22; Accession=PF08276.2; Description=PAN-like domain
  Pfam annotation: Domain name=S_locus_glycop; Domain location=249-374; Score=110.7; E_value=4.3e-30; Accession=PF00954.11; Description=S -locus glycoprotein family
  Pfam module annotation: Pfam domain module=B_lectin::PAN_2::S_locus _glycop; Domain location=125-235::391-459::249-374
MSSPIVQPLLPPSALAPPELWGPFRNRNGSLGLEAQKSKTLGFFFVGVLKLVGFKKGYIILLGEVVNEKCLLFYFGIISVNDTITSTRFIRDPEAIISSNGDFKLGFFSPEKSTNRYVAIWYLSETYIIWIANRDQPLNDSSGVFQIHKDGNLVVMNPQNRIIWSTNVSIIATNTSAQLDDSGNLILRDVSDGKILWDSFTHPADVAVPSMKIAANRLTGEKIAYVSWKSSSDPSSGYFTGSLERLDAPEVFFWFNKTKPYWRTGPWNGRVFLGSPRMLTEYLYGWRFEPNDNGTAYLTYNFENPSMFGVLTITPHGTLKLVEFLNKKIFLELEVDQNKCDFYGTCGPYGSCDNSTLPICSCFEGFKPSNLDEWNRENWTSGCVRNMQLNCDKLNNGSDVQQDGFLEYHNMKVPDFAERSINGDQDKCRADCLANCSCLAYAYDSYIGCMFWSRDLIDLQKFPNGGVDLFIRVPAQLLVVGMFFSPSTQYFGVI

SEQ ID NO: 177179 - protein, 199 aa, Glycine max
  Coding DNA Sequence Number=SeqID_85494
NIQPNDPNSDLPLPKCQLVYAILTRMSIHVAQLIADAIYLFVGMEPTRHHLDPDKSNRALGFLALITGLCQSFGIPVTPSKVIRPPITRAFIEKYCTQRQAQGDALQAADTPPPHQAGPAGSFDTEQYLWHLSQGFTSFPYPTQDQFRAEVAWPGDWPEARAGEAPAEAPAEAPDEADEAREDEEMTNLLDFLGGRGAT

SEQ ID NO: 177180 - protein, 228 aa, Glycine max
  Coding DNA Sequence Number=SeqID_85495
LALVKEFYANLYISEGPSPKQVKVRGHVVKIDADSLNIFLETPVVLAEGETLPAYSKYCRLPTYIREIEAALCIADRGFVLNVEGHLGKILRKHLTTLAQVWSVLSYSNLAPTSHTSDLTVDRARLIFGLVSQMDMNVGALISGQITSMAQSNSSRLGFPALITALCKSRGVASDSLVFERLSPVINLAYIRKNCWNPDDLTVTIRGAKRARRRPAETPSTSTAPPPT

SEQ ID NO: 177181 - protein, 200 aa, Glycine max
  Coding DNA Sequence Number=SeqID_85496
MGDLEEVQEQMNADMSVSKEQMASMMEAMLGMKRLMESNAVTAAATSTTAEADLALPTAHHPVPNIVGRGRSTSGHVSSPHLGYNRGAYPYDLPPNYTPQAMHEDAERAQGDVNSYSPFPAKGPVPNALSQPNITGEPQTHPTQPMLLSVGGPPPAAEGKEKLDLLEERLRAAEGFNDYPFADMTDLCLVPDVVISPKFK

SEQ ID NO: 177182 - protein, 275 aa, Glycine max
  Coding DNA Sequence Number=SeqID_85497
  Homolog annotation: Hit_ID=A9MHF0; Match level="QueryCoverage=89%, HitCoverage=17%, E-value=1e-40, Identity=42%"; Hit description =Putative uncharacterized protein
MVVQVLAIAAQFIVDDGLGALVAHDAFAREHLHVDHGAGHARRHAQRGVLNVGRLFTEDGAQQLFFRRQLGFALGRDLADQHVVGADFGADVRDARIVQAVQLRLGQVADVARDFFRTQLGIASDNRQFLDVHRGVAVIGHDLFGDQDRVFEVVAVPGHERDQHVLAQGEFAQVRRCAVGQHVTLGDTVATLDDGTLVDVRVLVGTRVLDQVVDVDTDFAGDVFFVVHADHHAFGVDVVDQAATQRLYGGARVNGHGCARYPCPRRLFRTQASTA

SEQ ID NO: 177183 - protein, 212 aa, Glycine max
  Coding DNA Sequence Number=SeqID_85498
  Gene Ontology: Mol. function=metal ion binding; Cellular component =nucleus; Biological process=histone H3-K9 demethylation
  Homolog annotation: Hit_ID=A7Q7J4; Match level="QueryCoverage=53%, HitCoverage=10%, E-value=8e-45, Identity=77%"; Hit description =Chromosome undetermined scaffold_60, whole genome shotgun sequence
MASVINLSCYHHHHIHLLSPRFCSLSYHLRKFYLNVWLFLVPAPFCCFCFACPDLSCCPCILWDWLAWPQILKLKDWPPSNLFEEQLPRHCAEFISSLPFKEYTDPHKGSLNLAVKLPNGSLKPDLGPKTYIAYGFPQELGRGDSVTKLHCDMSDAVNVLTHIAEVKLDSDQLTVIEKLKQKHLEQEKRELLGDDQDGETNVDMLNIIHLLQ

SEQ ID NO: 177184 - protein, 125 aa, Glycine max
  Coding DNA Sequence Number=SeqID_85499
MGIAPARHPVDPEKSNRALGFPALVTGLYQSYRVPVPPRQGYVIIGIAPARHPVDPKKSNRVLELSSSNYGSLSVYEYLSPQQGHQAPTNRASSRITASPGRRRVKHHSSLGMAGSGQQTHRHHL

SEQ ID NO: 177185 - protein, 164 aa, Glycine max
  Coding DNA Sequence Number=SeqID_85500
  Homolog annotation: Hit_ID=A5B536; Match level="QueryCoverage=65%, HitCoverage=68%, E-value=2e-32, Identity=71%"; Hit description =Putative uncharacterized protein
MNGSEGGAGFYFRAGREGSLLNPFPSLPHCSSKCATPYEDLLPFCPLSVHTVLKAEEEGWAAVMLRMLRHRIDRPSSRSFPVHSLYISDTQGRTRWEGSSPSLCPADHSAGILHSRLRLTAARGWSCRYVSLSGSLAPPVISFYDMLLSSPYSICNLVISASLR

SEQ ID NO: 177186 - protein, 171 aa, Glycine max
  Coding DNA Sequence Number=SeqID_85501
  Homolog annotation: Hit_ID=A5BY14; Match level="QueryCoverage=42%, HitCoverage=5%, E-value=9e-09, Identity=41%"; Hit description =Putative uncharacterized protein
KIGEELATQLAQANKVASSRSNRLLEEETGRPISYGNSRIAQQYFLLISDASRDFTYCETKDARSSFDPKNTKTERKNRKKQATTKTLGPKHYNNIVIPPSSDKVVKLKPTLLSLIGLHPFAGMDHEDPYTHLSTFMELCSTMGASDEDAKAVYLRAFPFSLAGKAKTWLQ

SEQ ID NO: 177187 - protein, 117 aa, Glycine max
  Coding DNA Sequence Number=SeqID_85502
MARVAKVVKISVQELDQVKQNRNGVVGIPRKHLEEKAKALAALLVFGVVLFSNMDGLVDLAAINAFLAYHHSKESLVVVVLGGAYDTFDRGMREEQRENCLLYTRSLCMAGLSHFSS

SEQ ID NO: 177188 - protein, 152 aa, Glycine max
  Coding DNA Sequence Number=SeqID_85503
  Gene Ontology: Mol. function=endonuclease activity
  Homolog annotation: Hit_ID=Q9AY32; Match level="QueryCoverage=34%, HitCoverage=78%, E-value=5e-21, Identity=96%"; Hit description=RRNA intron-encoded homing endonuclease
QSKSLNEDPLEGKSGASSRVKKLVVGPWVGSIGPPPVCTGRLVPSAGDALLSLTGRVVPPDSDPIVLAFGIGVMINRDSRGHSTKVGGSKTIRYRPSLNHNDADQGSADVAFRTPLAPYEKSKSLGSGGSMVARLKLKGIDGRAPPGVEPAA

SEQ ID NO: 177189 - protein, 77 aa, Glycine max
  Coding DNA Sequence Number=SeqID_85504
  Subcellular localization annotation: CTP_CleavageSite=59; ConfidenceScore=5.38e-01
MFSPSGIEKSLEISEKNCFRGKNPSRGASVTLSRRFRKRFRGDSSPFFIVLCSFFVVLRSSTGKFPKLNLSIHSMHP

SEQ ID NO: 177190 - protein, 329 aa, Glycine max
  Coding DNA Sequence Number=SeqID_85505
  Gene Ontology: Mol. function=two-component sensor activity; Cellular component=membrane; Biological process=two-component signal transduction system (phosphorelay)
  Homolog annotation: Hit_ID=Q7NZ89; Match level="QueryCoverage=99%, HitCoverage=34%, E-value=6e-77, Identity=43%"; Hit description =Putative uncharacterized protein
  Pfam annotation: Domain name=GGDEF; Domain location=108-269; Score =164.3; E_value=3.3e-46; Accession=PF00990.12; Description=GGDEF domain
  Pfam annotation: Domain name=PAS; Domain location=1-98; Score=17.2; E_ value=0.01; Accession=PF00989.15; Description=PAS domain
  Pfam annotation: Domain name=PAS_3; Domain location=9-101; Score =31.7; E_value=2.6e-06; Accession=PF08447.2; Description=PAS fold
  Pfam module annotation: Pfam domain module=GGDEF::PAS::PAS_3; Domain location=108-269::1-98::9-101
MVTDAKHVILSVNPAFTRMLGFTLDDVIGKTPKILSSGLHDANFYRSMWESVSNFGHWRGEIWNRRKNGEIFPEWLSISEVKNEAGEISHYVGTFSDLSDLKSAQKEIQYLASHDALTGLPDITHFRDRLENAISIAAAANQKIALLALNLDNFKFLNDSLGYASGDKLLKLFAERLKGCLHETDTICRHGGDEFILLLNNMHDDDSINYMVDMLLTEVSSPFAFAGSNISTSCSIGVAVYPTDGNDFEKLFGRARKAMSHAKEEGRNTARFFTEKLNTDSLHYLNIAYGLREALAHHQFELHYQPQISLKNAQVIGAEALIRWHHPQN

SEQ ID NO: 177191 - protein, 61 aa, Glycine max
  Coding DNA Sequence Number=SeqID_85506
MATSNEWEHIRDIAAKSGANTLRIAAILTFFNNSDAETIDKKTMEQAFTIMDWMSGNFISG

SEQ ID NO: 177192 - protein, 212 aa, Glycine max
  Coding DNA Sequence Number=SeqID_85507
  Pfam annotation: Domain name=Transposase_23; Domain location=92-162; Score=5.7; E_value=0.00028; Accession=PF03017.5; Description =TNP1ENSPM transposase
APWTCPCYWSRCHIKQYFGSAPRTSCGSSSLPPEELQQLTQQIKDQLEESITEKVTRQLMASFSQMQSQMQSQGLALPPEPPLGPSGNDPETGDSDRCGLYIEANPARLVALGRVYEGSTVVHNTPLLPGQVKVGVEEVKDPDAPILVPTNEVSLVGHAIHTFLVWPTHLVKFLSQQTVVSLAKPPQKPNPEVDDPLYLMTLTIPELFLRPY

SEQ ID NO: 177193 - protein, 139 aa, Glycine max
  Coding DNA Sequence Number=SeqID_85508
  Gene Ontology: Mol. function=protein dimerization activity
  Homolog annotation: Hit_ID=A7R8V0; Match level="QueryCoverage=94%, HitCoverage=24%, E-value=7e-25, Identity=40%"; Hit description =Chromosome undetermined scaffold_2988, whole genome shotgun sequence
  Pfam annotation: Domain name=DUF659; Domain location=49-139; Score= -14.3; E_value=3.4e-06; Accession=PF04937.6; Description=Protein of unknown function (DUF 659)
MDKNEVLKVHQYIACFWYRAGLSFNLIKLKCFENMVVAIGQYGPHLPIPSYHDIRVSLLKKEVEYTENLMKGYREQWVKYDFNSQAGTMFFKSVDGFDFVKIGEKLFELLDAIMEKVGEENVVQVVIDNGSNYVSASKL

SEQ ID NO: 177194 - protein, 129 aa, Glycine max
  Coding DNA Sequence Number=SeqID_85509
MQEEDEDEESKDEEDFSLFVKKFHKFVKKRRIERRQNFNHEKDSKKTLQLFDATNATNLVTSKQIAPQTSNGQRRMRRKVMKKEDPRRRILHRMTMTHPMVRRRRSTFYPRTMRAMRTSLKKIKQKVKV

SEQ ID NO: 177195 - protein, 204 aa, Glycine max
  Coding DNA Sequence Number=SeqID_85510
MDNEEGVQEQMKADLSALKDQMTSISEVMLKLQKTIEDKATATASSIVRETEPVLQPALNPGRDRNTAVFGRRYSPQAYPYGLPPDFTPRATPEDLSQAPTFKGQLPPYDDYPGQDDEEGDTHLGPLLHLKDPSPHELPQPNIVRHIPTSPTPVKESVPFVEDKGKIQALEERLRAVEGLGNYPFSDLADLCLVPNIVIPPKFK

SEQ ID NO: 177196 - protein, 83 aa, Glycine max
  Coding DNA Sequence Number=SeqID_85511
MSSPLALSSWLDMWHVTIATGDIASGCHHWWLRRGNQHIGNDDLRVFRRKLDIMKQHKEPYTTTVMAALPPICVVGNVAWFAV

SEQ ID NO: 177197 - protein, 110 aa, Glycine max
  Coding DNA Sequence Number=SeqID_85512
MHKALRLNALLPYPHLVTLFLQHFNIPLDFEPYVPIKRSFLIGADVVASFGYRKKRDGSWVKKGAQPNDDEGHLLVEGDSSLLQSNLDRFDGLQTCVGERFDSLESQVNT

SEQ ID NO: 177198 - protein, 74 aa, Glycine max
  Coding DNA Sequence Number=SeqID_85513
MEGADSREVKAKLLPKSVAANESHSGEAAVCETSSVPFEDTTSRKKPRLVKNLVGRLGVHDRTCLTMGKSGHSH

SEQ ID NO: 177199 - protein, 170 aa, Glycine max
  Coding DNA Sequence Number=SeqID_85514
MTRSKLGDLHPYDPEVGRTFHRLSRNNRSVVVHDSVVLDSSIVHTNFTSDFIPNFVFEPTVSAFESGTSVELIKIKLLRNWLHLMLCINLGVVNILRLRSMIDVAGEGALMDKIPVVARQLISNMAINDQQFSTRVVATSKASTTEVFVFMIANNQRLENKLTELKSLGR

SEQ ID NO: 177200 - protein, 286 aa, Glycine max
  Coding DNA Sequence Number=SeqID_85515
  Subcellular localization annotation: CTP_CleavageSite=48; ConfidenceScore=5.77e-01
MATPPNSPPPPSESATPSSLSTSKKTSKTTRLRLLATRPVGVGRPMVNVDLVTRNVDGPHRKKLSTYLGIVAHDKLMKEKQKKHLEEATQFGSTETVVDPPSPIRRHVKQKMARTKKTGQMTFQAAKEIADKIIYHFPLLVGSFVAHGRQDVLTAAIGRPEHLDRVRAVGAGVMIKHYFGTTSRGSCTFLSMGLTLSHEAEVGPSTTCASTVESCVDPLRQDLEMGDLDKCGLYIDDSPSRMVALRKVYEGSTNVHNVPLGNDQVKFNVEEVRDADACIPVPNQVV

SEQ ID NO: 177201 - protein, 57 aa, Glycine max
  Coding DNA Sequence Number=SeqID_85516
MSLSGSVYFVKMASRKRKSIGARPTAQYDTRRFHSLDSWNRYTDHVLGRSIFTREEG

SEQ ID NO: 177202 - protein, 103 aa, Glycine max
  Coding DNA Sequence Number=SeqID_85517
  Subcellular localization annotation: CTP_CleavageSite=89; ConfidenceScore=5.33e-01
MSPPPLRPHNHSQTHLMLSGWLPLHAQFSASGLVGACALSANLDRLARISESRLSTHLFAQRMNSSGALSGMTPRSVNMHNSSFFQILPCAQRMECFAQRMAR

SEQ ID NO: 177203 - protein, 127 aa, Glycine max
  Coding DNA Sequence Number=SeqID_85518
MSWVNLITVMPQNHRDHFLQHGMEVADGVRSKTWKCWWIALTWTIWHHRNKVVFQDTTFHGTKLLEDAIFLLWSWIKAMDKDFTLHFNQWSSNLKEGLDQTYLREVAKEKKHRLLTMLECDEHDARP

SEQ ID NO: 177204 - protein, 118 aa, Glycine max
  Coding DNA Sequence Number=SeqID_85519
  Subcellular localization annotation: CTP_CleavageSite=52; ConfidenceScore=5.30e-01
MEPKRKKVESLKDNSTVATGFVANSGATKHMTCDRNMFTQFSSNSFVLVIINANDVSSPVMGSGTNIHMKEKIGSGKRSEGLYYLKGNSQYTKGKALAHFISDETQAKNKRDIWQWHK

SEQ ID NO: 177205 - protein, 125 aa, Glycine max
  Coding DNA Sequence Number=SeqID_85520
MLESFKQQEQMSVLELYIEKDVAGGSIFHSANLLTSCGNNLSYNETQPPTNMSNLHVDEDDDDYLVSNSYVEESLDEDDSVDDISDTDDEVTDIIQPVRIVHQTEGAQGIQNPFWNDALHYNNIN

SEQ ID NO: 177206 - protein, 250 aa, Glycine max
  Coding DNA Sequence Number=SeqID_85521
  Pfam annotation: Domain name=Transposase_23; Domain location=120-190; Score=-8.0; E_value=0.0089; Accession=PF03017.5; Description =TNP1ENSPM transposase
MTTEAAKEIVAKIATQGSFVPHGRQDVLAAAIGRPEYPGRVRAVGAGQLTQQIRDQLEESITERVTRQVMASYNQMQSQIQSQMQTQGLALPLDPLVGPFGPRVSTKGSCVDPSGNDPETGDSDRCGLYIETDPARLVALGRVYEGSTVVHNTSLLPGQVKVVMEEVTDADAPVPVPTDEDSLVGQALHTFLAWPTYLVKSLSQQIVVSLPKPPPKPDQEVNDPLYLMTLTIPELFLRPYQVTWDATVFG

SEQ ID NO: 177207 - protein, 63 aa, Glycine max
  Coding DNA Sequence Number=SeqID_85522
MSSDSKGNCNNLNKQLETDDHHVEASFMMMNQVDSSSFDNDKDDDKKPKRMISRLSQQVQDQV

SEQ ID NO: 177208 - protein, 75 aa, Glycine max
  Coding DNA Sequence Number=SeqID_85523
  Subcellular localization annotation: CTP_CleavageSite=42; ConfidenceScore=5.63e-01
MPSAVHVSSTNESGSPANSLPSAVRQFSILSLIRRPMNSLPSAVHVCSTNEFGAKRIHCLALFANSPFSILFGDP

SEQ ID NO: 177209 - protein, 99 aa, Glycine max
  Coding DNA Sequence Number=SeqID_85524
  Subcellular localization annotation: CTP_CleavageSite=47; ConfidenceScore=5.30e-01
MAPRVVPFSEYASRLSCTGFQSLTPHFSNRRRVLQCRLKTWDQVKIKSLEVTSLRELGQLMGQLQRQAFRKAYGKIWDLARVEVSMEPIASLPSIMTSP

SEQ ID NO: 177210 - protein, 183 aa, Glycine max
  Coding DNA Sequence Number=SeqID_85525
MIMRGQDIYSSQDEATTSPSSSKSEEAKGEESSEEIYPQEEGQPLMVKEECKEVSVSSKRLAKKERHFEIKTNIKEISLLRQPPHFLLCKKTLVSIATYLRLEFIPQVKELLDEGLVRMRLNPCALLVPKIGIIRHQIPKIGGVMNALGGATLFCKITRAPNIFMICVHRDSLGIINMKIQKK

SEQ ID NO: 177211 - protein, 76 aa, Glycine max
  Coding DNA Sequence Number=SeqID_85526
MAAEWRRKRERRCHFKEKMSLEEAHHHRRPWIRAWRKKDMNEDKGREEHEILCSKRALKSEPTNPRSIPRFSTKCP

SEQ ID NO: 177212 - protein, 65 aa, Glycine max
  Coding DNA Sequence Number=SeqID_85527
MFLIFNSALKGLDDTPQPKSKAAARWIVVKCNRQKGSTECGYYIMHWMSTIILGSFRNNLETYFN

SEQ ID NO: 177213 - protein, 62 aa, Glycine max
  Coding DNA Sequence Number=SeqID_85528
MLQEVLLDEDVKRKVNIEFANFSDGREGFDDLDSLNDRGVGIGQARPGFKRPEPSLRLIFEA

SEQ ID NO: 177214 - protein, 60 aa, Glycine max
  Coding DNA Sequence Number=SeqID_85529
MGVLVAIAFGSGHFTLAVLAVHCPASDMLKVVYARVAARSAIGAQWRRQWVFPIDLLYAR

SEQ ID NO: 177215 - protein, 43 aa, Glycine max
  Coding DNA Sequence Number=SeqID_85530
MSEVLAKPLGTTTRCGSATTAIPATEIDACPWAPLEHAELERG

SEQ ID NO: 177216 - protein, 135 aa, Glycine max
  Coding DNA Sequence Number=SeqID_85531
MEVPAQKRHQTADLRFIQIGWRAAAPVKLADVTTGKQRRAMHNFLFECIKVLVGFVLLTGHNFIAAAEITELVAERNMDVERQRTLRIARDSLLKIILAKGIRELQRGGAKSQSIDGTDMLTPSVGVAFVYGGPF

SEQ ID NO: 177217 - protein, 64 aa, Glycine max
  Coding DNA Sequence Number=SeqID_85532
  Subcellular localization annotation: CTP_CleavageSite=10; ConfidenceScore=5.00e-01
MATRVTSGVSSASTSTSGYSSWALGASPPPKGEGWTPGQADAEPGRGYSASPGISHGGGSAHRH

SEQ ID NO: 177218 - protein, 192 aa, Glycine max
  Coding DNA Sequence Number=SeqID_85533
  Subcellular localization annotation: CTP_CleavageSite=41; ConfidenceScore=5.45e-01
MAEPSKKRKGSSSSTAATAHRRHRPSEAPTAPIHPSLSSPRSSTLFSSDDQRLRYLSQFSSRIILDPKYLDVDFFNDETFDCYQVFQNSGLIDFMSLKLPHYPELVKVFYCNLKIQDGIISSEGTIVDDWKFDYSSHDARRMVCNDQAEMTASEEDLILMWAFLTGRQIEWAHLVRYRMHKALRANAPLPYP

SEQ ID NO: 177219 - protein, 175 aa, Glycine max
  Coding DNA Sequence Number=SeqID_85534
MGQIQRQAFRKTYGKIWDLAMIELVPTVEEFEGILGCPLGGRKSYLISGLYPSMARIAKVVKVSVQELDRVKQNRNGVVGIPRKYLEEKAKALEDQDEWASFIDVLALLVFRVVLFPNVDGLVDLAAIDAFLAYHHSKARKVWSLMFWPMPMIHLTGDVRGAVQGLSTAHPLFMY

SEQ ID NO: 177220 - protein, 33 aa, Glycine max
  Coding DNA Sequence Number=SeqID_85535
VQTLEMPLIFGNTGSGSTSQARKWNMNSIRWEG

SEQ ID NO: 177221 - protein, 241 aa, Glycine max
  Coding DNA Sequence Number=SeqID_85536
  Gene Ontology: Mol. function=phosphoprotein phosphatase activity; Biological process=intracellular signaling cascade
  Homolog annotation: Hit_ID=A7QV78; Match level="QueryCoverage=99%, HitCoverage=87%, E-value=4e-30, Identity=29%"; Hit description =Chromosome undetermined scaffold_186, whole genome shotgun sequence
ATITLQDVSVLLGLRNEGAPLIGQTNLDWTELCEELLGVRPEEGELQGRGVLFVDKSSSKVSLRYLQFLRDFEQCNTTLHDFGSKENSSIMENKPLGHRWLRRGNQHIGNDDLIVFRRKLDMMKRHEFVWEPYPTTVMSMLPPICLVGSVAWCAVVPLICFHVVEWHQPDRVLRQFGMQQPIPESPSQPQNIHGLTLKGKQDENWFQLLGPFISQWNNRDEFRVDIYPRQEGLLSFNSDYM

SEQ ID NO: 177222 - protein, 270 aa, Glycine max
  Coding DNA Sequence Number=SeqID_85537
QLEVGYRGWWVYARIVDVENLLCTIARPPPSTTCDGVKLPAFIVDHRVVPGDMSGGSGDLGDVRRAPGSQQIKGKQDHKARRLVVAGQLLGKRGQEANEASGNRLPRGCNRLPGLKRELELMEALIVMAAQLIRDRVEMECLEGAWETLEGNTRCRFRGTIRFTATSLVHPDEPARTLQRTVEWILPTPTPYRLVEPVQVIEVTSSEEDPEEDLEELPPEPAVDALDFLEGDEDPLLEVDSLEEVMSASEADSTEDSGPREMAISGGSSS

SEQ ID NO: 177223 - protein, 166 aa, Glycine max
  Coding DNA Sequence Number=SeqID_85538
MYNYHEKGRALDLESVLADFITYQASSKDDLLMQFKGTVDSMQQAFKRAKTQIGNLVDDMIKVMVRREEEYAEIETHQESILQVNTIHHQLITKEEKDEVFVILEYPCIATTGYVVGKGKGRLELSVEDQKISFDLFEAMKHPNMSDACLEEDEVEQEIALSASTM

SEQ ID NO: 177224 - protein, 91 aa, Glycine max
  Coding DNA Sequence Number=SeqID_85539
  Subcellular localization annotation: CTP_CleavageSite=49; ConfidenceScore=5.12e-01
MAISTCFQQVSSQITIMKQKTSKTTHHISQNPIPTKFKRERSPPKPEISKSHTNDGQRLELCLELQWWMKKKEKSNVRERERELSEICWIS

SEQ ID NO: 177225 - protein, 73 aa, Glycine max
  Coding DNA Sequence Number=SeqID_85540
MVQLWFGIRVKHLPVWEKTGGPFGPANKSYSEPHELIVIHASSTNGSGAPRIDCLALFMRPPPSSLEPRELIA

SEQ ID NO: 177226 - protein, 97 aa, Glycine max
  Coding DNA Sequence Number=SeqID_85541
  Subcellular localization annotation: CTP_CleavageSite=21; ConfidenceScore=5.28e-01
MTGFLRFFPTFSTNKHWWRLRAFSSFGRGTREPRLARPQKGRLRQSHMYIAMKDAQLDNTFLLITLWSYDETIDPDEHLDVFLTQANLYTNDDAILC

SEQ ID NO: 177227 - protein, 94 aa, Glycine max
  Coding DNA Sequence Number=SeqID_85542
MDNGERVLILVPTGRTDEDKFMMMLLKRRGIGMRDKREFSCVQNLFNLDMSMIYGNKFVRLPRDEEYPYFLDTMMANFVIDNNLKATLWGEQCH

SEQ ID NO: 177228 - protein, 93 aa, Glycine max
  Coding DNA Sequence Number=SeqID_85543
MATEWRRKRERRHHFKEKMSLEEAHHHRRPWIRAWRKKEMNEGRGREEHEILCSKSNVTSPKTFEAFNVASPFLGTSLRGVFLYGLTLILLGF

SEQ ID NO: 177229 - protein, 116 aa, Glycine max
  Coding DNA Sequence Number=SeqID_85544
MTRAYIQSLSNLLRFPFLVKIIYKQRATKDVPSIVLFEQPSRCTLYLKRTTTDVPSLVFTITTKKLPASYTEFSDGINSPRRAGCLRMTTFHGPGAGDAVDAGADIDHVVDLTTAQ

SEQ ID NO: 177230 - protein, 106 aa, Glycine max
  Coding DNA Sequence Number=SeqID_85545
  Subcellular localization annotation: CTP_CleavageSite=38; ConfidenceScore=5.32e-01
MEQPKNYLTLPAKQTKNSQLINWAKRAPITKRTLSALSATKESGRALISRPRAKREISVLKAAVVFSQAQCMNDAKLKSTYSAHHNAYFGKRALEAARGVAFVERP

SEQ ID NO: 177231 - protein, 221 aa, Glycine max
  Coding DNA Sequence Number=SeqID_85546
MRGAPTEESLSPFLVRDFGVQSLKVIQRVHKGWRSPLRKDKELRGIRKGVIGGYHGWLRVHTRGLDWLSKLKVINEENFEAPEEDEEVQALKLELGKARLAKEKFKSTATNIRKECTELREENAATARALQQETKRAHKEEHGRDKFRGALWGNNNELKLRREEIDQSRVHGMILKEELAACARSKRSLAQHLEATEQSMLAIIGKYKEELNQSVTHEQKL

SEQ ID NO: 177232 - protein, 65 aa, Glycine max
  Coding DNA Sequence Number=SeqID_85547
MVPHVPFDEDITKGKDHEALEGPMTRGKLKQAQHIIETRLAQVEKDEGTEAEALPRLLIVVEGPN

SEQ ID NO: 177233 - protein, 110 aa, Glycine max
  Coding DNA Sequence Number=SeqID_85548
MGEMLATQLAQASKVTSSRSNRLLEESSGGPKWAWHVTELHELPNNGCQVPQNGQMKVACHQAKWMYPPLELIHKRCTLSCSQSNPSRCTLYLYHKGCTLQCVKTKISGD

SEQ ID NO: 177234 - protein, 47 aa, Glycine max
  Coding DNA Sequence Number=SeqID_85549
MENCTKQSLRMAPNSKDFLEGGVFGEEAGCFGLFLFVHVGWDIASRE

SEQ ID NO: 177235 - protein, 159 aa, Glycine max
  Coding DNA Sequence Number=SeqID_85550
  Homolog annotation: Hit_ID=A2Q6C8; Match level="QueryCoverage=100%, HitCoverage=53%, E-value=5e-12, Identity=25%"; Hit description =Lambda integrase-like, N-terminal
MTKSMVKPRNILLTLKEHNANNCTTIKQIHNARSAYCSSIRGSDIEMQHLMKLLERDQYIHWHRLKDQDVVRDIFWCHRDAVNFHINKNVKAKCKSLIGQRNACEYVMNAWGTLVDCPSEHQFDECLKRFEMVCSPWPMFVDYVKDTWIISHKEKFVTA

SEQ ID NO: 177236 - protein, 111 aa, Glycine max
  Coding DNA Sequence Number=SeqID_85551
  Subcellular localization annotation: CTP_CleavageSite=46; ConfidenceScore=5.07e-01
MPISPCRSISWSMSSRHRDHDHKTPSGPGGAQQGPGVSSFGIMPVRHSVDPEKSNRVLGFPALITGLCQFYEVHVTPSKVIRPPTNRALIKKYCAPRKAQGETPQQPEDGR

SEQ ID NO: 177237 - protein, 157 aa, Glycine max
  Coding DNA Sequence Number=SeqID_85552
ASFFDVLVLLVFGVVLFPNVDGLVDLAAIDAFLSYHHNMEILVVVVLVDAYDTFDRRCEKSSARIVCCTPVLYVWLVSHFFGHESRPVCHLQGHHMCAEKGKANWEQLLAGMAKVPEESKDVQALKVKLERTQVVKEKFKTTAIRVRKECDELRDVN

SEQ ID NO: 177238 - protein, 95 aa, Glycine max
  Coding DNA Sequence Number=SeqID_85553
  Subcellular localization annotation: CTP_CleavageSite=41; ConfidenceScore=5.20e-01
MRGANTFLKCKYNSRIWNILHDQFPSVFPTFSTNKCWWRLRAFSSHGRCTREPRLARPQKGVEGRSPEFQEPLDLRSNPFQGGGDDAILPPKGIG

SEQ ID NO: 177239 - protein, 107 aa, Glycine max
  Coding DNA Sequence Number=SeqID_85554
MRTCFSKETKLPTDQSNICFLDEKQCVYRLDVSISFLNDHLEETLDSTKIGKNHSKCINLTQGKDYGKLGFWLKACRTAGHDICQGLASGSGIKGMSYIISMIHMQQ

SEQ ID NO: 177240 - protein, 98 aa, Glycine max
  Coding DNA Sequence Number=SeqID_85555
MSSWHRDCARKTPSGPEEGQQGLGVASSKYGSLKVIRPPYQSSFHQEVLRPQAGAGRDTTVALGWPVAGNRRTATTFRVHLCSSIKRFEYCLHHMADP

SEQ ID NO: 177241 - protein, 356 aa, Glycine max
  Coding DNA Sequence Number=SeqID_85556
  Gene Ontology: Mol. function=N-succinylarginine dihydrolase activity; Biological process=arginine catabolic process to glutamate
  Homolog annotation: Hit_ID=A7MNV7; Match level="QueryCoverage=51%, HitCoverage=46%, E-value=9e-53, Identity=57%"; Hit description=N -succinylarginine dihydrolase
  Pfam annotation: Domain name=AstB; Domain location=1-225; Score= -22.7; E_value=6e-17; Accession=PF04996.3; Description=Succinylarginin e dihydrolase
MARPGVQLFVYGRDGQQQGSAPARYPARQTREPARRGCSTNDVIAVSNQQVFFCHEEAFVDQPQLLQQLAAQVPGFPARFVVPRDRVSVADAVNTYLFNSQLLQHPDGGMRLVLPEESRQHPGVWRYLSELVESGGPIRALQVFDLRESMCNGGGPACLRLRVVLTEAERQAVNPAVLMNDRLFTRRPGRSAAAERRAKRAGRADTAARLRQCLRVSALTPGANVLPPVSERRHTIPDTAYAHAAGAGPLRRDSRQRDRPGGDPQPVADAAAAGGKTAGRAPAGGRRAGGAARAPAGAGAGELLVRVPRSRNSLASRFAHRDSRFVAYALWRDAAQQPAVASRFFTLAGSGRTGSA

SEQ ID NO: 177242 - protein, 75 aa, Glycine max
  Coding DNA Sequence Number=SeqID_85557
MYPLLVPQRMYPPVATYPSAGGRRETRGMRVPRKEYARSRHQRLFEENVGKTGKDAIYELFSERFGSCIYARGRY

SEQ ID NO: 177243 - protein, 36 aa, Glycine max
  Coding DNA Sequence Number=SeqID_85558
MEASEEDYGDGNGKNQSRQYIEGKITSMNVQPKKKI

SEQ ID NO: 177244 - protein, 76 aa, Glycine max
  Coding DNA Sequence Number=SeqID_85559
MAAEWRRKRERRCHFKEKMSLEEAHHHRRPWIRAWRKKEMNEGRGREEHEILCSKRALKSEPTNPRSSPRFSTKCA

SEQ ID NO: 177245 - protein, 45 aa, Glycine max
  Coding DNA Sequence Number=SeqID_85560
MERKVVSDGGLCGEEAMRRGGLAGVEAGMAAMEGIHGLSTKAPNC

SEQ ID NO: 177246 - protein, 54 aa, Glycine max
  Coding DNA Sequence Number=SeqID_85561
LTAEPYESAKFSSTVLRKGIDSPIPTEENRPFDRETRKLRSLDLIRPMNIGNEL

SEQ ID NO: 177247 - protein, 167 aa, Glycine max
  Coding DNA Sequence Number=SeqID_85562
  Homolog annotation: Hit_ID=Q2HW90; Match level="QueryCoverage=95%, HitCoverage=41%, E-value=2e-14, Identity=29%"; Hit description =Putative uncharacterized protein
MGTNQIGKKFYQVKIKGLDVTSLKELGQLMGQLQRQTFRKAYGKIWDLAMVEVSIEAIASLAQYYDQPLRCFTFGDFQLSPMVEEFEEILGCPLGEGDHTSSQGEWAPFIDILALLIFGGVLFPNVDGLVDLATIDAFLAYHDHKESPVVAMLADLYDTFDRRCEKS

SEQ ID NO: 177248 - protein, 76 aa, Glycine max
  Coding DNA Sequence Number=SeqID_85563
  Subcellular localization annotation: CTP_CleavageSite=35; ConfidenceScore=5.21e-01
MSWIPLFRKILLLLIKSLSTAALPTRNPHLLFETRASRAMASDGRSFFPLLGLSEDSHFQALALKLKRCGLASCTL

SEQ ID NO: 177249 - protein, 105 aa, Glycine max
  Coding DNA Sequence Number=SeqID_85564
  Subcellular localization annotation: CTP_CleavageSite=68; ConfidenceScore=5.08e-01
MTAMLISPWGSISWSVSFRHRDRAHKTPGGPGGAQQGPGVSSSNYGPLDRAHKTPSGPGEAQQGPGVSSSGYGPLSVLQGTRPPSKDCARKTPSGPEEGQQGLGV

SEQ ID NO: 177250 - protein, 189 aa, Glycine max
  Coding DNA Sequence Number=SeqID_85565
MTMIVDTLPVFYYGKWWATHLQSFADLVFASERIDLGLKKGKFSHPAWTNEKTGANEEGGDEGEARAVTAILIRPSFPPTQQCRYSANNQPSPYPPPSYPQTITPAKVHQPPFLREYDSNATCACHGEAPGHSVEHCRALKRKVQGFSTFTGSGCKPLVCLLKRPVLLSLDFQDRSIRDYSSCTLVGVP

SEQ ID NO: 177251 - protein, 107 aa, Glycine max
  Coding DNA Sequence Number=SeqID_85566
ALASIATPLGLEFIPQVKKLLDEGLVRKSLNPCALLVPKIGIINMKNTEKSDQRVPMNPKRIKVIPEWLTPPSVEGRSPEYEEPRDLRSNPFQGGGNDAILPRKGIG

SEQ ID NO: 177252 - protein, 36 aa, Glycine max
  Coding DNA Sequence Number=SeqID_85567
MWLRMPPDSWVTVTKSVVVDKSRAFAPTICVEELRP

SEQ ID NO: 177253 - protein, 127 aa, Glycine max
  Coding DNA Sequence Number=SeqID_85568
  Subcellular localization annotation: CTP_CleavageSite=41; ConfidenceScore=5.34e-01
MAESSKKRKGSSSTTATAGHRCHGPSEAPAAPIHPSLSSPRSSTLFSSNDQHLRILLPRFSNLAQASEEDLILMWAFLTGCQIDWAHLVRYRMHKALRADAPLPYPQLATLFLCHFQIPLDDEPFVQ

SEQ ID NO: 177254 - protein, 179 aa, Glycine max
  Coding DNA Sequence Number=SeqID_85569
  Homolog annotation: Hit_ID=Q4A3R5; Match level="QueryCoverage=48%, HitCoverage=82%, E-value=1e-06, Identity=38%"; Hit description =Capsule O-acetyl transferase
MGVDEDNHGAEQSGGVLALGTADVAGLAGDGVLKPNGITHCVAQISKIPQPRNDSTRDDRTAILFVSLVVDGEAIFACAVLVGVEAKLHDESTMIQSSKDQRTTQVNQRTSQVNQEQVKSSRIKKNSRLKKKVYNQESRFKIQDLKNQDQDSRLKIQESRSRFKTQDSRMKKRLNQDKY

SEQ ID NO: 177255 - protein, 69 aa, Glycine max
  Coding DNA Sequence Number=SeqID_85570
MTKLPIPIKLIEAEFGNFNSNLTPKRVLIALGGVSHKPRGDHGQPLAFRAPPHAVAPSTQCGFGVAGEY

SEQ ID NO: 177256 - protein, 143 aa, Glycine max
  Coding DNA Sequence Number=SeqID_85571
MAHQCTSEVLLTIHEQVHLGDECIQPILHPMNLLSDRKSSFPPRHVNFIGLWQMVSMGLPSLGCLFASWHSSPFAGRDQGMIVKHLTQDVNHGCWAPIFRGIVVFVIIDDNDAVKGKVFPSPMMGTKCSYHIWQEVAHGGAPL

SEQ ID NO: 177257 - protein, 68 aa, Glycine max
  Coding DNA Sequence Number=SeqID_85572
MHLVMGPQVLHGPCPWLCPHLMQSYPARALDRRLQVDWARDPREGPRVLMSLMVDFEPMAKYEPAYLL

SEQ ID NO: 177258 - protein, 157 aa, Glycine max
  Coding DNA Sequence Number=SeqID_85573
MGFPSIREKEKGLQPSLHYVHAMSISPSIDIILHIPTVKIVEAKLHDESRLIQRCFDDNKDDDKGDDKKLKGQSKNEFKMFKIESRTLQNSRGKLKNTSRFKRKVKFKNQESRFKDQASKNQGSSFQESRSRFKTQDSRIKRRLNQDKYEKFFFFKN

SEQ ID NO: 177259 - protein, 450 aa, Glycine max
  Coding DNA Sequence Number=SeqID_85574
  Homolog annotation: Hit_ID=Q2HSI4; Match level="QueryCoverage=32%, HitCoverage=72%, E-value=5e-15, Identity=34%"; Hit description =Putative uncharacterized protein
  Pfam annotation: Domain name=DUF1723; Domain location=168-216; Score =18.3; E_value=0.0036; Accession=PF08330.1; Description=Protein of unknown function (DUF1723)
MGKMRRTWNALPEQLIPEVSSKEVVLPEDEHNAVDVPQRRRPTALAHRQQVHQMTEDVPHMIEDVPHMAEDAPEMIVHVQADDGAEGSHADDAKGFPGGPRDPSMLTSFADHVAHAIWIGQERPELKLVSHGRKVILIGRPVLEIEGLVAATGLSPLIGCSVVIGVLGLIFAFVERWHRETSTFHLPVGKLTITLDATPPSAYQWRLPQLSCSFCGRGDIFVDRVRCEARRWIVAACAYLLHLGVAALVHMCDQLDEASRTTTRQIRWYLTLLHHFPSVHQCVTDDAYEETSPRAPRWLTTKAHMKGITGAPYRARCDALTGQLRWDPMVVTVRLERVLRQFGYIQSIPPPPVSADYMEWFFQISHQFMIPTQEGDQPRHAPAPDHEEYMQPAIPQAIAERLERVLNLRMVTTGTELQDIMQTCLTIARGVPVQMEVSGLDRDGAQSIDY

SEQ ID NO: 177260 - protein, 65 aa, Glycine max
  Coding DNA Sequence Number=SeqID_85575
MNRKNNKNFDNRRETPQFKRLDKPKRKIATRVKTKDQAECFDDAKGSHASQSFIQDKEIKDIQDG

SEQ ID NO: 177261 - protein, 137 aa, Glycine max
  Coding DNA Sequence Number=SeqID_85576
  Homolog annotation: Hit_ID=A2Q1D6; Match level="QueryCoverage=54%, HitCoverage=11%, E-value=4e-08, Identity=43%"; Hit description =Ovarian tumour, otubain, related
MMLGGGNIDDDKRGAALVEVKVLLVGGDCCGGWFIVGGTPDEVDPYVDITHTDQVVFGTRDDVLQWAQSVAHVNRFVAVIMSSDTNTGSKGRTSFVLIGCERSGQYRSRKKDFVRRDTESRKCGCPFKLRWDTSGWM

SEQ ID NO: 177262 - protein, 134 aa, Glycine max
  Coding DNA Sequence Number=SeqID_85577
MVEATRSKASVDRWEEAFARLSSSMSSKFNELLHHMTQLETAHASPSLDIQDDTVLRVSCNSRSRKTHHNIFLHGRLSISLVSMDAQEWSIIFVPHSLVQAVSFARLHEERMLDRRRSSVRTSPSSSYMRKGYH

SEQ ID NO: 177263 - protein, 568 aa, Glycine max
  Coding DNA Sequence Number=SeqID_85578
  Pfam annotation: Domain name=zf-CCHC; Domain location=171-188; Score =20.0; E_value=0.0014; Accession=PF00098.14; Description=Zinc knuckle
MKREKDAFYSSHNSCKSLSEELRDYYEGRHRSHLRPHSHRREKERNPQEANINLPYFHGKDNVEANLVWEIRVEQQLKKKSTSKSYGSHSYPKKDQGQGILGDNVEANLVWEIRVEQQLKKKSTSKSYGSHSYPKKDQGQGILGVKPKDDKGKTIEKQAPKASMQEKTSSLKCFKCLGRGHITSQCPITKTMIMRGQDIYSSQDKATTSPSSSESEEAKGEESSEEIYPQEEGQPLVVKEKCKEVSVSSQRLAKKETHFTIKTNIKENFPRRQPPHFLFCKKTLASIATPLGLEFIPQVKKLLDEGLVRKSLNTCALLVPKIGIIRHQVPKIGVMMNFLSGATLFCKITRAPNIFMVCVHRDPLGSDQGVPMNPKRIKVIPEWPTPPSVEGRRPEYEEPQDLSSFFHGLFPSGWRLLSPLLLCLPLHLHDGKPPLKDLIEAQRSSLHRSPTSKLPSNRFGKPPHIVKVFKETHTRKKDNTWVDKRSEQKPMETFERNYRNALVVGCRQLNLHQEGDFRKKLQECSSGGMQAIKPASRGKLWDDVAGGLGDVFMGLETCPPIIGLVWKQ

SEQ ID NO: 177264 - protein, 50 aa, Glycine max
  Coding DNA Sequence Number=SeqID_85579
MEAGSLSFNEVLQWQRRRGEGRHHPLGNKPRKKELHHQELPWIRSLKRML

SEQ ID NO: 177265 - protein, 41 aa, Glycine max
  Coding DNA Sequence Number=SeqID_85580
MKKECPKVACGIDHQVMMKGSSLWVMARRLQWKLLELLDYS

SEQ ID NO: 177266 - protein, 140 aa, Glycine max
  Coding DNA Sequence Number=SeqID_85581
MVIRTLCYPETIKSNGTCRGNMVIRTIFAIQRQSSSMARGDKTWSSDFLQSRGNQVQWHVETKHGHPHPFCYPETIKFDDTWRQIMVTHSFSALSTTEESGRASISRPHAKREISALSILVVFSQAQRTIGAKLKSTYSR

SEQ ID NO: 177267 - protein, 143 aa, Glycine max
  Coding DNA Sequence Number=SeqID_85582
DKASSKEVGVDRNVISEVGPRPRVWRVYTKKKTKGMKDDDVADLVGSPLGDLGALRAWELVAITSNLLPLDLEIEATLRRNRVERRRKLLQDRTVASILEEETHFYDLLSPNSPSSRESATQLPEAITMAEEYDQRITLEDYS

SEQ ID NO: 177268 - protein, 267 aa, Glycine max
  Coding DNA Sequence Number=SeqID_85583
  Gene Ontology: Mol. function=4-carboxymuconolactone decarboxylase activity; Cellular component=integral to membrane; Biological process=regulation of transcription, DNA-dependent
  Homolog annotation: Hit_ID=A6TDN9; Match level="QueryCoverage=98%, HitCoverage=100%, E-value=1e-118, Identity=68%"; Hit description =Putative carboxymuconolactone decarboxylase
  Pfam annotation: Domain name=CMD; Domain location=173-257; Score =75.3; E_value=2e-19; Accession=PF02627.11; Description =Carboxymuconolactone decarboxylase family
  Pfam annotation: Domain name=CMD; Domain location=46-130; Score=80.7; E_value=4.7e-21; Accession=PF02627.11; Description=Carboxymuconolacton e decarboxylase family
  Pfam module annotation: Pfam domain module=CMD::CMD; Domain location =173-257::46-130
MKSVIAAAAMSLVISDFATAEETKGKAMMKIEPSTISEADIRSVSPALARFGREAITEDLWTRDALSPRDRSMVTVAMLIARNQPGDLKHYIDIALDNGVTPAELSEIITHLAFYSGWSNAMSAVSVTKAVFETRGVTADVLPEASPDLLPLNQEAEKQRSETVEKNVGPISPGLVKFTTDPLFLDLWQRPALKPRDRSMITVSALIASGQSAQIGYHLNRAMDNGLSVEEAGEIVTQAAFYAGWPNAFTAAPVVGEVLNNRSSSKR

SEQ ID NO: 177269 - protein, 110 aa, Glycine max
  Coding DNA Sequence Number=SeqID_85584
MGDQNEVQEQMKVDMSALKEQMTSMMDAILGMRQLIENNAAIAAALTPMDYHLITHHQSYVMTRVISLPPSLKGSLLDSQTRSTRIVESMPRETSIPTPCSPPRGRHPTR

SEQ ID NO: 177270 - protein, 67 aa, Glycine max
  Coding DNA Sequence Number=SeqID_85585
MENKMKNKELNSIGACRPWIFFIFGVLCFLKILEAEWRRKKDDWRCHFKEKMSQEEAHHHRKPWIRA

SEQ ID NO: 177271 - protein, 74 aa, Glycine max
  Coding DNA Sequence Number=SeqID_85586
MKKKKKLKKIKKGKKRVEVRKQDVEAMPSKIILMMPKNQESSKFQESRSRFKIQESIIKNQDSRIKRRLNQDKY

SEQ ID NO: 177272 - protein, 122 aa, Glycine max
  Coding DNA Sequence Number=SeqID_85587
  Gene Ontology: Mol. function=structural molecule activity
  Homolog annotation: Hit_ID=P03764; Match level="QueryCoverage=65%, HitCoverage=10%, E-value=2e-38, Identity=96%"; Hit description=Side tail fiber protein
  Pfam annotation: Domain name=Collar; Domain location=47-94; Score =83.2; E_value=8.5e-22; Accession=PF07484.3; Description=Phage Tail Collar Domain
MRKEKIPHQAPFAIQAAQLLGRAIGAGLFAITPAGERGMCCKAIKLGAPIPWPSDIVPSGYVLMQGQAFDKSAYPKLAVAYPSGVLPDMRGWTIKGKPASGRAVLSQEQDGIKSHTHSASAS

SEQ ID NO: 177273 - protein, 246 aa, Glycine max
  Coding DNA Sequence Number=SeqID_85588
MALSSQNGAQAFGAGVRFGEGQQIGRVQRRAGGAVRFAEQVILVDAQRVIRQKMDLRHADLVGGEVDNRADRVAIGVEIGDQRHAHGHWHAVRRQPAEIVHHPTGGAAGPGVETRFIGVFEIGQQQIQPGQRRGDVTPRNVQTGFDGGVDAGFAAAPQQLRRDLRLHKGFAAGQCYTAAAAQVERLIPHHLGHDIVGVDGAAAQAECAGRAGGGQRRIVVCADDIAPHRQCSLVTPQALWAALGAQ

SEQ ID NO: 177274 - protein, 67 aa, Glycine max
  Coding DNA Sequence Number=SeqID_85589
  Subcellular localization annotation: CTP_CleavageSite=38; ConfidenceScore=5.05e-01
MPDETHIVFKPSDTRIHRIKALTKNARRSRSSLRTSVKSEEEASCCGGRDSVHSSKMGGGRSCLRTH

SEQ ID NO: 177275 - protein, 46 aa, Glycine max
  Coding DNA Sequence Number=SeqID_85590
MGCLRRKQLGGKLLHVVENENPSRCASVSDFVEILHRSLSFFSLQP

SEQ ID NO: 177276 - protein, 182 aa, Glycine max
  Coding DNA Sequence Number=SeqID_85591
  Homolog annotation: Hit_ID=A4PUT7; Match level="QueryCoverage=28%, HitCoverage=7%, E-value=2e-07, Identity=50%"; Hit description =Polynucleotidyl transferase, Ribonuclease H fold
DEVHLKDNLTYKAQPQKITDRRMKSLRGKEIALVKVQWGTDEGDSTWEFEDREKWGQDTWVRLIKEEKSITGRETRGTGTRETARKLRQDFGISKGQIFLFMWLSMSHIKRKVGLLLHSNGDIQRKFQKALLSLTLPFSSSSSTIVAQQSSNLWSPFLLQIAKGRHFRSREAHLYVWDLEIS

SEQ ID NO: 177277 - protein, 95 aa, Glycine max
  Coding DNA Sequence Number=SeqID_85592
MEKPPATRPFTVLAFCWPFAHMSSALSPDSVDNRITALSELIPLAAAERPSAARNSYDHDYEFELGTLLFLQLLGMDNNLSFVVLFLELLGKAKH

SEQ ID NO: 177278 - protein, 117 aa, Glycine max
  Coding DNA Sequence Number=SeqID_85593
  Gene Ontology: Biological process=transposition, DNA-mediated
  Homolog annotation: Hit_ID=Q1J7G7; Match level="QueryCoverage=25%, HitCoverage=42%, E-value=2e-10, Identity=100%"; Hit description =Transposase
  Subcellular localization annotation: CTP_CleavageSite=58; ConfidenceScore=5.20e-01
MVKVGTSYVPINVSFSPKVGPRASRDLPSQWLLFLSAVPPVQLLTGWCVTAKAPPDISAGKCSGHAARRVPFAIQAAQLLGRAIGAGLFAITPAGERGMCCKAIKLGNARVFPVTTL

SEQ ID NO: 177279 - protein, 126 aa, Glycine max
  Coding DNA Sequence Number=SeqID_85594
  Subcellular localization annotation: CTP_CleavageSite=48; ConfidenceScore=5.62e-01
MVKVGTSYVPINVSFSPKVGPGLPAVPPVQLLTGWCVNGKSTRRTSALASVAVTLRVTTTPAALNAPLQGASHSPFRLRNCWEGRSVRASSLLRQLAKGGCAARRLSWVTPGFSQSRRCKTTASEL

SEQ ID NO: 177280 - protein, 24 aa, Glycine max
  Coding DNA Sequence Number=SeqID_85595
MGADDNGVEDDVSLYMLPDSESDG

SEQ ID NO: 177281 - protein, 107 aa, Glycine max
  Coding DNA Sequence Number=SeqID_85596
MEDECSEATIPEPFTTEEEADDTQTTQVAAATPERSLEAILEPPTPSVDPSSPQHATNPSTPVLEIPEGQTTPVLTLDTSPPATPVLHLTDEEDVQTQDTQDQSHEF

SEQ ID NO: 177282 - protein, 160 aa, Glycine max
  Coding DNA Sequence Number=SeqID_85597
MSLNRGQSITTDIYRYPIIVGSDMFNYQVVTINDNEDIDDMFNPSDLNVQPTTQIHVAQSQSNEISHDYHAKNGLPDEVVGDFSDNEDEILAVNDDNNINDNNDNDIQFLFQPATTKNVYRPYPNCVDIGDNQVIDNPNYRHFLDLPQQSKSQDGELYVG

SEQ ID NO: 177283 - protein, 61 aa, Glycine max
  Coding DNA Sequence Number=SeqID_85598
LGGVDGDPGLRGMRRRLQRARELNLKSGTWTYVMGVRRPWGRQVGCYCPKPSLANPDPTRA

SEQ ID NO: 177284 - protein, 47 aa, Glycine max
  Coding DNA Sequence Number=SeqID_85599
MKNDFVGYRRLLYEDTGSLRSRLLYGNCCGDGSCSCGHDYCGDGGCG

SEQ ID NO: 177285 - protein, 53 aa, Glycine max
  Coding DNA Sequence Number=SeqID_85600
MGKDSWSLDRNHFLKELAKWSDGISTCLVADRFEELKQSLLVEGLSMVTMDKY

SEQ ID NO: 177286 - protein, 99 aa, Glycine max
  Coding DNA Sequence Number=SeqID_85601
  Subcellular localization annotation: CTP_CleavageSite=79; ConfidenceScore=5.16e-01
TYQGNPCGVYPDLSSLTGSGVYPDLSSFTGSGVYPDLSSFTGSGVYPDLSSFTGSGVIQKLYSLYQVIRPVRFTSSGIRASALDTVGLKQTTVAKVMSI

SEQ ID NO: 177287 - protein, 56 aa, Glycine max
  Coding DNA Sequence Number=SeqID_85602
MKVDQENCIKPKLFHGNLASTKPWNGGREEAERPRGAAAAAAHNAMEEEVQPHSSP

SEQ ID NO: 177288 - protein, 50 aa, Glycine max
  Coding DNA Sequence Number=SeqID_85603
  Subcellular localization annotation: CTP_CleavageSite=35; ConfidenceScore=5.21e-01
MLGAPVIMLGAPNNTLVMFSPNRCKRNFRNSEFQRCAGRGGFRGCGLSIP

SEQ ID NO: 177289 - protein, 495 aa, Glycine max
  Coding DNA Sequence Number=SeqID_85604
  Gene Ontology: Mol. function=protein disulfide isomerase activity; Cellular component=endoplasmic reticulum lumen; Biological process =cell redox homeostasis
  Homolog annotation: Hit_ID=P29828; Match level="QueryCoverage=92%, HitCoverage=89%, E-value=0.0, Identity=77%"; Hit description=Protein disulfide-isomerase precursor
  Pfam annotation: Domain name=ERp29_N; Domain location=34-143; Score= -46.4; E_value=0.096; Accession=PF07912.4; Description=ERp29, N -terminal domain
  Pfam annotation: Domain name=Redoxin; Domain location=27-187; Score= -18.3; E_value=0.1; Accession=PF08534.1; Description=Redoxin
  Pfam annotation: Domain name=Thioredoxin; Domain location=32-140; Score=171.9; E_value=1.7e-48; Accession=PF00085.11; Description =Thioredoxin
  Pfam annotation: Domain name=Thioredoxin; Domain location=376-481; Score=144.0; E_value=4.3e-40; Accession=PF00085.11; Description =Thioredoxin
  Pfam module annotation: Pfam domain module=ERp29_N::Redoxin::Thioredox in::Thioredoxin; Domain location=34-143::27-187::32-140::376-481
  Subcellular localization annotation: CTP_CleavageSite=27; ConfidenceScore=5.01e-01
MAHHNNIRVSICFLFASSLLSLFAQISSGKEFVLTLNRSNFSDIVTKHNFVVVEFYAPWCGHCMKLAPEYEKAASILSSNDPPVILAKVDANEEKNRELASQFQVQGFPTIKILRNGGKVVQDYKGPREADGIVDYLKKQSGPATTEIKSADDASALIDKNKVVIVGVFPKFSGEEYENFNALADKLRSEYDFSHTLNAKHLPRGESSVTGPVVRLFKPFDELFVDFYDFNMEALSKFVEESSVPIVTVFNNDPSNHPFVVKFFDNPNVKAMMFFNFTVDNADSLKSKFRESAEQYRQQGISFLVGDLEASQGAFQYFGLKENQVPLIVIQHNDGKKFLKTNVEPDHIATWLKAYKDGSVEPFKKSEPIPEVNNESVKVVVADNLQDIVFNSGKNVLLEIYAPWCSHCKKLAPILEEVAVSYQSNPDVIIAKLDATANDIPRDTFDVQGYPTVYFRSASGQISQYDGSRKKEDIIDFIEKNRDKVDQQESVKDEL

SEQ ID NO: 177290 - protein, 201 aa, Glycine max
  Coding DNA Sequence Number=SeqID_85605
  Subcellular localization annotation: CTP_CleavageSite=65; ConfidenceScore=5.02e-01
MERVFDVLRNHRNLGNKDDGGRKKSGLNVATTVLSTSFNVHVTSRMSKTVSNYRDRDMDDIVDLCAKDRATSHGAETTMDDDEVMSRETNKVEFMGLGASATIDLEENTKGKRQGSTSFDTQSHKRRMGEKEGITASLDKMTNSFDRMIEKMDGKVDDEDIQEVLRETALIPDLNRQQWDKAIKWSGDNPKQLAIVKALPI

SEQ ID NO: 177291 - protein, 403 aa, Glycine max
  Coding DNA Sequence Number=SeqID_85606
  Gene Ontology: Mol. function=oxidoreductase activity, acting on other nitrogenous compounds as donors, with NAD or NADP as acceptor; Cellular component=integral to membrane; Biological process=nitrate assimilation
  Homolog annotation: Hit_ID=P39866; Match level="QueryCoverage=96%, HitCoverage=46%, E-value=1e-146, Identity=64%"; Hit description =Nitrate reductase [NADH] 2
  Pfam annotation: Domain name=Cyt-b5; Domain location=69-142; Score =87.6; E_value=3.8e-23; Accession=PF00173.19; Description=Cytochrome b5-like HemeSteroid binding
  Pfam annotation: Domain name=FAD_binding_6; Domain location=187-273; Score=82.9; E_value=1e-21; Accession=PF00970.15; Description =Oxidoreductase FAD-binding domain
  Pfam annotation: Domain name=NAD_binding_1; Domain location=292-394; Score=84.8; E_value=2.8e-22; Accession=PF00175.12; Description =Oxidoreductase NAD-binding domain
  Pfam module annotation: Pfam domain module=Cyt-b5::FAD_binding_6::NAD_ binding_1; Domain location=69-142::187-273::292-394
MNNCWFRVKTNVAKPHKGEIGIVFEHPTQPANQPGGWMVKEKHLEKSLEKLPTLRKSGSTQSMNTSSKMFTISEVKKHCTSDSTWIIIHGHVYDCTRFLKDHPGGVDSILINADTDCTEEFDAIHSDKAKQMLQDFRIGDLMSTCRAMATPHTHHPTTPCMTISNSPICLLLRKLITTPPPPREKISCKLVSKTSISHDDQLLGLPVGKHIFLCTTINDKLCMRAYTPTSSVDEVGFSELVIKVYFKACTPSSQTEDSCLNIWTPSPLGHIEYTARGNFLVHRKQRFAKRLAMLANGTGITPIYQVAQTILKDPEDRTKMHEVYANKTEDDILLKDEMDVWEKTHCDRFKVWYVVGTAREGWGYSVGFITESITREHLPETSRDALAFFDLWTTTYDSIRSAT

SEQ ID NO: 177292 - protein, 95 aa, Glycine max
  Coding DNA Sequence Number=SeqID_85607
MDEDQWTYDYTMSQEVHMDYDNEEECGVNEPHVDCSNAFNTCQWARTVAHENGFVAVIMRSDTDTSSRGRSSFVLIGCERSGFVGNQCMEGKVGW

SEQ ID NO: 177293 - protein, 39 aa, Glycine max
  Coding DNA Sequence Number=SeqID_85608
MVPNCSSPCGGPTTSKGGSWWSPVVSGGGGGGWGCWGRV

SEQ ID NO: 177294 - protein, 125 aa, Glycine max
  Coding DNA Sequence Number=SeqID_85609
  Gene Ontology: Mol. function=aspartic-type endopeptidase activity; Biological process=DNA integration
  Homolog annotation: Hit_ID=A5B7I7; Match level="QueryCoverage=47%, HitCoverage=6%, E-value=9e-19, Identity=72%"; Hit description =Putative uncharacterized protein
MKEKTQILKNLCFMSQYLCGYLQEKGESAILDDYVVFLQEHEKNNGMMEDDPVNFHQAMQDSNSEKWIEAMNEEYKSMQDNKFGNLSNYQRPSKIPKVMWRGIRLVLWQRAIPKRKGLTLKRLSL

SEQ ID NO: 177295 - protein, 140 aa, Glycine max
  Coding DNA Sequence Number=SeqID_85610
MSHFNFYHYKKNDLYLRTKTVIINKKSVELKGDKAAKSGEIEVESGDEHNHTENHKPCNMSKESGNSILIPHKGQGIAEKLTLGLTFRLWCLMGLLVPRVVSKSWTFNVLRKHNSKPLKLVHLEDFIYNLSYDIHTYVSI

SEQ ID NO: 177296 - protein, 342 aa, Glycine max
  Coding DNA Sequence Number=SeqID_85611
  Gene Ontology: Mol. function=nucleic acid binding; Cellular component= nucleus; Biological process=multicellular organismal development
  Homolog annotation: Hit_ID=Q1PFN7; Match level="QueryCoverage=38%, HitCoverage=62%, E-value=3e-22, Identity=45%"; Hit description=RNA -binding protein
  Pfam annotation: Domain name=RRM_2; Domain location=195-308; Score =63.4; E_value=7.6e-16; Accession=PF04059.3; Description=RNA recognition motif 2
MAPRLDPPPWQAPFHAPELAPWLTVPSLVTTARMGLLTSLHAKCANVGHAKDHDDLLDYDLGQLPKQPKHLPESLPCKSRLPKAHGKRCFGFRRNLRGGKYPLNPNAQSYYSTPNNQVFYDPRFIHHYVPPSNLGVYPPSPFPFPCDQNVKTVQVWARVRGRKLLAENNARAKPLGNRAVPFPNTVQEAKTSSITTVMIRNIPNQFKFEDLQLILDEHCFKQNKSAEDPKAWSKFDFVYLPMDYGKHAIEKKKSNLGYAFVNFTTPAAAFKFYSEFQGFEWDVAKNKKICEINVAQYQGGALQNRQLGLQAQWVEDGGSIPMTSMEDERRERDESDDNGWVR

SEQ ID NO: 177297 - protein, 109 aa, Glycine max
  Coding DNA Sequence Number=SeqID_85612
MEHQIFAQPYLQNTAVLRQLQKGVLTGFDGAATRDAGRGHGGAGKRHSVFKCTVLTYLCATNKDGHPRPTSLNVSRAMHMAHKMLSYLRNCHRYSYYDVFDGNDVERAL

SEQ ID NO: 177298 - protein, 34 aa, Glycine max
  Coding DNA Sequence Number=SeqID_85613
MQHKSTIGDARERTRAELDYSGDATLALTVVIKH

SEQ ID NO: 177299 - protein, 93 aa, Glycine max
  Coding DNA Sequence Number=SeqID_85614
MVIFHPGDAAEDKGEELGEDASMEDKKLGEDASMEEKKEGEKERGGSTKLKEEKKGEKLNFKLCLTRLSFIKVTTSVTHASIYRLGSFLEKLS

SEQ ID NO: 177300 - protein, 84 aa, Glycine max
  Coding DNA Sequence Number=SeqID_85615
MEVGKNGGEVKGGCPWIKFTDLNFISNTTRGKFDGFKDADTNVSPALSRRDMATQMNLEGSSCSSPSLRPSLWCCCSMLLLANA

SEQ ID NO: 177301 - protein, 522 aa, Glycine max
  Coding DNA Sequence Number=SeqID_85616
  Gene Ontology: Mol. function=ceramidase activity; Cellular component =extracellular region; Biological process=sphingolipid metabolic process
  Homolog annotation: Hit_ID=A7NVS3; Match level="QueryCoverage=98%, HitCoverage=63%, E-value=0.0, Identity=65%"; Hit description =Chromosome chr18 scaffold_1, whole genome shotgun sequence
  Pfam annotation: Domain name=Ceramidase_alk; Domain location=26-522; Score=573.5; E_value=2.2e-169; Accession=PF04734.4; Description =Neutralalkaline non-lysosomal ceramidase
MAQNYVIVALGLVVYAWTWMQGAHGEYLIGVGSYDMTGPAADVNMMGYANPLQNTAGIHFRLRARTFIVAESLQGPRFVFVNLDAGMASQLLTIKVLERLNSRFGNLYTEENVAISGTHTHAGPGGYLQYVVYSVTSLGFVKQSFDAIANAIEQSIIQAHNNLKPGSIFMNTGDVKDAGINRSPSAYLQNPADERARYPTNVDTQMTLMRFVDGASGKNIGAFSWFPTHGTSMSNQNKLISGDNKGVAARLFEDWFASQNNSTNTNSTVPEVDIDFSIIIIMDNADIGQLMKKAQSIKATRGKDCKKLASQASKVRKNDGSLFVGAFCQSNVGDVSPNVLGAFCIDSGKPCDFNRSSCHGNDQLCVGRGPGYPDEILSTKIIGERQFKTAVKLFESTSEELSGKIDYRHVYLNFTDIEVELDSNKVVKTCPAALGPGFAAGTTDGPGLFGFQQGDTKINPFWKNVRDFLTKPSQYQVDCQNPKPVLLSTGEMFYPYPWAPAILPIQILRLGKLIILSVPGGL

SEQ ID NO: 177302 - protein, 153 aa, Glycine max
  Coding DNA Sequence Number=SeqID_85617
  Pfam annotation: Domain name=Transposase_23; Domain location=45-112; Score=-14.2; E_value=0.042; Accession=PF03017.5; Description =TNP1ENSPM transposase
MQSQFQSQMQSQGLVLPPEPKVGPSATCVSTKESCVDPSGNDPDTSDSDKCGLYIEEYPPRLVALGRVYERSTTVHNIPLLHDQVKVGVKEVKDADALIPVPTKEVKGDVGPAKPPDRPDHEVDDPLSNDIDHSIAFSEAIIGYVGCYLVWPV

SEQ ID NO: 177303 - protein, 975 aa, Glycine max
  Coding DNA Sequence Number=SeqID_85618
  Gene Ontology: Mol. function=transmembrane receptor activity; Cellular component=intrinsic to membrane; Biological process=innate immune response
  Homolog annotation: Hit_ID=A2Q1X9; Match level="QueryCoverage=93%, HitCoverage=79%, E-value=0.0, Identity=47%"; Hit description=TIR
  Pfam annotation: Domain name=LRR_1; Domain location=613-634; Score =2.2; E_value=1.2e+02; Accession=PF00560.24; Description=Leucine Rich Repeat
  Pfam annotation: Domain name=LRR_1; Domain location=636-657; Score =6.4; E_value=20; Accession=PF00560.24; Description=Leucine Rich Repeat
  Pfam annotation: Domain name=LRR_1; Domain location=659-681; Score =3.7; E_value=64; Accession=PF00560.24; Description=Leucine Rich Repeat
  Pfam annotation: Domain name=LRR_1; Domain location=701-723; Score =4.0; E_value=55; Accession=PF00560.24; Description=Leucine Rich Repeat
  Pfam annotation: Domain name=LRR_1; Domain location=724-746; Score =9.7; E_value=4.8; Accession=PF00560.24; Description=Leucine Rich Repeat
  Pfam annotation: Domain name=LRR_1; Domain location=772-793; Score =3.2; E_value=77; Accession=PF00560.24; Description=Leucine Rich Repeat
  Pfam annotation: Domain name=LRR_3; Domain location=613-632; Score =36.0; E_value=1.4e-07; Accession=PF07725.3; Description=Leucine Rich Repeat
  Pfam annotation: Domain name=NACHT; Domain location=217-369; Score= -20.2; E_value=0.0022; Accession=PF05729.3; Description=NACHT domain
  Pfam annotation: Domain name=NB-ARC; Domain location=183-471; Score =129.3; E_value=1.1e-35; Accession=PF00931.13; Description=NB-ARC domain
  Pfam annotation: Domain name=TIR; Domain location=27-154; Score =176.2; E_value=8.7e-50; Accession=PF01582.11; Description=TIR domain
  Pfam module annotation: Pfam domain module=LRR_1::LRR_1::LRR_1::LRR _1::LRR_1::LRR_1::LRR_3::NACHT::NB-ARC::TIR; Domain location=613 -634::636-657::659-681::701-723::724-746::772-793::613-632::217 -369::183-471::27-154
MDEQNMIRAVASSSNSSSMVSSKKYDVFLSFRGEDTRKNFTSHLYEALKQKKIETYIDYRLEKGDEISAALIKAIEDSHVSVVIFSENYASSKWCLGELGKIMECKKERGQIVIPVFYNIDPSHVRKQTGSYEQSFAKHTGEPRCSKWKAALTEAANLAAWDSQIYRTESEFLKDIVKDVLRKLAPRYPNHRKELVGVEENYEKIESLLKIGSSKVRILGIWGMGGIGKTTLASALYDKLSPEFEGCCFLANVREESDKHGFKALRNKLFSELLENENLCFDASSFLVSHFVLSRLGRKKVFIVLDDVDTSEQLENLIEDFDFLGLGSRVIVTTRNKQIFSQVDKIYKVKELSIHHSLKLFCLSVFREKQPKHGYEDLSRSAISYCKGIPLALKVLGASLRSRSKQAWECELRKLQKFPNMEIHNVLKLSYDGLDYSQKEIFLDIACFLRGKQRDHVTSILEAFDFPAASGIEVLLDKALITISGGIQIEMHDLIQEMGWKIVHQEHIKDPGRRSRLWKHEEVHDVLKYNKGTEVVEGVILDLSKLTEDLYLSFDFLAKMTNVRFLKIHSWSKFTIFNVYLPNGLDSLSYKLRYLHWDGFCLESLPSRFCAEQLVELCMHCSKLKKLWDGVQNLVNLKTIDLWGSRDLVEIPDLSKAEKLESVSLCYCESLCQLQVHSKSLGVLNLYGCSSLREFLVTSEELTELNLAFTAICALPSSIWQKRKLRSLYLRGCHNLNKLSDEPRFCGSYKHSITTLASNVKRLPVNIENLSMMTMIWLDDCRKLVSLPELPLFLEKLSACNCTSLDTKITQQQVLQHMLQSRIPYLRKHYLKCYDEEYFFPGDHVIDECRFHTTQNSITIPYLQKPELCGFIYCIILSMGPLLECDVSCSVYQDGIRVGWLERLLEYENLISDHVVILYHDISEFDKISEVHDHFFSNITFIFENNEDRITEFGVFPVYASESGLKLVGSKEIFE

SEQ ID NO: 177304 - protein, 72 aa, Glycine max
  Coding DNA Sequence Number=SeqID_85619
METHKLSLAHQWAKRASTAKRSFSVLSAIEESGRASISRSHAKCEISALSAAVVFSQAQRMTDAKLKSTYSC

SEQ ID NO: 177305 - protein, 65 aa, Glycine max
  Coding DNA Sequence Number=SeqID_85620
MGPKSTLRLMRTLRPSLAYLAQSTWSLLSDALAGNFLLLSALFLLNVASIFKSRGTRLPMGDLCI

SEQ ID NO: 177306 - protein, 135 aa, Glycine max
  Coding DNA Sequence Number=SeqID_85621
  Homolog annotation: Hit_ID=A5AK77; Match level="QueryCoverage=46%, HitCoverage=7%, E-value=2e-07, Identity=42%"; Hit description =Putative uncharacterized protein
MARGNPGDLQTFGPEIDRNFHRLVRHSVHPNHSVHSEHFVVGDSEHSNFEHSAANFHTENMAQSPPRERNLREMAGPNFTYECLCIQYPDEDVPYVLKTGLIHLLPKFHSLAGENPHKHLKEFHSVCSTMKPPDV

SEQ ID NO: 177307 - protein, 135 aa, Glycine max
  Coding DNA Sequence Number=SeqID_85622
MSNIVCKLPAIIYKLGIICKGYNSPYKQGATIRLHSHKYQVPLNPQHIPHTSAHEQQACAHLSLSLTRASFKHILALFSSLMYLLKRQSPLFCLGSSSSMDSFAPWKMNGSGMEKEEREEMPLQGEDESRRSSPP

SEQ ID NO: 177308 - protein, 69 aa, Glycine max
  Coding DNA Sequence Number=SeqID_85623
MASSSSSSSHVNIKSGPIDANNMFGMGKKIGNYISDELSPRIKGKNKFLSKFFLFFYNLVSPGLSRWGT

SEQ ID NO: 177309 - protein, 70 aa, Glycine max
  Coding DNA Sequence Number=SeqID_85624
MASTSGDATPPSPKTTRLMSEEERSNHLILLMGKMKGIKRMRGEGGMRGIGREEMIIDIEVGKERKGLRE

SEQ ID NO: 177310 - protein, 379 aa, Glycine max
  Coding DNA Sequence Number=SeqID_85625
MHKPHRTGKWTLRPPPTTEDGQVTFFFTNFLMRLTAKDMWGALGGIVISGVCLCANVSRFDAADRWQLALGRREVAGSGHGGLWRSRGVLGGGGFVATPSSLVAASVVDDSCSMLGRWLGMRGEGGCQETTTLGGVISGVGDPIGCVFGLIGDIGVTTGVGNLVSVDEYMACRGRLDIVRVLVHVKGFHNIDTHVLVDVGGEPFDIWVKQDGYTSLCPSCSNNPKGEGDGDETDDELELLSLIADDLQVDQSRVIGGREGSRARSGVPIMMKVSDYSSHAAKFVEEVHKEVVSSNPQPRRSWVVPRFSQRELRRSASVITTLRVVDHSDDAMAWRVWSMVSAWGLKAKGVDEKWIRWIEEKEAREREAMVSRERLIIPP

SEQ ID NO: 177311 - protein, 43 aa, Glycine max
  Coding DNA Sequence Number=SeqID_85626
MISCLARPHYKPIKVLSDPPNVNIKTGGVTSKKARKIEEKKKI

SEQ ID NO: 177312 - protein, 57 aa, Glycine max
  Coding DNA Sequence Number=SeqID_85627
MAIEGFTMRRGERKKGRDGLWAFVGALSATPPRSARVDRALSAHVVGLARASVGSWA

SEQ ID NO: 177313 - protein, 166 aa, Glycine max
  Coding DNA Sequence Number=SeqID_85628
  Gene Ontology: Mol. function=calcium ion binding; Cellular component =plasma membrane; Biological process=G-protein coupled receptor protein signaling pathway
  Homolog annotation: Hit_ID=P27164; Match level="QueryCoverage=73%, HitCoverage=80%, E-value=1e-62, Identity=78%"; Hit description =Calmodulin-related protein
  Pfam annotation: Domain name=efhand; Domain location=102-130; Score =42.1; E_value=2e-09; Accession=PF00036.23; Description=EF hand
  Pfam annotation: Domain name=efhand; Domain location=138-166; Score =43.2; E_value=9.3e-10; Accession=PF00036.23; Description=EF hand
  Pfam annotation: Domain name=efhand; Domain location=65-93; Score =39.0; E_value=1.8e-08; Accession=PF00036.23; Description=EF hand
  Pfam annotation: Domain name=efhand_Ca_insen; Domain location=96-165; Score=1.2; E_value=0.074; Accession=PF08726.1; Description=Ca2+ insensitive EF hand
  Pfam module annotation: Pfam domain module=efhand::efhand::efhand::efh and_Ca_insen; Domain location=102-130::138-166::65-93::96-165
MWIVGLVGNALLACFGLRIVLWVVIWKVECGSGSGSERGRGRGCITTKELGTVMRSLGQNPTEAELQDMINEVDADGNGTIDFPEFLNLMARKMKDTDSEEELKEAFRVFDKDQNGFISAAELRHVMTNLGEKLTDEEVDEMIREADVDGDGQINYEEFVKVMMAK

SEQ ID NO: 177314 - protein, 112 aa, Glycine max
  Coding DNA Sequence Number=SeqID_85629
MDFDSKVFLLLPLPNNLNPDSEAYTGKTAHPFIPVREVCPREVQFATLTFSKDGGSFDIDTSFLQSSNKSCLNLESNDFQDYFDDAKESRVKQVPKNQESKSFKNQVSKNQD

SEQ ID NO: 177315 - protein, 106 aa, Glycine max
  Coding DNA Sequence Number=SeqID_85630
  Gene Ontology: Cellular component=chloroplast envelope
  Homolog annotation: Hit_ID=A7QYR9; Match level="QueryCoverage=85%, HitCoverage=36%, E-value=5e-31, Identity=78%"; Hit description =Chromosome chr5 scaffold_253, whole genome shotgun sequence
MAEDVQPLLTEVRDSGLLKEVETLTQSLTQATEDLRRVHSSIMTPENTELLQKSIYTLIFTLKNIEVGPYFLNGLQNVSSDILGFTGDEATRKSLKLLIKSLSRLL

SEQ ID NO: 177316 - protein, 150 aa, Glycine max
  Coding DNA Sequence Number=SeqID_85631
  Gene Ontology: Mol. function=nucleic acid binding
  Homolog annotation: Hit_ID=A5BP71; Match level="QueryCoverage=31%, HitCoverage=12%, E-value=2e-11, Identity=61%"; Hit description =Putative uncharacterized protein
  Pfam annotation: Domain name=zf-CCHC; Domain location=126-143; Score =13.5; E_value=0.014; Accession=PF00098.14; Description=Zinc knuckle
MAYDRRGRRYSHMTTNLSECVNKVFRGCRNTPITALVMKEIQKNQEKACSHIVRIYDIQEQCLKLRRLMILCLNEVDKSGNEDAILPSDESWTLVPDPSFIRMKGRPRSTRLRNEMDWREPSQTRQKCGRCGVQGHNRRNCPLQSNQGSC

SEQ ID NO: 177317 - protein, 216 aa, Glycine max
  Coding DNA Sequence Number=SeqID_85632
  Homolog annotation: Hit_ID=A7PQZ6; Match level="QueryCoverage=51%, HitCoverage=24%, E-value=6e-08, Identity=30%"; Hit description =Chromosome chr6 scaffold_25, whole genome shotgun sequence
  Subcellular localization annotation: CTP_CleavageSite=46; ConfidenceScore=5.28e-01
MVRGDFDSLHDSNFQDKKSRQDINQRRNFQSFTNPLPHKNSSLVLNADSTREASAYNNTKNRRKGTKHGFDGMRYDSASNPSDHYEKNNLVVKQTNSLLHGYENNSLKNVQRVPRTCHCGDANIPKLCRARQFQLHQVLVPCAEAQLLGSREPPRPRNPSVGLEAFVGAVIGNSDQWGELREGIFGVWREEEKRRMDFAGESDIRAMRRLIEIEAE

SEQ ID NO: 177318 - protein, 123 aa, Glycine max
  Coding DNA Sequence Number=SeqID_85633
MYCRRLDKLIPDVVCWIPYGDHRSFREFETILPHPTAPSSSIEEMDARWMQFDMPQQLVAAMTPDEIDVDVHRPQHAVDGYVAIVDKLERLLNLRILTEGTEAYIVAEECLSIARSYIGQPTV

SEQ ID NO: 177319 - protein, 134 aa, Glycine max
  Coding DNA Sequence Number=SeqID_85634
MAKLVCHLFADGLGLQLSHHYLIRLLLCGSSSSLLPHLRGSWFMLVLLLRWFIFSQIIVRARGFRQTLGRAIGKALGKREASDDDNDVSSSEGLPHLPIEQQQPPVEEGVTDVEDFPGGPHDTSVLRDFENQLL

SEQ ID NO: 177320 - protein, 107 aa, Glycine max
  Coding DNA Sequence Number=SeqID_85635
  Gene Ontology: Mol. function=helicase activity; Biological process =viral genome replication
  Homolog annotation: Hit_ID=Q9LW42; Match level="QueryCoverage=98%, HitCoverage=6%, E-value=1e-21, Identity=51%"; Hit description =Helicase-like protein
MARDRLINSQVDNVRLKLIEAREKDGRIYNLPNVSEVAALIVGDFDGNSSRDIIVETQNGELQRIHKLHSSYLGLQYPLLFPYGEDGYRPDILHSSTSASKKGREIV

SEQ ID NO: 177321 - protein, 223 aa, Glycine max
  Coding DNA Sequence Number=SeqID_85636
  Homolog annotation: Hit_ID=A5BQD9; Match level="QueryCoverage=47%, HitCoverage=5%, E-value=5e-09, Identity=33%"; Hit description =Putative uncharacterized protein
MDVLFLAQYRYLGIKWLDGEVISRNLYRGFKVGTKEVEVNLLQYADDTIFVGKFNVDNVVILKSMMKCFELVSGLKVNFHNTGLEQGGEIFSTIEEKFGRVLDSTYLGWQGMCDGGSTPNESIWWRVIKKKHLLEEFLALIDNVNIEDIGGDHWVWTVDPSNIFTIKSTYLALHNLKVTYKGVFNSWNMALLVVCAINMKRIFHMFSSHAKWYKLFGGDGMDH

SEQ ID NO: 177322 - protein, 474 aa, Glycine max
  Coding DNA Sequence Number=SeqID_85637
  Gene Ontology: Mol. function=nucleotide binding; Cellular component =Golgi apparatus; Biological process=regulation of transcription, DNA- dependent
  Homolog annotation: Hit_ID=A7NV80; Match level="QueryCoverage=86%, HitCoverage=66%, E-value=1e-174, Identity=73%"; Hit description =Chromosome chr18 scaffold_1, whole genome shotgun sequence
  Pfam annotation: Domain name=DUF246; Domain location=41-420; Score =593.4; E_value=2.1e-175; Accession=PF03138.5; Description=Plant protein family
MSRINLSLKDDNLTMSGTKLFPKEDIGKKRKMSPGLNGFLIVEANGGLNQQRSAICNAVAVAGLLNAILVIPQFEFHNVWKDPSEFGDIYDEDHFISALDGYVKVVKELPEALMERHNYNMTNITNIRVQAWAPVSYYLGVVSPILQKEGVIRIAPFANRLAMSVPPHIQFLRCLTNYKALRFSSSISALGKKLVYQMIEKSSRTDGKYIAVHLRFEEDMVAFSCCVYDGGKAEKLEMDSVREKGWRGKFKRKDRIILPDLNRVDGKCPLTPLEVGMMLRGMGFDNNTSIYLASGKIYHAERYLAPLIKMFPNLYTKESLATSDELAPFMSCNKNHDKVYAPTSRMHVMIKDGYSSQLAALDYTVCLSSEVFVTTQGGNFPHFLMGHRRFLYDGHAKTIIPDKRKLVVLLDDVSISWRAFKDQMEDMLGESDRKGIMPKVLYRSNYLELNVGDGTLITARKIWVHCTNLGSYFQ

SEQ ID NO: 177323 - protein, 551 aa, Glycine max
  Coding DNA Sequence Number=SeqID_85638
  Gene Ontology: Mol. function=protein binding; Cellular component =cytoplasm; Biological process=steroid metabolic process
  Homolog annotation: Hit_ID=A9ZM29; Match level="QueryCoverage=98%, HitCoverage=64%, E-value=0.0, Identity=75%"; Hit description =Oxysterol-binding protein
  Pfam annotation: Domain name=Oxysterol_BP; Domain location=99-496; Score=236.1; E_value=7.7e-68; Accession=PF01237.9; Description =Oxysterol-binding protein
MSIFLGKTEKVDLENTVVDESQRQLNDQEASSRLRQEKSSEASASESEDDNERNDAAEEETDEDDSAFFDTRDFLSSSNSFKSNGSDIRASSFSSDDGLYTVESEEDVDPSIKSVGGNYPSVKRRRKLPDPVEKEKGVSLWSMIKDNIGKDLTKVCLPVYFNEPLSSLQKCCEEMEYSYLIDRAYEWGRRGNSLMRILNVAAFAISAYASTEGRICKPFNPLLGETYEADFPDKGIRFFSEKVSHHPMIVACHCEGTGWKFWGDSNLKSKFWGRSIQLDPVGILTLEFDDGEVFQWRKVTTSIYNLILGKLYCDHYGTMRIQGNQDYSCNLKFKEQSIIDRNPHQVHGIVQDKNGKILSTLLGKWDDSMYYINGDYSGKGKGYESMSDAHLLWKRSKPPKFPTRYNFTRFAITLNELTPGLKEKLPPTDSRLRPDQRHLENGEYDMANSEKLRLEQRQRQLIVDSSLRRKKGLERCYLAQGYQHPNSLSMERLARKMQESGWEPRWFGRDKESGTYRYLGGYWEARKQGNWNSCPDIFGHIPSDHVSDEGQ

SEQ ID NO: 177324 - protein, 412 aa, Glycine max
  Coding DNA Sequence Number=SeqID_85639
MVLVKGSSSRESIGGEFNIHGYNNVVYEVSFDFHSLRSDFSSLIDFSAFKGSSNLLANMAKKVPNAKGEASASTNHAYGHDNGSETCPVTLHMVRLDATPPTEFVFMNREGMNKDFFYMYNFLFCDLRVKVLFDDFIMSMFWILDIASMQLHPNRWAAIQSLNPIWDLEGIMTQADDNMNVFRQAWLNQIVAAGEPSLNPATNQTSGPCDEHWSGSGEHSGHQEDTSWEKRLKQPIIGFQPDVATSLGNISAPNESRLLQPFLLAGPPYPDGNCFEARGSSKADALKDQFLKVEDSLNSALQANMKLVEDNKNLKDQETKEVNAEKEQIQQKAFDNVYNTHKADFDHCHRQMLHMCDVSEPGVFDIKKDAYEGGLVLIDEIMKEDVAPSHPRIMTLAKEPQVKGAEDRADKA

SEQ ID NO: 177325 - protein, 119 aa, Glycine max
  Coding DNA Sequence Number=SeqID_85640
MSLLFPLPIDGVDLTENLKGVETAEAATAACDEGAAERAASSVGCGSGSCLHMVKEKGRGRKKRQSGLVRVTKGIRKGLLEKSGIDACRAIHGIYAKCHFFTLMHLLSGFIFNIYQFKN

SEQ ID NO: 177326 - protein, 94 aa, Glycine max
  Coding DNA Sequence Number=SeqID_85641
MAVETGTGVPLLMCKEDDALDPVGYKHEEREWRVELVVLILFRLHKNGLGRCMYEKAEPPPRVARLPGTAGGTAAVPRRHGGGGARLLPQPHLS

SEQ ID NO: 177327 - protein, 112 aa, Glycine max
  Coding DNA Sequence Number=SeqID_85642
MKSDKVDNNNKNRDCIYPSCPYYKKSDNSRLVKRSLYRQSNMSNETTKCSEMLGSNSKAQSQDILPNAFPYCENFEVKCFVRSIDREPMIKHFYVRRKGDESQVGRNQTDLL

SEQ ID NO: 177328 - protein, 528 aa, Glycine max
  Coding DNA Sequence Number=SeqID_85643
  Gene Ontology: Mol. function=ribonuclease activity; Cellular component=exosome (RNase complex); Biological process=rRNA processing
  Homolog annotation: Hit_ID=Q0WPN0; Match level="QueryCoverage=92%, HitCoverage=42%, E-value=8e-99, Identity=42%"; Hit description =Putative 3'-5' exoribonuclease
  Subcellular localization annotation: CTP_CleavageSite=41; ConfidenceScore=5.13e-01
MYHGASEVNEAQGLSPDSGKIGTPTHASPSLGNSLNQVNVCSSNEQGLSKASNVAFISIPPMHINEQVEPGDLRILPMCGGGIDSNSFSEPTGCRGSSGINKNKDSVPCGQIGLCGQEKYFSPHWSVEAVEKELEEGDVFKALFHVNAHNRLEAYCKIDGMPTDVFIGGIPAQNRAVEGDVVAVKFDPLPLWTKMKGPNGSCNNTATPEGCNLTEDKEVGGNICKGKAKVDAEYESAHGRSYPGQNKEDADQNSLYKSYPFTETTMVYDDITSRGSTNHLDLHGMANHDSINGHHCAAPNSLKINSCSGQSNAVEKMCLLVNSFPSKRPTGRVVAIIERSPRREGIVGHINVKQWVSFRDTSKKDVKKNKNLISEHEYIQLIPTDPKFPNMMLLVRKLPKCIKKRMKSGDVTIQMDLVAVQIDDWVEESPFPEAHILRVFGQGGEVQTQLDAILFQNAICLSEFSPEALSCLPCVPWEIPLKEIQSRIDLRNLCIFTIDPSTATDLDDALSIEKLPNGNYRVGVHIAD

SEQ ID NO: 177329 - protein, 94 aa, Glycine max
  Coding DNA Sequence Number=SeqID_85644
  Homolog annotation: Hit_ID=A5BZQ3; Match level="QueryCoverage=73%, HitCoverage=75%, E-value=5e-30, Identity=94%"; Hit description =Putative uncharacterized protein
MGVLAAAHNPRFMPPICALGTWVFSVAGALLAIPVGIKRKSLAPLVFFGTTGTMLDIIMGISACEREHAERQMKLLEAQNAAAETPLGETEIDS

SEQ ID NO: 177330 - protein, 368 aa, Glycine max
  Coding DNA Sequence Number=SeqID_85645
  Gene Ontology: Mol. function=heat shock protein binding; Cellular component=integral to membrane
  Homolog annotation: Hit_ID=A7QY81; Match level="QueryCoverage=40%, HitCoverage=29%, E-value=6e-44, Identity=57%"; Hit description =Chromosome chr2 scaffold_241, whole genome shotgun sequence
  Pfam annotation: Domain name=DnaJ; Domain location=134-198; Score =10.1; E_value=0.00043; Accession=PF00226.22; Description=DnaJ domain
MALYFSEWLCVGLDVDALDSVNKEEGIVVESSDNEDLTVEVDVVRQWGTFLLFLPFGGAFVAHACDIIGDAKGRNDNSWMAIGFAFDVRHTGIPDYDGTVHVVEGGYLGIGIGGYEVAETVVVGSRGGDVCSGGWYLGFGLGRRMFKKKTMSKTKKKMKMKQKRKRKRRMKDIATQNFQQICKAYEILSDPNKRRIYDIYDMEGLTSNLELGPNLNGAEKIKAKLERLKRMKEREKVAAHFLPFGTILANMSLPHYVDGNGLLIGYCSRNAVTIGGNLAVNGEEGGGAAIAMFRHELSEVSSVEVVASTGLHALIGVQTTWWEQNQQKLRKAVLDVSNEIGRYYNELELEKILGAIEEVEQAKCQSLF

SEQ ID NO: 177331 - protein, 268 aa, Glycine max
  Coding DNA Sequence Number=SeqID_85646
MVRFGEGEGTGVQCCGGRRRHTMYAMLGLRCGVPQIARIKLIRKKFMDQLDLHMDEDQWMYESIMFEEVNIDYENEEECGVNEPHVDYSDAFNTSQIIMFMIPRGCCRCIGNLLRFQCMQRKNDDDVNTMLMCNHQFSSVGLIELLCTIGRTPDDILNILEATMIPTHDALLYYNRRWNMSRQNEFVGYSFTAKDPKKFDIPFGCTMNELKDLIKQVAPYGIPPYGIYETQTVLVHSNYWKKFGSIEVLAVFSKRVIEMEDNMSLWQN

SEQ ID NO: 177332 - protein, 264 aa, Glycine max
  Coding DNA Sequence Number=SeqID_85647
  Gene Ontology: Mol. function=transcription factor activity; Cellular component=nucleus; Biological process=regulation of transcription, DNA-dependent
  Homolog annotation: Hit_ID=A9PLA6; Match level="QueryCoverage=99%, HitCoverage=99%, E-value=2e-34, Identity=40%"; Hit description=RAP2 -like protein
  Pfam annotation: Domain name=AP2; Domain location=41-92; Score=73.4; E_value=7.4e-19; Accession=PF00847.11; Description=AP2 domain
  Subcellular localization annotation: CTP_CleavageSite=76; ConfidenceScore=5.62e-01
MVKSENKIQREQPSSSKLMRPLSSSSSSSSSSSDNNNKNKKKYKGVRMRSWGSWVSEIRAPNQKTRIWLGSYSTAEAAARAYDAALLCLKGSSATNLNFPSSSSSLQHYIIPQDTSMMSPKSIQRVAAAAANNFLDNNAIAINNNVTTPPSPISPHSPPLASTPSSSSFVSSPSMSSSSPSDQIDDDVSLLTPFGAYTTAVATTTICDQENESMAMMESWYGLEGLQSPKYVDQMLSGAFFDIDSTQLLDDLYEESDIRLWSFC

SEQ ID NO: 177333 - protein, 367 aa, Glycine max
  Coding DNA Sequence Number=SeqID_85648
  Gene Ontology: Mol. function=metallopeptidase activity; Cellular component=cytoplasm; Biological process=amino acid metabolic process
  Homolog annotation: Hit_ID=A7NVA7; Match level="QueryCoverage=82%, HitCoverage=67%, E-value=1e-124, Identity=70%"; Hit description =Chromosome chr18 scaffold_1, whole genome shotgun sequence
  Pfam annotation: Domain name=M20_dimer; Domain location=216-335; Score=9.8; E_value=0.026; Accession=PF07687.5; Description=Peptidase dimerisation domain
  Pfam annotation: Domain name=Peptidase_M20; Domain location=104-365; Score=42.9; E_value=1.1e-09; Accession=PF01546.19; Description =Peptidase family M20M25M40
  Pfam annotation: Domain name=Peptidase_M28; Domain location=101-320; Score=-42.5; E_value=0.0032; Accession=PF04389.8; Description =Peptidase family M28
  Pfam module annotation: Pfam domain module=M20_dimer::Peptidase _M20::Peptidase_M28; Domain location=216-335::104-365::101-320
MATPQSHFRFLAFSLSIIHISLFLSTTATQQPLLEEQDTPITHFQRYLRINTAHPTPDYTSAVSFLKAQAQSLGLKTQTLEFVQGKPVLLLTWPGSNPSLPSLLLNSHLDSVPAEPEKWLHNPFSAHRTASGAIFARGAQDDKCIAIQYLEAIRNLKSQSFTPHRTIHISLVPDEEIGGIDGAAKFVESEEFNGLNVGFALDEGQASPGDEFRVFYSDRVPWNVKIRAKGRPGHGSRMYDGSAVENLMESVEVVSRFRESQFDVVKAGKALNGEVVSVNPVYVKAGVVSEDGFAMNVQPSEAEAGFDLRLTPTTDPEEMRRRIAEEWAPAVRNMSYEVRFLMGNVAVSFRHLSSMLSLAAFFVQVGF

SEQ ID NO: 177334 - protein, 134 aa, Glycine max
  Coding DNA Sequence Number=SeqID_85649
  Homolog annotation: Hit_ID=A2Q1D6; Match level="QueryCoverage=54%, HitCoverage=11%, E-value=6e-08, Identity=42%"; Hit description =Ovarian tumour, otubain, related
MDEDQWTYDYMMSQEVHMDYDNEEECGVNEPHVDCSNAFNTCPVIMFISLSHLVELIMRSDTDTGSRGRSSFVLIGCERSGLYKCRNKEFVRRDTGSRKCGCPFRLPGKPVHGREGWMVKLICGIHNHELAKSL

SEQ ID NO: 177335 - protein, 182 aa, Glycine max
  Coding DNA Sequence Number=SeqID_85650
MDRLFTMIVGFTSKLPLRCPFKYQIAVILIPNEVINLLERTTTPTHDALLYYNGRWNMPPQNKFVGYTFTGKNPKKFEIPSGCTLDELKDLIKQVAPKGIPPHGIHESQAVRRLLFRQLGRFEYSDKIIKYEINELKTDDEVLKVLVQSNYWKKYGPIEILAVFTKHGMEFEDDVDATSLND

SEQ ID NO: 177336 - protein, 64 aa, Glycine max
  Coding DNA Sequence Number=SeqID_85651
MERIQKSTSSDNSQGWFHGLSATMHHQKKKTLDEISLSSSESETQHDHISTSTPYGSHRPGYRA

SEQ ID NO: 177337 - protein, 224 aa, Glycine max
  Coding DNA Sequence Number=SeqID_85652
  Homolog annotation: Hit_ID=A2Q6D4; Match level="QueryCoverage=37%, HitCoverage=17%, E-value=2e-09, Identity=37%"; Hit description=RNA -directed DNA polymerase
DQRSLGSLQEAGFASWLITGHKRPTSFGFIARSAYNFLVVITGHKGPKFLGDSGNLKRVAWGLDVGTSCGRTNKEIEGNPTVGNSPSRRHIPSQSRRCRLQSTEGNSSSPKPRNYASPSQPVINSEVAGNTDCRKIIYEVWKTTIMGFPMLIQSQKLKILKRPTDDLVLQEKQAYILLQQALANQKEFWKEKARINWLLQGNRNTAFFHLAEKIKRTTNIITMW

SEQ ID NO: 177338 - protein, 188 aa, Glycine max
  Coding DNA Sequence Number=SeqID_85653
  Homolog annotation: Hit_ID=A5AKA7; Match level="QueryCoverage=61%, HitCoverage=22%, E-value=5e-07, Identity=28%"; Hit description =Putative uncharacterized protein
MVIDESLFFQLTQLSSDGVPFEGTIDEDWKFDFSNHDARRLVCTNQLDMTVRLFVGSLAFECRIMHYLIVCILLPRSSNLAQVSEEDMVVIWVLLIGRQINWAHLIRYRMQKALRSNAPLPYPHLITLFLRHFDVPLDSKTFVQVKKSFSIRAGVVTSFGYRKERDGSWVKKDVLAQAAENCSPSPLP

SEQ ID NO: 177339 - protein, 93 aa, Glycine max
  Coding DNA Sequence Number=SeqID_85654
MKVEQPFACHHTSEEGKVPLAALSFQRYALYWWTSLVREIRIQGDSPVVSYNRSVQKSCLAQEATLEGNYHDQACILRLSVWSLDPVGHMRST

SEQ ID NO: 177340 - protein, 270 aa, Glycine max
  Coding DNA Sequence Number=SeqID_85655
  Gene Ontology: Mol. function=phosphoprotein phosphatase activity
  Homolog annotation: Hit_ID=A5C0F5; Match level="QueryCoverage=65%, HitCoverage=37%, E-value=3e-16, Identity=28%"; Hit description =Putative uncharacterized protein
MAIDRTVPHHAPSPHGLLRIALMRLSVHYAAAYITDESLSVTSWLLTALFSITYQAQRITENHIKAVLDACLQGECTIRLEDVTLHLGIRVNGHVVTESSFLHWDELCDELLGKVPLNITHKGAALKLTWLLSILRAPLPEEPTIHQLQCKCRAYIMYMIDENLYRELCRASSEVGRVIGGYAILLQSWAWYHMPFIAPKVLGPETTYSLAKRWSGGRLEHRSTPHGDLVGYRSRIDHMESHQDLKSTYRDIHTETGRFVGQMASVILKG

SEQ ID NO: 177341 - protein, 45 aa, Glycine max
  Coding DNA Sequence Number=SeqID_85656
  Homolog annotation: Hit_ID=A7NVB3; Match level="QueryCoverage=97%, HitCoverage=11%, E-value=6e-08, Identity=61%"; Hit description =Chromosome chr18 scaffold_1, whole genome shotgun sequence
MSMAVKKYPAELSLSTLICMAGALQSAVVAVIADHNPRTSAIGFD

SEQ ID NO: 177342 - protein, 78 aa, Glycine max
  Coding DNA Sequence Number=SeqID_85657
  Subcellular localization annotation: CTP_CleavageSite=50; ConfidenceScore=5.10e-01
HSARLASWENLEDNLRSIYVLSMSSVCSTRRLSLPALSVPSSLSGYSLTRAKRAFEDRKPFLRMKLEKSSIRLKESMD

SEQ ID NO: 177343 - protein, 196 aa, Glycine max
  Coding DNA Sequence Number=SeqID_85658
MVTTIVMMMMSTAMVTIEISVAVVVEVTLVAMAVNDNDVGGGGGGDASGGDKGGISGGGSCSNLGGFGRGDKGGIVDSGGGSDNDNGDDSDIDGGVVLGVAPSGGGDGGCENIGGGDNDGGTNGVVVVVAMLVVTVMSITMVVVVVVLVVVVVVTTSYNGENDTDGGGGGVVVAMTKVVLVMVAPESVIVKCVKVS

SEQ ID NO: 177344 - protein, 213 aa, Glycine max
  Coding DNA Sequence Number=SeqID_85659
DNPPSTSFEGKAVQIVKLASVSIIVVVVSLKDKEPKVHIEHFFNIESLENVGYIIKAHIMLCGIHHFFEDPKVVVPKLICKFWRIANVCRNVVIGGYFASKVLGIPMKLTTESIAQAIGCFATEVMKDKSTRKDIYHSVVPTKTAQVDDSILSELHQNFGLNIGQDDQLDAVCEKDIEEEDMVDANASQVENRTKKTMGTPSTKVAHVPQCPI

SEQ ID NO: 177345 - protein, 400 aa, Glycine max
  Coding DNA Sequence Number=SeqID_85660
  Gene Ontology: Mol. function=transferase activity, transferring glycosyl groups; Cellular component=integral to membrane; Biological process=protein amino acid glycosylation
  Homolog annotation: Hit_ID=Q9ZS49; Match level="QueryCoverage=99%, HitCoverage=99%, E-value=0.0, Identity=79%"; Hit description=Avr9 elicitor response protein
  Pfam annotation: Domain name=Galactosyl_T; Domain location=145-343; Score=216.0; E_value=8.6e-62; Accession=PF01762.12; Description =Galactosyltransferase
MKIRSSKKISAKWVPVFSVFSFLIGMLITTRIWEPPESNGVFLSNHRHEQELQVVSGDCAPKKPVQDNDVMNKVYKTHGAIQGVRSLDKQVSMLQMELAAARSTREHKISDGSANTLASGVSTEGPPRKKVFVVIGINTAFSSRKRRDSVRETWMPQGEQLLQLEREKGIVIRFMIGHSATSNSILDRAIDSEEAQHKDFLRLEHVEGYHELSAKTKIFFSTAVAKWDADFYVKVDDDVHVNLGVLATTLARHRSKPRIYIGCMKSGPVLSRRDVKYHEPEFWKFGEEGNKYFRHATGQIYAISKDLATYISINQPILHKYANEDVSLGAWFIGLEVEHIDDRSMCCGTPPDCEWKAQAGNICVASFDWSCSGICKSVEKIKYVHSKCGEGDGAVWSALV

SEQ ID NO: 177346 - protein, 307 aa, Glycine max
  Coding DNA Sequence Number=SeqID_85661
  Homolog annotation: Hit_ID=Q2HVW1; Match level="QueryCoverage=41%, HitCoverage=52%, E-value=5e-11, Identity=30%"; Hit description =Putative uncharacterized protein
MGERRGSKMKTGADRLGDLSIRGLEEWPKGDEVKTLIQRDLTLLERLQDFFVSDVAGNVKLKYVGDDIVIMEGISDERIVEETKNEEDSLLSIFHSVHKWNDEEYSGNRLAWVQCLGIPLKAWNEVCFSKLVSEFGKFIFVDKVTASREKIDVARVMVQIATPSTIIFCVNLRINGIICNVSGGGDPTTGGVMGEEVMFDEGFGGGDIGEMVEGLERSRVETVGCSNYKPMDITQQANTLHNSHSTSCLGGTIKLNEGDNRESKKEITRETKGCEVIKTQHGTIKGVGKCMEHSSGQIGAKENMSAR

SEQ ID NO: 177347 - protein, 74 aa, Glycine max
  Coding DNA Sequence Number=SeqID_85662
MKTFTKDSGRFGNIIIGKHLSNKGCCKAAKGVDNAEGGGLLKQLVLTEELQRERQGCQKAFGFQQQKMCYMRSA

SEQ ID NO: 177348 - protein, 158 aa, Glycine max
  Coding DNA Sequence Number=SeqID_85663
MASRKCKSIGSRPTTQYDTRRFHSLDPWNRYTDNVLGRNILPEKKVKLYHTEFDVFKTELERHNLHKRLTNLVDGSIDVALVKEFYANLYSSEGPSPKQARFRGHLVKIDADSLNTFLETPVVWHKVRLCLHTPDIAGCLQILGRLRLPYAYQVEGSS

SEQ ID NO: 177349 - protein, 154 aa, Glycine max
  Coding DNA Sequence Number=SeqID_85664
MATTTVEDPPLLVVDVADVGSKISDVRPRVPFVKMAKGGTYEIKDFDAKRWKANVCIRVPHSLPYVFGGPWIVHKPPSSESVCGRKRLSSVEGSSLDNPPTKTSVVRAASIKLSKVDMPFGFAGEIRHVRCRTGCHDITLQNMQIVCVRMNRLN

SEQ ID NO: 177350 - protein, 199 aa, Glycine max
  Coding DNA Sequence Number=SeqID_85665
  Subcellular localization annotation: CTP_CleavageSite=18; ConfidenceScore=5.17e-01
MASLQKSSELANFTWRCRVATLTAKVREGRYFRTSSSTHSKASNNWMEDGNLALWLRRTWRDALTSPPSLLLAPPGTKGGRIMVTKNDSLAREAVEGYAFLQRREVPPPAWCEIVKLSEEEDSLSEAPWRVSEEGEPSMEMTYWSIRVVESNSQSHYYPCPRRNHKLKTLSKNNTLKVKKANEEEGESQIVNSKARKIR

SEQ ID NO: 177351 - protein, 22 aa, Glycine max
  Coding DNA Sequence Number=SeqID_85666
MAATRTGFGPLSVVLSHRSTSV

SEQ ID NO: 177352 - protein, 224 aa, Glycine max
  Coding DNA Sequence Number=SeqID_85667
EALERFYSLLRKTPTHGFSEPIQLNIFIDGAHESGCCIPLDDAAKEINYMGNQNRQGFNLGGFLGYQQGANFNQNQGQWWMSHPRNQFNKNQGGPSNRPQNHGPSLYERTTKLKETLAQFMQVSMSNLKSTESAIKNLEIQVGQLAKQIAENSSGGFGANTKKNAKEECKAVITRSKKVTMVEDKRRNSNEQELEDEGEKEKEEDQTREKKINDEEKEEKEEKK

SEQ ID NO: 177353 - protein, 143 aa, Glycine max
  Coding DNA Sequence Number=SeqID_85668
  Gene Ontology: Mol. function=DNA polymerase processivity factor activity; Cellular component=PCNA complex; Biological process =regulation of DNA replication
  Homolog annotation: Hit_ID=Q00268; Match level="QueryCoverage=73%, HitCoverage=59%, E-value=2e-32, Identity=51%"; Hit description =Proliferating cell nuclear antigen
  Pfam annotation: Domain name=PCNA_C; Domain location=39-131; Score =71.8; E_value=2.2e-18; Accession=PF02747.6; Description =Proliferating cell nuclear antigen, C-terminal domain
MTIIFYNDINFGEGFLQSLCKNDDLGFRNDEVYAAAQDKISDFEMKLMDIDNEYLGILEEGVKFSTKGDIGTTNIVCKQNTSMDKPEEASIIEMNEPLSNIVIISLSNELSVVVEYKIVKMGYVCFYLAPKIEEGEEDTKPQV

SEQ ID NO: 177354 - protein, 222 aa, Glycine max
  Coding DNA Sequence Number=SeqID_85669
  Gene Ontology: Mol. function=protein serine/threonine kinase activity; Cellular component=intrinsic to membrane; Biological process=protein amino acid phosphorylation
  Homolog annotation: Hit_ID=Q7XTK4; Match level="QueryCoverage=66%, HitCoverage=24%, E-value=7e-53, Identity=74%"; Hit description =Putative mitogen-activated protein kinase 1
  Pfam annotation: Domain name=Pkinase; Domain location=19-209; Score= -65.9; E_value=0.00012; Accession=PF00069.16; Description=Protein kinase domain
  Pfam annotation: Domain name=Pkinase_Tyr; Domain location=53-216; Score=-106.6; E_value=7e-06; Accession=PF07714.8; Description =Protein tyrosine kinase
  Pfam module annotation: Pfam domain module=Pkinase::Pkinase_Tyr; Domain location=19-209::53-216
MAEVVGKMFCSINVKLQVFECLKYICSVGHPDMEMHFFISSDFHCRDGFFFAVKEVSLLDQGNHGRQSVYQLEQEIALLSQFEHENIVQYIGTEMDASNLYIFIELVTKGSLRNLYQRYNLRDSQVKLERLNDSLNPKGKMRITPRKIKDIKCANILVDANGSVKLADFGLAKATKLNDVKSCKGTAFWMAPEVCLQSPPVKKVIEKWVNICINGVNIAVCN

SEQ ID NO: 177355 - protein, 91 aa, Glycine max
  Coding DNA Sequence Number=SeqID_85670
MENNDATRKQRLKCLNKKCSRERNLRAHSRHLLKDPNSQIMDKCLVKLQTKFQEDPTINEGWAAFLPRQLHVASSRSFIERLLQEASPWLL

SEQ ID NO: 177356 - protein, 104 aa, Glycine max
  Coding DNA Sequence Number=SeqID_85671
  Pfam annotation: Domain name=AT_hook; Domain location=89-101; Score =17.6; E_value=0.022; Accession=PF02178.10; Description=AT hook motif
MSTSMMWMIKGCQRVVRPSRWWRIQPFERGLASVARLCANHGLKREFTRYFYCGPTAKCTYQNLELSHVKVANVGSKISHVRPRVPYVKRTRGRPAKQKTLTPK

SEQ ID NO: 177357 - protein, 52 aa, Glycine max
  Coding DNA Sequence Number=SeqID_85672
MVEKKMDRGRMLCMPWEATMQRRHWFYARLSASVTETNIVDCPGRTTVVQGG

SEQ ID NO: 177358 - protein, 133 aa, Glycine max
  Coding DNA Sequence Number=SeqID_85673
  Gene Ontology: Mol. function=RNA binding
  Homolog annotation: Hit_ID=A7NVB6; Match level="QueryCoverage=79%, HitCoverage=56%, E-value=1e-39, Identity=72%"; Hit description =Chromosome chr18 scaffold_1, whole genome shotgun sequence
  Pfam annotation: Domain name=ChaC; Domain location=7-128; Score=91.0; E_value=3.8e-24; Accession=PF04752.3; Description=ChaC-like protein
MRTSPWSLILETRNTVKSRLLAFEGMLQYLEVREKQYDKKEYLDFYTDLTATSPAVSGVMVYIATPDKKSNVNYLGPASIEDIARQIIQAKGPAGPNRDYLFNLEKALHEIGCKDKHVIDLANEVRRILAEEH

SEQ ID NO: 177359 - protein, 422 aa, Glycine max
  Coding DNA Sequence Number=SeqID_85674
  Homolog annotation: Hit_ID=A2ZZZ8; Match level="QueryCoverage=40%, HitCoverage=12%, E-value=2e-20, Identity=33%"; Hit description =Putative uncharacterized protein
MVGNIVLAKHSRHLPGSTESFFKTPIAISMAHIRLAAAKAILRLARKWDLHITPDIFRFTILIAKDSSFFVRSTFLSKTQKLLKEHKLPIRFACAFALAVTDGTDDLQYQALVDISIVEGAQDIVNDAVLHVISIFRAIRKVEDAIDAQITPKLHMLAEIGIFILNEFNHGGISVLQTPGQILLPSSLYRVSLIKNDTSSKCPKSFFDEKFLSRVFHALKESTVPHGYAQKPAKTLPKHGHKGQQDVKKSNVNIYGVLDSASSKPDDLSRREIANAKAVRPNIPSVKRGKCVPSSGSGTVGLHECSMTEKQQKIASKHCEKTIERNMLSSSDSVRFKGSLTESHVPTRKSKRAAACSSENAVTSSKHTVEPSKCRRTKRKDTCGSKVGGKFFQISKVEYEFDPYHLVSLKPSSIKGLSRLVL

SEQ ID NO: 177360 - protein, 170 aa, Glycine max
  Coding DNA Sequence Number=SeqID_85675
  Gene Ontology: Mol. function=binding
  Homolog annotation: Hit_ID=A5B0Y6; Match level="QueryCoverage=60%, HitCoverage=14%, E-value=2e-11, Identity=43%"; Hit description =Putative uncharacterized protein
MAHNYIATDSPLSRRIVRAFLHFLNSVEPGPGVDAEGIEVARECLAEAFKLNQSPVAGDDVKSDSLIDIFKSLEAKKQCEPSKSDVGPQPDSVDASSSFSGENPARGKNHSEASKSTSSSECLLFFSNWVEHVVVVMRPSEIAGEERKDLTCHISQSVKATIPHLMLGLT

SEQ ID NO: 177361 - protein, 252 aa, Glycine max
  Coding DNA Sequence Number=SeqID_85676
  Gene Ontology: Mol. function=binding; Cellular component=endoplasmic reticulum membrane; Biological process=protein amino acid dephosphorylation
  Homolog annotation: Hit_ID=UPI0001555832; Match level="QueryCoverage =48%, HitCoverage=44%, E-value=7e-15, Identity=42%"; Hit description =PREDICTED: similar to Small glutamine-rich tetratricopeptide repeat (TPR)-containing, beta, partial
  Pfam annotation: Domain name=TPR_1; Domain location=32-65; Score =28.3; E_value=2.8e-05; Accession=PF00515.19; Description =Tetratricopeptide repeat
  Pfam annotation: Domain name=TPR_1; Domain location=66-100; Score =7.8; E_value=0.61; Accession=PF00515.19; Description=Tetratricopeptid e repeat
  Pfam annotation: Domain name=TPR_2; Domain location=32-65; Score =21.8; E_value=0.0026; Accession=PF07719.8; Description =Tetratricopeptide repeat
  Pfam annotation: Domain name=TPR_2; Domain location=66-100; Score =8.8; E_value=2.4; Accession=PF07719.8; Description=Tetratricopeptide repeat
  Pfam module annotation: Pfam domain module=TPR_1::TPR_1::TPR_2::TPR _2; Domain location=32-65::66-100::32-65::66-100
MQSKKYSDAIELYNCAIAVHEKSAVYYCNRVRLILIIRAAAYTQINKYTEAIQDCLRSIEIDPNYSKAYSRLGLVYYAQGNYRDAIHKGFRKGCGNHLENVDFIAVMYCYFIKVAERKLLEEQHRAYQNQNSRSSQEFPNQSAQGGSRSHSVPPPFSSMSFNPRDIASMFMNITNPTNAQPQGSHSHQERQEDSNGSGTSEPEIRIGGNISVNMEDMPEDITGALQSMMEMLSGAAPPGQPQDQTNGRTAPN

SEQ ID NO: 177362 - protein, 770 aa, Glycine max
  Coding DNA Sequence Number=SeqID_85677
  Gene Ontology: Mol. function=nucleotide binding; Cellular component =intrinsic to membrane; Biological process=defense response
  Homolog annotation: Hit_ID=A7PYV7; Match level="QueryCoverage=38%, HitCoverage=40%, E-value=6e-41, Identity=35%"; Hit description =Chromosome chr12 scaffold_38, whole genome shotgun sequence
  Pfam annotation: Domain name=NACHT; Domain location=137-286; Score= -22.5; E_value=0.0034; Accession=PF05729.3; Description=NACHT domain
  Pfam annotation: Domain name=NB-ARC; Domain location=93-398; Score =96.9; E_value=6.5e-26; Accession=PF00931.13; Description=NB-ARC domain
  Pfam module annotation: Pfam domain module=NACHT::NB-ARC; Domain location=137-286::93-398
MALGADSDLGGGPGRGVEARPKIVPEGGGAPNRVRRLGGVLARLAVPSPLFPDLVYLSSTFASHGGFDKPPSKSLSTAPSKETFESPSKSPSMAVPKLPAYNLELTDRVLGRQKEKDQVVKFLLDLSDNTNTNGNMSILGIVGPGGIGKTTLAHVVYEDHKVRTSFQLRIWITFPSYQLEARTLAKIMLRILQVSSGQDDELLDPMPHLQESLNGKNLLLVLDGCWSIHEWEKLQTCFESAARGSAIILTTRTTKTALQMLADLHLSFLSMEYCWSLFSNHCFGNQRHSCSPELEVMGKRILRKSGGMPLAVKMLGGLLYEKDYEVFEKMHNLPCYMDGQRSNSAGNMDFTREKLGSEYFDFLVARSFLIRSNSGGNMDFTMHDMVRDLALFVSAKSHPIFDRNDESIDTSFLISNLQNVEESSSELYGPQMEEYIPLKDKIDIANITHGLDQESPEIEVNYLSSTANDAVQTTFEYWTHFDTLRILDASQLVELPSELYSLRIEGCHSFKSLQDVLIDRSTNLFELFIIDCSFLEYLTDASCPTSSKCPELDSLQGLPSCLKLLSIAFGGKLIPKKDWNLQALHCLLHFVEIERDLILETTVLSNPDASLGLKELFQNHDMSDKVLRAHFSEALAIVQATTCSDTAQMIPLAGGMIQKSSCWVTVPMDEVLLKVVKKYSDKILLKESDRKPKSSKKKGKKHSLFNGISLEKHFEKSDEWRGTPPWDPLVGGNAYPKFLCDVMVEGLAKHLRCVGIDAAIPYSKKPEPRL

SEQ ID NO: 177363 - protein, 222 aa, Glycine max
  Coding DNA Sequence Number=SeqID_85678
MNKGKEPLEGLGGPMARARTKKAKEALQQVLTMLFEFRPTLQVENLRIVNCTMFQEECIPDRSSHRLIKPKVRPWLIKPKVHLGESHFSKGLPNPRSALVSLAFPKAYQTQGPPMVSLASPKARQTQGPSLVSLASPKARQTLGPPLVILASPKNHQTQGLPFVSLLSPKAHKTQGPPLVRLTGLSNLRSALGEFHFSKGSLNPRPALSKSHRLFKPKVRPW

SEQ ID NO: 177364 - protein, 283 aa, Glycine max
  Coding DNA Sequence Number=SeqID_85679
MTWRTLNRGHDKLFVSLRTCINYGKKNRHRTAKQELKFYFYSSYLLYHALFDIVMLCQLLGHSLVVVVISTVLSFGEHDLCAKDRTIELGVENALDVNDIMSKGENEEEVVHSVSIDLEGSSSAIRKNTRPSKNGEKQGMISSIKKVVESMKEFVEVTKKKTENKKKMEIKEAQEMVHEVVNELDNIPNFNGALRHRVIDWLTENSIKFSIIKALPLDWMRRKITSRLLCLDAKLQVSSSSSLSVTNLTVSEFKATKNTMLNNTSGSISLMDTPIPNLNVELS

SEQ ID NO: 177365 - protein, 845 aa, Glycine max
  Coding DNA Sequence Number=SeqID_85680
MGYLRTGRKHGKWPNQYKSSHLSNKSLTAKGITFVLLCQGRHGELTYVMECHGEEFVEPPSMNECYPVSRGVTSTSVVRAASAKLARVDMLLVLQVRRVKHRCSTLAYVSLMEWTRTGDADRGYPLLIMSFFLFESTIGMDGIDSGGSIQQPLVDLEAVLVFMGGCSLLLLLQSRNLFHIAIVMGRHRPPAVAGYEWVRDNVLKSDDFPFLTVALRSPPFVFVYHCFFNVMGLVIPLNTFQCALVEHLNVSPSSLHLNSWAMMMLTSKINWVSLNNVSKKLFNFDSNVFRRSKDHFFKSDPTKFKSFNVDLLTLVERVEKAILEQLPVLLDAWAILSLPLTDDPFPTLDDKTRSAGGTVPLSTIIPLTRERGQLVVEVGPTTGVAQVSLGVPSSILAKRKQDDNTWGPPLAPSAIQASVVVLAPPLPLAAPIQEFTPTASTSPIVAPSSIIIAPYRVPHHLPPYFTPAFLWITSTLPMMLIRCGVWVTRSVGLVLIFDKNLVHLAILKENGQRHQEALSKVASLEDEVAKWRANACIAWRMECPKVVNATIAFAEAIKSNHQLSSKVGSVLAKLCTSIMTEKDELAKLVANLEVQLKESKSRLEEFELHVSKEKEASKKLEKELLMYKREVVEQHEKGFHNTIRQVGFIAKDRDLSHFYLFKDVKDSVMLDEEDIVVEGEECVPRVDLGFCTKGEPWVSEAELSNEGTYQGQNLGLTNLGPGAHSSWVLASLTKDGPWDLGFCEPLEIGDSQRANLGFDDSLEKQESPRADLGFDEPLEKRDSPRMDLGKTHQGGPWIWQAFREMRLTKVDLGFDEPLEKADLGFDKPVRAAIRDAPMLGFFKTY

SEQ ID NO: 177366 - protein, 57 aa, Glycine max
  Coding DNA Sequence Number=SeqID_85681
MEGHEPTLIITDQDPAMKVGLAPSGTRVLVRADHEKIARKRLKNMMRVSVKLRHGSF

SEQ ID NO: 177367 - protein, 118 aa, Glycine max
  Coding DNA Sequence Number=SeqID_85682
  Homolog annotation: Hit_ID=Q69FA4; Match level="QueryCoverage=100%, HitCoverage=10%, E-value=1e-07, Identity=29%"; Hit description=Gag -pol polyprotein
  Subcellular localization annotation: CTP_CleavageSite=67; ConfidenceScore=5.32e-01
MSVKANTVQDKTFHKRYVNKNYHNNKKKYKHNNPRVAPSNPIPRATTSNPSFKKKGTRDDIVVVVISQVNVVTNVNRWVVDFGATRHVYANKIMFISYTIVGDGEEQVYLENSRTTSV

SEQ ID NO: 177368 - protein, 310 aa, Glycine max
  Coding DNA Sequence Number=SeqID_85683
  Gene Ontology: Mol. function=hydrogen ion transporting ATP synthase activity, rotational mechanism; Cellular component=proton -transporting ATP synthase complex, catalytic core F(1); Biological process=ATP synthesis coupled proton transport
  Homolog annotation: Hit_ID=A2WTV8; Match level="QueryCoverage=53%, HitCoverage=36%, E-value=4e-58, Identity=57%"; Hit description=ATP synthase subunit beta
  Pfam annotation: Domain name=ATP-synt_ab; Domain location=206-310; Score=-53.8; E_value=0.00027; Accession=PF00006.16; Description=ATP synthase alphabeta family, nucleotide-binding domain
  Pfam annotation: Domain name=ATP-synt_ab_N; Domain location=139-197; Score=9.4; E_value=0.027; Accession=PF02874.14; Description=ATP synthase alphabeta family, beta-barrel domain
  Pfam module annotation: Pfam domain module=ATP-synt_ab::ATP-synt_ab _N; Domain location=206-310::139-197
  Subcellular localization annotation: CTP_CleavageSite=64; ConfidenceScore=5.06e-01
MVVSSSLKVSCKKKKMKAEVLVFGEEMRPPTFSFSNKPYFLNLPPCWPPLSTSLELSQLTLSVSRSHTHSLRSLQSEPRGCRSWLSSFGSKHERPRKDRKGWFTIFPVRRWPQLPWSCLSPLRSVWTDEFIGKGAIGQVCQVIGVVVDVKFDEGLPPIMTALEVLDHSLRLVLEVAQHLDTEHYLPIHREAPAFVEQETAQQILVIGIKVVDLLAPYQRGGKIGLFGGAGVGKIVLIMELINNVAKAHGIVVSLSLMQTESKCALVYGQMNEPPGAHARVGLTGLTVGEHFRDIKDAMTVPKCYIYKANS

SEQ ID NO: 177369 - protein, 247 aa, Glycine max
  Coding DNA Sequence Number=SeqID_85684
  Homolog annotation: Hit_ID=Q2HSV3; Match level="QueryCoverage=47%, HitCoverage=18%, E-value=1e-14, Identity=37%"; Hit description=IMP dehydrogenase/GMP reductase, putative
  Pfam annotation: Domain name=DUF1723; Domain location=85-134; Score =34.0; E_value=5.5e-07; Accession=PF08330.1; Description=Protein of unknown function (DUF1723)
MIMMPPNDKGLPHLPGFPNGPHDTSVLRDFENHVALRVWNGKEHPELKLSSHGRKMAKFDKPAPEIEGHVAVSGLSPSIACSLDTGDRGLMSAIVERWHKETSSLYLPVIEVTIILDDVASLLHLSIIEAFHSFETLHVDDVVYMLVELLECWIYEYFPSIGFAIAVEDYDERRPCACRWTSGKVLPVWTYRRHLDMLTPDVPEDPPRVLPVQQYDTFVEPDVPQQPKATTTHDEPDIDVHLPRHAV

SEQ ID NO: 177370 - protein, 189 aa, Glycine max
  Coding DNA Sequence Number=SeqID_85685
  Homolog annotation: Hit_ID=Q9M811; Match level="QueryCoverage=54%, HitCoverage=25%, E-value=2e-09, Identity=39%"; Hit description =Putative uncharacterized protein F9I5.12
MEQEQESLRSRLFHFKGMLENTRSHTKSLSIKSAGALDPSPLEEEPVSSRSQGSKALNDLDKVPRPRKSKEEIVAKEAKDKISGGGKSVSSALALSNAFTSLADAENADRNNDTKWWMPTPKVLIDSYYLMWKQGSHRLLLSNVATRFVQYQKDRVNHVLKAAQETIGRATVDGGHDLSKDTRHGQVSE

SEQ ID NO: 177371 - protein, 170 aa, Glycine max
  Coding DNA Sequence Number=SeqID_85686
  Pfam annotation: Domain name=DUF1723; Domain location=16-65; Score =47.1; E_value=6.3e-11; Accession=PF08330.1; Description=Protein of unknown function (DUF1723)
MAVIGLSPLIACSLEADDRGLIFAFVERWYKETSSFHLSVGEVTITQDDVASLLHLLITSTSIALRLFIVAYTSIFFTVASSIAAEDYDERKPHACSWKSRKALPMSTYRKQLDRLTSNVICVAPRKCAANYIKWFCFTSHPFMSPTQPEDPPRNPPVVHDDTFIEPDPP

SEQ ID NO: 177372 - protein, 135 aa, Glycine max
  Coding DNA Sequence Number=SeqID_85687
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=P59229; Match level="QueryCoverage=88%, HitCoverage=71%, E-value=2e-39, Identity=73%"; Hit description =Vacuolar ATP synthase 16 kDa proteolipid subunit 4
  Pfam annotation: Domain name=ATP-synt_C; Domain location=13-78; Score= 56.6; E_value=8.6e-14; Accession=PF00137.12; Description=ATP synthase subunit C
  Subcellular localization annotation: CTP_CleavageSite=25; ConfidenceScore=5.19e-01
MAGFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVSDMAMRGGRQLSVSG

SEQ ID NO: 177373 - protein, 454 aa, Glycine max
  Coding DNA Sequence Number=SeqID_85688
  Gene Ontology: Mol. function=transmembrane receptor activity; Cellular component=intrinsic to membrane; Biological process=innate immune response
  Homolog annotation: Hit_ID=A7Q7V0; Match level="QueryCoverage=90%, HitCoverage=81%, E-value=1e-52, Identity=30%"; Hit description =Chromosome chr18 scaffold_61, whole genome shotgun sequence
  Pfam annotation: Domain name=LRR_3; Domain location=381-400; Score =33.7; E_value=6.6e-07; Accession=PF07725.3; Description=Leucine Rich Repeat
  Pfam annotation: Domain name=NB-ARC; Domain location=85-302; Score= -110.1; E_value=0.003; Accession=PF00931.13; Description=NB-ARC domain
  Pfam module annotation: Pfam domain module=LRR_3::NB-ARC; Domain location=381-400::85-302
MECKKQGEDIHVIPAFYKIDPSQVRKQSGSYHAAFAKHEKDRKVSEEKMQKWKNALYEATNLSGFHSNAYRTESDMIEEIARVVLQKLNHKNYPNDFRGHFISDENCSNIESLLKIESEEVRVIGIWGIGGIGKTTLAAAIFHKKDLHIDTPKVIPYIVKRRLMNKKVLVVTDDGSRVIVTTRDKHVLMGEVVDKIHQVKKMNFQNSLELFSINAFGKTYPKKGYEELSKRAVEYAGNFSADIGTRSLLDKALISITSDGDHVDMHDLIQQMGREVVRQESIENPGQRSRLWNPEEVYDGNGAVEGICLDMTQITYMNLSSNAFRKMSNLRLLAFKSYQDFEIINSVYLPKGLECLHKSLRYFEWDGYPLESLPSTFCSEKLVEFSMPYSNVKKLWHGVQGDQSGSQCFARMLQPYGINTGLKEHSNRVTPKAYTPKSLSGSLPPDSGPTQKTF

SEQ ID NO: 177374 - protein, 176 aa, Glycine max
  Coding DNA Sequence Number=SeqID_85689
MLESFKQQDQMSVLELYIKKDVAGGSMFHYANSLTSCGNYLSNDETQPPTNMSNLHIDEEDDDDDYLVSNSYVEESLDEDDSVDGISDTDDEVTDIPQPVRNVHPAEGAQRIENPFWDDALHYNNINWSYPDEEDICGLEMSSTFNVGQELYVGMEFDSKDAIRGKSHNGVDYTHV

SEQ ID NO: 177375 - protein, 256 aa, Glycine max
  Coding DNA Sequence Number=SeqID_85690
  Gene Ontology: Cellular component=integral to membrane; Biological process=vesicle-mediated transport
  Homolog annotation: Hit_ID=A2YJ34; Match level="QueryCoverage=28%, HitCoverage=26%, E-value=6e-22, Identity=73%"; Hit description =Putative uncharacterized protein
WFAIETTTTLGAFEEILDVKISGSDSDREVKIVPLTIDLDDVEPKEQYFDSDTFEIIEPALGDDTRDGSFVLEHVGFYVEAAHSLEIHCELVVVFVKRIPYGSLGKKTQREPEGKGEVEGHREVEIESDGDEDDEPGGDNDNEGEREQKSSCNATIVESPKTKDDCGKLSNATRVLNRNHFGFSAYCVATIEFSRRQIPIAFLQRINEDFTKKYVGGKAATTAAQSLNREFGYEQMKYCVDHAEEISKLAKVKAQV

SEQ ID NO: 177376 - protein, 42 aa, Glycine max
  Coding DNA Sequence Number=SeqID_85691
MKKVEEQRSEEGETNLSLEAHLVVFFTLDESKEKEMLLIPLF

SEQ ID NO: 177377 - protein, 62 aa, Glycine max
  Coding DNA Sequence Number=SeqID_85692
MIFICGLGSSSSMDSFASWKMNGSGMEKEEREETPLQGEDESRRSSPPLEAMDKSLEEKRDE

SEQ ID NO: 177378 - protein, 78 aa, Glycine max
  Coding DNA Sequence Number=SeqID_85693
  Gene Ontology: Mol. function=nucleoside-triphosphatase activity; Cellular component=integral to membrane; Biological process =proteolysis
  Homolog annotation: Hit_ID=A7P7L9; Match level="QueryCoverage=56%, HitCoverage=3%, E-value=1e-11, Identity=79%"; Hit description =Chromosome chr9 scaffold_7, whole genome shotgun sequence
MKNQGVLEDKLNPLKGVSGTFRPGVLTALMGSTGAGKTTSMDYINPCSIQHGFDYEQKSILRPGRSVLESHVEYKYLS

SEQ ID NO: 177379 - protein, 65 aa, Glycine max
  Coding DNA Sequence Number=SeqID_85694
MEDKEALVSNCSRAGDEVPPSTFSMMNIDEDRLSFHTSTDGYGYLLATLCSFIAYLFILYTGMTI

SEQ ID NO: 177380 - protein, 108 aa, Glycine max
  Coding DNA Sequence Number=SeqID_85695
  Subcellular localization annotation: CTP_CleavageSite=4; ConfidenceScore=5.16e-01
MPVRISSFTNLRSNMTIFEVSLKESPLSSPLNMNLMDAPRLLMSLAPMTPTSRELDTAVMVEEEAVAWRKLQQLWRVWAFCQRLPIKCSLNLLLWWDFNGFCQSYGFL

SEQ ID NO: 177381 - protein, 99 aa, Glycine max
  Coding DNA Sequence Number=SeqID_85696
  Gene Ontology: Mol. function=zinc ion binding; Cellular component =intracellular
  Homolog annotation: Hit_ID=Q6Z8A4; Match level="QueryCoverage=80%, HitCoverage=31%, E-value=6e-31, Identity=73%"; Hit description =Putative zinc-binding protein
  Pfam annotation: Domain name=PLATZ; Domain location=23-97; Score =77.6; E_value=4e-20; Accession=PF04640.5; Description=PLATZ transcription factor
  Pfam annotation: Domain name=zf-B_box; Domain location=22-62; Score =1.6; E_value=0.083; Accession=PF00643.15; Description=B-box zinc finger
  Pfam module annotation: Pfam domain module=PLATZ::zf-B_box; Domain location=23-97::22-62
MKKKTSGHHGLGHFSKQAFFVQCKVHTDFHKSECNTYCSDCMNGALCSACLASHREHKAIQTRRSSYHDAMRVSEIQKILDITGVQTYTITCAKIVFYE

SEQ ID NO: 177382 - protein, 193 aa, Glycine max
  Coding DNA Sequence Number=SeqID_85697
  Homolog annotation: Hit_ID=A5BX70; Match level="QueryCoverage=59%, HitCoverage=9%, E-value=1e-09, Identity=38%"; Hit description =Putative uncharacterized protein
MAKINFPDLKDKLDVLSEEELQRRRVCLGELWKVSRHHDSLTQQKARVKRGTLFLYDDGVSGEWIGFGERWIKWIIGCMEFAFVFVLVKGSPTMEFSPHRGLKQCDPIASIVAEGLSELMRQALHSRIFSSYKVNFHKICVGGLGVDGNILSTFAASDLEVYVGSSDLDFVVPWKLHHFRGGRARIGPGDGTD

SEQ ID NO: 177383 - protein, 106 aa, Glycine max
  Coding DNA Sequence Number=SeqID_85698
  Homolog annotation: Hit_ID=A2Q186; Match level="QueryCoverage=66%, HitCoverage=18%, E-value=9e-09, Identity=37%"; Hit description =Reverse transcriptase-beet retrotransposon, putative
MCSSIRGCDDVDWREASAINKSGGLLCFWRKDILEVNHTFIGSGFLGLKGTWEVDVPCTVVLNVYAPCEIEGVKSVTAWVVWVWVFDAVLVAWPMVVVHGGGGWRF

SEQ ID NO: 177384 - protein, 111 aa, Glycine max
  Coding DNA Sequence Number=SeqID_85699
MGEVVATQLAQASSAHPDELDCLTMGVKFLEAVKRRLHAIKQWSPDEIREPIGKITKLYFPLIGGSVLDNGGPMNSARQSIHGTPDSMMENARTALGNQFVELQTQMVEDA

SEQ ID NO: 177385 - protein, 87 aa, Glycine max
  Coding DNA Sequence Number=SeqID_85700
MHHRPRTRPHLIRLVQPDHLIQSSICGIWFASRRPTTGHMAEVAWPGDWPEAQAGEAPAEAPDEADEAHEDEEMIDLLYFLGGSGAT

SEQ ID NO: 177386 - protein, 273 aa, Glycine max
  Coding DNA Sequence Number=SeqID_85701
  Gene Ontology: Mol. function=phosphoric ester hydrolase activity; Cellular component=cytoplasm; Biological process=carbohydrate metabolic process
  Homolog annotation: Hit_ID=P0A994; Match level="QueryCoverage=98%, HitCoverage=80%, E-value=1e-131, Identity=85%"; Hit description =Fructose-1,6-bisphosphatase
  Pfam annotation: Domain name=FBPase; Domain location=1-267; Score =486.6; E_value=3e-143; Accession=PF00316.11; Description=Fructose-1 -6-bisphosphatase
MKLDLFANEKLKAALKARGVFAGLLSEEEDEFVIFEGSENGKYVVLMDPLDGSSNIDVNVSVGTIFSIYHRISEPGTPITEADFMQPGHKQVAAGYVVYGSSTMMVYTTGVGVHAFTYDPSLGVFCLSHERMTFPEKGYTYSINEGNYIRFPQGVKKYLKFCQEEDVSTKRPYTSRYIGSLVADFHRNLLKGGIYLYPSTASHPKGKLRLLYECNPMAFLAEQAGGKASDGKNRILDIQPETLHQRCPFFCGNDAMVDDVERFMREFPDEHQA

SEQ ID NO: 177387 - protein, 119 aa, Glycine max
  Coding DNA Sequence Number=SeqID_85702
DGESPTAQVPQQVQDASSKTTIPESFTLHPKAGEEQARPETDATPERSLEGTSEPPTPVADLSSPQPAADPSTLVLDIPEDQTTPVLAPNTSPPATPVLHLTDEEDAQTQDTQDLSQDF

SEQ ID NO: 177388 - protein, 92 aa, Glycine max
  Coding DNA Sequence Number=SeqID_85703
MNVVATYPSAGGRRVTRGMRVPRKEYARSRHQRLFEENVGKTGKDAIYELLSERFGSCIYARGRVFPFAPTYSSIGMRKSDLRSSFGTKCLV

SEQ ID NO: 177389 - protein, 246 aa, Glycine max
  Coding DNA Sequence Number=SeqID_85704
HEVATNLAASSESKKLEGKLDALVNLVTQLALNQKSVPVARVCGLCSSADHHTDLCPSMQQPGAIEQPEAYAANIYNRPPQPQQQNQPQQNNYDLSNNRYNPGWRNHPNLRWSSPQQQQQQPAPSFQNAAGPSRPYIPPPIQQQQQPQKKPTVEAPPQSSLEELVRQMTMQNMQFQQETRASIQSLTNQMGQLATQLNQQQSQNSDKLPSQAKQHIPPLPFPPRAVSNKKMEEAEKEILETFRKVE

SEQ ID NO: 177390 - protein, 49 aa, Glycine max
  Coding DNA Sequence Number=SeqID_85705
MATMMEAMMSMKKIMEANVIAVAATGVVAKVNPTPPSGLNQMNHPTSDM

SEQ ID NO: 177391 - protein, 141 aa, Glycine max
  Coding DNA Sequence Number=SeqID_85706
MSDGFCGTHLQILVRIRGLGRALGQCRRPTTSARRQRVAVTTDHVDKPVIPAPDVQDDPVEAPAAVEDILADAGAEPAEDVHEGFSSGPSDPSVLTLYADHVACSVWTGEERPELKLSSHGRKVHNLGRPVPTIEGLVAGT

SEQ ID NO: 177392 - protein, 53 aa, Glycine max
  Coding DNA Sequence Number=SeqID_85707
GELELHRGGGRSRTSGSPGLQEFDPCVFRTCKRNLQDSGTLKRVAWGLDVGTR

SEQ ID NO: 177393 - protein, 45 aa, Glycine max
  Coding DNA Sequence Number=SeqID_85708
MAQECFPNEYMMWNCSSSVDRWHESSFSNARNGPEETCLKEIQEG

SEQ ID NO: 177394 - protein, 125 aa, Glycine max
  Coding DNA Sequence Number=SeqID_85709
MPTRRKEVVFVFWVIPLHGKSSEGGQDLDARIGPREWTSFIDVLALLVLGVVLFPDMDALVDLAAIDAFLAYHHTKENPSVPYKVTACAPGKGKQIRSSSWLEESIMPFIAQGFSDPNARMLQRV

SEQ ID NO: 177395 - protein, 273 aa, Glycine max
  Coding DNA Sequence Number=SeqID_85710
MRGAPIEESMSPFLVRHFGAQNFKAIQRIHKAWETPLRKDQELRGIRNGIIGGYHEWLKVHIRGLDWLAKLKVVSEDSFEAPEEDEEVQALKNELGKAKLAKEKFKMQLPQRALEQETKRARKEEYGRNKFRGALWGSNNELKLRREERDQSRAHSMVLKEELVACSRSKRSLSQRLCETETNMLAIIAKYQEELGLATTHKHRVADEYAQVYAEKEARGRVIDSLHQEATMWMDRFALTLNGSQELPRLLAKAKAMADTYSAPEEIHGLLGY

SEQ ID NO: 177396 - protein, 252 aa, Glycine max
  Coding DNA Sequence Number=SeqID_85711
  Homolog annotation: Hit_ID=Q84VI1; Match level="QueryCoverage=51%, HitCoverage=18%, E-value=1e-42, Identity=70%"; Hit description =Envelope-like protein
GRLLLMMKCCKLLEDAAVNSPAEVPGQTYWEKITAKRVQHWPKKGKLSAGKAKCESMQFYTRRLVMLKTGTHRIILPLLPQGTRKLLQVLCPSTLIAELKECKVLEATSLPTQVAPGLQNGDTRLSEREKPPLRAKEISSSDSDDDVELDVSTSKRAKKSGRKVPENVPDAPLDNISFHSIGNVEKWKYVYQRRLALERELGRAAMDCKEIMDLIKAAGLLKTVSKLGDCYEGLVREFIVNIPSDITNRKSG

SEQ ID NO: 177397 - protein, 357 aa, Glycine max
  Coding DNA Sequence Number=SeqID_85712
  Gene Ontology: Mol. function=leucyl aminopeptidase activity; Cellular component=intracellular; Biological process=protein metabolic process
  Homolog annotation: Hit_ID=P68768; Match level="QueryCoverage=100%, HitCoverage=70%, E-value=0.0, Identity=91%"; Hit description=Cytosol aminopeptidase
  Pfam annotation: Domain name=Peptidase_M17; Domain location=184-357; Score=146.5; E_value=7.4e-41; Accession=PF00883.12; Description =Cytosol aminopeptidase family, catalytic domain
  Pfam annotation: Domain name=Peptidase_M17_N; Domain location=19-147; Score=154.9; E_value=2.2e-43; Accession=PF02789.8; Description =Cytosol aminopeptidase family, N-terminal domain
  Pfam module annotation: Pfam domain module=Peptidase_M17::Peptidase _M17_N; Domain location=184-357::19-147
MEFSVKSGSPEKQRSACIVVGVFEPRRLSPIAEQLDKISDGYISALLRRGELEGKVGQTLLLHHVPNILSERILLIGCGKERELDERQYKQVIQKTINTLNDTGSMEAVCFLTELHVKGRNTYWKVRQAVETAKETLYTFDQLKSNKVEPRRPLRKMVFNVPTRRELTSGERAIQHGLAVASGIKAAKDLGNMPPNICNAGYLASQARQLADAFSTHITTRVIGEQQMKELGMNAYLAVGAGSQNESKMSVMEYKGNPNPDAKPIVLVGKGLTFDSGGISIKPADGMDEMKYDMCGAATVYGVMRVVAELNLPLNVIGVLAGCENMPGGRAYRPGDVLTTMSGQTVEVLYTDAEGRL

SEQ ID NO: 177398 - protein, 152 aa, Glycine max
  Coding DNA Sequence Number=SeqID_85713
  Pfam annotation: Domain name=zf-CCHC; Domain location=83-100; Score =21.5; E_value=0.00084; Accession=PF00098.14; Description=Zinc knuckle
MREKERKPQEANINLPYFHGKDNVEANLDWEIRIEQQLKRKSTSKSYGSHSYPKKDQGQGILGGKTIEKQPLKASREEKTSFMKCFKCLGRGHITSQCPTKKIMIMRGQDIYSSQDEATSSPSSSESEEAKREESSEEIYPQEEEQPLMVKE

SEQ ID NO: 177399 - protein, 73 aa, Glycine max
  Coding DNA Sequence Number=SeqID_85714
  Subcellular localization annotation: CTP_CleavageSite=69; ConfidenceScore=5.20e-01
MAKIHHQAWPTKTYHPMKHTLPHTYSQNNSKAPKFLKSRAYKNKIPKSSPNMHVKQEVSTRVKPRLLCKQSMG

SEQ ID NO: 177400 - protein, 57 aa, Glycine max
  Coding DNA Sequence Number=SeqID_85715
YCHHQKEGDCRQMIKLYTKDQAESFDDAKGLHESYASQRFTQDKAIRDIQDDNQDSL

SEQ ID NO: 177401 - protein, 188 aa, Glycine max
  Coding DNA Sequence Number=SeqID_85716
MVIDQSFFHDLTQLSSDGVPFEGTLNDDWKFDFSAHDARQLVCTNNADMTGRLLVGSLAFESRILHYLIVRILLPRSSNLAQRSFLIGAAVIASFGYRKEHDGSWVKKGAQPADEEGNLPVEDNSTLLRRLMDKFDGLQTFVGDKFDAMELQVDMRFNAMESRITKVEEDVSFIRTCFDPPPPPPSSS

SEQ ID NO: 177402 - protein, 63 aa, Glycine max
  Coding DNA Sequence Number=SeqID_85717
MTRHTTQWGDQSGSRCFARMLQPCGIDIGLKKHSNRVTPKAYTPKSPLGPLPPDSGPTQTKNI

SEQ ID NO: 177403 - protein, 296 aa, Glycine max
  Coding DNA Sequence Number=SeqID_85718
MAMFDPEIVLEFYANAWPTEEGVRDMRSWVRGQWIPFDADAISQLLGYPMVLEEGQECEYGQRRNRSDGFDEEAIAQLLCIPGQDFARTAAGRRVRIMRTNMTTLTQIWMTLLLSNILPTDHNSDLPMPKCQLGMAPTRHPLDPDKSNRALGFPALITGLCQSFGVPVAPTKRQAQGDAPQAAGAPPPPHQAGQAGAFDIEQYLRHLVRQQAANHRAHVRTHDCLYQMSLSMQSQGFASFSCPTPDQFRAEVAWPGDWPEAQAGEAPPEAPGDGEEAHEDEEMADLLDFLGGSGDT

SEQ ID NO: 177404 - protein, 58 aa, Glycine max
  Coding DNA Sequence Number=SeqID_85719
MGRLGVHDKTHHKMTMSGLKEHSNRVTPKAYTPRSLPGPLPPDSDPTPKIIFASRHCS

SEQ ID NO: 177405 - protein, 119 aa, Glycine max
  Coding DNA Sequence Number=SeqID_85720
MFQSRDHFIGASVIASFGYIKEHDGSWVKKGARNIGEEGHEGEDSSLLSKILERFDGLQTFVGESNHQNDTVRDFFGSKSSHDPESKMFKGVLMITMMTTKDNDKGDEQKAQKIKEQLK

SEQ ID NO: 177406 - protein, 99 aa, Glycine max
  Coding DNA Sequence Number=SeqID_85721
MTNYYPSDLPPSIGVPRGSQGAVLKKVLHRIVVQSSNFLDPGIKFPPQRHYFMTREKKVGCRFNLTLAEGVEVILKDNLPPNKVFLRWKPIPEKSPSKS

SEQ ID NO: 177407 - protein, 109 aa, Glycine max
  Coding DNA Sequence Number=SeqID_85722
MNDPNTPNCSEIYNIITVDERSLYLKMHNFGFDKLGIEEVIESFPLLHFQTLLRTKNEKESLSHEIRGLRFAAGARGGSDNKMEGTMGVAEAHDEGIPANAARATDDDD

SEQ ID NO: 177408 - protein, 62 aa, Glycine max
  Coding DNA Sequence Number=SeqID_85723
  Subcellular localization annotation: CTP_CleavageSite=42; ConfidenceScore=5.06e-01
MDAFYTDALVSFISQQKNTHPSESSQFTRLMVQQRHSLIMVPCKEYQASAIVQWQKARVWNL

SEQ ID NO: 177409 - protein, 83 aa, Glycine max
  Coding DNA Sequence Number=SeqID_85724
MVEACVESTSKDKKESSSDATRNPWGSLALAFGHDHTSYEVYVMGRGCLGALIGPWSLALTFDRDHSSYDTGNRVTVAKCTLY

SEQ ID NO: 177410 - protein, 36 aa, Glycine max
  Coding DNA Sequence Number=SeqID_85725
MGAWHWPGDKINNQCLEDGIHAIANAGNPPKRSLNA

SEQ ID NO: 177411 - protein, 204 aa, Glycine max
  Coding DNA Sequence Number=SeqID_85726
MERSMIDAASGGALGDMTPAEARNLIEKMASKSQQFSAKSDAIVIRGVHKVATNSSSSAETKKLEGKLDALVNLVTQLAMNQKFVPVARLCGLCSFTDHHTDLCPSVQQSEAIEQPEAYAANIYNRPPQPQQQNQPQQNNYDLSSNRPYVPPPIQQQQQQQQLPQKQQTIEAPPQPSLEELVRQMTMQNMQFQQETKEKNPVIV

SEQ ID NO: 177412 - protein, 124 aa, Glycine max
  Coding DNA Sequence Number=SeqID_85727
  Gene Ontology: Mol. function=receptor activity; Cellular component =mitochondrion
  Homolog annotation: Hit_ID=A7QN13; Match level="QueryCoverage=65%, HitCoverage=22%, E-value=2e-25, Identity=64%"; Hit description =Chromosome undetermined scaffold_129, whole genome shotgun sequence
MEKTLHWLVLIATSTVKAHHGFGWVGEWARIGSELNKKTMKADVMRIETLHHADKDKVKNYILELLIWLHRLAIKSKDGIDTRETRDVHDYQCFLECMQFNDTQSCKLGSCNKGSNLNVFSLPF

SEQ ID NO: 177413 - protein, 103 aa, Glycine max
  Coding DNA Sequence Number=SeqID_85728
MWQEYERDQWGPDPRRKRTTKGRPVSTRIPTEMDKDENERASRKKCGLCRQHDHSRNNCPNEGGKSGCQNPTSVNATKSGVVWKLIPKVVYFKQILKREGAVW

SEQ ID NO: 177414 - protein, 128 aa, Glycine max
  Coding DNA Sequence Number=SeqID_85729
  Subcellular localization annotation: CTP_CleavageSite=31; ConfidenceScore=5.12e-01
MGQMATQLNQAQSQNSDKLPSQTVQNLKNVSAITLRSGKQIEVPPPIVAPAPKHVKLHSTPKKEDELAAQKRKLPDHEGANKNFHPGGPSSSSSELQQPPIPLPFPSRAILNKRWKKWVRRSWRPSGK

SEQ ID NO: 177415 - protein, 81 aa, Glycine max
  Coding DNA Sequence Number=SeqID_85730
MFLNDTKSEKELMNGLVEDDAKDKELKVAGTVEDDVTSDNKLEATSSPFANEPNVTHSLENDANIRFLMKRTTKDESVWSA

SEQ ID NO: 177416 - protein, 33 aa, Glycine max
  Coding DNA Sequence Number=SeqID_85731
MEKNEETTMEEKVKLKINEAEDKGEEVRGGAIH

SEQ ID NO: 177417 - protein, 109 aa, Glycine max
  Coding DNA Sequence Number=SeqID_85732
  Subcellular localization annotation: CTP_CleavageSite=52; ConfidenceScore=5.26e-01
MDKSMIGAASGGTLMDKTHVVAKQLISNMATNYQQFGTIVVVLSRVVANEVSISMVVDNQRLENKLIELASLMRQLAIGQHQNMMTTNQPRLCGIYCASDHPTDACSTL

SEQ ID NO: 177418 - protein, 115 aa, Glycine max
  Coding DNA Sequence Number=SeqID_85733
  Homolog annotation: Hit_ID=A5BP71; Match level="QueryCoverage=65%, HitCoverage=19%, E-value=6e-11, Identity=45%"; Hit description =Putative uncharacterized protein
  Pfam annotation: Domain name=zf-CCHC; Domain location=88-105; Score =18.2; E_value=0.0027; Accession=PF00098.14; Description=Zinc knuckle
MAIIVNAEACGYMSMNYYQYIDVVYTNEHILKAYSAQWWPLGNEAAIPPSDDAWTLIPDPTTIRAKGRPKSTRIRNEMDWLEPSDHRQKCSRCGVEGHNRRRCPMQSDRGSNSFN

SEQ ID NO: 177419 - protein, 100 aa, Glycine max
  Coding DNA Sequence Number=SeqID_85734
MTHHNFQVQAIGLFAQATCALEFGLPRPFNQRLLVLHVGGGAIKQRGQPFPCVQESSTTRDPRSLNPFSEIRRREEEISLKRDSLYNEDQSKFLIEYASG

SEQ ID NO: 177420 - protein, 154 aa, Glycine max
  Coding DNA Sequence Number=SeqID_85735
MAEKTKKRLEEAAQSRSTEDVIDPSSPIRRHVKLKMARTKKTGQMMSEAAKEITEKIDVLTAAIGRPEHPGRVRATGAGVTIKQYFGSAPRTSRSSSSMPPEDLQQLTQQIRDQLEELITEKVTRQLMVSFSQMQSQFQSQMQSQGLALPPEPE

SEQ ID NO: 177421 - protein, 110 aa, Glycine max
  Coding DNA Sequence Number=SeqID_85736
MGKAEEMQEKVKADMEAMKEQMVAMMEAMMSMKKIMEANAVAIAATSVVAKVNLMSPSGINQMNRPTSDMVGKDLGSTDGPHDVQNQNKHAFPPYGLPLNYTPPNVAYTP

SEQ ID NO: 177422 - protein, 72 aa, Glycine max
  Coding DNA Sequence Number=SeqID_85737
  Subcellular localization annotation: CTP_CleavageSite=66; ConfidenceScore=5.03e-01
GLVGSCVLSTTLARLAHISEFRLSAHLFAQRMDSSSALSGISPRSVNMHSSSFFQILPHAQPEECCAQRMAR

SEQ ID NO: 177423 - protein, 87 aa, Glycine max
  Coding DNA Sequence Number=SeqID_85738
PRPTWALRGNIPPEGGCFWRKATLLAWASWAATTSPYFAINRGGRQEGRAEALPKRFRNVFREEFRKGFNRSSTFFIRSSSFFDLQR

SEQ ID NO: 177424 - protein, 78 aa, Glycine max
  Coding DNA Sequence Number=SeqID_85739
MTIICLCVPSDTTVSEWQKVCGMTIICRMSHDLRVRITVRCLRGLPALGHGNKKRCGRQSEAFAPTYPPMRNSDLRSS

SEQ ID NO: 177425 - protein, 203 aa, Glycine max
  Coding DNA Sequence Number=SeqID_85740
  Homolog annotation: Hit_ID=A5BUF0; Match level="QueryCoverage=90%, HitCoverage=49%, E-value=3e-07, Identity=29%"; Hit description =Putative uncharacterized protein
MTLKLPYYPELVRAFYNNLEIHEGVIFSKVNKIQIVVDHSLFYSLTKLSSQGVPFEGTLVDDWKPIYSSHDARKMVCVANADITSHLLVGSFTFECRIMYYILYCVLLPRSTNLAQSFEEYLILMWALQTGHQIDWAHLVCYRMHKALWTNAPLPYLHLVTLFMKHLKVLLTNEPFVKVKHSFAIGATTVASFGYKKDLDGQW

SEQ ID NO: 177426 - protein, 73 aa, Glycine max
  Coding DNA Sequence Number=SeqID_85741
GEACRPARPGELSSPKRARLLPPEATAFWRNLLEGPSGPAFEEVTETYGLRKNTSFRLPPHYGISRIAQACFL

SEQ ID NO: 177427 - protein, 54 aa, Glycine max
  Coding DNA Sequence Number=SeqID_85742
MKKNSVALSTAEAEYISADTKNQLSDIFTKPLPIDSIYAIRRELGLLDASDLDK

SEQ ID NO: 177428 - protein, 230 aa, Glycine max
  Coding DNA Sequence Number=SeqID_85743
  Gene Ontology: Mol. function=4 iron, 4 sulfur cluster binding; Cellular component=integral to membrane; Biological process=protein -chromophore linkage
  Homolog annotation: Hit_ID=P56766; Match level="QueryCoverage=98%, HitCoverage=30%, E-value=1e-113, Identity=85%"; Hit description =Photosystem I P700 chlorophyll a apoprotein A1
  Pfam annotation: Domain name=PsaA_PsaB; Domain location=1-230; Score=- 148.0; E_value=0.00032; Accession=PF00223.10; Description=Photosystem I psaApsaB protein
MLNHHLTGLLGLGSLSWAGHQIHVSLPINQFLNAAVDPKEIPLPHEFILNRDLLAQLYPSFAEGATPFFTLNWSKYAEFLTFRGGLDPVTGGLWLTDIIHHHLAIAILFLIAGHMYRTNWGIGHSIKDILEAHKGPFTGQGHKGLYEILTTSWHAQLSINLAMLGSLTIVVAHHMYSMPPYPYLATDYGTQLSLFTHHMWIGGFLIVGAAAHAAIFMVRDYDPTIRYTIY

SEQ ID NO: 177429 - protein, 298 aa, Glycine max
  Coding DNA Sequence Number=SeqID_85744
  Gene Ontology: Mol. function=hydrolase activity, acting on glycosyl bonds; Cellular component=flagellin-based flagellum; Biological process=peptidoglycan catabolic process
  Homolog annotation: Hit_ID=A8GG23; Match level="QueryCoverage=100%, HitCoverage=94%, E-value=1e-142, Identity=85%"; Hit description =Flagellar rod assembly protein/muramidase FlgJ
  Pfam annotation: Domain name=Glucosaminidase; Domain location=141 -281; Score=205.9; E_value=1e-58; Accession=PF01832.11; Description =Mannosyl-glycoprotein endo-beta-N-ace
ALNGLKRDAAADPQGNLKQVAQQVEGMFVQMMLKSMRSALPQDGVLSSDQTRLYTSMYDQQIAQQMSQKGLGLADMMVKQMSNANAVPSETAGLSPMALDNEVLQTLPNQALEQMVRRAMPKAPPAAAPLSLNNGNFVARLSIPAKVASQQSGIPHQLIVAQAALESGWGQREIPTSDGTPSYNLFGIKAGGSWNGPVTEITTTEFEQGAAKKVKAKFRVYGSYVEAIADYVKLLTNNPRYADVAAARSPEQAAHALQRAGYATDPQYASKLVSVIQQMKSAGEQAVKAYTHDLNELF

SEQ ID NO: 177430 - protein, 411 aa, Glycine max
  Coding DNA Sequence Number=SeqID_85745
  Gene Ontology: Mol. function=motor activity; Cellular component =flagellin-based flagellum basal body; Biological process=ciliary or flagellar motility
  Homolog annotation: Hit_ID=A1JSW7; Match level="QueryCoverage=79%, HitCoverage=97%, E-value=1e-175, Identity=92%"; Hit description =Flagellar motor switch protein FliM
  Pfam annotation: Domain name=FliM; Domain location=37-230; Score =369.1; E_value=7e-108; Accession=PF02154.6; Description=Flagellar motor switch protein FliM
MGDSILSQAEIDALLNGDSAGDEPEAIVGKESEVKPYDPTTQRRVVRERLHALEIINKRFARQFRMGLFNLLRRSPDITVGPINIQPYHEFARNLPVPTNLNLVHLNPLRGTALFVFAPSLVFIAVDNLFGGDGRFPTKVEGREFTPTEQRVIKRMLRLALDAYGDAWSAIYKIDVEYVRAEMQVKFTNITTSPNDIVVTTPFQVEIGALTGEFNICIPFAMIEPLRELLTNPPLENSRQEDSHWRETLVKQVQHSELELIANFVDIPMRLSKVLKLQPGDVLPIDKPERLIAHVDGVPVLTSQYGTLNGQYALRVEHLINPILNALTVFREVRREHRRGVQVAGSSGCARQPAGYRPDPGYSGQADRGTRAHQDDHQRAAAPVARLGGGAGRPGRRAAGHPDQRLPDRTR

SEQ ID NO: 177431 - protein, 18 aa, Glycine max
  Coding DNA Sequence Number=SeqID_85746
MGRRLQKDWTRDAGEGPR

SEQ ID NO: 177432 - protein, 171 aa, Glycine max
  Coding DNA Sequence Number=SeqID_85747
  Gene Ontology: Mol. function=DNA-(apurinic or apyrimidinic site) lyase activity; Cellular component=intracellular; Biological process= base-excision repair
  Homolog annotation: Hit_ID=P0AB84; Match level="QueryCoverage=96%, HitCoverage=78%, E-value=8e-80, Identity=90%"; Hit description =Endonuclease III (EC 4.2.99.18) (DNA-(apurinic or apyrimidinic site) lyase)
  Pfam annotation: Domain name=HHH; Domain location=99-128; Score=28.7; E_value=2.2e-05; Accession=PF00633.14; Description=Helix-hairpin -helix motif
  Pfam annotation: Domain name=HhH-GPD; Domain location=34-169; Score =64.7; E_value=3.1e-16; Accession=PF00730.16; Description=HhH-GPD superfamily base excision DNA repair protein
  Pfam module annotation: Pfam domain module=HHH::HhH-GPD; Domain location=99-128::34-169
MNKEKRIAILTRLRDENPHPTTELNFTSPFELLIAVLLSAQATDVSVNKATALLYPVANTPKAMLELGVEGVKSYIKTIGLFNSKAENVIKTCRILLEQHGGEVPEDRAALEALPGVGRKTANVVLNTAFGWPTIAVDTHIFRVSNRTNFAPGKNVEQVEEKAVKSGTCRI

SEQ ID NO: 177433 - protein, 179 aa, Glycine max
  Coding DNA Sequence Number=SeqID_85748
MGEVEEVQEQMKADTEALKEQMAIMMEAMMSIKEIMEVNVAAIAATSTIVEVDLTPPYGLNQINHPTFVGERIKVGQEKGKSDHPAMMNAKTRANEEDENEGEALAMTAIPTRSNLSSTQQCHYSANNSPSHPIIHKSHPQISHKASITPARVPQPHFSEDTTRTQHVHTHGGVPGHFH

SEQ ID NO: 177434 - protein, 34 aa, Glycine max
  Coding DNA Sequence Number=SeqID_85749
MSVKNLVGRLGVHDKTNHTLAYTLKSSSRPLPPD

SEQ ID NO: 177435 - protein, 188 aa, Glycine max
  Coding DNA Sequence Number=SeqID_85750
MTTLTQMWMTLLLSNVLPTDHNFDLPLPKCQLVYAILTRMSVHVAQLIADAIYLFAGMPPTRHLLDPDKSNRALGFPALITGLCQLFGVPVTPSKYCTPRQAQGDGPQAADAPPPPHQADPARSLGMERYLQHLVRQQAANHQGQMQIHESLYQLSLSQQGQGFIPFGCPTPDQFRAEVAWPGYWPEA

SEQ ID NO: 177436 - protein, 26 aa, Glycine max
  Coding DNA Sequence Number=SeqID_85751
VLREGAQSMKNQGGRNDAILPRKGIG

SEQ ID NO: 177437 - protein, 39 aa, Glycine max
  Coding DNA Sequence Number=SeqID_85752
  Homolog annotation: Hit_ID=Q2HW89; Match level="QueryCoverage=100%, HitCoverage=3%, E-value=4e-07, Identity=64%"; Hit description =Integrase, catalytic region; Ribonuclease H
MEALLSFEVEVPSQRIMAESGLEESEWAQARYDQLNLIE

SEQ ID NO: 177438 - protein, 248 aa, Glycine max
  Coding DNA Sequence Number=SeqID_85753
  Homolog annotation: Hit_ID=Q6WAY6; Match level="QueryCoverage=86%, HitCoverage=33%, E-value=5e-08, Identity=26%"; Hit description =Putative uncharacterized protein
FPSVPLMGMMGCINYNLVLSIRQLGYSMRGAPSEESTTSFIARGFSDPNAKTLQRVRKACNAVQRKDKELRGSSNGIISSYYKWLKARTQEMNWLLRLKISSKEEVETLEESEEVQALKANLERTQVVKEKFKTKAIKVRKECDELRDGLYGAATANSSFEGPKETSQELKYKLKLNLATTHEQRLEDEYAKVSVLQAEREARERVIDSLHREAIMWMDRFAFTLNGSQELPRLLAKAMANVYSAPKE

SEQ ID NO: 177439 - protein, 73 aa, Glycine max
  Coding DNA Sequence Number=SeqID_85754
MVKVGTSSCRQRLHLSGQKLSQGFPVKMQNTGQPGFDLEELVFEVMRRLQAKLKGQVLVTALLQASYLGSKSW

SEQ ID NO: 177440 - protein, 109 aa, Glycine max
  Coding DNA Sequence Number=SeqID_85755
  Subcellular localization annotation: CTP_CleavageSite=25; ConfidenceScore=5.61e-01
MVFLVGNLALGISACSFSLFLFSARQKSRWRTRVWLHICSLTVNGSSFLRRSFCSFFWGPGQNFPSWIKAGGRVEILALRACRKAGHDVCQGIGLASGSGIRGCPTSFP

SEQ ID NO: 177441 - protein, 374 aa, Glycine max
  Coding DNA Sequence Number=SeqID_85756
MEGFSGSGSTSHDGKGDDHHDSGHTPVFYYEKLVGYMPSSIVDLVFEGERIEHKQQKIRADWGKEERRGCSRRNLGSCLANTPINPSQYSLVCLAPSELFGPGRKILQLDTCPAKDICPTIKSPRSSPDSCKASSCRQFQSWHKFQFGEEPSSEEASGVHPDSDTNSLANHRGPAVNVVEASGLQRPKQMKDVVTSRRFIFEALQEASIVSFDEHKGDSCLMHPGALHDMKTCSTAEELLQQMMSADKESPARPKPLVIHFTRDVASQKPRGPHSVSGSKPVPFPYRSNKAVSWRYSPQKPSETKEEATDTDLPFAKVTNIIGLSGVTYSDCVFVAPEPSVRPTDAKGKEKVVTEETNEASPILDEDVPTGRFA

SEQ ID NO: 177442 - protein, 74 aa, Glycine max
  Coding DNA Sequence Number=SeqID_85757
MQIEEPSSHQTTPQPSHHPTPPSSHQPTPVESFIGTVECPNNEPMQQPPNIEVDDRGASSTKTGEGRLKSIMWN

SEQ ID NO: 177443 - protein, 217 aa, Glycine max
  Coding DNA Sequence Number=SeqID_85758
MDLLFTTTVVFPFKLPLQFSFEYLTGNQFRFQCMQLKDDADVNTMLMCNHEFSFVGPIELLCSIARTPDDILNLLETTMTPTHDALLYYNGRWNMSRQNEFVGYSFTGKNPKNFDIPTGCTLDELKDLIKQVAPRGIPPYGVDETQMVRRLFFRKPSHHEYSEKVIKFEIIELKTNEDVMKVLIESNYWKKIGPIEILAVFSKPILQMEDELSLLQN

SEQ ID NO: 177444 - protein, 195 aa, Glycine max
  Coding DNA Sequence Number=SeqID_85759
ALWGSNNKLKLQRAKRDQSRVEGMILEDKLKACQRLEDEYAKVSVLQVEREARERVIDSLHREAMMWMDRFAFTLNGSQELPRLLAKAKAMADVYSAPEEVQEQMKADMEALKDQMASMMEAMLSMKRMMESNATTIVTAEADPTHPSAINQAHQPISDMVRQGGEVLAASTIHTWGIIGTLTPMAYPPIIRRPP

SEQ ID NO: 177445 - protein, 64 aa, Glycine max
  Coding DNA Sequence Number=SeqID_85760
MFKIESRTLQGSRGNLISRIKNQESKFKVQASKKQDQDSRIKRRLNQDKYEKVIDYQNIVIDYQ

SEQ ID NO: 177446 - protein, 117 aa, Glycine max
  Coding DNA Sequence Number=SeqID_85761
  Homolog annotation: Hit_ID=Q2HW90; Match level="QueryCoverage=84%, HitCoverage=19%, E-value=2e-10, Identity=37%"; Hit description =Putative uncharacterized protein
MDLCGLVNDGDKSKRQKIYQVKVKGLDVTSLKELGRLMGPLQRQAFRKVYGKILDLTAAQVFTEAVVSLAQYYDQPLRCFTFGDFQMVPTVEEFEEILGCPFRGRKPYLFSGFLPSL

SEQ ID NO: 177447 - protein, 162 aa, Glycine max
  Coding DNA Sequence Number=SeqID_85762
MKKKKTESRRDEDENIQSKNGPLRRVHLLGLLTENKRGYISCGSVLVEGTSTRLFKENKGRYIPYGSLLVKEFYKVEKKSQGPQVAWGLDVGTSCCRTSIKTLGAEPLLLNLPRPFIAKIGEELAAQLAQASWWLSSEATCSPWRASCFMLKLPNGPRWPHD

SEQ ID NO: 177448 - protein, 140 aa, Glycine max
  Coding DNA Sequence Number=SeqID_85763
MRSQASGFDEEAIAQLLCILGQDFAWTAAGRWVLIMRTNMTTLTQIWMTLLLSNILPSDYNSNLPLPKCLCQFYGVPFAPSKSQDPSPFPWPTPEQFKATVAWPGDKTYFETRVGPAEASGGGDEAQEDEDMADMLDFLL

SEQ ID NO: 177449 - protein, 56 aa, Glycine max
  Coding DNA Sequence Number=SeqID_85764
MTCPHAIELDCLWWRMAMIGLHPSSNLLSLDDEGADNHKVSLHTIGLDCLLIAKCV

SEQ ID NO: 177450 - protein, 79 aa, Glycine max
  Coding DNA Sequence Number=SeqID_85765
DEYHDHQQRRGVEEGCQGGQAQVAEGVARVGLALGEVHRHQRHQQRGGIGQHVAGVGQQRQRAGQQAADHLGHHKDGGD

SEQ ID NO: 177451 - protein, 407 aa, Glycine max
  Coding DNA Sequence Number=SeqID_85766
  Gene Ontology: Mol. function=metalloendopeptidase activity; Cellular component=membrane; Biological process=proteolysis
  Homolog annotation: Hit_ID=A4TQM9; Match level="QueryCoverage=84%, HitCoverage=100%, E-value=1e-117, Identity=63%"; Hit description=M48 peptidase family protein
  Pfam annotation: Domain name=Peptidase_M48; Domain location=235-406; Score=53.3; E_value=8.6e-13; Accession=PF01435.9; Description =Peptidase family M48
STLEDPPNAAVYGAVDHQYPDHPVLARFRRAGGGSAPRPKPPTARWPKKRCRRWIWAAASEAPMILEGAYQLPGRAAREAARLLVNESGEGVTLQRQDEQRYIPLADITVSAALGNIPLTLTFKDGARFVPDDDAAFRRWFYQRRSPGWVHRLERHKRGVAVALLMTLLAVVAYVNVVLPWASSEIAMRIPTSVEQTLGEHTQTFLSQSGFEPSALPAERQQALQQLFRQVMPAEMRQERTPLSLKLMAAPGAPNAFMLPDGTLVLSDGLVALSKNDDALAAVMLHEMGHHAYRHPMRMLVRSSLVALTLMWMTGDVSGIGDTLLQSASFVNEMQFSRGMEREADAFAIAEMQRQGRSLAQMAAIYRALAQAPERETADGWALPAWLSTHPAMQERLDAVNEAMAQQ

SEQ ID NO: 177452 - protein, 149 aa, Glycine max
  Coding DNA Sequence Number=SeqID_85767
MRGAAIAAPRLQPAVRLRPLGMVRAVRQELALQRHAGMSCSAGASVNTLICTCPSADHKWAAGLSSAPQEILQQRFRLAKIHAAAVHRRQIGAWNALGVDGQIAIGEQLQPLGAGVGAGAVQVEIGVVGQVDRAGSIDLLRYLISMRLS

SEQ ID NO: 177453 - protein, 139 aa, Glycine max
  Coding DNA Sequence Number=SeqID_85768
  Homolog annotation: Hit_ID=A8GL18; Match level="QueryCoverage=61%, HitCoverage=15%, E-value=1e-18, Identity=46%"; Hit description=O -antigen polymerase
MAAVGVLAMAVFTWQGRMALTQSERTMLATIDSIEQMPPPAAWIYRERKTFDEQSHALLVYNQTRDDALLTGYRQWANAYLQRRIDANVYATLIMILRYQGAQGGSRRSPAGGRFPVCAGCAIQIGRIKVRAHRSHLPS

SEQ ID NO: 177454 - protein, 241 aa, Glycine max
  Coding DNA Sequence Number=SeqID_85769
MSLHSSSSVNGEGSTPKDPLYKILDELRSLKLWKEKQERKEKGKKRAKEISQDEKEKIREDERRKILKELRKEKHASYSSHNSCKSLSEELRDYYEGRHRGYYFILRLESKEAKGEESSEEIYPQEEGKPLMVKESVRDTCSHCERIGRLEFIPQVKELLDEGLVRKSLNPCALLVPKIGIIRHQIPKIGGMMNALGGATLICKITRAPNIFMIYVHRDSLGVPMNPKRLKVIPEWPLHQV

SEQ ID NO: 177455 - protein, 123 aa, Glycine max
  Coding DNA Sequence Number=SeqID_85770
MEFGDITVHFNILDAMKHPSEDLFVFRAEIIDHVVNEYMTDLYSNLHAYHSSCIESEIVLDHMSEFNAESESEIDIYYMSGDVLPLEIDFIESDRTNHVSGSTHTFDFLYEVQAEKPSLSTTI

SEQ ID NO: 177456 - protein, 156 aa, Glycine max
  Coding DNA Sequence Number=SeqID_85771
QTQEHRSLEQTDQWLAPTSGFTRDSPQISASPHQLDLAPYTSEPYNAQWNAPGLLRDKHMLRSSRILGEMEAFSLQNSFLGWCSWFVLKGWAFVDNWAVGKEKVCYWLSNDIVGLVGKLGGIGMAVTARASPSSSPSSFAPTHFDHFAGEDQIRKA

SEQ ID NO: 177457 - protein, 136 aa, Glycine max
  Coding DNA Sequence Number=SeqID_85772
  Subcellular localization annotation: CTP_CleavageSite=59; ConfidenceScore=5.72e-01
MAAKSTKPSMFGKRTTPKINKASISANGPHFSWLAISLALPSKYFRGRPTTPLQVCFMRSNSLAESPTTAATLLKEGRNPEKRYGFLPPRGHPSISSNSSIVVPFGSPKHEAPQRWVIVLDEGYDSLRKYLHRGQI

SEQ ID NO: 177458 - protein, 282 aa, Glycine max
  Coding DNA Sequence Number=SeqID_85773
  Homolog annotation: Hit_ID=Q5QJQ3; Match level="QueryCoverage=37%, HitCoverage=82%, E-value=7e-57, Identity=100%"; Hit description =Putative uncharacterized protein
VDSRGSPEAGARGRRALGLMASGATCVQRLDGSRDSAIHTKYRISLRSSSMQEPRYPLPRVIVSPGFVFVARTRRPGARGRRGHPLPPDGSVDFSQRRGQRTAHVAAIRTLSPDHSIGRSDGGVPSSNRNHGSAPLTSITKIDAQVRGGETRQDYKDTRRFPLEAPSCALLFRPCRLPDTCPPFSLREAWRFLIAHAVGISVRCRSFAPSWAVCTNPPFSPTAAPYPVTIVLSPTRISRARYVGGATEFLKWWPNYGYTRRTVFGICALLKPVTFGKRVGSS

SEQ ID NO: 177459 - protein, 190 aa, Glycine max
  Coding DNA Sequence Number=SeqID_85774
MPTGRKEAISPSRFYPSTTRVAKVVKISAQELDQVKQNRNGVVGVPRKCWRKGQRPWKIKANGLSFIDILELLIFGVVLFPNMEGLVDLAVIDAFLAFHHGKESPVVAILAMYDTFDRGCEKSGARIVCCALALYVWLVSHLFLQQGRPVYPLQRHRSRVEQGKANWDQLLASMEGRLLICSLARRKEES

SEQ ID NO: 177460 - protein, 98 aa, Glycine max
  Coding DNA Sequence Number=SeqID_85775
  Subcellular localization annotation: CTP_CleavageSite=62; ConfidenceScore=5.28e-01
MTMQNMQFQQETRASIQSLTNQMGQLTTQLNQQQSQNSDRLPSQSVQNPKNVSDITLRSRKQCESKEKQHIPLPFPPRVILNKKMEEAEKEILETFRK

SEQ ID NO: 177461 - protein, 52 aa, Glycine max
  Coding DNA Sequence Number=SeqID_85776
MYCLRRWDAQTKAQHVLSNRGKSHILVLFTLRMARFMLEIDGRVPGTKDIMP

SEQ ID NO: 177462 - protein, 43 aa, Glycine max
  Coding DNA Sequence Number=SeqID_85777
MEVEEPWQGLWLPLHYQVDMGASFLLQNSFLVYAKGGVWALGV

SEQ ID NO: 177463 - protein, 50 aa, Glycine max
  Coding DNA Sequence Number=SeqID_85778
GADNRKGADNRKGADNRKGQYDKDYGAADKSKALAPTYPPMRNLDLRSSG

SEQ ID NO: 177464 - protein, 176 aa, Glycine max
  Coding DNA Sequence Number=SeqID_85779
  Homolog annotation: Hit_ID=A5B3F8; Match level="QueryCoverage=75%, HitCoverage=20%, E-value=2e-07, Identity=31%"; Hit description =Putative uncharacterized protein
MTRGNPGDLQPFDPEIDRTFHRLVRHNVHLDHFEHFEHSVAGDSKHSDFEHSTANFHTENMAQSPPRERTLREMVAPDFTYESLCIQYLDEDVSYVLKTGLINLLPKFHGLAGEDPQKHLKEFHIVSSTMKPPDVQEDHIFLKAFPHSLEGVAKDFLYYLLLGPLLAGMTLRGCSG

SEQ ID NO: 177465 - protein, 141 aa, Glycine max
  Coding DNA Sequence Number=SeqID_85780
MHKALRANEPLPYPQLVTLFLCHFQIPLYDEPFVQVKRPFAIGAGVVTSFGYHKDRDGQWLKKDALPQQDEHTPSPPPQRDDSSALMNEVLSELRGLCTYVGERFDSLDGRFEGMDTCITQLEEDVTYLRRCFDLPPPSKS

SEQ ID NO: 177466 - protein, 368 aa, Glycine max
  Coding DNA Sequence Number=SeqID_85781
  Homolog annotation: Hit_ID=A5B5V0; Match level="QueryCoverage=70%, HitCoverage=57%, E-value=2e-14, Identity=25%"; Hit description =Putative uncharacterized protein
  Subcellular localization annotation: CTP_CleavageSite=32; ConfidenceScore=5.04e-01
MAEPSKKRKGTSSRSHRHSGSQEAPIPSSIPSGSLFSSEEQSIRYTNLFSSHSIVDPKFIDMEFFSNENFECFQAFGKSNLIPFMSLRLPVYSELVKAFYSNLEIHEGTLMFEVYGIKMVIDQSLFYDLTKLPSEGVPFEGALIDEWKFDFSVHDARRLVCTNQADMTGRLLAGSLAFECRILHYLIVCILLPRSSNLAQVSKEDLIVMWAFHKGLQIDWAHLVRYRMHKALGLNAPLPYPHLVTLFLQHFNIPLDSEPYVPIKRSFLIGASVIASFGYIKEHDGSWVKKGARNISEEGHEGEDSSLLSKILERFDGLQTFVGERFDTLELQVDMRFNEMESRMTRVEEDVSYIRSSFDLPPPSPPSS

SEQ ID NO: 177467 - protein, 132 aa, Glycine max
  Coding DNA Sequence Number=SeqID_85782
MGEVEEIQEKIKADMEAMKEQMATMMAMMSMRKIIEANAVTIAATSIVAKVNPMPPSGLNQMNHPTLDMVGKDLGSRGGPHYAQNEHAFPPYGLPLNYTPPNVAYTPNDDVNNSTPIPIESQQPQTDHAYVS

SEQ ID NO: 177468 - protein, 108 aa, Glycine max
  Coding DNA Sequence Number=SeqID_85783
  Subcellular localization annotation: CTP_CleavageSite=12; ConfidenceScore=5.00e-01
MLVRMIRTRLFAAARVKSCPGMHSSCVIASLSGCARTVGPPPISGGVDVEHTEMRTRSPLKVRACSPLKARICSPLEVRACSPLMVRTCSPLKVRACSPLTVRVTSTQ

SEQ ID NO: 177469 - protein, 75 aa, Glycine max
  Coding DNA Sequence Number=SeqID_85784
MENGVTRVNTIPYHQLTVFHCHTKFRMSIHQAGKNILHYKLHNDRWRKQVRHNKQFGLPHQCLSFILSGFQDVEL

SEQ ID NO: 177470 - protein, 107 aa, Glycine max
  Coding DNA Sequence Number=SeqID_85785
  Pfam annotation: Domain name=RVT_2; Domain location=1-103; Score= -175.8; E_value=0.004; Accession=PF07727.5; Description=Reverse transcriptase (RNA-dependent DNA pol
MNTVRIILSSPLALVWKLCQLDVKSSQGELGKMYMEILPGYGFDNGGNKVCKLRKKILKKSAAQFEMNDLGKLKYFLGVEREGQLALEVYTDVDYVRSIVDRRSTSG

SEQ ID NO: 177471 - protein, 185 aa, Glycine max
  Coding DNA Sequence Number=SeqID_85786
MGCYRRQTIDMVLMDQMNIKVVDNQYEYKTTSVKEVERLEITANVRIITEIVDIISSIAPRHTLVDVVGVVAEVIERKTVNPAYRVMVKLRDNSDAEIIMTLWEDYVLQLDDAIEKNHFVREPLVLMLTLAKIKDAKDKYPLSVQNIKNGSKLYVNADIAEIKKFRNSLRVPFYVGGVTDEGSGS

SEQ ID NO: 177472 - protein, 119 aa, Glycine max
  Coding DNA Sequence Number=SeqID_85787
LVPTQQHATQHGQIPKFFWNLTAKLIIAEVEFVDVGGDLARELVADEVQDAEGGKRCDSSGDLLDNVFPISDDEGGEVEVGVGDAAGGGVAADAVQIEAVVGARPRVEEANVGLVQCLF

SEQ ID NO: 177473 - protein, 120 aa, Glycine max
  Coding DNA Sequence Number=SeqID_85788
  Gene Ontology: Mol. function=helicase activity; Biological process =viral genome replication
  Homolog annotation: Hit_ID=A2Q378; Match level="QueryCoverage=99%, HitCoverage=7%, E-value=2e-26, Identity=47%"; Hit description =Putative uncharacterized protein
  Pfam annotation: Domain name=DUF889; Domain location=1-120; Score= -30.9; E_value=2.2e-09; Accession=PF05970.5; Description=Eukaryotic protein of unknown function (DUF889)
MRLQSIPFDQANSDELKQFSDWLLDIGDGKLGQPNDGYNEITIPEEFLIMDFDDPIQEIVDATYPDLLKNYNNEHFLQKRAILASTKDVVDKINDYVLSLVPSEEKEYCSVDSVDKYDEL

SEQ ID NO: 177474 - protein, 80 aa, Glycine max
  Coding DNA Sequence Number=SeqID_85789
MDIEEDAEIPLILGRLFMLTTNFVVDMGKDNLEMSVDDLKVTINPFDVVKHSIDQNVCSKMENIENETTQIARAKVLQDP

SEQ ID NO: 177475 - protein, 106 aa, Glycine max
  Coding DNA Sequence Number=SeqID_85790
  Subcellular localization annotation: CTP_CleavageSite=24; ConfidenceScore=5.36e-01
MHKIPKIRGKRVFSLSFLDPSSPRLASGSRGPANYFKVKEPARLGELVTSGVSINSPRRAAISPSAHFPINRRAWEAEGRFQGLEVERIERRRRKKRKRSGGAAES

SEQ ID NO: 177476 - protein, 16 aa, Glycine max
  Coding DNA Sequence Number=SeqID_85791
MADMTVQVNTSWAFCQ

SEQ ID NO: 177477 - protein, 136 aa, Glycine max
  Coding DNA Sequence Number=SeqID_85792
  Homolog annotation: Hit_ID=A7R5Q5; Match level="QueryCoverage=50%, HitCoverage=14%, E-value=1e-07, Identity=42%"; Hit description =Chromosome undetermined scaffold_1022, whole genome shotgun sequence
MLNIGNPSDLQPFDPEIDKTFHRPVRHHLVPFEHPEHFVIGDFEHYCFEHSDFEHFENMAQPPPRERTLREMAAPDFTYESLCIQYPDEDVPYVLKTGLIYLLPKFHGLAGEDPHKHLKEFHIVCSTMKPPDAGIL

SEQ ID NO: 177478 - protein, 287 aa, Glycine max
  Coding DNA Sequence Number=SeqID_85793
MKADMEAMKEQMTTMMEAMMNMRKMMEDNTAIVVDASTSIEMDLIHPTGFNQVNHPVSDVVGQGDEVTKNAYGPHHVQVQSKHSFPPYRLPPNYTSPTVFPKTDHTLAGFGVYPGYTTEGQAFSGIPERIEHMEERLRAIEGGGNYAFVDMAELCLVPDVVIPPKFKESLVGAAITWYTNLEPSRVHSWKDLMDVERFGNSSSAPMMEKEMITMIVDTLPVFYYEKMVGSMPLSFADLVFAGERIEVGLRRRKFDYDATASSSNRRPEMSGGNKNEGETHVVTVVPT

SEQ ID NO: 177479 - protein, 203 aa, Glycine max
  Coding DNA Sequence Number=SeqID_85794
EEIARRRWAPLVTPMAKFDLEIVLEFYANAWPTEEGVREMRSWRRSQADGFDEEAIAQLLCIPGQDFARTAAGRRVRIMRTSMTTLTQIWMTLLLSNVLPSDHNSDLPLPKCQLVYAILTQMSVHVAQKSNRALGFSALITGLCQSYGVPVTPSKVIQPPITRAFIEKYCTPRQAHIRPQAHCHHLSGPTTHGTGGRYMSVST

SEQ ID NO: 177480 - protein, 106 aa, Glycine max
  Coding DNA Sequence Number=SeqID_85795
  Homolog annotation: Hit_ID=A5ZQM3; Match level="QueryCoverage=67%, HitCoverage=99%, E-value=8e-23, Identity=55%"; Hit description =Putative uncharacterized protein
TTGRGTVSGRQFLWGVGLPKVTEACKGFLGPDGDWPSSAKAEGSLTARPTRRAGTKVGLSDPTVPSGRAVAQRIKGWAVRPLKRYVSWVQNVVRQFGPYPVWALEH

SEQ ID NO: 177481 - protein, 180 aa, Glycine max
  Coding DNA Sequence Number=SeqID_85796
MQENGELWTRVLKSKYGGWRNIEETGNSAKQSVSWRDVKHTFNQSQQGMVIQNNMRWKVGDEEKIRFWKDKWINQQESLAESQQQWTSKIASHPNVKTKGRTSVDKWQTRTPQRPTPQCGCSHGNATQFATKTNLGQKEKEEERPGSLKANHNALPKSIPTLSGTFSFPRFLRPAKASKC

SEQ ID NO: 177482 - protein, 173 aa, Glycine max
  Coding DNA Sequence Number=SeqID_85797
  Homolog annotation: Hit_ID=Q6UUU1; Match level="QueryCoverage=34%, HitCoverage=40%, E-value=1e-18, Identity=78%"; Hit description =Putative uncharacterized protein
  Subcellular localization annotation: CTP_CleavageSite=34; ConfidenceScore=5.13e-01
DGCRYKSSLGQGISRAASTPPFDKLPFLGTGPSYCSMGTSIDSAIGKVRHGITLRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 177483 - protein, 78 aa, Glycine max
  Coding DNA Sequence Number=SeqID_85798
MGESRPGSPKENRPHRDKNEKEELIPTRVQNSWIVCIDYRRLNQVDKSGAFAPTYPPLERKSDLRSSFLSVNQVILFT

SEQ ID NO: 177484 - protein, 178 aa, Glycine max
  Coding DNA Sequence Number=SeqID_85799
MASRKHKSIGARPAAQYDTRRFHSLDARNRYTDNALGRSILPEKKVEIYHTEFDDFKTELERCNLHKCLTNLANGTIDVALMKEFYANLYSSEDPSPKQARVRGHLVKIDADSLNTFLETPVVLEEGETLPTYSRYCRLPTDHREIEVVLYIPGQAFILNVEGHPGMILKKDLTTLAQ

SEQ ID NO: 177485 - protein, 51 aa, Glycine max
  Coding DNA Sequence Number=SeqID_85800
MFKIESRTLQDSRGKLKNNSRFKRKVDFKIQGSSFQDSRLNRRLNQDKYEK

SEQ ID NO: 177486 - protein, 110 aa, Glycine max
  Coding DNA Sequence Number=SeqID_85801
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=Q8GEG0; Match level="QueryCoverage=60%, HitCoverage=52%, E-value=1e-26, Identity=89%"; Hit description =Putative uncharacterized protein
MVIDYQRVKTLCESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 177487 - protein, 115 aa, Glycine max
  Coding DNA Sequence Number=SeqID_85802
MGEVEEVQEQMKADIEAMNEQMATMMEAMMSMKKIMEANAVAVAATRAIAKTKIWEVWTAPYYVQIQNEHAFPPYGLPPNYTSPNVAYIPNENVDNSTPIPIKSQQPHTVHAHVS

SEQ ID NO: 177488 - protein, 55 aa, Glycine max
  Coding DNA Sequence Number=SeqID_85803
MTEGCGEGFLPCKPSRVGGAGLWPRAKFRIGWPPPPPRDQFCCQDFANFGLRPVG

SEQ ID NO: 177489 - protein, 121 aa, Glycine max
  Coding DNA Sequence Number=SeqID_85804
APSTPTQARFDKSRFTSQEAWERYTDIVVPRKLLPERNVVVYYTEFDEFKEELERRQWDEELTDFADSNIDVAIMKEFCASLYDPEDKSPKFALLRSDPQELAAKLCIPGRDSSLMLMVIC

SEQ ID NO: 177490 - protein, 107 aa, Glycine max
  Coding DNA Sequence Number=SeqID_85805
  Homolog annotation: Hit_ID=A5AFY0; Match level="QueryCoverage=80%, HitCoverage=6%, E-value=9e-12, Identity=38%"; Hit description =Putative uncharacterized protein
MSNSKLTLMSAFKLSTSQAPKTYDDIIYMKDIPYANVVGSLMYAMIQGNPSQDLCSLLLALQLVGKTSLQKVVVLSITEAEYTALTEAVKESLWLEGSKGAEEQNEA

SEQ ID NO: 177491 - protein, 88 aa, Glycine max
  Coding DNA Sequence Number=SeqID_85806
RSNWITRHGALSTALGSPAGGQTPWGQGSAPFACPTPEQFGTEVAWPGDWPEAQAREEPTGSPGEAEEARMDEDMTNLLGFLGGSEAT

SEQ ID NO: 177492 - protein, 205 aa, Glycine max
  Coding DNA Sequence Number=SeqID_85807
MGDQEETQEQMKADMSALKEQMASMMEAMLGMRQLMEKNAATAAAVSSAAEADPTLLATAHHPPSNIVKRGRDTLGHDGSPHLGYNRAANPYGLPPNYSPPVLQDDAGHIASPVLEREPPQQPEEGHKDPQDYARRDVEFYPPIPEGPAPSTLPQPNIATQPIVLSTEGPSPATEERRKLDLLEERLRAVEGFGDYPFADMTDLC

SEQ ID NO: 177493 - protein, 203 aa, Glycine max
  Coding DNA Sequence Number=SeqID_85808
DSHAYAHDLHPPPRSSLGEILPRYAQHPGDGLLIEAICLVPPLAGLTLLVLLQNQRVTQKLAEGICIEGDLVTPHPRVHVPNPLLRGPGVGIEFYDYLRVKFSHRGHLSFPTLASYLFLEVRLLVLPELDTPLPMERPSLDGLEALLVFGTLESVTVKLHGGAGAFPMGVPPGPLRGKLLRSHLLLGTINNANRAWKRKRMVT

SEQ ID NO: 177494 - protein, 211 aa, Glycine max
  Coding DNA Sequence Number=SeqID_85809
  Gene Ontology: Mol. function=oxidoreductase activity, acting on the CH-OH group of donors, NAD or NADP as acceptor; Cellular component =cytoplasm; Biological process=electron transport
  Homolog annotation: Hit_ID=A6TGH5; Match level="QueryCoverage=100%, HitCoverage=50%, E-value=2e-90, Identity=76%"; Hit description=UDP-N- acetyl-D-mannosaminuronate dehydrogenase
  Pfam annotation: Domain name=UDPG_MGDP_dh; Domain location=1-88; Score=141.0; E_value=3.3e-39; Accession=PF00984.10; Description=UDP -glucoseGDP-mannose dehydrogenase family, central domain
  Pfam annotation: Domain name=UDPG_MGDP_dh_C; Domain location=115-211; Score=85.4; E_value=1.8e-22; Accession=PF03720.6; Description=UDP -glucoseGDP-mannose dehydrogenase family, UDP binding domain
  Pfam module annotation: Pfam domain module=UDPG_MGDP_dh::UDPG_MGDP_dh_ C; Domain location=1-88::115-211
MCKLTENSFRDVNIAFANELSLICAEQGINVWELIALANRHPRVNILQPGPGVGGHCIAVDPWFIVAQNPQQARLIRTAREVNDAKPGWVLDQVKRALAECLTASGKRATDVTIACFGLAFKPNIDDLRESPAMSVAQRIAGWHSGRTWVVEPHVADIPPQLAERATLVSLADALQHADILVMLVDHAQFRAVTPEQVTQPWIVDTKGVWR

SEQ ID NO: 177495 - protein, 161 aa, Glycine max
  Coding DNA Sequence Number=SeqID_85810
  Gene Ontology: Mol. function=protein kinase activity; Biological process=protein amino acid phosphorylation
  Homolog annotation: Hit_ID=A2Q378; Match level="QueryCoverage=83%, HitCoverage=8%, E-value=5e-24, Identity=45%"; Hit description =Putative uncharacterized protein
  Pfam annotation: Domain name=DUF889; Domain location=8-160; Score =7.1; E_value=5.7e-12; Accession=PF05970.5; Description=Eukaryotic protein of unknown function (DUF889)
MAHKFCFQALDQTKTCVYKAIPQSIDDQETTKFAKWILDIGDEVFGNQNDGYATVEIPEYLLITEYNDPIDAIVKSTFPDLYEHHSNPEFFKCRAILASTNETVEEVNDYILSLIPGEQMEYLSSDYIEKSETIDSWHFQSITTEFLNSLNTFGLPKAKNW

SEQ ID NO: 177496 - protein, 56 aa, Glycine max
  Coding DNA Sequence Number=SeqID_85811
MRIPFFTGQGSKRSEVVFQWGLLSWEPNLDIWGETNPGDKSWLQPGGHSSIPFMAS

SEQ ID NO: 177497 - protein, 67 aa, Glycine max
  Coding DNA Sequence Number=SeqID_85812
MQQSKAIKQPEVYAANIFNRPPQPQQQNQPQQNNYDLSSNRPYVPPPIQQQQQQQQPQKQHTVEAPP

SEQ ID NO: 177498 - protein, 166 aa, Glycine max
  Coding DNA Sequence Number=SeqID_85813
AGESGRAATSLSESSGMSIKGGAGGASGGGRISTFGEAGGSTIGGCSSAGAGSILVGMGLGAQPREIFLTAAELQARPLYLKIAPWILLAYYEPTAAGGGLDNEGMSLALALFLEAIYLAKPKTCRNDVRLALPEPRLAVLHSKIFTNSTELWELSEMGCSTQSLS

SEQ ID NO: 177499 - protein, 297 aa, Glycine max
  Coding DNA Sequence Number=SeqID_85814
  Gene Ontology: Mol. function=catalytic activity; Cellular component =chloroplast; Biological process=metabolic process
  Homolog annotation: Hit_ID=A7P5A9; Match level="QueryCoverage=100%, HitCoverage=76%, E-value=1e-139, Identity=82%"; Hit description =Chromosome chr4 scaffold_6, whole genome shotgun sequence
  Pfam annotation: Domain name=Aminotran_4; Domain location=6-281; Score=72.9; E_value=1.1e-18; Accession=PF01063.10; Description =Aminotransferase class IV
MYSSIFGGITTDPAAMVIPMDDHMVHRGHGVFDTAAIMDGYLYELDQHLDRFLRSASMSKIDPPFDRGSIRRILIQTVSASKCRKGSLRYWLSAGPGDFQLSPSCCHRSSLYAIVIQDLSPSSPNFRGVKVVTSSIPIKHPKFAITKSVNYLPNVLSKVEAEEAGAFVGIWLDGEGFVAEGPNMNVAFVTKDKELIMPHFDKILSGCTAKRVLTLAESLLREGKLKGIRVKTVTVEEGKQADEMMLLGSGVLVCPVVQWDEQVIGDGKEGPITQALLNLIVEDMKSGPSTVRIPVPY

SEQ ID NO: 177500 - protein, 57 aa, Glycine max
  Coding DNA Sequence Number=SeqID_85815
MKLPLLKETGRNKRMDKKSSLSSNKGCYTLLEQDSFQRRSALDKKTDKRKGNTHKAR

SEQ ID NO: 177501 - protein, 106 aa, Glycine max
  Coding DNA Sequence Number=SeqID_85816
VQGSIIDKIIQLTKGANDRIIIQVFREGKYLYLGACHSVWNSLVTRAYHHWGWGGVACAQQDDLDTCYPAFLGVSVVWECSGYFMTNGTTLHLRVKVKCMHHTKHD

SEQ ID NO: 177502 - protein, 112 aa, Glycine max
  Coding DNA Sequence Number=SeqID_85817
MCAESPPTFICGKSRKNRRKPVKMKILSSGVVFTLEEGISTSYDDKSGAFAPTYPPLERKSDLRSSSLCMDQVILFYLKGEKLAAQLAQASQVASSRSNSLLEESSGGPKWA

SEQ ID NO: 177503 - protein, 143 aa, Glycine max
  Coding DNA Sequence Number=SeqID_85818
MDYIKLLRKEKEEELTDYCTGYKASKRNDVGNDPRLRFGSTSTLLFFFFLPLPLFFFLPQLYDPQNPSPAWLFIEKAIWGQGSSPQASWLPMAKGLSHKVIWFLEGKTSRNKTILVLNMQPSPLIECPSTKLSSLLGRYPSQP

SEQ ID NO: 177504 - protein, 94 aa, Glycine max
  Coding DNA Sequence Number=SeqID_85819
MGTRLVLDRENLLSMGSSFDFLGLGEVGTGAALENSHSFLLLSSKTLPQRPKLLLHHLQPPVATTNRRRSPLKPHTERNPSIGAESSKLISQFR

SEQ ID NO: 177505 - protein, 88 aa, Glycine max
  Coding DNA Sequence Number=SeqID_85820
  Subcellular localization annotation: CTP_CleavageSite=76; ConfidenceScore=5.83e-01
MAKTASPSSKPSPMDPQIQNPAPSNSNSNSNPPISSPSPSHNMTSPSLPPLPQDQQQQLQQQLSPPPQQQQQQPLVSSNNMYPKISYK

SEQ ID NO: 177506 - protein, 131 aa, Glycine max
  Coding DNA Sequence Number=SeqID_85821
  Gene Ontology: Mol. function=nucleoside-triphosphatase activity; Cellular component=chloroplast
  Homolog annotation: Hit_ID=Q2PMM5; Match level="QueryCoverage=58%, HitCoverage=3%, E-value=5e-34, Identity=94%"; Hit description =Protein ycf2
MVLRTGTSMKKLTILLYLLSCSAGSVAQDLWSLPGPDEKNGITSYGLVENNSDLVHGLLEVEGALVGSSRTEKDCSPMNWDFPIGPGHFGTSGSFMMKRMSFKRMIQSSCRVEPCSTRHEIDLPKNRAFFE

SEQ ID NO: 177507 - protein, 229 aa, Glycine max
  Coding DNA Sequence Number=SeqID_85822
  Homolog annotation: Hit_ID=A5C169; Match level="QueryCoverage=96%, HitCoverage=19%, E-value=8e-09, Identity=24%"; Hit description =Putative uncharacterized protein
MDFFSNESFECIQAFENSNLIPFMSLKFLFTTDLVKAFYSNLEIQEGTLISEVYGIKMVIDQSIFYDLTKLSSKGVPFEGTLIDDWKYDFSVHDACRLVCTNQADMTGRLLAGSLAFESRILHYLIVRILLPRYSNLAQVSKEYLIVMWAFHKGQQIDWAHLVRYHMHKALRLNAPLPYPHLVTLFLQHFNIPLDFEPYVPIKRSFLIGADVIASFGYRKEHDGSWVKK

SEQ ID NO: 177508 - protein, 91 aa, Glycine max
  Coding DNA Sequence Number=SeqID_85823
MWRNIDIVRVCLTFMTFPGMSAAIAFCHTLISSGNLCSMTCDHSLVLVRPIWALQKVPPEGGCFWRKQPCSPGRAELAWRAGGKHLPICYK

SEQ ID NO: 177509 - protein, 33 aa, Glycine max
  Coding DNA Sequence Number=SeqID_85824
MKDCSFTETILGFCGKGKGYDAKGISLSSNMIS

SEQ ID NO: 177510 - protein, 113 aa, Glycine max
  Coding DNA Sequence Number=SeqID_85825
MLLSSNIIYIYVRVVMLVRMIRTRLFAAAQVKSCPGIHSSCVIASLSGCARTVGPPPISGGGPGTVRMSSTLKMRTRSPLKVRACSPLKARSVVLWSEGVQPSAGEDGVVLSR

SEQ ID NO: 177511 - protein, 37 aa, Glycine max
  Coding DNA Sequence Number=SeqID_85826
MKMLLIPHDMNGSGMEKEEREEMPLQGEDESRRSSPP

SEQ ID NO: 177512 - protein, 73 aa, Glycine max
  Coding DNA Sequence Number=SeqID_85827
MMTKVMNKKLKRSKNNSSESRTSQEFKNQEEFKTQEERLQSSLKIQDSRSQESRSRFKTQDSRMKIGLHQDKY

SEQ ID NO: 177513 - protein, 105 aa, Glycine max
  Coding DNA Sequence Number=SeqID_85828
MADTTNKSHIILLSNSLPIDTQSMTFLGETSSQTIVNSRLAFIFPNGSIIHNDNGIYFQTSTPVPIRVPNSCDFASLKTRIHNTLQLSDKQFLDDIHYRKPFTDT

SEQ ID NO: 177514 - protein, 146 aa, Glycine max
  Coding DNA Sequence Number=SeqID_85829
  Subcellular localization annotation: CTP_CleavageSite=76; ConfidenceScore=5.53e-01
MGVQIATRPTWALQKIPPKGGCFWRKPPCSPGRAGTSKPRFFCNVSVGDFMKTFNRSSTFFIRSSSFFGLEPVLVPSSNVNTTPESGIFFMTGFPSAFLTFSTNKRWWRLRAFSSFGRCTHEPRLARPQKGRLRQLATPLGTVFVS

SEQ ID NO: 177515 - protein, 195 aa, Glycine max
  Coding DNA Sequence Number=SeqID_85830
MERLVVHVDPFARKVDGPHKKKLRTYLGIISRYKIEFDIPEASNQRTKKKILKTDVRKKAQAIQKVNTAPHVLSHGEQEAQSRSTGTIIDPPSPIRRHVKWKLARTKKSREMTSEVAQEIVDRISAQGSFVAHGHQDVLTTAIGQPEHSGHICTVGASLTIRQYFGPDSKSSRTSTSITPKELELLAQKIRDQLE

SEQ ID NO: 177516 - protein, 109 aa, Glycine max
  Coding DNA Sequence Number=SeqID_85831
  Homolog annotation: Hit_ID=A5BS38; Match level="QueryCoverage=95%, HitCoverage=4%, E-value=7e-09, Identity=36%"; Hit description =Putative uncharacterized protein
MNLPNLTLLQKKMMTKMSRELCTNKRKLKGSERISMGRNVSALIGKSVPQIPEKCKDPGPLQSTDVVIHLANRSVSYPVGFIEDVLVRVGELIFPIDFYILNMEDGFSK

SEQ ID NO: 177517 - protein, 208 aa, Glycine max
  Coding DNA Sequence Number=SeqID_85832
  Homolog annotation: Hit_ID=Q6UUU1; Match level="QueryCoverage=52%, HitCoverage=93%, E-value=1e-33, Identity=60%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGNGGETRQDYKDTRRFPLAAPSCALLFLPFGLPVSFRWLWPRLSHSTPDTQFRVGSSLQAGLYARTPRSVRPLRLIRGVSLEVMPRLRAKLKGQVLVTALLRASYL

SEQ ID NO: 177518 - protein, 168 aa, Glycine max
  Coding DNA Sequence Number=SeqID_85833
  Gene Ontology: Mol. function=sequence-specific DNA binding; Cellular component=intracellular; Biological process=regulation of transcription, DNA-dependent
  Homolog annotation: Hit_ID=A6THT2; Match level="QueryCoverage=73%, HitCoverage=51%, E-value=6e-29, Identity=48%"; Hit description =Negative transcriptional regulator of cel operon
  Pfam annotation: Domain name=AraC_binding; Domain location=50-159; Score=28.0; E_value=3.5e-05; Accession=PF02311.10; Description=AraC -like ligand binding domain
  Pfam annotation: Domain name=Cupin_2; Domain location=54-125; Score =20.4; E_value=0.0028; Accession=PF07883.2; Description=Cupin domain
  Pfam module annotation: Pfam domain module=AraC_binding::Cupin_2; Domain location=50-159::54-125
MTGYGRKVGYIRTVPNEALPDGSQTWYKKCPEGVPMTDIRHILQTFHRASGLELRSTWQSTQAYKRHCHPQLSIGAIVEGQTCCVCHDREYILHPGDLIVIPAYAPHSCNPIAGQARSYHMLYIDTDRPLALQVIRNATFFKHFLDIVETMSPASVDRPAFCPSPPCG

SEQ ID NO: 177519 - protein, 181 aa, Glycine max
  Coding DNA Sequence Number=SeqID_85834
MEPTTRIAMIITEANQMHQNLNHRGHQDCTQNNRLGGRTAHHHPERDHRQDDRQDETCHIDNREHTDPHHVQEVPEQAQAQDTGTVSTGQAATGDLEHQYCHPDQTGGHVQTVGADQREERGQEATAIRAEAFHDQVMEFIDFHPDKSSTKQPGQRQPGHNLALVVFVHGDSRHAVGDGAE

SEQ ID NO: 177520 - protein, 106 aa, Glycine max
  Coding DNA Sequence Number=SeqID_85835
MASRKHKSIGSRPTTQYDTRRFHSLDAWNWYTDNVLGRNILPERKVELYHTKFDYFKTELERRNLHKRLTNLVDGSIDLALVKEFYANMYNSDDPSPKQAWVRGHL

SEQ ID NO: 177521 - protein, 250 aa, Glycine max
  Coding DNA Sequence Number=SeqID_85836
MAMGDFISRLSFPENTETFSSLTSYPELRRSEFLIGGYVGAKALLLSTAPLSVTMSQELVARGDTLRLSAPRHSVTPSVIDEQRPMWSSAPFPEMSASSGGDFFKSHKLSRTTSCDMHPCVIQRRRGPMTRRDKIWSFCTLVSSRGGGPDDTRRYLTVIRTLVSSRGGGPDETRRYLTVIRTLVSSRGGGPDDTRRYLTVIRTLLSSRGGGPDDKQRQNLRRGPDDMQRQNLVFCTLVLQRRRADDKYPY

SEQ ID NO: 177522 - protein, 44 aa, Glycine max
  Coding DNA Sequence Number=SeqID_85837
MLAYLYREICSATDYKVKSFGGGCDVEINILAMMILEFFVANWI

SEQ ID NO: 177523 - protein, 140 aa, Glycine max
  Coding DNA Sequence Number=SeqID_85838
MPSSFADLVFAGERIKVGLKRGKFNYVSSIGTNSRRIGATGAKRKEGDTHAVTSTPAWIKPPQISHGTHQYAQHHPSFSARAVDSSNSAPVQPRVPAPIQREPLPPPPPARLSRGRPPKLWLQPRFAWLAMPTLASVPTR

SEQ ID NO: 177524 - protein, 105 aa, Glycine max
  Coding DNA Sequence Number=SeqID_85839
IEKYCTPRQAQGNAPKAADIPPPPHQVDPTGSLGMECYLQHLVRQQAVIHQGQPQSAGAGFGAEVAWPEAQAGEAPARSPGDAEEARMDEEMTDLLGFLGGSGAT

SEQ ID NO: 177525 - protein, 64 aa, Glycine max
  Coding DNA Sequence Number=SeqID_85840
MVSESDSDPPSPSSAKIMASLAKQMDKLQRNRGGGIISHLILLKGVMMTMNKLEGIGIGGIRME

SEQ ID NO: 177526 - protein, 233 aa, Glycine max
  Coding DNA Sequence Number=SeqID_85841
MEDLFKRWTNHLDSTRSKVNQPPLINCNFCGEHYNDNCHLYSMNNSRWGQELSPYNQYEEERTPNLKSVFEEFMAYHANSKANQNSVQNQEIQFGKSYSMENYRGGQELQPYNQNEEEREVEAQEESLVKEHDSREKDEEEFEEEAQQREKYSTIENQQESILQLKTSPHQLIVKEERHGEHDKALSVILSLITSTSLAMIWKIFPKYMSFIEFLAKRRKCKEDVFYVTFMPP

SEQ ID NO: 177527 - protein, 128 aa, Glycine max
  Coding DNA Sequence Number=SeqID_85842
  Homolog annotation: Hit_ID=Q2HV71; Match level="QueryCoverage=38%, HitCoverage=6%, E-value=3e-07, Identity=51%"; Hit description =Protease-associated PA; Proteinase inhibitor I9, subtilisin propeptide
MWLLSREMAPSFSNDKKEDVIVGVIEIGVWLENEGFKDHGMTKKIPNKWKGGCEEVQDFNTHVKMRLSHEMLKHASTAKHSFSVTEESGRASISRSRAKREISALSAVVVFSLVQHMNDAKLKSTYVR

SEQ ID NO: 177528 - protein, 103 aa, Glycine max
  Coding DNA Sequence Number=SeqID_85843
MYNSIITYIGLHYRAHWQIVFILPKENVVIRFCSLYNRPDNYLKGIINSALKGLGNTPQSKFKAGARWIVVKYFNDARPLEPERLKALRIQWAKYYLKVKNDT

SEQ ID NO: 177529 - protein, 73 aa, Glycine max
  Coding DNA Sequence Number=SeqID_85844
MITKDDDKGDDKNLKGQSKDEFKIESRTLQDSRGKLILRIKNQDSRDQDFKNQDSRDQDSRLHIQESREGLIK

SEQ ID NO: 177530 - protein, 53 aa, Glycine max
  Coding DNA Sequence Number=SeqID_85845
MGRVDGEDEGNLRGNTKSESGSGSDNDYVRESNFFLNKGGKALTCSLYNLEDS

SEQ ID NO: 177531 - protein, 190 aa, Glycine max
  Coding DNA Sequence Number=SeqID_85846
MEMKPYFLSLISAHQFAGMDHEDPYTHLSTFYELCGTMGIPEDVEQAIRTIDAFVSNNYQARHNKQSVQIHKVLDVIFVEATIQVVNVLSNKSYTNNFSQGWRNNPNQNFGWRQEASSSNRQPPNQKQANFSPIHERMQSLKTPWRSSCKVGEIIQIRTLDGDKKQVLPIDNLQIKSKQIFLLYMKGCKA

SEQ ID NO: 177532 - protein, 86 aa, Glycine max
  Coding DNA Sequence Number=SeqID_85847
  Subcellular localization annotation: CTP_CleavageSite=54; ConfidenceScore=5.09e-01
MITKDDDKGDDKNLKDQSKNNSKSRRIQDSRRKFRVKNQDSRFKISRIKIQGSRSQESRSRFKTQDSRIKKRLNQDKYKKSFSKTE

SEQ ID NO: 177533 - protein, 137 aa, Glycine max
  Coding DNA Sequence Number=SeqID_85848
MKKNNGREACLWGFYGGWIFELLWGPLMVIFHHGDSAEDKGKEDCITWHMQLRSSSHRANIQIVCRPKKRRCKKLLMNSLSKVDWLSEPHPLSEAASSLSGWETLEEDKSEICTLSAQSAHPARTLSLLALSVSKLA

SEQ ID NO: 177534 - protein, 61 aa, Glycine max
  Coding DNA Sequence Number=SeqID_85849
MEACLWGFYRGWIFELLWGPLMVIFHHGDSVEDKGKEVASLRSFLEKTSLRSFFEKTSLRS

SEQ ID NO: 177535 - protein, 186 aa, Glycine max
  Coding DNA Sequence Number=SeqID_85850
TQGITWLPKLKGLSGKEVEVPEESKEVQALKVELEKMRVVKEKLKTTVTRARKDNKLKLRRAERDESRMESMVLEDKLKACQSAKRSLMEQLSRTKENMLIIIDQYKEKVNLVTSHGQRLEDEHVKVLALHIEREARERVIKSLHGESMKWMDRFALTLNGSQELPRLLARAKAMADTYSDPDEVH

SEQ ID NO: 177536 - protein, 191 aa, Glycine max
  Coding DNA Sequence Number=SeqID_85851
MGEVEEVQKQMKADMEAMKEQMATMMKAMMSMKKIMKANAVAVTATSAVAKVNPKPPSGLNQMNHPTSDMVGEDLGSMDDPYYVQIQNKHAFPPYGLPPNYTPPNVAYTSSENVNNSTPILIESRQPQTDHAHVSQTMRETHEIPHHNLADFEPCLGYATEGQAVGGIPLQKHFGGPSVSPTTTPLAFYIG

SEQ ID NO: 177537 - protein, 108 aa, Glycine max
  Coding DNA Sequence Number=SeqID_85852
MLQSIHKGHIILLQSLQLVAPPDSIPTTEKFNEWVAWPGTQPPLHREDEDPTAQVPYQPEDESSESSTPEPLIRKRRVAVTQEAAATSEKSLEATPASPTPVADTTSP

SEQ ID NO: 177538 - protein, 56 aa, Glycine max
  Coding DNA Sequence Number=SeqID_85853
MTLIHFPSPEGAHHTLLGSEGGGGSVRVALRQQLIMESRVVAGVEVVATLGLLRNE

SEQ ID NO: 177539 - protein, 63 aa, Glycine max
  Coding DNA Sequence Number=SeqID_85854
MNPNNNLDEVLDQMIDEELEDNTDEEIIRKGPVTRAMSKRLQENWVRAAEEGPRILMNLRVDF

SEQ ID NO: 177540 - protein, 198 aa, Glycine max
  Coding DNA Sequence Number=SeqID_85855
  Gene Ontology: Cellular component=mitochondrion
  Homolog annotation: Hit_ID=Q6R9A5; Match level="QueryCoverage=28%, HitCoverage=51%, E-value=3e-27, Identity=96%"; Hit description =Putative uncharacterized protein orf111-b
EEPSDAPALLIERQHVAVLSVRREPAPFEFEALSSVRCFLIAASEQENGCANAAFFRLACDDDVELAAEKDSAFSDILEEGGDDVKSAWPLWAGPHTCYNGNYNGKQGCKAERIRKDCLSSDCSLQLGNMKLESLVIADQHAAVNMYPGPVHTARHTLGIGFARSIGPMITHDFCVPLVPQRLLVVLLAHTTVGSSTG

SEQ ID NO: 177541 - protein, 98 aa, Glycine max
  Coding DNA Sequence Number=SeqID_85856
NTETFSSLTSYPELRRSEFLIGGYVGARALLLSTTPPFAVMTQELVTRGDTLRLSAPRHSVTPNVIDEQRPVRSEFLIGGYVGARALLLSAAPQDLSY

SEQ ID NO: 177542 - protein, 95 aa, Glycine max
  Coding DNA Sequence Number=SeqID_85857
MAIRCTDNHNLSPHVIRLAALDDKRCIMTIICLYVPSDSIVSGWRKVMRITIICLRMSSGSPPLDDKRLDRHWMAKRYVDYHNLSPHVIGLAASG

SEQ ID NO: 177543 - protein, 37 aa, Glycine max
  Coding DNA Sequence Number=SeqID_85858
ITSDTLQQMVADILSKAQVEKDEAPECRRMKSSSGEG

SEQ ID NO: 177544 - protein, 199 aa, Glycine max
  Coding DNA Sequence Number=SeqID_85859
  Gene Ontology: Cellular component=mitochondrion
  Homolog annotation: Hit_ID=Q6R9A5; Match level="QueryCoverage=32%, HitCoverage=58%, E-value=7e-32, Identity=95%"; Hit description =Putative uncharacterized protein orf111-b
MPHSRGTASDILEEGGDDVKSAWPLWAGPHTCYNGNYNGKQGCKAERIRKDCLSSDCSLQLGNMKLESLVIADQHAAVNMYPGPVHTARHTLGIGFARSIGPMITHDFCVPLVPQRLLVVLLAHTTVGIHDWGEVVTRLTRRTGGTETSKYPEEKKSTEIPPVAASERGAAQDLNQLVHQWKRLESRAIPGDSPVHEDA

SEQ ID NO: 177545 - protein, 209 aa, Glycine max
  Coding DNA Sequence Number=SeqID_85860
MPGTAMQIMSLAGRSFLKGIIYANLYDPEDKSPKQVRVRGHLIKFDIGTLNTFSKTPVVIEEGESLSAYSRFSNLRPVPQELVARLCILGRGFELNANGLRLKILRKNLTTLAQSLSVLSFSNLVPTSHTSDITLDRAKIIYGLVMQMDMNLGSLISGQISLIAQHDSSRLGFPSLITAMCKARGVTSDSLTFESLSPTINFGYIKKNC

SEQ ID NO: 177546 - protein, 142 aa, Glycine max
  Coding DNA Sequence Number=SeqID_85861
MAEDQPQRVTLEDYSSSTMPQFFTSIARPEAGEAKRWFHSFKGNSLKIWEDVVEIFLRKYFPESKTIEGKASKQLLDASAGGKIKLKTPEEAMELIENMAASDHIPTKRNLLELSSVDALLAPNKLLAKLEVAVYVEERINL

SEQ ID NO: 177547 - protein, 79 aa, Glycine max
  Coding DNA Sequence Number=SeqID_85862
MPANIADLVFAGERIESGLKKGKFEYASNAGPNSNRRAPVVGTRKKEGDTHAVTTAPTWMKTPQNAQNSYQHNHPNFSI

SEQ ID NO: 177548 - protein, 111 aa, Glycine max
  Coding DNA Sequence Number=SeqID_85863
  Homolog annotation: Hit_ID=Q6WAY6; Match level="QueryCoverage=40%, HitCoverage=8%, E-value=7e-11, Identity=66%"; Hit description =Putative uncharacterized protein
MGSSQAPSLKKRFYQVKVKSLGTTNLKELGQLMGQLQRQAFRKAYGRTGVLISCEGFPNVPLMGTRGCISYNHVLAIRQLGYPMRGAPLEEELAPIIARGFNKTNVEALQK

SEQ ID NO: 177549 - protein, 148 aa, Glycine max
  Coding DNA Sequence Number=SeqID_85864
  Homolog annotation: Hit_ID=Q6UUU1; Match level="QueryCoverage=58%, HitCoverage=55%, E-value=7e-19, Identity=61%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPGVSPWRLPRALSCSCLSVYRCHSAVWPRCLIPPPDTQFR

SEQ ID NO: 177550 - protein, 80 aa, Glycine max
  Coding DNA Sequence Number=SeqID_85865
MQSSSRPPGCARNCPPPIGDQPGSPKEFPKVTSPLSTKYTLPQLLYFLCRISYEHGQNVYAYMFLVEVGIAGARYAGLTN

SEQ ID NO: 177551 - protein, 88 aa, Glycine max
  Coding DNA Sequence Number=SeqID_85866
MAYTHIPDSTSDSPQISASPHQLDLAPYASEPYNAQWNAPGLLRDKHTLRSSRILGEMEVDEPWLGLWLPLNYQVDMGASQHNTPELG

SEQ ID NO: 177552 - protein, 70 aa, Glycine max
  Coding DNA Sequence Number=SeqID_85867
MNVEERSRIFTNFERMRSAKKAEPLFFFTPPPIYSKIGEELATQLAQASKVASSRSNRLLEEESGRPKWA

SEQ ID NO: 177553 - protein, 235 aa, Glycine max
  Coding DNA Sequence Number=SeqID_85868
AWETPLRKDQELRGIRNGIIGGYHEWLKVRIRGLDWLAKLKVVSEENFEAPEEDEEVQALKSELGKAKLAKEKFKLAATHVRKECAGLREENAITAKALEQETKRARKEEYGRNKFRGALWGSNNELKLRREERDQSRAHSMVLKEELIACSRSKRSLSQRLCEIETNMLAIIAKYQEELGLATAHEHRIADEYAQVYAEKEARGRVIDSLHQEATVWMDRFALTLNGSQDFPDC

SEQ ID NO: 177554 - protein, 53 aa, Glycine max
  Coding DNA Sequence Number=SeqID_85869
MGVQIATRPTWALPEAEALPKRFRNVFREEFRKGFNRSSTFFIRSLSFFDLQR

SEQ ID NO: 177555 - protein, 117 aa, Glycine max
  Coding DNA Sequence Number=SeqID_85870
MAFKHKVQSLIAAGWLTFQEDSPNVRTNPLTSHGGSVVNAVEKWEPWGRKQMRDMLTSRRFILEALREAGMMDKGQIEVCNTRKGEWDVCMQLDDKSLRKPKPLVIHFTRDVATQKT

SEQ ID NO: 177556 - protein, 102 aa, Glycine max
  Coding DNA Sequence Number=SeqID_85871
  Subcellular localization annotation: CTP_CleavageSite=40; ConfidenceScore=5.04e-01
MSPSPLRSHNHSQLISSSQNGIRFELASLQIFTQQSGLVRACALSADLDRLARKVDFGLARLFHLADELKRCALSPGAVCLANLTAHLLLDSSSRLAIEGSA

SEQ ID NO: 177557 - protein, 130 aa, Glycine max
  Coding DNA Sequence Number=SeqID_85872
MKLRSSSDNPSRRLNHNDARILDECVVFAESGGGGGGGCSIKGFWPLMLTSLPLGVKVWVVDNITWDSLLDLGPKREGGKENYMEFSASDDGGVFIIFTGKCNRRKINWRQRTYKGKAKPTDKVAEKENE

SEQ ID NO: 177558 - protein, 65 aa, Glycine max
  Coding DNA Sequence Number=SeqID_85873
MVELQAEKDVGELQRVGEAWVVGLDEANDEVVGDDIDVLYAGREVVSERGFRRGRWWTRFVLEED

SEQ ID NO: 177559 - protein, 50 aa, Glycine max
  Coding DNA Sequence Number=SeqID_85874
MSVEIKSESTYKSFKVNGHQLKPFLTNPSLVDVVVEETSLLHLTFSSAMT

SEQ ID NO: 177560 - protein, 440 aa, Glycine max
  Coding DNA Sequence Number=SeqID_85875
  Homolog annotation: Hit_ID=Q2HTA0; Match level="QueryCoverage=30%, HitCoverage=19%, E-value=5e-13, Identity=35%"; Hit description=IMP dehydrogenase/GMP reductase, related
  Pfam annotation: Domain name=DUF1723; Domain location=146-195; Score =23.8; E_value=0.00063; Accession=PF08330.1; Description=Protein of unknown function (DUF1723)
MVRTRGFGRALGRAIGKVLGRKDVSDDDAPQRRRPIALARRQRQQQRVVKDPPTAAEELIDEQPEAPTEEVVTNVEGFPSGPHDTSILTDFENNIALRVWNGDECSELKLSSHGRKMAKFERPAPQIEGIVAVSGLSPLIAYSLDTGDWGLMSAFMECRHKETSSFHLPVREMTITLDVVASLLHLPIVRVFHSFKLLHVDDVVEMLVELLEVSAAECWIYDHFSSVGSAVPAENYDERSRVHVDGPLARHCPFPRIRGVWIDRPLMRWGLLTVIHRPERVVRQFGYIQTIPPHPAASSLSVEEINDRWMQFGEYIAPVGQLCAVSDHCSPDYMDWFYMISHPFMSSAQSGDPPRVPSIQQYEEFVEPDMYQQPMATVAPNEDDFVAIADKLDRLLNLRILIEGIEANTIVEECVSITRRYIGQPTVGHRLRRRRHTDGH

SEQ ID NO: 177561 - protein, 47 aa, Glycine max
  Coding DNA Sequence Number=SeqID_85876
MEIFRKKLLPKTFRMTFFRKLFVLPEKFRKEVFRKVSGKIFFRKKNC

SEQ ID NO: 177562 - protein, 166 aa, Glycine max
  Coding DNA Sequence Number=SeqID_85877
MATIYWGRWRTQVMAAVLQPRESDIVSESARFEHRLLLIYTSLFLLGVSLSPNVCCILSKYHPQFHFGIITQTVSSLFRISDYFNSVRQFNSVESTVLGSLNDRDDKDWEFGGQTFCVVKEYLQKGNNIGLVKYYCMLQTCNICKLVQLNIVHALTHFTLGEHYKA

SEQ ID NO: 177563 - protein, 75 aa, Glycine max
  Coding DNA Sequence Number=SeqID_85878
MPKKFIFCNLYSINALLSKLMKMPKNSHYSPEKEENLVGEPRSSVNGERWSPEKEESLAGEQWSPENECGFSLQS

SEQ ID NO: 177564 - protein, 84 aa, Glycine max
  Coding DNA Sequence Number=SeqID_85879
MKGMDNIQHVKSSRIKTVMKIIQAPQTWQDRTFHRLVRHSVHPDHFEHFVHFVHSEHSVAGDSEHSDFEHSAANFHTENMAQPP

SEQ ID NO: 177565 - protein, 99 aa, Glycine max
  Coding DNA Sequence Number=SeqID_85880
MLGYSVYNVGLAGKKPAKPMGRSTQQMPQEISLGAGDPGLARGQSIKNFTKLPGLSESASLSHRYCTRRKSVHPQDINSLNVVGALSEFFSKTPIFNEY

SEQ ID NO: 177566 - protein, 388 aa, Glycine max
  Coding DNA Sequence Number=SeqID_85881
  Homolog annotation: Hit_ID=Q1SL03; Match level="QueryCoverage=22%, HitCoverage=26%, E-value=5e-07, Identity=29%"; Hit description =Ribosomal protein S2; Nucleic acid-binding, OB-fold
  Pfam annotation: Domain name=DUF223; Domain location=1-95; Score= -0.2; E_value=0.0032; Accession=PF02721.5; Description=Domain of unknown function DUF223
MVLMDHTGSKIGATLWQELFTELRDKLQYGSSYLIQNLRIVDNQSEYRVSPVPYLVYFLKTTSVKEIHRPKIPSNIYLITPFTDIISGLAPRHTLVDVKIVNPPHRMIVRLRDNSKCNILITVWEDYAIKLHDAIDKNLLLQEPLVVMLTLGKIKDVTDLFTLGDKYNAQVVSIGEINNLRQDCYCLTVGTVDEIIIDAPWSYDSCPNCTTTFDPSKGGSACRSFHTSVIDTVPQLAMIIFCTNYLLTRFPVLPNFPETSMDVKVGDDIKVFPTCVDEILCKTWVVRFKFRSQLRQSSVLDVSEELHHIQSLIATLGLKEQSSKGKTIAVEPESSPPIFAPTSSDYDPENSTCLTPTKRISCQQTSSDFDYDEHTQYQLSTNKHIKAE

SEQ ID NO: 177567 - protein, 517 aa, Glycine max
  Coding DNA Sequence Number=SeqID_85882
  Gene Ontology: Mol. function=helicase activity; Cellular component =chromatin; Biological process=viral genome replication
  Homolog annotation: Hit_ID=Q2A9E0; Match level="QueryCoverage=100%, HitCoverage=40%, E-value=6e-97, Identity=35%"; Hit description =Putative uncharacterized protein
MYTVEFQKRGLPHVHLLLFLHANNKYSSPNNIDNIISAEIPSQKDDPELYKLVQNHMIHGLCGILRHASPCMKEGKCSRFYPKKFQPTTLIDGDGYPIYRRRNTGWTITKNGIIIDNRCIVPYNPKLLKNYQAHINIEWCNQSTSIKYLFKYINKGYDRVTAVMVHDDNETVPLANTPNDEIKEYLDCRKPSVERLQFHPPGQHSVLYQDQDDIDDLLSNPSISESKFIAWMNTNQAFVEDIRTVDGAEYSTCKEACFAMGFLQDDREFIAAIQEAKDWGSAPYLRNLFVLLLLTGLHIDDSNLMNLVLFEVENLLLANQRSLKDYPSMPYPENANLLTHADNHLILFELNFNNEELRFEFLNLFSQMTDQQAQIYNQIIQVVNKNEGGMFFLYGYGGTTKTFIWKTLAASLRADNKIVIMVASSSIASLLLPGGKTTHSKLKILVPIFEDSTCNIHQGTQLAELLNEASLIIWDEAPMAHKFCFEALDQSLRDVIKAKSSSDKIFGGKVMLFGGDF

SEQ ID NO: 177568 - protein, 160 aa, Glycine max
  Coding DNA Sequence Number=SeqID_85883
  Pfam annotation: Domain name=B3; Domain location=10-102; Score=5.3; E_ value=0.02; Accession=PF02362.12; Description=B3 DNA binding domain
MLSDCLATIRFTAPFRVQKNLLQVPFSFHRQWVYRYPKYVLFHYDGNKYFIRVRRHSGKCFFADGLKEFRRAHDLNESVILHCVASNKNTTFSVYVIEPTQRQLRVKPLISKRRYIFTADVTKDMIQRTLPLILPAAASRFVHASKKFITLQRGLAKRTH

SEQ ID NO: 177569 - protein, 146 aa, Glycine max
  Coding DNA Sequence Number=SeqID_85884
ESGDVAGAPERVSFLFNKPAHPGNGSAGRTECLPRPVVLITASGLQGEQPLVDGTIPEPVGCRWTARAASAARAGRRVPVGGRIGNGPFGASSPGVEQSTQNCALNVKVKKFNQARVNGGSNYDSLKRNHSQGNGLGGISGERRPC

SEQ ID NO: 177570 - protein, 86 aa, Glycine max
  Coding DNA Sequence Number=SeqID_85885
  Subcellular localization annotation: CTP_CleavageSite=44; ConfidenceScore=5.00e-01
MVKVGTSYVPIKRLIFAKSWPRASRYQTGTPGFIYFCEVIFRHRCSSGFCFLSAVPPVQLLTGVVRNGKKHRPDISAGKCSGPRCA

SEQ ID NO: 177571 - protein, 128 aa, Glycine max
  Coding DNA Sequence Number=SeqID_85886
MEGQPTQTSVSNANINSGIRAIPDQTVGTIKFNRFDGYESDRGDFSHDSNMTLARLQNSQPNVENLNMFSPSGSVAGNQGRQPPIRQIQIQAPVQEIQMPNNPGMQMAQAPQPVARIEPPAQQVEPNP

SEQ ID NO: 177572 - protein, 125 aa, Glycine max
  Coding DNA Sequence Number=SeqID_85887
MASITEAMLKLQKTIEDNATAAASNTTREAEPVLQPALNLGQDRNTKVLGRRYSPQAYPYGLPPDFTPRTAPEDLSQAPTFGGQLPPYPDYPLQEDDEGDAHLGPLLPLKDPAPHELPQPNIVRH

SEQ ID NO: 177573 - protein, 148 aa, Glycine max
  Coding DNA Sequence Number=SeqID_85888
  Gene Ontology: Mol. function=unspecific monooxygenase activity
  Homolog annotation: Hit_ID=A5B940; Match level="QueryCoverage=56%, HitCoverage=76%, E-value=3e-27, Identity=76%"; Hit description =Putative uncharacterized protein
MNAGCHKPVILWTKGSIGHAFTVRIRTGNQNQTSFYPFVPHEISVLVELILGHLRYLLTDVPPQPNSPPDNVFRPDRPAEADLGSKKRGSAPLPIHGITPTYPTPLKSFHKVGLESSSTGSSFPADSAKPVPLAVVSLDSRQGQWESR

SEQ ID NO: 177574 - protein, 164 aa, Glycine max
  Coding DNA Sequence Number=SeqID_85889
  Gene Ontology: Mol. function=aspartic-type endopeptidase activity; Biological process=proteolysis
  Homolog annotation: Hit_ID=A5BXN6; Match level="QueryCoverage=81%, HitCoverage=10%, E-value=2e-17, Identity=40%"; Hit description =Putative uncharacterized protein
MEEVDKEILETFRKVEVNIPLLNAIKQTPRHAKFLKELCTHKRRLKGNEKISMGRNGFSHGSGPIILGIPFMKIARTKIDVYAGTLSTEFGDIVVHFNIFDAMKHPSEDHSISRAEILDQIVDDYMFDFDSLHGDDKNLKGQSKDEFKMFKKKSRTNSRLKRKS

SEQ ID NO: 177575 - protein, 381 aa, Glycine max
  Coding DNA Sequence Number=SeqID_85890
  Homolog annotation: Hit_ID=Q01UC0; Match level="QueryCoverage=87%, HitCoverage=71%, E-value=9e-17, Identity=27%"; Hit description =Putative uncharacterized protein precursor
MTKKKHKRLMVSFIFISLFNVKGQVKIITRQSGGSSPENSGDTWSAYVKGFIQTDAMLDFQEMGFKDGFIAPSIAIPQNNSVNSNFSIKQSQIGFGIKQMDENGNSDLSAYTEIDFLGPNGTTAPRFRQGYIKWKKLLIGQTWRPNGTMFIRTVQIRYSTPLSKKESLSLSLEDPDAASIFLPNNAPNWKKKSILPIFTAVYRYGNTRDYCKLGTMVSPISYEIKNDEQKHTDANTILGYSGMVSARLYSGTLSNFRFQSSYGKGYSSYNVVLNGEKYDAIPDMANNRLVALNLFNIVGIYEHWWNPKLSSVIYYSFSQLGRKDFVPDTMIHNFQNSGINLAFQPRKKLRMGIEGTYGMLKNFGRQKANIFRIQLSSSLSF

SEQ ID NO: 177576 - protein, 91 aa, Glycine max
  Coding DNA Sequence Number=SeqID_85891
  Subcellular localization annotation: CTP_CleavageSite=20; ConfidenceScore=5.25e-01
GSRLQDTRWTRRSPTRSGVSSSNYGSLSVLQSTYNPQQVHQAPFNQAFIKKYCVSRQAQGETPQQPGDGRQRATDAPPSPLEFTSAHPQKG

SEQ ID NO: 177577 - protein, 150 aa, Glycine max
  Coding DNA Sequence Number=SeqID_85892
MGGQQRSYNNFKQRGFQNIHGYYNRAGDNKTTTKRKFVGPHRKVGRSLDQIHRSGHRQPQKHQSHDQKHGNPKCHCKAIISTIECDVEDEEEKQVQESTMLEEEMKAQLNPSTQVTFWSNFPLYKYVQGKFDSPESAPGRRPNVLNLDPS

SEQ ID NO: 177578 - protein, 209 aa, Glycine max
  Coding DNA Sequence Number=SeqID_85893
METCLGVEELLQRMIDQGRLEVGSEGREEQHICMQSTDGSTVAKPKPLVIYFTKGTASQKPGHPLAAKPVPFPYQNSHVVPWRYTPPRGKEEEATDVSSLSAKRSCVCTRGPTSPTRKRQGGKQKLVEGTRMAKHPSLRIKDIPGERSSGRKRDERIQGYRTAQQNPGQGLAVGVTHELRASSGSASEGFERGPRGPRYLGRRFRRAGQ

SEQ ID NO: 177579 - protein, 124 aa, Glycine max
  Coding DNA Sequence Number=SeqID_85894
MGGMDECMKKMHMAQMHFTNIGAWEIVPFLDTTFGQHDARCMHLRRRHGPSVACLLRAPILGTLMGGTKRLLVIIPKVVISLLMVSRGIIPFEKHIAVVGTTSNNMLSKRKTLDEELLSSKSET

SEQ ID NO: 177580 - protein, 142 aa, Glycine max
  Coding DNA Sequence Number=SeqID_85895
  Homolog annotation: Hit_ID=A5C4I3; Match level="QueryCoverage=33%, HitCoverage=18%, E-value=9e-14, Identity=80%"; Hit description =Putative uncharacterized protein
MAARALGVPRHLRAPGVGLWAPHSARLETRTKESDMCASQRASKPVRRKEADWWDPLGAKPEETLVEARSDTDVQIPAGEFYRPRHGIESSKWAIFGKQNWRCGMNRKLGYGAQLRANLDPTKGVGRLRQQDGGHGSRNPLR

SEQ ID NO: 177581 - protein, 73 aa, Glycine max
  Coding DNA Sequence Number=SeqID_85896
MWDATVFRVFNEDFPLYIKHEDLSEIAHGGQCLSIFVIQLWIMHLTETVHTGKWSSFCLRKILLSGFVPRITG

SEQ ID NO: 177582 - protein, 77 aa, Glycine max
  Coding DNA Sequence Number=SeqID_85897
MRNCPTCGVSLYKVNDGKCSDGAATTNSRPAKDPSNLRLGLALDGMNHFAGVQIAIRPTWAFQEVPPERRCLLEEAT

SEQ ID NO: 177583 - protein, 106 aa, Glycine max
  Coding DNA Sequence Number=SeqID_85898
MSALKEQMASMMEAMLGMRQLMENNVATAAAVSSAAEADPTLPTTAHHPPPNAVGRERSTLGHISNPHLGYNRVAYPYGLPPNYTPPVMRDDAGHVPSPVLEGEPP

SEQ ID NO: 177584 - protein, 137 aa, Glycine max
  Coding DNA Sequence Number=SeqID_85899
MVTTILPHLAVPSASIEEMDAKWMQFDYMKWFYMISHPFMTPTQPGDTPRVLPVQQYDTIVETNVPQQPVAVAAAAPDELDVDVHRLGHAMEISIANKLERLLNLRILTECLSIVRSYISQPTGGHRSKRRRCMNDH

SEQ ID NO: 177585 - protein, 59 aa, Glycine max
  Coding DNA Sequence Number=SeqID_85900
MASVDISAMVKSKIFPYALRKACIWRGPINCPNSLMLCEKWHAACPLRAPIQGTYMGES

SEQ ID NO: 177586 - protein, 67 aa, Glycine max
  Coding DNA Sequence Number=SeqID_85901
MCANYRIGHLRMLPDFSQVGVAELCVWITTWANETFSQSQPEDADISKEGADDDVSHCMLSGSIVPA

SEQ ID NO: 177587 - protein, 174 aa, Glycine max
  Coding DNA Sequence Number=SeqID_85902
  Homolog annotation: Hit_ID=Q6UUU1; Match level="QueryCoverage=49%, HitCoverage=55%, E-value=1e-18, Identity=61%"; Hit description =Putative uncharacterized protein
MNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPGVSPWRLPRALSFRSKLDCMHEPPVQSDRCALSGNYRLESNPERHAKAPLAAATASTSVQELVAQRTFENRPAR

SEQ ID NO: 177588 - protein, 110 aa, Glycine max
  Coding DNA Sequence Number=SeqID_85903
  Homolog annotation: Hit_ID=Q6WAY4; Match level="QueryCoverage=74%, HitCoverage=15%, E-value=7e-09, Identity=40%"; Hit description =Putative uncharacterized protein
MGTNQNGKRFYQVKVKGLDVTSLKELGRLMGPLQRQAFRKVYKKILDLTAAEVFTEAVVSLAQYYDQPLRCFTFGDFQMVPTVEEFKEILQCPLGGRKPYLFSGFLPSFK

SEQ ID NO: 177589 - protein, 154 aa, Glycine max
  Coding DNA Sequence Number=SeqID_85904
  Subcellular localization annotation: CTP_CleavageSite=48; ConfidenceScore=5.69e-01
MATLPASPPPPPPSDTSASSSTVKWTRKATRLRSLATRPPGVEKSVVNVDPATGKADGPHEKKLRTYLGILVRDKVDVTYETWKEVLAAQKELISEDIQAEFEIPEASNTDQDGVDDTVCQKYDISKEKWVQFCQTRRDPSWEDMRKKAQTIQK

SEQ ID NO: 177590 - protein, 32 aa, Glycine max
  Coding DNA Sequence Number=SeqID_85905
MADGKLIEMKGRVNLGFKRLWESLGCAKEENE

SEQ ID NO: 177591 - protein, 206 aa, Glycine max
  Coding DNA Sequence Number=SeqID_85906
  Gene Ontology: Mol. function=sugar binding; Cellular component =integral to membrane; Biological process=recognition or rejection of self pollen
  Homolog annotation: Hit_ID=A7R7F5; Match level="QueryCoverage=67%, HitCoverage=71%, E-value=3e-24, Identity=44%"; Hit description =Chromosome undetermined scaffold_1741, whole genome shotgun sequence
  Pfam annotation: Domain name=B_lectin; Domain location=24-124; Score =62.0; E_value=2e-15; Accession=PF01453.15; Description=D-mannose binding lectin
  Subcellular localization annotation: CTP_CleavageSite=52; ConfidenceScore=5.04e-01
MGRPWYQKLESLNLGFSALVVPRNKTVVWVAKTPSRFLRHLNTQQHRQSCPNNSHKQAQNPVVVLLDSGNLVIKIKGQADPEAYLWQSFDNSSDTLLPGMKLGSNLRTGLNRRYTSWKSPDDPSPGDTIATATNDFSTENKIGEGGFGPVYKGGYIAPEYAVDGSFSVKSDAFSFGILALEIVCGKRNRGLNQTDKSLNVVGCVRA

SEQ ID NO: 177592 - protein, 189 aa, Glycine max
  Coding DNA Sequence Number=SeqID_85907
  Gene Ontology: Mol. function=heat shock protein binding; Biological process=response to stress
  Homolog annotation: Hit_ID=A7QP45; Match level="QueryCoverage=60%, HitCoverage=13%, E-value=8e-13, Identity=36%"; Hit description =Chromosome chr1 scaffold_136, whole genome shotgun sequence
  Pfam annotation: Domain name=DnaJ; Domain location=69-131; Score= -11.0; E_value=0.049; Accession=PF00226.22; Description=DnaJ domain
MSVHFVDSLAMFARRNAEEKFKLGDLKGAIISATMAKTLDPDVVGIDETLVAYKIHLAASKNRVNGATNWYKVLGICEGFEDIDSIKRQHNKLVEMVNPTKKASVATWGALRLIYKASSNLCDPNKRNVALLHRQALGSYLGHEDFRTKKRSCGIKVTKRACPRCRKWCKCKFDPISGKTPNSRFSRGK

SEQ ID NO: 177593 - protein, 643 aa, Glycine max
  Coding DNA Sequence Number=SeqID_85908
  Gene Ontology: Mol. function=transmembrane receptor activity; Cellular component=intrinsic to membrane; Biological process=innate immune response
  Homolog annotation: Hit_ID=A7QUW7; Match level="QueryCoverage=100%, HitCoverage=51%, E-value=1e-130, Identity=42%"; Hit description =Chromosome chr13 scaffold_181, whole genome shotgun sequence
  Pfam annotation: Domain name=LRR_3; Domain location=624-643; Score =35.2; E_value=2.4e-07; Accession=PF07725.3; Description=Leucine Rich Repeat
  Pfam annotation: Domain name=NACHT; Domain location=222-380; Score= -29.6; E_value=0.012; Accession=PF05729.3; Description=NACHT domain
  Pfam annotation: Domain name=NB-ARC; Domain location=181-482; Score =105.2; E_value=2e-28; Accession=PF00931.13; Description=NB-ARC domain
  Pfam annotation: Domain name=TIR; Domain location=24-157; Score =153.9; E_value=4.3e-43; Accession=PF01582.11; Description=TIR domain
  Pfam module annotation: Pfam domain module=LRR_3::NACHT::NB-ARC::TIR; Domain location=624-643::222-380::181-482::24-157
  Subcellular localization annotation: CTP_CleavageSite=10; ConfidenceScore=5.05e-01
MASTSNAIIQCTSSSSSSSFEYDVFVSFRGEDTRNSFTGFLFEALKKQGIEAFKDDKDIRKGESIAPELIRAIEGSHVFLVVFSKDYASSTWCLRELAHIWDCIQKSPRHLLPIFYDVDPSQVRKQSGDYEKAFAQHQQSSRFEDKEIKTWREVLNDVGNLSGWDIKNKQQHAVIEEIVQQIKNILGCKFSTLPYDNLVGMESHFATLSKLICLGLVNDDVRVVGITGMGGIGKSTLGQALYERISHQFNSRCYIDDVSKLYQGYGTLGVQKELLSQSLNEKNLKICNVSNGTLLVWERLSNAKALIILDNVDQDKQLDMFTGGRNDLLRKCLGKGSIVIIISRDQQILKAHGVDVIYRVEPLNDNDALGLFCKKAFKNNYMMSDFEKLTSDVLSHCQGHPLAIEVLGSSLFDKDVLHWRSALALLRENKSKSIMNVLRISFDQLEDTHKEIFLDIACFFNHYPVKYVKEVLDFRGFNPEYGLQVLVDKSLITMDSRQIQMHDLLCDLGKYIVREKSPRKPWKWSRLWDVKDILKVMSDNKAADNVEAIFLIEKSDILRTISTMRVDVLSTMSCLKLLKLDHLDFNVKINFFSGTLVKLSNELGYLGWEKYPFECLPPSFEPDKLVELILPKSNIKQLWEGTK

SEQ ID NO: 177594 - protein, 87 aa, Glycine max
  Coding DNA Sequence Number=SeqID_85909
MESLMKMCVLVVEIIRRPFIMLFLDVITGKKSRGNKLHFLSPMGHLAKKNIWVFENKKQILRQTLAVADSMYYQANTSTGHNHTLKR

SEQ ID NO: 177595 - protein, 163 aa, Glycine max
  Coding DNA Sequence Number=SeqID_85910
  Homolog annotation: Hit_ID=Q6UUU1; Match level="QueryCoverage=52%, HitCoverage=55%, E-value=8e-19, Identity=61%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPGVSPWRLPRALSFRSKLDCMHETPRSVRTAAPYPVTIVLSPPGKTCKSTTGSST

SEQ ID NO: 177596 - protein, 158 aa, Glycine max
  Coding DNA Sequence Number=SeqID_85911
MEMSMIDASGGGALGDMTHVEARNLIEKMASNSQQFSARDDAIVLRGVHEVATDSSSSAKNKKLEGKLDALVNLITIQVSVLLCSNLESMSNLKLMLQTCWRNHPNLRWASPPQQQQHVPPFQNVAGPSRPYVPPPMQQQQQQQRQQATEAPSQPSLE

SEQ ID NO: 177597 - protein, 238 aa, Glycine max
  Coding DNA Sequence Number=SeqID_85912
MIMRGQGIYSSQDEATTSPSSSESEKAKGEESSEEIYPQEEGQPLVVKEKCKEVSFSSKSLAKKETHFTIKTNIKETFRLRQPLGLEVIPQVKELLDEGLVRKSLNPCALLVPKIGIIRHQIPTISDMMNLLSVATLFCKISHAPNVFMIHVHRDSLGRNNQHKNTEKGTLYCITFLNFLNSDQGVPKDPKRIKIIPDWPTPPSVKGRSPEYEEPQDLRSNPFQGGGDDAIIPPKGIG

SEQ ID NO: 177598 - protein, 148 aa, Glycine max
  Coding DNA Sequence Number=SeqID_85913
EPAFVGHPTIPVILTLGSCDAQRQIMVILRLLSSRGGGPDDMWRQIMVIPLTLLPFRHSRVRWFHWQGDSQAKWDHPLSGCDPRLTTLRYLAPIVRQFVKFRDMPKVKRKHCSTIRGANSNQAHLGLPGSSAEDSAFWRKQPSSPGRA

SEQ ID NO: 177599 - protein, 180 aa, Glycine max
  Coding DNA Sequence Number=SeqID_85914
MTLLTEEEDKIIEAREEAPSLVPQFERQQFDMLGRSVETQGLGQRRESVDAEAHVIPAMPERQHGMYYTPDQFTQEPSQMSSLYPYPYQSGTSSDAYFIGTQPPLQPGYVMADLFGSLSPAGTPSFAHGCQISTPNAPMGPPWTVSGNIPNITDLLGIDFGNQFSVKADERKGDRRRNPD

SEQ ID NO: 177600 - protein, 125 aa, Glycine max
  Coding DNA Sequence Number=SeqID_85915
MHTGARFRLDHYRETSADHSHHHNSDLPLPKFQLGSRPQDTHWTKRSPTGPWGFQLWLRASISPTGCPSPPARSCHRDIGKDRARKTPSGHGEVQQGPGVSSSDYGPLPVLWSAHCPQQGHQAPY

SEQ ID NO: 177601 - protein, 197 aa, Glycine max
  Coding DNA Sequence Number=SeqID_85916
  Homolog annotation: Hit_ID=UPI0000F2ADE5; Match level="QueryCoverage =35%, HitCoverage=12%, E-value=6e-07, Identity=45%"; Hit description =PREDICTED: similar to PDZ-LIM protein cypher3s isoform 1
MTDPLDESISCFLIRVNPWVLVPSPPEDYMSSPSKDYTSSPSEDFTSSPSEDYTSSPSEDYTSSPSEDFTSSPLEDYTSSPLEDYTYSPSKGHVPSPSEDYTSSPSKGHGYTPSPSEDYTSSPLENYTSSPSEDYMSLIFKGRHALTFRGLHVLAIIGLHSFAFKRQHVLNFRGLHTLAFRGLRVLTFSGLHIHTLR

SEQ ID NO: 177602 - protein, 87 aa, Glycine max
  Coding DNA Sequence Number=SeqID_85917
ANKEVCEVLIFSFSLSQSAGLASHPLSASLLRLSARKNLEKDKLYTRAKRGLIQLSTPLAYWQRTELEEEAIVRVWDESVSDCEVLE

SEQ ID NO: 177603 - protein, 174 aa, Glycine max
  Coding DNA Sequence Number=SeqID_85918
MALTPYPKKYQGQGILGVTPSKPKDDKGKTIEKQPLKARMQEKTSSMKYFKCLGRGHITSQCPPKKTMIMRGQDIYSSQDEATTSPSSSESEKAKGEESSKEIYPQEEGQPLMVKEECKEVSVSSKRLAKKERHFEIKTNIKEISPLRQSPHFLLCKKTLVSIATPPRLEFIPQ

SEQ ID NO: 177604 - protein, 277 aa, Glycine max
  Coding DNA Sequence Number=SeqID_85919
PLDESISCSSHKGGPLGLHVLTIRGLHALTSRGLHVLALRGLHALTLGLHALTSRGLHLLALRGLHALTLGITYPHRQRTTRPRLERTTRPHHQRAARPHLQRTISPRLERATRPHLGGLHVLAVKGSCTFTFVGLHALTFRGLHVLTFRGLHVLAIRGLLVLTFVGLHALTFRGLHVLANRGLHALTLRGLHALTSKGLHILALRGLRVLIFRASSFLLTVPGPPPDIAGGPTVRAQPEREAITQLLCIPGQDFIRAAVKRRVRIMRTNMTTLTQI

SEQ ID NO: 177605 - protein, 170 aa, Glycine max
  Coding DNA Sequence Number=SeqID_85920
MGGYSGCVKKGTGHSETKHCPSHVVSWGYEFLEKKLMDKRKKKQLEEATQSRSTDIVIDPSSPIRQHMKWKMTHTKKSGQMTSKAVKEIADKIDVSTATIGRPGHPGRVRTAGVGVTIKQYFGSAPRTSRSSSFMALKDLEQLTQKIRDQLEESITKKVTRQLMLSFSQM

SEQ ID NO: 177606 - protein, 114 aa, Glycine max
  Coding DNA Sequence Number=SeqID_85921
  Homolog annotation: Hit_ID=UPI0000ECBAF8; Match level="QueryCoverage =37%, HitCoverage=50%, E-value=1e-17, Identity=100%"; Hit description= UPI0000ECBAF8 related cluster
MNFAAKKPVEFTPIPVSYVDLLPYLLDNSMVAITIEFLQPGGSTSSRAAATAGGAPIRPIVSRITIHWPSFYNVVTGKTLALPNLIALQHIPLSPAGVIAKRPAPIALPNSCAA

SEQ ID NO: 177607 - protein, 137 aa, Glycine max
  Coding DNA Sequence Number=SeqID_85922
MLRNFMDYVIIPSLPSGTLWNFTDCALTLPFNFRHVTELHGLCYDAFLLASGMSRNFTNFVTMGAKYLEVVKRGSHPNNGWSLDEIRKKEHGYRYSNAKTNRKLKMVESTKAHIKSVLCISHPLQRMDSMRTQQECN

SEQ ID NO: 177608 - protein, 88 aa, Glycine max
  Coding DNA Sequence Number=SeqID_85923
MENWRRALRNNFAGLQTRWWRMHEQRQAMTFMGLRKKRQAMTFMGLRKKVENGELTRWWRMHEQRQAMTFMGLRKKVENGELANSATQ

SEQ ID NO: 177609 - protein, 114 aa, Glycine max
  Coding DNA Sequence Number=SeqID_85924
MGTNQTETRFYQVKIKGLDVTSLKELGRLMGPLQMQAFRKAYGKILDLTIAEIFIEAVVSLTQYYDQPLRCFTFGDFQLGFGKRVGSCKANSKRRSGPQKYLEGKARDMANHEE

SEQ ID NO: 177610 - protein, 83 aa, Glycine max
  Coding DNA Sequence Number=SeqID_85925
MDAKHLTRTKERSHVIKQRSPDEIRYMYEGVEGVTSSASEFVGHGWATRQAQLDATHHPGMDIRRACHLHVQIIGRRACRHCA

SEQ ID NO: 177611 - protein, 129 aa, Glycine max
  Coding DNA Sequence Number=SeqID_85926
  Subcellular localization annotation: CTP_CleavageSite=52; ConfidenceScore=5.03e-01
MYSLNGSQYLKRSVSDSPQEDILSKFGGKQGGFYVSTQLGSKINQNRKVKVKALRVGGLSARMSTNYGAKSAFVRERETEKDGDISLYITANNSYEDLSWSNNSRMICISKELNMDLVEHELCPRCHPH

SEQ ID NO: 177612 - protein, 92 aa, Glycine max
  Coding DNA Sequence Number=SeqID_85927
MEKMSVHIITRETPKRKMHVGAVEDHPGELNLNPEVMSSPRRADCLAMKPFHGPGKLDASLGELGSRKIHKRPFCPLLWYPFVFLIKTLSDP

SEQ ID NO: 177613 - protein, 45 aa, Glycine max
  Coding DNA Sequence Number=SeqID_85928
  Homolog annotation: Hit_ID=Q2HW89; Match level="QueryCoverage=77%, HitCoverage=3%, E-value=4e-07, Identity=74%"; Hit description =Integrase, catalytic region; Ribonuclease H
MDPTKYIFGKPTFTRRIARWQVLLSEFDIVYVTQKEEVEDEDRDK

SEQ ID NO: 177614 - protein, 116 aa, Glycine max
  Coding DNA Sequence Number=SeqID_85929
MDEFDTQVAWPGAQPSSSRGGGTSAAQEPAAAAEEPAEGEDELTPPEAFYYDTNVHMAQEEETSTDQMLEPPPVPASKETLTSVPALEPEQPILQDVPAAPVLDLNEDQPQDEQDV

SEQ ID NO: 177615 - protein, 194 aa, Glycine max
  Coding DNA Sequence Number=SeqID_85930
  Homolog annotation: Hit_ID=A2Q246; Match level="QueryCoverage=43%, HitCoverage=34%, E-value=9e-39, Identity=91%"; Hit description=CENP -B protein
MIDVRKETIANCFQHCKIRSASDVARNLDESTFDEETQDLETMINQCGYRNKMDIDNLMNYQGENEACSEVQSLEDILGTIIENNAEDDSEDDMEELERKKWDEELTSFIEGSIDVAIVKEFYANLYDLEDKSPKQVRVSGHLIKFDEDTLNTFLKTPVILEEGENLCAYSRFALLRLDPQELAAKLCIPGRGF

SEQ ID NO: 177616 - protein, 46 aa, Glycine max
  Coding DNA Sequence Number=SeqID_85931
MEEEFSLQEKNITMKIIYFSTLSSGNRLHFLVIDYQSLECLENTLF

SEQ ID NO: 177617 - protein, 64 aa, Glycine max
  Coding DNA Sequence Number=SeqID_85932
  Gene Ontology: Mol. function=protein binding; Cellular component =anaphase-promoting complex; Biological process=regulation of mitotic metaphase/anaphase transition
  Homolog annotation: Hit_ID=A7PUT4; Match level="QueryCoverage=85%, HitCoverage=28%, E-value=3e-21, Identity=85%"; Hit description =Chromosome chr4 scaffold_32, whole genome shotgun sequence
MWGFILLWHLIVLYVVFKLDESYMPSKVSIRAGDGFHNLKEIKTVELVKPTGWIYLSLSGADPR

SEQ ID NO: 177618 - protein, 331 aa, Glycine max
  Coding DNA Sequence Number=SeqID_85933
MERFDFKNLPVEDRRTTKNKRRTVMNDEELPRNRLQKRLGNNVVKLYGLRNNVRFDFRSVAKLHGLCNKAYFDFRRDHTKFTSRPPVSPNEIRVSRVGLLVGQVRFNSNALLNRMPKTSPHAIKLDRLWVWATICCLRVSSNLLSLDDKGADNHESRLEDVDISGKGVDDHIGKDNHKVSMNATGPSSRDSRSETFSRSRPEDADISGKGADNHKVYPHAIGPSSCDSKSETFSRSRSEDADISKKGANDHIGADNHKVSLHATGPSSRDSRRETFLQSLLEDVDISEKGADDHICLCVSTGSLASSCRIRTNGAGNHKMSPRVNRLDISG

SEQ ID NO: 177619 - protein, 58 aa, Glycine max
  Coding DNA Sequence Number=SeqID_85934
MTKVNVAKVVEAMSSKVILMMPKNQELSKVSSKDSRIKFQDSRLKNQDSRIIKIKIQE

SEQ ID NO: 177620 - protein, 58 aa, Glycine max
  Coding DNA Sequence Number=SeqID_85935
LCTTSSSEVKLLSLHPYLALTLTRLNTTDNSVKEFLHPGYKGFFESLYNLSYTGAWAC

SEQ ID NO: 177621 - protein, 118 aa, Glycine max
  Coding DNA Sequence Number=SeqID_85936
MTPRLDMRLNEEYNLKELMTLINHRREHGEQGRLERKKYLFFVTGVKQHRHSVDEKSDDLDLLETESLVGFMLILESDPIKETYLQPIGSTLAVQENYVASPLVDNPTVAQITNWNET

SEQ ID NO: 177622 - protein, 374 aa, Glycine max
  Coding DNA Sequence Number=SeqID_85937
  Gene Ontology: Mol. function=motor activity; Cellular component=cell projection
  Homolog annotation: Hit_ID=P15305; Match level="QueryCoverage=87%, HitCoverage=64%, E-value=2e-19, Identity=21%"; Hit description =Dynein heavy chain
GGPLGTSTLTFRGLHIFTFRGLHAITFRGLHPLAFRGLHILAFRRLHVLTFRGLHALTFRGLHALTFRGLHALTFRGLHALTFRGLHALTFRGLHVLAIRGQHVLAFRGLHALAFRGLHVLAIRGLHVLAIRGLHVLTIRRLHVFRGLHALRGLHLLAIRGLHFLAIRGLHAFRGLHVLAIKVLHALTFRGLHVLAFRGLHVLAIRGLHALAFRGLRVLTFKVGLHALSFRGLHALTFRGLHVLTFRGMHVIAFRGLHTLSFRGLHALAFRGLHVLTIRGLHVLTFRGLHALTFRELHILTFRGLHVLTFRGLHALSFSGLHALAFRGLDALAFKGDCARKTPSGPGEVQQGLEVSSSNYGPLSILRSARHPQQ

SEQ ID NO: 177623 - protein, 88 aa, Glycine max
  Coding DNA Sequence Number=SeqID_85938
MENNSLRCLQCNGEESAKGFTEKKKAREARDPEELPPEPAVDALDFPEDDEDPLPDVDSPEDVMSASETDSTEESSPGGTANSGDSSS

SEQ ID NO: 177624 - protein, 160 aa, Glycine max
  Coding DNA Sequence Number=SeqID_85939
  Gene Ontology: Mol. function=oxidoreductase activity, acting on CH-OH group of donors; Cellular component=peripheral to membrane of membrane fraction; Biological process=lactate metabolic process
  Homolog annotation: Hit_ID=P06149; Match level="QueryCoverage=93%, HitCoverage=26%, E-value=5e-63, Identity=80%"; Hit description=D -lactate dehydrogenase
  Pfam annotation: Domain name=FAD_binding_4; Domain location=44-160; Score=-5.1; E_value=0.0048; Accession=PF01565.14; Description=FAD binding domain
MNNNTSHPALLSELRRLVGASQLLTDAEQTARYRKGFRSGEGDALAVVFPGSLLELWRVLQALVQADAIVLMQAANTGLTEGSTPNGNDYDRPVVIISTLRLDKLQLIDGGRQILAFPGSTLYQLEKTLKPLGREPHSVIGSSCIGASVLGGICITPAAR

SEQ ID NO: 177625 - protein, 88 aa, Glycine max
  Coding DNA Sequence Number=SeqID_85940
MHLRTREPGKLSLLTCTLGGAVPHGPTREELKGLLVIIPKVVISLLMVSRGIIPFEEHIAAEGTTNNNMLSKRKTLDEGSLLSRKLET

SEQ ID NO: 177626 - protein, 54 aa, Glycine max
  Coding DNA Sequence Number=SeqID_85941
WISDGVRQYVELVGPQSCARGLRGWVQLRETKEEGYQGRQEVNVITCKFYIDLS

SEQ ID NO: 177627 - protein, 127 aa, Glycine max
  Coding DNA Sequence Number=SeqID_85942
  Subcellular localization annotation: CTP_CleavageSite=44; ConfidenceScore=5.60e-01
MATQLNQAQSQNSDKLPSQTVQNPKNVSVVTLRSGNQIQAPPPVAAPAPEPVKLPSTPDKEDEIVAQKESFLTRNCRCKLSSPQISEQLLLPYFYEGQLATWKRSMIDAANGRALGDITPTEARNLI

SEQ ID NO: 177628 - protein, 103 aa, Glycine max
  Coding DNA Sequence Number=SeqID_85943
MSVEEFLAQMAWPGASAALEPMPDVKDDLVPPEPFIFENDPVAQKEATAQEPTSPVHISPEPIPEDSQPSAPASEPEQPIIQNPPAAPVLDLNEHAEDHPQED

SEQ ID NO: 177629 - protein, 279 aa, Glycine max
  Coding DNA Sequence Number=SeqID_85944
  Homolog annotation: Hit_ID=UPI00006A2939; Match level="QueryCoverage =50%, HitCoverage=87%, E-value=4e-11, Identity=32%"; Hit description =UPI00006A2939 related cluster
HKGGPLGTCTYHLERTTRPRLERTTCPNHQRAARPHLQRTTRPHLERATRPRHGGLHALAIRGLHVLTFVGLHALTFRGLHVLANRGLHALTLRRLHVLALRGLHVLTIRGLHTLTSRGLHVLTNIGLHALPLRGLHVLANRGLHALTLRGLHVLALRGLHVLTIRGLHALTSRGLHVLALRGLPALALGTSYPHLQRTTCPHFQRATRPFHLRTACPHLRLHAVTFRGLRILIFVGLHALTFRGLHALAIRGLHVLTFVGLHALTFRGLHVLAFRGLH

SEQ ID NO: 177630 - protein, 204 aa, Glycine max
  Coding DNA Sequence Number=SeqID_85945
MSSSGQARSGTGRKPKFDSHRFRSAEHQQCFEGIRGWSFHKERHVQLREDEYTDFHEEIARRRWTPLVTPIAKFDPEIALEFYANAWPTEEGVQDMRSWVRGQWIPFDADALSQFLGDPLVLEESQQCEFSQRRNRADGRRVRIMHTSMTTLTQTWMTLLLSNVMPSDHNSDLPLPKFQLVYAILTRMSVHVAQVIANVIYLFA

SEQ ID NO: 177631 - protein, 203 aa, Glycine max
  Coding DNA Sequence Number=SeqID_85946
  Homolog annotation: Hit_ID=Q6WAY4; Match level="QueryCoverage=90%, HitCoverage=32%, E-value=9e-24, Identity=37%"; Hit description =Putative uncharacterized protein
MGTNQNGKRFYQVKVKSLDVTSLKELGRLMGPRQRQAFRKVHGKILDLAAAEVFTEAVVSLAQYYDQPLRCFTFGDFQMVPTIEEFEEILGCPLEGRKPYLFSGFLPSLSKIAAVVRDSTKELDRMKQTRNGVVGLPRKYLEDKARDMASQEKWGLFVDILALLIFGVVLFPNVDGLVDLAAIDAFLAYHHSKESPVVAILAD

SEQ ID NO: 177632 - protein, 134 aa, Glycine max
  Coding DNA Sequence Number=SeqID_85947
METFQVSQVIKNYVGLNSSFAEIPYGYRTLLSSRGGGPDDKQRPKAAGPMIRGDTLRLSAPFCHPEAAGPMTSRDQVWSFCTLVSSRGGGPDDTRRYLTVIRTLLSSRGGGPDDKQRPSLVILHPCIIQRRRAR

SEQ ID NO: 177633 - protein, 327 aa, Glycine max
  Coding DNA Sequence Number=SeqID_85948
  Gene Ontology: Mol. function=transferase activity, transferring glycosyl groups; Biological process=lipid A biosynthetic process
  Homolog annotation: Hit_ID=A8GID3; Match level="QueryCoverage=99%, HitCoverage=85%, E-value=1e-135, Identity=76%"; Hit description =Lipid-A-disaccharide synthase
  Pfam annotation: Domain name=LpxB; Domain location=1-321; Score =474.0; E_value=1.9e-139; Accession=PF02684.6; Description=Lipid-A -disaccharide synthetase
MEELAVMGIVEVLGRLRRLLHIRKDLTQRFTELRPDVFVGIDAPDFNITLEGNLKRAGIRTIHYVSPSVWAWRQKRVFKIGRNTDLVLAFLPFEKAFYDRYNVPCRFIGHTMADAMPLQPDKLAARRELGIADDALCLGLLPGSRGAEVEMLSADFLRAAQLLRQRYPALEIVVPLVNAKRRTQFEQIKASVAPELPMHLLDGKGRQAMIASDAAILASGTAALECMLAKCPMVVGYRMKPFTFWLAKRLVKTPYVSLPNLLAGRELVQELLQEECQPAALAAALEPLLHAGPERDALLATFTQLHQQIRWNADEQAADAVLEIANG

SEQ ID NO: 177634 - protein, 49 aa, Glycine max
  Coding DNA Sequence Number=SeqID_85949
MAEEHQHRVTLEDYSSSFVLQFFTRKAKKWLHLFKGNSLKTWEEVVENF

SEQ ID NO: 177635 - protein, 158 aa, Glycine max
  Coding DNA Sequence Number=SeqID_85950
MRETHEIPHHNLADFEPCLGYATERQAAGGIPLQNTLEGPQFRPQPQPFYGKMVGYTPSSFADLVFTGERIKVGLEKGKSDHPALMNAKTGANEKNENEGETLAMTAIPTQSNFPSSQQCHYLANNSPSHPIIHKGIPNHHKACPSHIRVKTLTKWNF

SEQ ID NO: 177636 - protein, 149 aa, Glycine max
  Coding DNA Sequence Number=SeqID_85951
  Homolog annotation: Hit_ID=Q6UUU1; Match level="QueryCoverage=57%, HitCoverage=55%, E-value=7e-19, Identity=61%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPGVSPWRLPRALSCSCLSVYRCHSAVMGRGLSHSTPDTQFR

SEQ ID NO: 177637 - protein, 45 aa, Glycine max
  Coding DNA Sequence Number=SeqID_85952
MLMHTHARAYLLSCDRDRIVLSNGQIPRQIQDGDESRYLGMSANG

SEQ ID NO: 177638 - protein, 98 aa, Glycine max
  Coding DNA Sequence Number=SeqID_85953
KKLVVGPWVGSIGPPPVCTGRLVPSAGDALLSLTGRVVPPDSDPIVLAFGIGVMINRDSRGAFVFHSQRRSDTVLVSTINDADQGSADVAFRTPLASL

SEQ ID NO: 177639 - protein, 128 aa, Glycine max
  Coding DNA Sequence Number=SeqID_85954
LITGLCQSFGVPVTPSKGDASQAVDAPPPPHQADPAGSFGMERYLQHLVRQQAANHKDQVQIHECLYQLSISQQSQGFAPFACPTPDQFRAEVAWPRDWPEAQAGKAPAEAPGDAEEARMDEEMIDLL

SEQ ID NO: 177640 - protein, 31 aa, Glycine max
  Coding DNA Sequence Number=SeqID_85955
MVRALPMTHGRPIGDHSPKPKVERYLRYACM

SEQ ID NO: 177641 - protein, 163 aa, Glycine max
  Coding DNA Sequence Number=SeqID_85956
  Gene Ontology: Cellular component=chloroplast
  Homolog annotation: Hit_ID=Q49KT9; Match level="QueryCoverage=52%, HitCoverage=92%, E-value=2e-25, Identity=63%"; Hit description =Putative uncharacterized protein ORF113
MSPHGGDMDGGEKRKERDGVSLAFGIAGPGGRPARRAIAQWALSHMDSLMCSSAPDPEMWIIQGTLAWRTSPVRSNVDPTFSSLVGSGRSGGDHHGSSLLENSYIPYQYMDSYLSSTGLGLASMEKNGAPNNVSSQTKNYEIAPFILGDQEIGSSHKKNRMLG

SEQ ID NO: 177642 - protein, 47 aa, Glycine max
  Coding DNA Sequence Number=SeqID_85957
MKISAGTKRGRGALSVNTGTHAKPAARAKHEYRHPRASRACSTEGNP

SEQ ID NO: 177643 - protein, 180 aa, Glycine max
  Coding DNA Sequence Number=SeqID_85958
MEISSFLQFPNESLCEALDRFHGLLRKMPTHGYSELVQLNIFIDGFIHTNKEKPSGAHSPRCNADPKQATGLDGDPQQASSITTSGQICGGAHEPGKCIAQEDSSREVNYMGVQNHHGFQGYNQGGPPRFNQGMNLTQGSSWRNHPGNQFNKEQRSQPAQNSNQGIDLYEKTSKLEETLN

SEQ ID NO: 177644 - protein, 121 aa, Glycine max
  Coding DNA Sequence Number=SeqID_85959
MSKLGGVLNEGSADEAWIFSLTRDQGVFQQKVLPSGGSNPADASSIRACRPRIFFINGFLCFLEDEWQRNGERERERRRHIKEKMSLEEAHHHRRPWIRAWRKNEMNEGRGREEHEILCSK

SEQ ID NO: 177645 - protein, 53 aa, Glycine max
  Coding DNA Sequence Number=SeqID_85960
MVIFHHGEAAKDKGEEELHHQECALDKKLVEDASMEEKKKREKERGGSTKLKE

SEQ ID NO: 177646 - protein, 47 aa, Glycine max
  Coding DNA Sequence Number=SeqID_85961
MEVFHSKFGQTLVTSNPMVLLEWLSSKTQKSPFKQLFGRGKCTESRK

SEQ ID NO: 177647 - protein, 200 aa, Glycine max
  Coding DNA Sequence Number=SeqID_85962
  Homolog annotation: Hit_ID=Q2HW90; Match level="QueryCoverage=51%, HitCoverage=19%, E-value=2e-07, Identity=36%"; Hit description =Putative uncharacterized protein
MSTSTVPFESTLGTRGWVLDQYLNYLSPKIVEALVCLEDWLKGSPTTFPSKEDLEEIEKIEQGVLYEKICVDYEQDSARGLDRVKQTRNGIAGLPRKYLEDKARDMANQEEWVPFMDVLALLIFGVVLFPNVDGFVNLAAIDAFLAYHHSKESPVVAVLADLFDTFDRSARRVAHGSSVACPLSVFGWFHTCSSKTRGIH

SEQ ID NO: 177648 - protein, 69 aa, Glycine max
  Coding DNA Sequence Number=SeqID_85963
MTDAHIKLPDRGLSKEEEFGLGGLNMDGPMMQSYPARALDRKLQVDWARDAREGPRVLMSLRVDFGPMG

SEQ ID NO: 177649 - protein, 58 aa, Glycine max
  Coding DNA Sequence Number=SeqID_85964
MRTLKVIELGTWWYKECHLGEPIVEAMSSKVILMMPKNQELSKFQRFKNQVSRIKIQE

SEQ ID NO: 177650 - protein, 71 aa, Glycine max
  Coding DNA Sequence Number=SeqID_85965
MTRGRLKRAKHVIETRLTYQGNPCGVYPDLSSFTGSDVIQISVACIKRSAPTQVHIKGPVKTHLIYNPSRP

SEQ ID NO: 177651 - protein, 246 aa, Glycine max
  Coding DNA Sequence Number=SeqID_85966
  Homolog annotation: Hit_ID=A5AEH5; Match level="QueryCoverage=81%, HitCoverage=55%, E-value=2e-12, Identity=27%"; Hit description =Putative uncharacterized protein
  Pfam annotation: Domain name=zf-CCHC; Domain location=178-195; Score =13.7; E_value=0.013; Accession=PF00098.14; Description=Zinc knuckle
MVMFSVYTVVKYCSGSVWRVSYCPSTVHFSCCMRMQSIGLPCDHILAVLICLNFTELPSSLVLNRWSKSATENIKEKYPDSAMYWDSYLIGRYATLVQVSREVCEVAYCDKEEYDKMLHFLSNELRRLKSKKNSQPCFDENDDQQGDNCDGILDPVVVRTKGCRQVGIDESGKRRRIQKCGQCGGSGHNKRSCTNPPRNANVLVGGSFISSSEQTNTICQPTDENNYELFMQHPHTFVAGSSCAGR

SEQ ID NO: 177652 - protein, 121 aa, Glycine max
  Coding DNA Sequence Number=SeqID_85967
MRHQIPMIGGMMNVLSGETLFCKITHAPNIFMIFVHRDSLGRNNQHENKEKGMFYSMTFLNFLNSDQGLPRDPKRIKVIPEWPTPPCAEERIPELQEPMDLRSNTFQGGGNDAILPSKGIG

SEQ ID NO: 177653 - protein, 32 aa, Glycine max
  Coding DNA Sequence Number=SeqID_85968
MVVVATYPSTRGRGEKQKVLAPHAPVTRDNIL

SEQ ID NO: 177654 - protein, 295 aa, Glycine max
  Coding DNA Sequence Number=SeqID_85969
  Gene Ontology: Mol. function=unspecific monooxygenase activity
  Homolog annotation: Hit_ID=Q5CEG7; Match level="QueryCoverage=35%, HitCoverage=99%, E-value=4e-44, Identity=84%"; Hit description =Senescence-associated protein
  Subcellular localization annotation: CTP_CleavageSite=52; ConfidenceScore=5.26e-01
MIGRADIEGSKSNVAMNAWLPQASYPCGNFSDTSSFKFRRTKGSIGHAFTVRIRTGNQNQTSFYPFVPHEISVLVELILGHLRYLLTDVPPQPNSPPDNVFRPDRPAEADLGSKKRGSAPLPIHGITPTYPTPLKSFHKVGLESSSTGSSFPADSAKPFPWLCRIPLVRTSSELTVRRPGKRPRRARSQSVPRPARDDPLSPRKQLEQSTDSRRVRDWDPRAQPSEPILFPRGCSPWRPDAVMSTTGRGRHSVLRIFKGRRGRTGHHATCGALPAAGPYLRLSRFQGGQAVKQKR

SEQ ID NO: 177655 - protein, 101 aa, Glycine max
  Coding DNA Sequence Number=SeqID_85970
MGGYSTDKESVDDTVCKKYDISKEKWAQFRQTRRDPSREDVRKKAQSIQKQNTAPHVLSRGGYEYLEKKMMEEKKKKKLEEVAQSRSTYTMIDHPSSIRQH

SEQ ID NO: 177656 - protein, 165 aa, Glycine max
  Coding DNA Sequence Number=SeqID_85971
VVVTENKRGYISCGSVLVEGTSTRLFKENKGGYIPCGSLLAFENSNLIPFMSLKLPVYSDLVKAFYSNLEIQEGTLIFKAYGIKMVIDQSLFYDLTQLSTEGVPFEGTLIDDWKYEFSVHDARRLVCTNQADMTGRLLAGSLAFESRILHYLIMRILLLRSSNLA

SEQ ID NO: 177657 - protein, 153 aa, Glycine max
  Coding DNA Sequence Number=SeqID_85972
  Pfam annotation: Domain name=Transposase_23; Domain location=37-107; Score=5.6; E_value=0.00029; Accession=PF03017.5; Description =TNP1ENSPM transposase
MQSQGLALPPEPKVGPSAARVSTKESCVDPLGNDPNTGDSNKCGLYIEENPPRPVALGRVYKGSTNVHNIPLLHDQVKVGVEEVKDADAPVPVPTDEVNLVGQTLNTFLAWPTHLVKHLSEKVMSDATMFGVFNPDFPLYIKHEDLSEIAHGG

SEQ ID NO: 177658 - protein, 104 aa, Glycine max
  Coding DNA Sequence Number=SeqID_85973
YILCGTSRGYIYLGLTENKRGYISCGSVLVEGTSTRFKKNKGGYIPCGSLLMYVIDYCHTLISSGDHCLVACNLRFVGPCGLNNLKRDRLRMQKKQQQFIYNVL

SEQ ID NO: 177659 - protein, 107 aa, Glycine max
  Coding DNA Sequence Number=SeqID_85974
MSGRHRPTDTSAGGDWHCGRWAECLLSSNVIYICVRVVMLVRMVRTCLFAAGPLRVRTRSPLKARACSPLKFRTCRLLKARECSPMMARTCNPLKVRACPPLKMGNM

SEQ ID NO: 177660 - protein, 120 aa, Glycine max
  Coding DNA Sequence Number=SeqID_85975
MGDQEETQEQMKADMSALKEQMASMMEGMLGMRQLMEKNVATATLNTLGHNSNPHLGYNRAAYPYGLPPNYTPPVMQDDAGHISSPILEGEPPPQPDEVHEDHQEYAQRDVEFYPPIPIE

SEQ ID NO: 177661 - protein, 179 aa, Glycine max
  Coding DNA Sequence Number=SeqID_85976
MVPTTHPLDPDKSNRALVFPGLITGLCQSYGVPVTPSKVIQPPITGAFIEKYYTPWQAQGDAHQDAGAPPPPRQADPAGSLGVEHYLQHLIRQQAANHRGQVQIHECLYRFNLSQQGQGSAPFVCPTPEQFGAEVAWPGDWPDAQAGEEPAGAPGEEDESHMDEDMIDLLGFLGGSGAT

SEQ ID NO: 177662 - protein, 157 aa, Glycine max
  Coding DNA Sequence Number=SeqID_85977
MSMDHAYHHNVDLPLRKYQLGSHPQDPQWTRRSPTGPWGFQLWLWAFVSPTGCPSPPAKSRHCDIGKDHARKTPSGPGEVQQGPGVSNSDYGPLSVLRSVRRSQQGHQAPYEPGFLQEVLRPQAGAGRDTIVAWGWPTVGNRCTTATSKAPQLIYKY

SEQ ID NO: 177663 - protein, 290 aa, Glycine max
  Coding DNA Sequence Number=SeqID_85978
  Gene Ontology: Mol. function=chlorophyll binding; Cellular component =photosystem; Biological process=photosynthetic electron transport
  Homolog annotation: Hit_ID=Q9TKW4; Match level="QueryCoverage=100%, HitCoverage=69%, E-value=1e-108, Identity=58%"; Hit description =Photosystem II P680 chlorophyll A apoprotein
  Pfam annotation: Domain name=PSII; Domain location=1-290; Score =418.5; E_value=1e-122; Accession=PF00421.10; Description=Photosystem II protein
MGLPWYRVHTVVLNDPGRLLSVHIMHTALVAGWAGSMALYELAVFDPSDPVLDPMWRQGMFVIPFMTRLGITNSWGGWNITGGTITNPGIWSYEGLYGPGIWVSDPYGLTGRIQSVNPAWGVEGFDPFVPGGVASHHIAAGTLGILAGLFHLSVRPPQRLYKGLRMGNIETVLSSSIAAVFFAAFVVAGTMWYGSATTPIELFGPTRYQWDQGYFQQEIYRRVGAGLAENQSLSEAWSKIPEKLAFYDYIGNNPAKGGLFRAGSMDNGDGIAVGWLGHPVFRDKEGHELF

SEQ ID NO: 177664 - protein, 35 aa, Glycine max
  Coding DNA Sequence Number=SeqID_85979
MDEDMTNLLGFWEEAEPHDQGSVCPHPHDLFRKRK

SEQ ID NO: 177665 - protein, 108 aa, Glycine max
  Coding DNA Sequence Number=SeqID_85980
MSGLTRDSPQISASPHQLDLAPYASGPYNAQWNAPGLLHDKHTLRSSRILGEMEVDEPWLGLWLPLNYQVDFVVDSGMAFVDNWVVGKEKGCYWLSNDIVGLVGSLAM

SEQ ID NO: 177666 - protein, 34 aa, Glycine max
  Coding DNA Sequence Number=SeqID_85981
MADRQAIKSKAKAKDVKEALLGGNLVPFGSMLVI

SEQ ID NO: 177667 - protein, 76 aa, Glycine max
  Coding DNA Sequence Number=SeqID_85982
MPIYRNSLLDNTSYVEVELHGESKVIQRCFDDNNDDKKKMMTKVMTKSSKKQLKGIKNNSRVQDKNQEDSRLKKKV

SEQ ID NO: 177668 - protein, 191 aa, Glycine max
  Coding DNA Sequence Number=SeqID_85983
MNSLSEHAALSEFISTHCMTSRKRKSIGRHILPERKVEIHHTELNEFKDELERRNFHKRLTNLVGSNIDLALVKEFYANLYSSEGPSPKQVRVRGHVVKINADNLNTFMETPVVLAEGETLPTYSRYYWLPTDIREIEAALCIPGRGFVLNAEGHPGKILRKDLTTLAQVWSVLSYSNLAPTFHTSDMTVD

SEQ ID NO: 177669 - protein, 396 aa, Glycine max
  Coding DNA Sequence Number=SeqID_85984
  Gene Ontology: Mol. function=unfolded protein binding; Cellular component=mitochondrion; Biological process=cellular protein metabolic process
  Homolog annotation: Hit_ID=A7NXQ8; Match level="QueryCoverage=45%, HitCoverage=58%, E-value=3e-35, Identity=50%"; Hit description =Chromosome chr5 scaffold_2, whole genome shotgun sequence
  Subcellular localization annotation: CTP_CleavageSite=25; ConfidenceScore=5.07e-01
MVASFFLTHLLLEVASPLFLPSPFRCHLSSKKQRNPLMKKILGLQAPMELTSLLKPSKSWSDRKLVDVEFILFMEGNVVMEQSFGVPKVTEDGVNTAESIEFKDKVKKVSFRLVVHVANATNDVAQYQIAGFCGTTCAIVLTRAIFTEGCKSVVAGMNSLDQRCGLSMAVGDAVANLKSKARMISTSEEIAQGEKKMIMLMSMAIFLNLKKGTTQALGSAILEQVDRNIDGGEFDKECIAGEYAELQFEKEKSEMNSVSSDPKIEEEILEAEEKLQFPDNEPAQEEADPLADVSKKEDGSQHGSNKDGSVCIKVIGEKSAKMVTDEGAIYVIANRGYNWRAIVQETVSATLNRTSVNDVIHEEGAAREGGKGPSIWDTFAHKYPGAAREGGKGPSI

SEQ ID NO: 177670 - protein, 76 aa, Glycine max
  Coding DNA Sequence Number=SeqID_85985
MAAEWRRKKERRRHFKEKMSQEEARHHRRPWIRAWRKKEMNEGRGRKEHRILCSKRALKSEPTNPRSIPRFSTKCA

SEQ ID NO: 177671 - protein, 333 aa, Glycine max
  Coding DNA Sequence Number=SeqID_85986
  Gene Ontology: Mol. function=protein methyltransferase activity; Cellular component=cytoplasm; Biological process=protein amino acid methylation
  Homolog annotation: Hit_ID=A7P1R7; Match level="QueryCoverage=84%, HitCoverage=70%, E-value=2e-91, Identity=60%"; Hit description =Chromosome chr19 scaffold_4, whole genome shotgun sequence
  Pfam annotation: Domain name=Methyltransf_11; Domain location=111 -243; Score=1.4; E_value=0.061; Accession=PF08241.3; Description =Methyltransferase domain
  Pfam annotation: Domain name=PrmA; Domain location=2-281; Score =179.6; E_value=7.8e-51; Accession=PF06325.4; Description=Ribosomal protein L11 methyltransferase (PrmA)
  Pfam module annotation: Pfam domain module=Methyltransf_11::PrmA; Domain location=111-243::2-281
MICISSIFHEVEDINVSISHAADSIGLKEIPRYEVKIDDEEDWMKRSQESLHPVQVTEGLWVVPKWCTPPDVQATNIIVNPGLAFGTGEHATTKLCLLLLHGCIKGGEHILDYGTGTGILAIAALKLTLNSNFDILLPYKFGAAFAVGVDVDSEAIASASQNAYLNNIGQDKMQLHLVASKTSSSSKNDLTFGVMEGENTCEIHPVTDEEKFDVVVANILLNPLLDLADQIISHAKPGAVVGLSGILSEQVQYIIERYSPFLEGIEVSKMDDWACRFGSSQPIPHCSLMPPSKFCVGQLLTCHLTMHFGMVNVVFGCNSFAKQKIRLKGQCRA

SEQ ID NO: 177672 - protein, 162 aa, Glycine max
  Coding DNA Sequence Number=SeqID_85987
MLFRSPALGDRCCVLPTREGHAAVWIHPDHSCSACQFIAGEVCVVPGQCVSDYVDWFFRILHPFMTPGQASDPLPDETDIPHVPEPREPSTSARPAVDEPRHAVEVCYGIVERLEHHLSLGVVTPGSSTHEVIEECLRMVRSVTQDQLVYVRSQRRRYTDQA

SEQ ID NO: 177673 - protein, 237 aa, Glycine max
  Coding DNA Sequence Number=SeqID_85988
MPAIEDEQLLTSTMPTRRENTTLKMPGLLNTNEHHDRRTQTPDVDEEDDTHGENAARRTSTVGQAFLKPATTSRKQNERKKNATEVRSRVRKGTKTTSRQQEEEKMVRDHKEEEGQLSPPPYMIQIPQEISKFWRRLSGEERSGGGSGGVDVTGFKEIFNLKNDAGSYAYCVAFAGSCRSGVIGAGRCWVWGRRRWSLLGAGSSPLVAAGCGVVRAGHAAVFCAVRPPTVLLHFNFG

SEQ ID NO: 177674 - protein, 102 aa, Glycine max
  Coding DNA Sequence Number=SeqID_85989
MYFHLCSNEIQQKRKFYCILYSDVGNIFTWCGEGEGTSVEHCGSHRQQTKYAEGGASVRDMDEDEWMYESIMSEEADMDYQDEEACGANEPHVDCFDAFNTS

SEQ ID NO: 177675 - protein, 94 aa, Glycine max
  Coding DNA Sequence Number=SeqID_85990
MDWFFCISHPFMTPGQASDPLPDRHATQPRVIPQVPETDIPQVLEPAAPSTFARSNVDEPRHAMEACYGTAERLERHLNLGMVTPGTSTHEVIE

SEQ ID NO: 177676 - protein, 312 aa, Glycine max
  Coding DNA Sequence Number=SeqID_85991
  Homolog annotation: Hit_ID=A5ASR8; Match level="QueryCoverage=91%, HitCoverage=61%, E-value=1e-14, Identity=24%"; Hit description =Putative uncharacterized protein
  Subcellular localization annotation: CTP_CleavageSite=38; ConfidenceScore=5.28e-01
MAESSKKRKGISTSSAATETRSHGASKAQTTQIPPSISSTLFSSEEQCIRYNSLFSSRSIIDPKYVDLAFFDDELFDCFQAFQNSGLILFISMKLPFYPELVRTFYSNLEIQEDSLISEVYGIKMVIDQSLLFELTHLSSDGVPFEGTLDDEWKFDFSIFDACQLVCTNQADMTGRLLAGSLAFECRIMHYLIVRILLPRSSNLAQISEEELIIMWVFLIGRQIDWAHLVRYRMHKALRSNAPLPYPHLITLFLHHFNVPLDSDPFVKVKRSFSIGANVVSSFGYHKERDGSWVKKDAPTQAAECNIPIFII

SEQ ID NO: 177677 - protein, 105 aa, Glycine max
  Coding DNA Sequence Number=SeqID_85992
  Homolog annotation: Hit_ID=A7NWP7; Match level="QueryCoverage=57%, HitCoverage=35%, E-value=2e-16, Identity=70%"; Hit description =Chromosome chr5 scaffold_2, whole genome shotgun sequence
MAEDTRGMSFLTVPTHPKCIVYAEHIHLIRSKVMVGYIVAVAAFCVLELPFRSDADVAVEEAPNFFRFVAETDEIGDVRAHTMEIHPSVTKIVVKEGGSVELSLD

SEQ ID NO: 177678 - protein, 92 aa, Glycine max
  Coding DNA Sequence Number=SeqID_85993
MSCPSLQMSRTLACCMSPLPANSALSCCVKKGPHWSRWCYWRDAQSAPVSLVLLAGCPIMLLVLAAPSHVSTILARASGDINGVADAAGGIK

SEQ ID NO: 177679 - protein, 59 aa, Glycine max
  Coding DNA Sequence Number=SeqID_85994
MHAESSSPSQGEKEAKRTSTAKRSFSALNAIEESGRASASRPRAKRSMCLQPGLAHNWS

SEQ ID NO: 177680 - protein, 61 aa, Glycine max
  Coding DNA Sequence Number=SeqID_85995
MGLAQRSALSLITKDSITMGKLGLAQQGLAQQAHLARSSCRSKRHDDESSSRLSQQVQDQD

SEQ ID NO: 177681 - protein, 149 aa, Glycine max
  Coding DNA Sequence Number=SeqID_85996
LLLQITALCKVWGVHSDSLTHERLSPAIDLATFKYFIYTTDTALHAPELIPGVVHHHVAWPGNQPSSSGGGDAYAAQEPDPEEPPATAAEGEDELTPSEPFDFDASVPMAQEEETSQDIIPEPSPASAPIPDDAIPSAPVMEPEQLIQD

SEQ ID NO: 177682 - protein, 62 aa, Glycine max
  Coding DNA Sequence Number=SeqID_85997
MKPDCALSLTSWAKRIFQDQSELLTALSTCPRAKPGLSAKGQAKRLSFKLKHHEGTISAELR

SEQ ID NO: 177683 - protein, 301 aa, Glycine max
  Coding DNA Sequence Number=SeqID_85998
  Gene Ontology: Mol. function=cellulose synthase (UDP-forming) activity; Cellular component=membrane; Biological process=cellulose biosynthetic process
  Homolog annotation: Hit_ID=A7PBB7; Match level="QueryCoverage=83%, HitCoverage=22%, E-value=1e-119, Identity=79%"; Hit description =Chromosome chr16 scaffold_10, whole genome shotgun sequence
MAGAKGSSCAIPGCDSKVMRDERGADILPCECHFKICKDCYIDAVKTGGGICPGCKEPYKNTELDEVAVDNGRPLPLPPPSGMSKMERRLSMMKSTKSALVRSQTGDFDHNRWLFETKGTYGYGNAIWPKEDGFGNEKEDDFVQPTELMNRPWRPLTRKLKILAAVLSPYRLIIFIRLVVLALFLAWRIKHQNTDAVWLWGMSVVCEIWFAFSWLLDQLPKLCPVNRSTDLNVLGDFNSIRSQDERTGSSQRSVGTYDSFGFNDWISDMEIQEIKSFGSRFTWCRPNGSVRSRLHRCLVSE

SEQ ID NO: 177684 - protein, 92 aa, Glycine max
  Coding DNA Sequence Number=SeqID_85999
  Gene Ontology: Mol. function=ATP-dependent helicase activity
  Homolog annotation: Hit_ID=A7Q0G9; Match level="QueryCoverage=58%, HitCoverage=6%, E-value=7e-14, Identity=72%"; Hit description =Chromosome chr7 scaffold_42, whole genome shotgun sequence
MDCLQAGSLASLKATLEELSGQATLSSSNEEETSVNIEATQFHVFDEVRDGEWLVIATNVVEISLTIPRIKYVVDTGREKVKNYDPSNSMET

SEQ ID NO: 177685 - protein, 88 aa, Glycine max
  Coding DNA Sequence Number=SeqID_86000
MGCLAEHSFFFILALKVESASSGKVTVEVQMENKIHKVKQKKGTQLRNGETPEVVPSHAKEFHTLSIGKMRMLFPGNSSAWEANKFYQ

SEQ ID NO: 177686 - protein, 249 aa, Glycine max
  Coding DNA Sequence Number=SeqID_86001
  Subcellular localization annotation: CTP_CleavageSite=17; ConfidenceScore=5.43e-01
MTIPPSSPPLPPELAPSSSSLKKTRKATWLRSLAARPVRMERPVVHVDPATRKVDCPHKKQLRTQFKSDLTSNWALAQGNEEEDDTVYEKYDISKEKGQHFCQSRRNHSREDARKEAYAIQKLNIAPHVLSHEGYLNTKEGLSLCGSDIVKEILQDSETLKRVAWGLDVGTRGSVLPPEPKVGPSVSRVSTKGSCVDPSGDKQGVEGSKKPVDRPEPDDDPLGQMTLTISGLFLMPMQVSWDSTVFGCV

SEQ ID NO: 177687 - protein, 218 aa, Glycine max
  Coding DNA Sequence Number=SeqID_86002
  Gene Ontology: Mol. function=calcium-dependent phospholipid binding; Cellular component=synaptic vesicle; Biological process=transport
  Homolog annotation: Hit_ID=A7PY44; Match level="QueryCoverage=57%, HitCoverage=24%, E-value=1e-49, Identity=76%"; Hit description =Chromosome chr15 scaffold_37, whole genome shotgun sequence
  Pfam annotation: Domain name=C2; Domain location=105-186; Score=97.5; E_value=4.3e-26; Accession=PF00168.21; Description=C2 domain
MHYLYIVLASSDLPHQYLKSNNVLVGPDNEPMLVDYRAPEATQQGQVSRSCAVYYLGVVIIEILIARAVAYEDQRARRETGHVSVSGSVGWGEADELELKPQGTLRAIVIKANDLKNMEMIGKSDPYAVLYIRPLFKVKTKVIDNNLNPVWNEVFDLIAEDKETQSLIVEVFDKDIGQDKRLGIVKLPLNDLEPKIEKEFELRLLSSLDTLKVKDKKD

SEQ ID NO: 177688 - protein, 53 aa, Glycine max
  Coding DNA Sequence Number=SeqID_86003
MWVSTEWFPADFGREEKENNDFRQEDDKEKRNDHGDIEEVIHIFELAIQVDKW

SEQ ID NO: 177689 - protein, 49 aa, Glycine max
  Coding DNA Sequence Number=SeqID_86004
FRAEVAWPGDWPEAQAREAPTEALGDAEEARKDEEMMDLLDFLGGSGAT

SEQ ID NO: 177690 - protein, 134 aa, Glycine max
  Coding DNA Sequence Number=SeqID_86005
  Subcellular localization annotation: CTP_CleavageSite=45; ConfidenceScore=5.15e-01
CASSGILLDEPLLPESSRKRFFRSGRRLVTSGRTLLPETFRKNPSSGNFPENVLPELPEEPLTGLPEVSAVSLLSPFFPASSPLVFYPKVTILSKGELGRLTSFAEKKKTRFALALPEKKKQFAEKGEQASRKE

SEQ ID NO: 177691 - protein, 451 aa, Glycine max
  Coding DNA Sequence Number=SeqID_86006
  Homolog annotation: Hit_ID=A5B5G7; Match level="QueryCoverage=44%, HitCoverage=14%, E-value=3e-07, Identity=27%"; Hit description =Putative uncharacterized protein
MAYHWKRYIDIVVPRKLLPERNMVIYHTEFDEFKEELERRKWDEELTSFDEGSIDVAIVKEFYANLYDPEDKSPKQVRVRGHLVKFDEDTLNTFLKTPVIIEEGETLLAYSRFALLGPDPQELAAKLCILGRGFELNVDGQLLKILRKNMTILAQTWSVLSYSNLIPTSHTSDITLDRAKLIYGIIMKMDMNLGYLISNQISIIAQHDSSRLGFPALITALCKARGVTSDFRSLESLSPAINLVYIKKNYWNLDDPTMTFKGPRKAMGKRSEAPLTSTAPDTSAPSLPDPSTAPSITVPSSSTAAPLSAPSVPAPLIGPSSFTSETLFAMLQSLHRGQIIIIHRLQSSSQQPSMSMEEFLTQVAWPGVQPSPSRGGEASAAHEFVPDVEDEPVPPKPFIFETNPVTQEEATAHDPISPIHISPAPISEDTGHGARAAHFSGCTNCFNAGFK

SEQ ID NO: 177692 - protein, 188 aa, Glycine max
  Coding DNA Sequence Number=SeqID_86007
MDLSVLAPEISFSSLSDSLVSWAETTWVVNMTCFAEDKFDILKHNNLNSAKEVIQEMGDAGLKPIAFAYRQRDGEQLQQKELILLGLIEDDIMEVKDIAPGLGLEHAIMHEGRKIKDLNEEAIKQSGSAHANYLVDEDMTKSKGKDPLEGLGGPMTRTRARKEKEALQQVLSILFEYKSKFQGEKSKD

SEQ ID NO: 177693 - protein, 143 aa, Glycine max
  Coding DNA Sequence Number=SeqID_86008
MSVMTASQSRKGEDRHEAKGFRGSVRVVSVVALRILDVIEHGNYIPLDNQLSQVPKTSRTYAQRQRFMLNSKARNTLLCILSEKEYTKELQQDEGLEKGKSLALKPQKSKASSTCKESSSKFVNIDTPSNDESNDEGSNEDKQ

SEQ ID NO: 177694 - protein, 73 aa, Glycine max
  Coding DNA Sequence Number=SeqID_86009
MKNKAEKKNLLPKENENLPEEASSGNIPDDVLPEVVSEYFWKSQILLPEEGSSGKVPERGFPKSFRKKSSFGR

SEQ ID NO: 177695 - protein, 322 aa, Glycine max
  Coding DNA Sequence Number=SeqID_86010
  Gene Ontology: Mol. function=aspartic-type endopeptidase activity; Cellular component=cellulose and pectin-containing cell wall; Biological process=proteolysis
  Homolog annotation: Hit_ID=Q9C6Y5; Match level="QueryCoverage=29%, HitCoverage=23%, E-value=3e-24, Identity=56%"; Hit description =Nucellin, putative
MDIDEDLDLSDFDLDPANAEILEELSEDIPPRKALMPPPFASSMRSSSPSKKQLYELASSFKLHYAAKEVTMAFGEGHIKRFLAQFLSTLTLFQTNPSFDLSNQVPPFPSETPIAIVEEEFGSPLASVFDHFEYEPIAAAASPKGCDSFSYLRRVSDRLLDENFGRQRYCTVNRAIGNPPKVYELDIDTGSYLTWTQCDASCKGCTLPCNRQYKPHGNLVKCVDPLCGAIQSALSLPHVTTNVQCDYQVQYADQGSSLGVLGTSFVVQVEGTSTWVVVTKNKRGYISCGSVLVEGTSTRLFKENKGGYIPCGSLLVKGFLQG

SEQ ID NO: 177696 - protein, 162 aa, Glycine max
  Coding DNA Sequence Number=SeqID_86011
  Subcellular localization annotation: CTP_CleavageSite=69; ConfidenceScore=5.11e-01
MVLEISFQPCKNPFTSKDPQGMYPPLFSLNNLVDVPSTRTDPQEMYPLLFLVTTTQVDVPSTCTTKDVPSNVLKQSSQAVSPLKLCEWGNKRILKREKGDTKEFRRLVLCSFGKGRRETQKEFRRLVLGEFFLAKKEERHKRIQAVSPLFFWKREKRDTKRI

SEQ ID NO: 177697 - protein, 140 aa, Glycine max
  Coding DNA Sequence Number=SeqID_86012
  Gene Ontology: Mol. function=protein transporter activity; Cellular component=cytoplasm; Biological process=intracellular protein transport
  Homolog annotation: Hit_ID=A2ZLA8; Match level="QueryCoverage=96%, HitCoverage=15%, E-value=1e-18, Identity=37%"; Hit description =Putative uncharacterized protein
MADIKDVHGNDLSEKKNLDHPILSSILDSNFMNLVKSLEADIREQIVDVYSRPKMKVAVVPAKLEQRSGESDANIYYCLLTSSICSDLVLRNASMAEDLAKTSSTLQPEQRVSGGLDRVPIDTLRRDLQEASQRLNMRKL

SEQ ID NO: 177698 - protein, 174 aa, Glycine max
  Coding DNA Sequence Number=SeqID_86013
  Gene Ontology: Mol. function=nucleic acid binding; Cellular component= ribonucleoprotein complex; Biological process=nuclear mRNA splicing, via spliceosome
  Homolog annotation: Hit_ID=A7Q0F0; Match level="QueryCoverage=50%, HitCoverage=35%, E-value=2e-25, Identity=68%"; Hit description =Chromosome chr7 scaffold_42, whole genome shotgun sequence
  Pfam annotation: Domain name=RRM_1; Domain location=16-89; Score=7.4; E_value=0.031; Accession=PF00076.13; Description=RNA recognition motif. (a.k.a. RRM, RB
MSEVNATPEIPQNKAIYINNLNEKIKIDGMLLKSLNTVFTQFREILEVLAFKTLKHKGQAWVFFEDASSASNVVRQMQGFPFYDKLMPRSLDHGVPHCRRHHPLVLQALNVSRAPPCNRDWHLDTPVWLQMKPYINDMFLDMLQIAESGGLNHEGSNIDYPSWYNSTNGHPYGS

SEQ ID NO: 177699 - protein, 348 aa, Glycine max
  Coding DNA Sequence Number=SeqID_86014
MGEEKGLWLGWITPARCGEEDGYGVEYYVGVVVWKVLQRWRGIGSGWRQLEGVWAQVWVWGGACGGGGRAGGGEGKGCICTKGDVTTQMREATVYQYNHLMAAQIPEEAKRLRGWSAVHRIQTDLRSNCMFRHGRSWIVDGIEVRWGLEFIISDEEMADVGRGDGPTAYLLGGVRAPWREEGTKAVVLVPHGKVLESSLKQNSSTSMKGVGLGCGLPNARIPANPIPELAASLAMKGKSRCDTSIDTRITRVPPCKMRQLAGPPISCGGGEGKRKYVMVSEEVAESEIVLGEGFDGLLQLVGGDLACVMLRHGGERRGRNSCVRKKTRVLGVNGARNGEGGGRWRRVA

SEQ ID NO: 177700 - protein, 44 aa, Glycine max
  Coding DNA Sequence Number=SeqID_86015
MVLVVVETTWLQERYVYLGFGILLSPITREGGILMLRKIPFQIE

SEQ ID NO: 177701 - protein, 80 aa, Glycine max
  Coding DNA Sequence Number=SeqID_86016
MVCNGAIRDPGIESVIIVDFEAFLSDSVTELKRRLLGSLGKVAREEKVRGRGSCFDSKAFRRDSSFEGSRNGAENRVMCG

SEQ ID NO: 177702 - protein, 163 aa, Glycine max
  Coding DNA Sequence Number=SeqID_86017
MVRTRGLGRALGRVIGRALGREVSHDTDDAPQRRRPIASARRQRKVAPVAEDVDDTDHADEEVHEQPEQAVGVDVSTDAEGFPGGPHDTSVLQDYVYHVAVKVWSGEERPELKLCSHGRKVEKFGKPTPKIEGLVAVTKLSPLITCSLDTGDWGLMSAFMEMS

SEQ ID NO: 177703 - protein, 124 aa, Glycine max
  Coding DNA Sequence Number=SeqID_86018
MVVLVFSTWWLKERVRTVPLVAALLSSSNMAVTRGESTLLARWTWPSPTRVCLRGRDGNLGEAMEILDGVTVEGVGIADLYNAVEREVQRWSEGSPQRLGRKLSNHNKNKNSPHSKTVFENDRL

SEQ ID NO: 177704 - protein, 61 aa, Glycine max
  Coding DNA Sequence Number=SeqID_86019
MWVSTERFPADFGREEKENSDFRREEKEKRYQAAVKEKEKEAPTSYNNNNNNNNNNNGNAM

SEQ ID NO: 177705 - protein, 156 aa, Glycine max
  Coding DNA Sequence Number=SeqID_86020
MNDEERLKIFAKSPTKTKIGEELATQLAQASQVASSRSNHLVEEHPGRPNMLRNLTNCVTMLPFDLRHVTELHVMCNKGCQVPRSGQKKVACHQTMDYCIGKLVNKSNLPKNKAVKEKEKQKGRRKYLKKEKCESEKEEVNVAMEAEIYPTGTTAI

SEQ ID NO: 177706 - protein, 96 aa, Glycine max
  Coding DNA Sequence Number=SeqID_86021
MELKTLWREMSRLETRGATLFQLSRWSISDRLSLRYIRNRNLVEGISKANMDFDGLLGSSLRDNHSLGPQPTPEGGFIQSGAKRLLVEGVKLTCRF

SEQ ID NO: 177707 - protein, 213 aa, Glycine max
  Coding DNA Sequence Number=SeqID_86022
MVVLYKLPWNPNFECFILALFFPWTSFDYQSVEKDQAEKAAKAKDEKAKAEKSQVDKARAEKAQVEKIAIVRGKRKENHLDDWVPSPYTRVIIRDSSTLQALIQNSMLGPTEIDMLRTTKSRKEALKASAADSTKTLQEEVEHLNKEFALFKIDAVAAEEKVKTNLGDAKAEILKLMKLGFRRPVDRSNKDVNGQGELVNKADISANVMLESA

SEQ ID NO: 177708 - protein, 134 aa, Glycine max
  Coding DNA Sequence Number=SeqID_86023
MSALAILIPILVATADADAIVSGGVPKGLPVGIDSVGDLGELVQHGVPAAAFGVGTAVVGGGRGEAAIGGLRWEREEQGRPLFGERNGKLLRREGESWCGNRRRSHERENKRVDMRVVEEEGDWEYTVCVENVK

SEQ ID NO: 177709 - protein, 182 aa, Glycine max
  Coding DNA Sequence Number=SeqID_86024
  Gene Ontology: Mol. function=ligase activity; Biological process =response to auxin stimulus
  Homolog annotation: Hit_ID=A7PZS7; Match level="QueryCoverage=40%, HitCoverage=18%, E-value=4e-27, Identity=80%"; Hit description =Chromosome chr15 scaffold_40, whole genome shotgun sequence
MQERVQRETLKRILEDNASAEYLQSLGLNGRTDPESFKACVPMVTHKELEPYIYRIIDGDASPILTGKPITTMSLSFWMIFLQFWHYPGETKGVSYNVVVTVKQDEIEISGLITGFGDAMHKGFVLDWMRAQDCVVCEESNGYCKFDQATKQSRACCHPLMLHTICANMNGVLIEKGLVELL

SEQ ID NO: 177710 - protein, 148 aa, Glycine max
  Coding DNA Sequence Number=SeqID_86025
MGVGDDNVDAGWLGRQRIALALHAAADILRIKDLLAVMTFLISRPLILDAFSRMPRMLLAETFDLETMMFPDQQVLKIPVDDSGLIVSWVNDPSSFDFWVDDPAWVGVPEDVEDAFLVVGSGRASIVPLLDLPPLPEELVALGGISVS

SEQ ID NO: 177711 - protein, 54 aa, Glycine max
  Coding DNA Sequence Number=SeqID_86026
MAYSDQTTEIKYYERTSSHCKLNTKRRIHELEGGCKYVAKIWVECGWKMDQIQK

SEQ ID NO: 177712 - protein, 203 aa, Glycine max
  Coding DNA Sequence Number=SeqID_86027
  Homolog annotation: Hit_ID=A7NV34; Match level="QueryCoverage=100%, HitCoverage=74%, E-value=2e-39, Identity=65%"; Hit description =Chromosome chr18 scaffold_1, whole genome shotgun sequence
  Pfam annotation: Domain name=Kelch_1; Domain location=46-108; Score =14.4; E_value=0.057; Accession=PF01344.16; Description=Kelch motif
MPSVVDEEDSQKGSSGLWMWNMVKGIRIAKIIRGLLGQKDALDDMPFCGCAFGAIDGCLYVLGGFSKSSTMKLNGELYAFDPSNYVDSGRIKVYDQGEDEWKVVIGKVPVYDFTESESPYLLAGFRGKLHFITKDANHDISVLQADHCSNVDSSPSTSAPQSPKYMEDELLRESAETNEVVWKLVACKGFEQAELINCQVIDI

SEQ ID NO: 177713 - protein, 135 aa, Glycine max
  Coding DNA Sequence Number=SeqID_86028
  Gene Ontology: Mol. function=protein kinase activity; Cellular component=integral to membrane; Biological process=protein amino acid phosphorylation
  Homolog annotation: Hit_ID=A7P266; Match level="QueryCoverage=83%, HitCoverage=13%, E-value=3e-25, Identity=46%"; Hit description =Chromosome chr19 scaffold_4, whole genome shotgun sequence
MAPEYAMHGYLTDKADVYSFGVVALEIVSGRSNMIQRQKEEAFHLLDWVTARINVSLLCTNVTASLRPTMSLVVSMLEGRSVVQEVFSESSEALDEKKLEAMRQRYQEIIEENKLTEIQWMTHWLLHHLQQISIL

SEQ ID NO: 177714 - protein, 145 aa, Glycine max
  Coding DNA Sequence Number=SeqID_86029
  Gene Ontology: Mol. function=aspartic-type endopeptidase activity; Cellular component=small subunit processome; Biological process=DNA integration
  Homolog annotation: Hit_ID=A5AFV0; Match level="QueryCoverage=98%, HitCoverage=11%, E-value=1e-15, Identity=33%"; Hit description =Putative uncharacterized protein
  Pfam annotation: Domain name=zf-CCHC; Domain location=126-143; Score =12.0; E_value=0.023; Accession=PF00098.14; Description=Zinc knuckle
MKVTALKQTSNDMIAHVGKARAAVEELRKFLVADSLEEVNRKLDKFYMVLILRSLHSDFDHVRDQVLVGDQVPSMDSLITRLLRVPHLSKDENPTDSVETSAMVASRGRGGGRNSRGGRNGRGGRPHCTYCKRMGHTQENCYSLH

SEQ ID NO: 177715 - protein, 223 aa, Glycine max
  Coding DNA Sequence Number=SeqID_86030
MGGEEAFFAYGRTFFRMRDCLKMLRMEEGSSVSSYGRTFFHKNLRKKIMVRTRGLGRALASVRGRDMGQDEHHVDVRRQCRPIASAHRQQVHVDVTKDVPQVTEDAPHMDEDIPERTANVDAADVEGIAIDGAEGSPADHAEGFLGGSYDPSVLTSFADHVAHSIWSGEEQLELKLASHGMKVDKFGRPAPEIKGLVAATGLSPLIRCSVVTGDPGLIFAFVK

SEQ ID NO: 177716 - protein, 59 aa, Glycine max
  Coding DNA Sequence Number=SeqID_86031
MWCEQEVYMDYENEQECGVNEPYVDCSDAFNTSQVFGTRDDVLQWARLVAHKNGFVQSL

SEQ ID NO: 177717 - protein, 208 aa, Glycine max
  Coding DNA Sequence Number=SeqID_86032
MTLIGIFAVILVYDSFPDAPCDLCNGFHGQHHLFSKNLRHDGLLVLELSIFPKHPNEFWVESLQHFNIEKVFNMNNGFTFRVDGGGIYGDDGHGRNNVLVGVYQEIMRILAKIVKIDHCPNLKEFIKEYGGWIDEDMFKSKGKDPLEGLGGPMTRARARKAKEALQQVLSILFEYKPKFQGEKSKGPIGNLGISLLGDQMVADLLAVG

SEQ ID NO: 177718 - protein, 262 aa, Glycine max
  Coding DNA Sequence Number=SeqID_86033
MKSLDLLFQSSLKKACPQTTLMRRSQQQISEQASKAQKLRDLKETKDVGPLIILRKHKVKQERKKKFGRKFMPPKESIKIPSSNGSSSSESEAMPPGGIVALDTPSWMRLMYSNPKLKEVITSKDPLPKHHDSLHLLQQSDWTPLLNPMVYGGGILKQMYIPDQATAYPSKLHISRCIDIKMVRDRTYPRLPIYDEGKKGFKLYFNKEIPNKGQKVKSSSKSLMLMMLTLWNQTMWNNTKGASSSNSEHMPTTNQVYHFDDA

SEQ ID NO: 177719 - protein, 96 aa, Glycine max
  Coding DNA Sequence Number=SeqID_86034
MKNGGKPSRNRPRKRLESVKEGKRGRWLPPSSPRRAGLLSPEGTAFCWNILEGPRNLMDYAIVPFLTSRMSRNFTDCLMMDIKYLEVVKRGSHPNK

SEQ ID NO: 177720 - protein, 63 aa, Glycine max
  Coding DNA Sequence Number=SeqID_86035
MKQHIGLETKYPIRGIRTQQFARRYMIISQHLNFWPCFKNCRGMNKNSSKCFRTSFLGDKLWH

SEQ ID NO: 177721 - protein, 144 aa, Glycine max
  Coding DNA Sequence Number=SeqID_86036
MWFVRLSEGVSLSQSYKASKKRKASASRPREPYDTTGFVSKVAWERYAQNVHSRNIIPKRNITLYISEYDEFNWELEQRQWHRALTRQPDNHIDVALVKEFYANLYDLEEKSQRHVRVWSKLIKFDVASLNVFLKTPPVIQLGE

SEQ ID NO: 177722 - protein, 306 aa, Glycine max
  Coding DNA Sequence Number=SeqID_86037
  Homolog annotation: Hit_ID=A7QLP4; Match level="QueryCoverage=72%, HitCoverage=76%, E-value=2e-11, Identity=21%"; Hit description =Chromosome chr13 scaffold_120, whole genome shotgun sequence
MDNSGAWWPKIASRWQRLKSKGFCCGHGDEVIYGGGFLHFAVVAIRGDGEAAEEGEGDGGWTRSALNAAATVLSTSFNVNITSDNVKNRIKLWISWYGIVSDILGQSGFDWDGTKHMITVENENAWSEYCTSHKSAKPFRFEVLQNWDDIVDLCAKDRATSHKAEMAMDADEAMSRETNEVEFMGLGATTTIDLEEPSSNPKGKGQGSTSSGTHSHTRRMGEKEGIAASLDKMVNSFNRMVEKMDGKVNDEDIQEVLHEAALIPNLNRQQWAKAIKWLADDPKQLAIVKALPIHKKTNYVLTHLAE

SEQ ID NO: 177723 - protein, 354 aa, Glycine max
  Coding DNA Sequence Number=SeqID_86038
MGLGSDQAPEKRIDVALVKEFYSTYMIQRTEVQSFAGFEDKWSDSMQRQLMISSTPRSSWQMGRSTQLTPSTSALLQTTRPSLLPCGPTHIWLCDEEGPELRQLHFSADQLDRPVQQFQAWVSNVDHNVVGPSHTHQSPNISIRGSSSSITSFSAFLSDTYSSTVIHFSTAGYAWTDVELVLKSPTLEMLLITGETLVLEAKVSYLAKKPTQHNSTPCTHVEPIDYFELTLERNIDSPDLFRILREQKGCKGQKKGGVKGKVLWRNKRAKCNKQKARKKTEEKKKIGSRPSPVRALSTCHALSGPGSTDTKRGVKHEDVEFITRAKRVIQQKHMLSLQHTLSTRSKCAKCGVSC

SEQ ID NO: 177724 - protein, 166 aa, Glycine max
  Coding DNA Sequence Number=SeqID_86039
  Homolog annotation: Hit_ID=A5BG98; Match level="QueryCoverage=59%, HitCoverage=22%, E-value=2e-09, Identity=31%"; Hit description =Putative uncharacterized protein
MDHEDPYTHLSTFMELCNTMGVSDEDAEFVYLIAFPFSLAYVGEIFVVEVPNHNFDDAAQLYIFYSGLKPQTKIILDASTGSTMMSKSPEEAIVIIDSIATSDYQSHRDRAPTQRKAKPQQNFQGRYQGYRGGSGSSQPYGWRPHNNAYSGPNNTSFASPSNNSYG

SEQ ID NO: 177725 - protein, 196 aa, Glycine max
  Coding DNA Sequence Number=SeqID_86040
  Homolog annotation: Hit_ID=Q9M197; Match level="QueryCoverage=26%, HitCoverage=4%, E-value=2e-07, Identity=51%"; Hit description=Copia -type reverse transcriptase-like protein
MREVNKVEVEVEVADEDRLDVAIEDEVQISSIAITRKKKAQQENVEEAIEAQVEEETNYVEQKDGKFETVLLAHGGNKGNQENTWYLETGASNHMCGKRSMFVDLDESFIYPTDLQQEMYGERDHKKHGVEESLKQSQKEGKNGLFTKIFNPNFSQASNQLAWAKDLTSSLSKQLAWASYSSPGQVDAFNSKQQIP

SEQ ID NO: 177726 - protein, 262 aa, Glycine max
  Coding DNA Sequence Number=SeqID_86041
MANNPSRAQKKAKSSKMKQGECSQTTLNRLDMWFTNEINKTDFKMIYLMKSVKILKFLDLEWFSQQGFNFPRVDKLYSTVNSVEMIIDATVWKVVAGLDMGGVCKFEESTDGPTRNLRNLLRVGGLTAEDRMLVHLITYILAPRSRNHEQVTNDDLQIVHGLKSGIQMNWVLMIEDIMLKSRRLVDYELPYAVLASRFIDYFNIDVSNEIIDFTKALNEIIKRHLKKLGMRYVDHEWIMAGEPQATSNINQMEEEAQQEHAQ

SEQ ID NO: 177727 - protein, 156 aa, Glycine max
  Coding DNA Sequence Number=SeqID_86042
MNFSSQASLEVEKVLLRAFAKCDTQWLSARKNPKEDELSGSLSAPLQVIKRTASAHPLSERSVLSQKSLTCAKRTSTNKATYLSLKSDLQREFGVFLEKASTCTRIWPWLEAFACLGSSRERKVQVPKSSERFCCVKICKDASTKRKPFCELEMSL

SEQ ID NO: 177728 - protein, 177 aa, Glycine max
  Coding DNA Sequence Number=SeqID_86043
  Subcellular localization annotation: CTP_CleavageSite=46; ConfidenceScore=5.20e-01
MSIWQTSVHVSIPMWQFALPSTTFPLSVIVHIRAWQSGFSFALSSRFAERMNDNITLILHHGGRFTPRASDGKVEYIGEEFDVWEDISADFLDAFILYDLVKACKKYSNMGDCFWLIDKDLVMQSYPARALARRLQVDWARDPRKGPRVLMSLRLSSSFFRNLLKEASQGGELSYER

SEQ ID NO: 177729 - protein, 257 aa, Glycine max
  Coding DNA Sequence Number=SeqID_86044
  Homolog annotation: Hit_ID=Q6WAY6; Match level="QueryCoverage=29%, HitCoverage=16%, E-value=7e-10, Identity=41%"; Hit description =Putative uncharacterized protein
MGSSQMPSLKKRFYQVKDLAMVEVSTEAIASLAQYYDQPLRCFTFGDFQLSSMVEEFEEILGCPLGGGRPYLFSGFYPSLARISKIVQISAQELDHRKKAENGVVGIPRKYLEAKARILARFPNVPLMGTRGCISYNPVLAIRQLGYPMRGAPLEEEIAPVRKAWEVVRKKDKELRGSNNGPIGGYRKWLKAHLQGLDWLPSLRTAKREEVEASEEDEEENAKLRDVNIATTKALEQETKRARREEHGRNKFQGALW

SEQ ID NO: 177730 - protein, 40 aa, Glycine max
  Coding DNA Sequence Number=SeqID_86045
MMMMSLGVARCDRQWWHDVVDGGGTVVVVSIEEGDKGKKV

SEQ ID NO: 177731 - protein, 263 aa, Glycine max
  Coding DNA Sequence Number=SeqID_86046
MWHWGIGFYRWPCLSRSEFIIYLEKFYDDVIKYIYVWGRGCHRLDLDQFKSFGYEDLAISTKSLLDYGCLESILIPSLDRFEGFNPSINEAINLIQAEMMDYIAIKRIICLSNFFAQNYPYHVMKLLLEDHRDFPCLFNDEYKTWDVQGNTQYQYNLMRPQIQGNQWFFSESDKREFDLIRETYDTKLFQPSYNGKFFIPFPIDHNNKLVHFFQKEKKDKEIYEASGCHGQQTPPFPSTDLSMEDSSDISALEISKTKKKALL

SEQ ID NO: 177732 - protein, 153 aa, Glycine max
  Coding DNA Sequence Number=SeqID_86047
  Pfam annotation: Domain name=Transposase_23; Domain location=53-123; Score=-3.7; E_value=0.003; Accession=PF03017.5; Description =TNP1ENSPM transposase
  Subcellular localization annotation: CTP_CleavageSite=33; ConfidenceScore=5.43e-01
MQSQFQPQMQSQFQSQMQSQGLTLPPKPEVGPSATRVSTNEICVNPSGNDQETGDSEKYGLCVEENPPRLVALGRLYEGSTIVHNIPLLHDQVKVCVEEVRDADAPILVPTEEVKLVGQTLNTFLAWPTHLVKRLLEQAYDLDKYASGEYRCV

SEQ ID NO: 177733 - protein, 65 aa, Glycine max
  Coding DNA Sequence Number=SeqID_86048
MIGDEDDRGRGRRRSGVGGEVTSTGTGRGSNKWRRRRIGTSNKHQQRKRKRKTKMAKEEEDEEAT

SEQ ID NO: 177734 - protein, 58 aa, Glycine max
  Coding DNA Sequence Number=SeqID_86049
RVHLLELLTENKRGYISCGSVLVEGTSTRLFKENKGWYIPCGPLLVKGFLTGKCKDHA

SEQ ID NO: 177735 - protein, 82 aa, Glycine max
  Coding DNA Sequence Number=SeqID_86050
MKEIFQENFIAKCSLKRNSWANTCKSIKSSSMDLNCLKRGKFDYAALMNSGDMRPGENGGNKKEGETHVVAAILAWPNFPLA

SEQ ID NO: 177736 - protein, 84 aa, Glycine max
  Coding DNA Sequence Number=SeqID_86051
MSAKGATNALRKLLDQSVHIFSNQNSHKESASVGHHVRVGHLPAGHLHGLASVGVVVGLVATGEVVVVVVVVVVVVDDDDDDDE

SEQ ID NO: 177737 - protein, 176 aa, Glycine max
  Coding DNA Sequence Number=SeqID_86052
MKKESGRAPESKQRVKREISLLRASSPDDVEPPSWPSPRHLELASTIHSPFYGASTDDAKGFSTNRINYTVIEVLKLKAQKPSHADEHALVQVPAADGGVPDHDFSQHDCFKSKLASGARVIAARDLVVVAALVADDVIELVADGGGVGDGGKGSGEGRVEDGVGITHAYKWITRV

SEQ ID NO: 177738 - protein, 179 aa, Glycine max
  Coding DNA Sequence Number=SeqID_86053
MASRKRKASTSASQAHYDRSRFTSQEAWDRYSDIVIGRKILPERNVMIYHTKFDEFKTELERRNWHKELTNFLDESIDVAIVKEFYANLYDPEDKSPKQVRVRDHLIKFDEDALNTFLKMPVIIEEGESLSTYSRFCRLRPDPQELAARLCIPGRGFELNTDGLPLKILRKNLTTLAQT

SEQ ID NO: 177739 - protein, 152 aa, Glycine max
  Coding DNA Sequence Number=SeqID_86054
MMTTKDDDKGDDPKSSKIKEQLKGYIYLGLTENKRGYISCGSVLVEGTSTRFKENKGGPLDPTDDPWANLIRARVLKGNNLPRIYIKSSIWPGIKTFWGMPSNFGTSSFGQAMDFLIPLGNVVPWAKLIWNNCIPPTKTGFMVIHSQQDSYK

SEQ ID NO: 177740 - protein, 60 aa, Glycine max
  Coding DNA Sequence Number=SeqID_86055
MQKKAEELGPCSPTECGASNYCKEAKYDATEFGVFKSTPNKLVIHSWLVTLTDSPVWPKV

SEQ ID NO: 177741 - protein, 137 aa, Glycine max
  Coding DNA Sequence Number=SeqID_86056
MAEILGWNHPSLKIPEAPIPCMMFSFTSYEQEFPSLDRKTYPMTRTDNARIQNHLLKKIDDKIDKIYTQQHRMKLISSSSRVIRVSIASKCSPTNARRSQSSVRTSVKREEEASCYGGGNGVHSSGMGGGRSCLWTH

SEQ ID NO: 177742 - protein, 152 aa, Glycine max
  Coding DNA Sequence Number=SeqID_86057
  Subcellular localization annotation: CTP_CleavageSite=37; ConfidenceScore=5.23e-01
MPHASCNSGYHHVRSSKPHSPPHTSLQLHIHSLHSPSCRMRVDRINGIRFIFSGGALGSIFFVVFELVVVGVPEAVEVDGSDVADADVAEEVEVAEGEGDLVEEGGRADGGVGEVGGVVRLDGETLRRRRHDDDELRSRGVVTWQRFLWSIA

SEQ ID NO: 177743 - protein, 84 aa, Glycine max
  Coding DNA Sequence Number=SeqID_86058
MDTFRSFMSAETCKMVLVCFLMGTAIEIGEKLGAAIEDGEKLGIAIEDGEIAAYVEVPPVLLARHIHDLVSLEPLVAQGRGEKA

SEQ ID NO: 177744 - protein, 90 aa, Glycine max
  Coding DNA Sequence Number=SeqID_86059
MTAQKETAILLSSNIKDVYSIRKRTEKKDVTTPNTLPYVAREADLYPCLQHELRIAPLQSLGSFFNNTEELVEEKWGNYKPEQLYYSGFS

SEQ ID NO: 177745 - protein, 161 aa, Glycine max
  Coding DNA Sequence Number=SeqID_86060
MPHITNTATQEEEMIEIVLTRITSSAKHRPVKAEAAGSSLGRRRQTQEFYTGSTTTRAYIQSPSDLRCLRFLFNLVKSFTSKDPQGMYPPLFSLNNLVDVPSTRTDPQEIYPLLFSVTTTQVDVPFTCTTKDVPSNVLRQSSQAISPLKLCEGDTKDISGS

SEQ ID NO: 177746 - protein, 56 aa, Glycine max
  Coding DNA Sequence Number=SeqID_86061
MRKLSSMKNKGKDVESYGNIKVRTLSPMEDKGKDVESYGIINVRTLSPMKDKDKGL

SEQ ID NO: 177747 - protein, 350 aa, Glycine max
  Coding DNA Sequence Number=SeqID_86062
MEDIGEMVEVDEYVEERKRMDVARTLIRTNRRLGFQENVRATIDGEEHELTVVEDMSSMGAKLKSYQNNSWFPPSPMSTQPNTPVPLADNTPGRDSDNDDSDADFDDVDAGVPNHWNNFRSSKQRSSKPRRDHWVKSLGRSPSVWSIRDADDLDHSKVVNAGGYPTLPCGVDSELHNGHITQSVVQEGRTGQTYKEKKESSDIDAEGDREEVRPLEEDYPHRADTLKLKKCGANFPFGQHDVNEAIGEMGQKLKGPIKSATKVYVRRKEVLLRHGKAQHFQGPDAELDLVPGADCMPAIQGDKTEQELALVRELGLTYGGDDKEIKETLLDMDNRDTMKAAETGIKKQIL

SEQ ID NO: 177748 - protein, 50 aa, Glycine max
  Coding DNA Sequence Number=SeqID_86063
MEILVDGEFDANRLFDEAVFLTWTWLRHFEKHFSTHLNQWASNISQGFLM

SEQ ID NO: 177749 - protein, 322 aa, Glycine max
  Coding DNA Sequence Number=SeqID_86064
  Homolog annotation: Hit_ID=A5AE61; Match level="QueryCoverage=47%, HitCoverage=13%, E-value=7e-19, Identity=37%"; Hit description =Putative uncharacterized protein
MASTCPISPFSATPSITIEKLNWKNYQSWSDSVELWFHGQGYYDHLEKDVNEVPDVFANDIQCLFNSTQKVVCLQQTHHDMVSHMAKARAAVKELKVFLVCDSAEEMKKRLDKLFLVLILRSLRSDYDHVHDQILSGDQNPSMNSLVTRLLHIPTLVKGENAAAAVGTSAMVASHGIGRGGCGNRGGGHGGRGGHGKLQKSSSQAQSSSVPSVSTACLSQSMEGQGPWIVDSGASNHNSCNNSDEEYQEYLRLKSSSQAQSSLQYQVFQQHAFLNLWKFKFLHDRLGHPSLAKLKIMVPNLNKVPMLLMADGGSWRKAKNPP

SEQ ID NO: 177750 - protein, 77 aa, Glycine max
  Coding DNA Sequence Number=SeqID_86065
MGSKSILRLMRTLGPSLASLGQSSWSLLSNTLAGDINSGSDGNYEGDNNNSSDDGGHNDNVVMAAMTIMIVRSHFSE

SEQ ID NO: 177751 - protein, 65 aa, Glycine max
  Coding DNA Sequence Number=SeqID_86066
MIELDDVLLCLSHGKQLTTGKRGLVQHQLAKGFPKSEFGNGFPAFMNQNPWMVHVSECVMNVGIP

SEQ ID NO: 177752 - protein, 223 aa, Glycine max
  Coding DNA Sequence Number=SeqID_86067
  Gene Ontology: Cellular component=membrane
  Homolog annotation: Hit_ID=A7QNF5; Match level="QueryCoverage=21%, HitCoverage=18%, E-value=2e-12, Identity=77%"; Hit description =Chromosome chr2 scaffold_132, whole genome shotgun sequence
MPSINESPDVDEVQATRNDRDEGLWENIVTVMGTPPPSPPQSDVRSEAISPNKVTEAVKPVNDVDVDDPLRDLIKSLVVIYEKLVQLLWDASKFGIPDVDASLFVTCVDVNEIISSVQCLNIAILQLWTMYMDEWSNSLDHGSVYGFLEPQSILNAKDGRGPCQEYIEKWLRESHGEAELAVSDFSGNGDGILSAATTVASTFLLDFVVEWGDKSFFSTIGEF

SEQ ID NO: 177753 - protein, 67 aa, Glycine max
  Coding DNA Sequence Number=SeqID_86068
  Subcellular localization annotation: CTP_CleavageSite=36; ConfidenceScore=5.43e-01
MVILQSTSKRASTAKRSFNVLSTTEESGKASISRPRAKRKINALSATVLFSQAQCTTDAKLKSTYSR

SEQ ID NO: 177754 - protein, 129 aa, Glycine max
  Coding DNA Sequence Number=SeqID_86069
MAVSPAVWASPTWAIPPVGLAAPAGCVAVPIGDTLLSPSYVAISPLLVTIHPSLHLCRHWQWRVEPCRQWQWRFPPQNKPPPLFLLKQTPSRKYFGCKILVFIVKSNNLAYVKRSDNVFETKFTMHNTN

SEQ ID NO: 177755 - protein, 255 aa, Glycine max
  Coding DNA Sequence Number=SeqID_86070
  Gene Ontology: Mol. function=ATP binding; Cellular component =chloroplast
  Homolog annotation: Hit_ID=A7NYV5; Match level="QueryCoverage=22%, HitCoverage=14%, E-value=3e-17, Identity=72%"; Hit description =Chromosome chr6 scaffold_3, whole genome shotgun sequence
MSLHYNKTNGMQFMIDFFGALRARVYDDEVRKWISVVGVDFIGKKLVNLMTLSKLLEYGNMLVQEQKNFPRFFREKDRKPAEEGSAGSSTGSAEDNVLPLAPAEEPAEASSAGSTEDNVLSLAPAEEPAEASSAGSSGRIFFRWNPQKNLFTFLPQEPAEEHLLPLQYPMSTFTRAEEGSSHGRTFVFNLKHQTSLMSSILRPFTRFKQRRGEEGNQNGERTPVRMKACGGEEGNQNGEANDQQSLREGRMEEDE

SEQ ID NO: 177756 - protein, 112 aa, Glycine max
  Coding DNA Sequence Number=SeqID_86071
MTNKAKGKGKEVAGKGSTGKRKGAFDDDKTGGGRKRNKRGPVRMNQSLLLLFLDSLTCKHDTGHLWRVSHLSQIIFKKLRTGARCILPLLTLPRKVTDMTRHDSERCDRRLL

SEQ ID NO: 177757 - protein, 649 aa, Glycine max
  Coding DNA Sequence Number=SeqID_86072
  Subcellular localization annotation: CTP_CleavageSite=32; ConfidenceScore=5.27e-01
MDKDSPVSSLVARTGVGLSSLSSPPTKIENVRVTLSWALCFPLTLAGARHMQYLFMRGTRGVAMFMEHMDREVISISGSSSEETHHGVSDSESSSSERMRALCYSNGGISRLPKKNVGEDFRVSPSVNVGSPLSHPVVVGFEWVKDDVLKATMGSPPFFFMYRRLFEVLGFALPLTSFQCALLEYLNVAPSQLHPNIDRQDWLGLLERVMADGLPLMFSRDGEPHFSFYWKSSPTMFNSFDKDLLTLVERVEKVILDHLSASLDARTILSLLLASDPIATLDGNFAWRKLVKQAGPGDGYMPSFVVVPPTEEMGQLAIEVDPVVGVEVSSKKKSRAYLSLRDLRDVVGLMPSLGHSLSLHSPPLSPSTIEAPTPAVAIVALAADINVPVVMASATTTSLSLAATPSLSASVAAVSFLQMLPPSAIPLAPPSTVSTSPASTSRPRVYLDHIYTTNDSDSLWSVGYKPEQKTSVGFVSTFNKNLIRGLAILEENGHRHQEALNKVASLETEVAKWRATARTVWRVECPKMVMSCMIALACEKADLGGKIEGVAVKKDELLKMVSELEARLKEFELEASKERRPTKGLEELLLFKKEIVEQHEKDFHKAVMQGRYFVKSLDLGLFDPFKDVKDGVLLDKDDVAVGEEDIGRE

SEQ ID NO: 177758 - protein, 311 aa, Glycine max
  Coding DNA Sequence Number=SeqID_86073
MKREKYASYSSHNSCKSLSEELRDYYEGRHRSHLRPHSHRREKERKPQEANINLSYFHRKDNVEANLDWEIRVEQQLKKKSTSKSYGSHSYPKKDQGQGILGVTPSKPKDDKGNTIEKQAPKAKAKGEESSEEIYPQEEGQPLVVKEKCNEVSVSSKRLAKKETHFTIKTNIKETFPLRQPPHFLLCKTTLVSTATLLGLEVIPQVKELLDEGLVRKSLNPCALLVPKIGVPTDPKRIKVIPDWPTPPTPLIELVRNHVPSWEDVHERGVEGRSPEYEEPRDLRLNHFQGGGDDAILPPKGIGWKTPRGLG

SEQ ID NO: 177759 - protein, 157 aa, Glycine max
  Coding DNA Sequence Number=SeqID_86074
  Homolog annotation: Hit_ID=Q1SKZ9; Match level="QueryCoverage=62%, HitCoverage=31%, E-value=9e-07, Identity=52%"; Hit description=Zinc finger, CCHC-type
MKPMVHIHKYVFEGLYAPWEDTLVVKLLGKKVGFNVTNVRLPKIWKLSADKFPRFELNFFYDESILMALATIVGRPIWVDATTRDIRRGKFMKVCMETDLNKLVTDVFCFVTIGIELNMKACIEYAHHVAAMATCQGSFQQNQFQQRWRNNNRRAKR

SEQ ID NO: 177760 - protein, 461 aa, Glycine max
  Coding DNA Sequence Number=SeqID_86075
  Homolog annotation: Hit_ID=A7QBS9; Match level="QueryCoverage=27%, HitCoverage=19%, E-value=8e-20, Identity=45%"; Hit description =Chromosome chr1 scaffold_75, whole genome shotgun sequence
MGIHNDMGWEWKFSWRRLVFDNEIDATIFLREVEGQSIQQQQQQNDIWEWLGDPSGNYSTRSAYNLMWEEIAGGQKEDWSVELWKTKIPSKIMGQIAYKRAMEDMLCPFCNGAVEDKSHLFIHCTKIQPIWWESMSWMNIKGAFPFSLKQHFIQHISIQIEGLRAKRWRVVHINQQYLYTTQVDIFCSKTTQRIKIGARAGGLHQREDAFKKIAFMDDITAITIQHQMQDTMVWKTDPSAGGISNYQDYVTRNALVKHLRTHGIGGSPGTSFRIPDSEILLYTGIENSCDDNYDQASVESNSWSIEINNYDSANSPCNSKSSSVNYGARHLKFLLQSSRRRDTKEAASDLEDDVSVNSFSSRNNLKELYFQEQCRGFCGFERGQCGFSGSVGGCVGLSEDNVGVEGAVSGSFQVGGEREERFHGDKEKREGKVFERARLVKSQFLTYKHNNIGFLWITDVN

SEQ ID NO: 177761 - protein, 78 aa, Glycine max
  Coding DNA Sequence Number=SeqID_86076
MDMQAYLEEQYVARRVNSQKGTMTQGCGGAANNTRRRGSGAATMYPSFCGVDGVYVNIGFQKIDVNIDNVNVGGFNID

SEQ ID NO: 177762 - protein, 128 aa, Glycine max
  Coding DNA Sequence Number=SeqID_86077
MSTLSNEGVHQTKKRIATTAWLLEVGQLGLYNEGNGLLTIKKRNFVLIITEVQKKELDLIICSYGDDEERAKESVASSQKENIVGRVSRSFGKEISIVGKRDLDPMKYGSDIVKFWEDNGRDNTIKDL

SEQ ID NO: 177763 - protein, 389 aa, Glycine max
  Coding DNA Sequence Number=SeqID_86078
MGSNQAPSFKKRLYHVKIKSLEVTSLHELGQRMDQLQRQAFRKTMEKIWDLTMIKVFVEAIASLAQYYNQPLRCFTFGDFQLVPTVEEFEGILGCPLEGRKLYLFSGLYPSMARVAKHLEEKAKALANQGECNSFIDVLALLVFGVVLFPNVDGLVDLAAIDTFLAYHHNKESSVVAVLVDAYDTFDWRCEKSSTRIVCCTPALYVWLGCPLIGSLDGRKEGPGFCAHVKGVPSEDSIASFIARGFSDPNAKMLQRVRKAWNTVQRKDKELRGSNNGVIGRYHKWLKARMQGITWLPKLKSSGGEEADVPEESEEVQALKAELERTQVVKEKFKTIDIRVRKECDELRDQQRTQALKGRKGRVKGGKYDIRGQVEGLSKVEEELDRTVE

SEQ ID NO: 177764 - protein, 293 aa, Glycine max
  Coding DNA Sequence Number=SeqID_86079
  Homolog annotation: Hit_ID=A2Q185; Match level="QueryCoverage=37%, HitCoverage=24%, E-value=1e-12, Identity=38%"; Hit description=Non -LTR retroelement reverse transcriptase-like, related
  Subcellular localization annotation: CTP_CleavageSite=51; ConfidenceScore=5.43e-01
MQSPSSLYLNKNFFTTHHHHLGFHHTLSSTHNSLTSLGFSPKPSCSTRLITAQAYRPNNHKRNGSPKEGARVRGSKDNMWSIDNELAKASSSQKEKRRRQRGRSVVRRKGPKGGRVIVSGAMLLEVETVLQTLVHFSSLGLLGLCVKWALGGLQVGSMSQMAKKNLFESYLVGEHKGFLLVLILVRKVEKGDKVLFWCNRWVGQQSLANEFPRLYLNSLQKEECIINMGEWAEGVWRWNFRWHRDWFVWEREVVERLSLMLSEATLVEGGEDSWIWKQDRTRNYLVKSSYLAL

SEQ ID NO: 177765 - protein, 342 aa, Glycine max
  Coding DNA Sequence Number=SeqID_86080
  Gene Ontology: Mol. function=phosphoglycolate phosphatase activity; Cellular component=cytoplasm; Biological process=metabolic process
  Homolog annotation: Hit_ID=A7P1Q2; Match level="QueryCoverage=93%, HitCoverage=61%, E-value=1e-130, Identity=71%"; Hit description =Chromosome chr19 scaffold_4, whole genome shotgun sequence
  Pfam annotation: Domain name=Aldolase_II; Domain location=27-249; Score=198.5; E_value=1.6e-56; Accession=PF00596.12; Description =Class II Aldolase and Adducin N-terminal domain
MAAATATADSVSSQAYLEGNAVKETRILISELCRHFYSLGWVSGTGGSITIKVHDDSISKPHQLILMSPSGVQKERMEPEDMYVLSHTGSVLSAPSPKPYPHKPPKCSDCGPLFMKAYEMCDAGAVIHSHGIESCLVTMLNPLAKEFKITHMEMIKGIKGHGYYDELVIPIIENTAYEYELTESLAKAIEAYPKTTAVLVRNHGIYIWGDSWISAKTQAECYHYLFDAAIKLHQLGLDWSTPNHGPIKSLRSLMIAGESNASDKTRKASGEIDPFPRCIVLDIEGTTTPISFVTEVLFPYARQNVGRHLSVTYDTPDTEADIKLLCSQESSTLSHPHTLTTE

SEQ ID NO: 177766 - protein, 83 aa, Glycine max
  Coding DNA Sequence Number=SeqID_86081
  Gene Ontology: Mol. function=phosphoglycolate phosphatase activity; Cellular component=cellular_component; Biological process=metabolic process
  Homolog annotation: Hit_ID=A7P1Q2; Match level="QueryCoverage=93%, HitCoverage=15%, E-value=7e-28, Identity=75%"; Hit description =Chromosome chr19 scaffold_4, whole genome shotgun sequence
MTIGAVPIPSDGACKRAVIDALVTNVEAMIKADRKITALKELQGHMWRTGYENNELKGIVFDDVPEALEKWHTLGIKVAISFS

SEQ ID NO: 177767 - protein, 286 aa, Glycine max
  Coding DNA Sequence Number=SeqID_86082
MTGLYQFGIEHQGNLLFDFGFLEMWVAGGRWVGSQKISRNWVMMEGTCWEVVVQSNVLSSPTIMRRVFEGDTGQGLGLDLEGQGDLRARKGHQGSMRRVRCPRRQSKEVRRLKGIFGAKVVFCLGKGEIGFEGIGMKVEGPAPRDASPGLTVGVEQDVGRIIVICRGKTRLEGFEHTSPGFGIGDEGGEGGTMVIAAKCSRIESNLAFVEAWICARFCAREDWPWVKRVTASSKRSMVACLVLWFDGDIGAASNEVIEACGFSGIPCGLAMVQFLAALVLLLFMDV

SEQ ID NO: 177768 - protein, 621 aa, Glycine max
  Coding DNA Sequence Number=SeqID_86083
  Gene Ontology: Mol. function=RNA binding
  Homolog annotation: Hit_ID=A7P1N8; Match level="QueryCoverage=62%, HitCoverage=93%, E-value=1e-148, Identity=67%"; Hit description =Chromosome chr19 scaffold_4, whole genome shotgun sequence
MAVEVVGFEMVQGPVENGAKEDKSISEKTENGKLEQDTGVAEPTKFGSHGDESAKPEANVVSDANVPKDAVDDWPAPRQIHSFYFVRFRPYDDPNIKAKLEKYDKEISQENQARIQVTDALRAKRTERAGCISQIKSLKGDNRQFQSIVDEKIKEIEPLQQALGKLRTANNAGRGVGLCSSEEELNNLINSLHYRIQHESIPFAEEKQILREIKQLEGTREKVIANAAMRAKVQDSMGQKEAIQDQVKLIGGDLDGVKKERQAIRSKIKQLEDTVKALDKDIQSLQDELGAVTEKREKAYESIQQQRKQRDQGNSYFYQSRTILNKARELAAKKDINAIEELAQTEVEKAMSLWNSDKSFRDDYEKRLLPSLDMRQLCRDGRMRNPDEKPLLEEPKPAETDTLPKSSVKQPKEEEPKSSPPETVPEQKIQKETKKKGKDLKSNLNKVLEDTDEYEFELPKVNKEPPIDPEKLKEMKREEEIAKAKQALERKKKQAEKAAAKAATRAQKEAEKKLKVREKKAKKVAGGTGAVPSPEEPANEAVEVAEQKTDDSMEASAPAKEKVPKESSVKFRNRAKALKGPDTIPKAIMKRKSLDLEGAVNQFSVGGLARFCRLIIREMAR

SEQ ID NO: 177769 - protein, 112 aa, Glycine max
  Coding DNA Sequence Number=SeqID_86084
MEITKSLVSNNNNKKNKCTPSRLVGPDGVGLLVLPRKVELKDDTSLLVATYQPLPAAFTKSKVQRVRNRHMRLHDAKNKGEVVAICCSRGWAMQFPCVYEKSRLEIPMAHNV

SEQ ID NO: 177770 - protein, 310 aa, Glycine max
  Coding DNA Sequence Number=SeqID_86085
MLHGGVREKQTTRRRVNLVGGGGIRGRIDVLDQNEVVTTMMEYPQSKEDTEENSLRGLGTSIREKDKEEKLYYFSAVLYYILSIPYIEALAKGATMKTEGARIILLTAQHLLTNSVKGNPPRVCARSGAFAGRLVLLLGLPSWVSGLSSSIAWASVNKFKETRKDMRAEDAEGHGAASEEADGERPYEKPMDVEDYHGNPQREPRLLRVNLQRQTRWQPRFGFVDSQRAEGEKRMAMLLRTTVGTVKGMTGCCVVTGSEKVGNGDNDFFKTKMENRSDMGSSTPQDPHGSDEVSSNSANETNDECNDASQ

SEQ ID NO: 177771 - protein, 114 aa, Glycine max
  Coding DNA Sequence Number=SeqID_86086
  Subcellular localization annotation: CTP_CleavageSite=36; ConfidenceScore=5.26e-01
MSVPVSVSVSGSGLLSFPSIQRPHSNPPPKHAVLPSTSREPDTDTKYLCLLSPFQIIASQELPYQTFPFRGLGHRLTGQHRTVVGWIAIFDEMPNKDLNPSTWFKGAFVIEKTV

SEQ ID NO: 177772 - protein, 90 aa, Glycine max
  Coding DNA Sequence Number=SeqID_86087
MKIQRKRLQCERYFSQLKQDIKIPNGETSRNWTANVVLKFHNDPTVNESEIVIFLRHVRWPVGKREGFGRREKKRNCEAEETEESVWKLT

SEQ ID NO: 177773 - protein, 200 aa, Glycine max
  Coding DNA Sequence Number=SeqID_86088
MTRMSVHVAQLIADAIYLFAGMPPTRHPLDPDKSNRALGFPVLITGLYQSFGVPVTPSKVIRLPITRAFIEKYCTPRQAQGDAPQAADAPPPPHQADPAGSFGMGRYFQHLVRQQAANHRGQVQIHECLYQLNLSQQSLDFAPFACRTPDQFRAEVAWPRDWPEDQTEEAPAGALDGAEDARMDEEMIDLLDFLGGCGAT

SEQ ID NO: 177774 - protein, 84 aa, Glycine max
  Coding DNA Sequence Number=SeqID_86089
QHSGALVTRANKPMACTHIPVEAKMDKLEDPDESLETSNNSFQNCPMCGVAWPYNAQWNAPGLLHDMHMLRSSRILGKMEIEET

SEQ ID NO: 177775 - protein, 183 aa, Glycine max
  Coding DNA Sequence Number=SeqID_86090
MLARNILPERNVKLYITEFDDFRRELIRRNWHKKLTNLTEGSIDVAIVKEFYANLYVPDDKFPKQVRVRGHLIKFDVDSLNTFLETPVVVEQGESLPCYSRFARLRPDPQELAARLCIPGRGFVLNAEGLLWKLLRKDLTTLAQTWSVLSYSNLAPTSHTSDLNLDRAKFHLLLSLTPRGLDF

SEQ ID NO: 177776 - protein, 57 aa, Glycine max
  Coding DNA Sequence Number=SeqID_86091
MALEDMEKTTFVTLWGTFCYKIFRKMIDLIQHKQLQPRNAHCYIIMEAARVLYQVRD

SEQ ID NO: 177777 - protein, 120 aa, Glycine max
  Coding DNA Sequence Number=SeqID_86092
MEEPSKKHKGSSSRSQGHSEAQDIPIPSSISSSSLFSSEEKCIRYTNLFSSRSIIDPKFIDMDLFSDESFECIQAFQNSNLIPFMSLKLPVYSELVKAFYSNLEIQKYLDFISLWDKDGH

SEQ ID NO: 177778 - protein, 233 aa, Glycine max
  Coding DNA Sequence Number=SeqID_86093
  Gene Ontology: Mol. function=long-chain-fatty-acid-luciferin -component ligase activity; Biological process=bioluminescence
  Homolog annotation: Hit_ID=A5FMH9; Match level="QueryCoverage=99%, HitCoverage=73%, E-value=3e-64, Identity=51%"; Hit description =Putative uncharacterized protein
MNLSKHFIANENLYRESIYKSFEQFIGKPEDFIFLGLLPSYLEKKNSSLIYMVDYLMNVSAQSENGYFLYNHADLFELLKILKDFLDFCASQRGDEPIGFSKNLIIIETGGMKGRKEEMTKDELLVILQKGFNTNAIYSEYSMTELLSQAYSLGNNEYECPKWMRVLVRNAEDPLTYEKEGRTGAVNIIDLANFHSCSFIATQDLGKMLPKNKFQILGRIDHSDIRGCSLLVS

SEQ ID NO: 177779 - protein, 40 aa, Glycine max
  Coding DNA Sequence Number=SeqID_86094
MGHLSYQGVPMNPKRIKVIPEWPTPPSVEEKSQSFKNLGI

SEQ ID NO: 177780 - protein, 161 aa, Glycine max
  Coding DNA Sequence Number=SeqID_86095
  Subcellular localization annotation: CTP_CleavageSite=33; ConfidenceScore=5.74e-01
MGHFKVQCLKRTSFQFPSVFPTFSTNKRWWRLRAFSSFGKRTREPRLARPQKGRLQQLATSLGIVFVSDLLDNSETSSRAFSLYNVSSLVFHTAANIIILSDDTSRKQPYCVHPRVMFLRVCIMSSHTRCMLVSSFWHGMPEDPYHLLNYTHGALHPQVCK

SEQ ID NO: 177781 - protein, 568 aa, Glycine max
  Coding DNA Sequence Number=SeqID_86096
  Gene Ontology: Mol. function=structural molecule activity; Cellular component=flagellin-based flagellum part; Biological process =flagellum organization and biogenesis
  Homolog annotation: Hit_ID=A8GG28; Match level="QueryCoverage=55%, HitCoverage=77%, E-value=1e-152, Identity=85%"; Hit description =Flagellar basal body FlaE domain protein
  Pfam annotation: Domain name=DUF1078; Domain location=279-317; Score =67.0; E_value=6.4e-17; Accession=PF06429.4; Description=Domain of unknown function (DUF1078)
  Pfam annotation: Domain name=DUF1078; Domain location=526-564; Score =6.4; E_value=0.038; Accession=PF06429.4; Description=Domain of unknown function (DUF1078)
  Pfam annotation: Domain name=FlaE; Domain location=81-199; Score =97.5; E_value=4.2e-26; Accession=PF07559.5; Description=Flagellar basal body protein FlaE
  Pfam annotation: Domain name=Flg_bb_rod; Domain location=322-352; Score=44.8; E_value=3e-10; Accession=PF00460.11; Description =Flagella basal body rod protein
  Pfam module annotation: Pfam domain module=DUF1078::DUF1078::FlaE::Flg _bb_rod; Domain location=279-317::526-564::81-199::322-352
GGIFYTRNGQFKLDENRNLTNMQGLQLTGYPAAGSPPTIQQGANPVPLSIPEGMMNAKASTSGEMVTNLKSTHKVPENKTFDPTKQDSYNYVNTITAYDSLGNAHNINAYFVKTDDNKWQVYTQDGSAAPVNAGTMEFSTSGNLVKTTSTNGAPGEFSMVIPMTAKDGAPAQNFTLSFAGSMQQNVGSDSVSKVAQDGYAAGEYTNFQINNDGTVVGIYSNQQTQVLGQIVMANFSNPEGLASQGDNVWQETGASGQPRVGLSGGGGFGKLTSGALESSNVDLSQELVNMIVAQRNYQSNAQTIKTQDSILQTLGRVMDHAIYTAMGAARQTLEQQSITANNLANASTPGFRAQLAALRAVPVDGPSLATRTLVTASTPGADMSQGALNYTARPLDVALQQDGFLAVSLPGGGEAYTRNGNIQISSTGQLTVQGLPVMGDGGPIEVPPSAEITIAADGTISALNAGDPPNTIAQIGRLKLVKADAREVMRGDDGLFRLTPETQQQRGNQLQNDPQVRVMPGVLEGSNVKPMETMVDMIANARRFEMQMKVIHSVDENEQRANSLLSLS

SEQ ID NO: 177782 - protein, 329 aa, Glycine max
  Coding DNA Sequence Number=SeqID_86097
  Homolog annotation: Hit_ID=UPI00016621D1; Match level="QueryCoverage =45%, HitCoverage=40%, E-value=4e-11, Identity=32%"; Hit description =UPI00016621D1 related cluster
MTGPLDESISCFLIRLDPWVLVPITFRGLYALTVRGLHVLAFRGLHVLTFRGLHAFAFIGLDVLKFRGLHVLAIRGLHVLAFKGLYALTFRGLHVLTFRGLHALTFRGLHPLIFRGLHVLTLRGLHALAFRGPNILIFRGPNILIFRGLHVLIFTGLRVLAIRGLHIHTIRELKGDNCAAQPEREAITQLLCIPGQRLQPCRLQRDEVRIMRTQHDHSYTDIDDNCYLATFCPATANANLPLQKVSVGLCRPRHGDCTPQRHLVDLKKSNRAPRVSSSGYGPLSAPTERPDRARKTPSGPEEGQQGLGVASSKYGAKHHISIGMADSGQ

SEQ ID NO: 177783 - protein, 173 aa, Glycine max
  Coding DNA Sequence Number=SeqID_86098
  Gene Ontology: Mol. function=RNA-directed DNA polymerase activity; Biological process=regulation of transcription, DNA-dependent
  Homolog annotation: Hit_ID=A5C142; Match level="QueryCoverage=93%, HitCoverage=11%, E-value=5e-18, Identity=35%"; Hit description =Putative uncharacterized protein
MGMIATPSIPRPLDHEQINKITPASIDKETLRKDFYSPENEPQRRWFFQHYKGTNRKQVQDEFYEFVKRVKINVLFFDWFHSYTIRKDIDYPWKQDIIGNPTTNVITNWQTKDGELIQSELPPTTQYQLPKIKDSNDRPVMASPFKTKDVIEEVTIKDIKSLMEQANYTNKYS

SEQ ID NO: 177784 - protein, 325 aa, Glycine max
  Coding DNA Sequence Number=SeqID_86099
  Gene Ontology: Mol. function=catalytic activity
  Homolog annotation: Hit_ID=A6EHA5; Match level="QueryCoverage=95%, HitCoverage=37%, E-value=1e-158, Identity=85%"; Hit description =Glutaminase
  Pfam annotation: Domain name=DUF1793; Domain location=244-325; Score=- 9.3; E_value=1.4e-08; Accession=PF08760.2; Description=Domain of unknown function (DUF1793)
IEGGGALVELGYDEIYAIQYFKNNLRPWWNNSGQETIENQLTLAADEYRSVLDKCVAFDKAVYADALKSGGKEYAHLNVLAYRQSIAAHTLVKSPQNELLWLSKENNSGGFINTVDVTYPSAPLYLIYNPELLKGMLSGIFYFSESGQYPYPWAAHDLGTYPLANGQTYGEPMPVEESGNMIILTAAITKVQGNGDYAKKHWKTLTTWVDYLVKDGFDPKTQLCTDDFAGHLARNANLSVKAIVGIACYAQLAETIGETATAKKYRAIAEEMVPKWMEMADAGDHYALTFDDKNTWSQKYNLIWDKVLGLNLFPQKCMILKSNIT

SEQ ID NO: 177785 - protein, 58 aa, Glycine max
  Coding DNA Sequence Number=SeqID_86100
MTKLPRLSDSASLSHRRRQKCRKLGVREKIQAVQQFLANRGSCLANYGALSDDIAARN

SEQ ID NO: 177786 - protein, 81 aa, Glycine max
  Coding DNA Sequence Number=SeqID_86101
MVKLVQNVGVKGKHAIWSLGDINAEHDYSCQHSNIPKIPPLSGVITCATSETHSRKDTMIIPPSYLMFPSSPGVGLISPLT

SEQ ID NO: 177787 - protein, 315 aa, Glycine max
  Coding DNA Sequence Number=SeqID_86102
MAPKKLFAKRSRRDAAAEGSSAAPEFDSHRFRSVEHQQRFEAIKGWSFHRERRVQLREDEYTDFQEEIARRHWTSLVTPTAKFDPEVVLEFYANAWPTEEGVRDMRSWVKGQWITFDADALSQFLGDPLVLEEGQECEFSQRRNRADGFDEEAIAQLLCTPGQDFARTAAGRRVRIMRTNMTTLTQTWMTLMLSNVLPNDHNSDLPLPKCQLVYAILTRMSVHVAQVIADAIYLFTGMPPTRHPLDPDKFNRALGFPALITDLCQSFGVPVTPIKVIRPPITWAFIKKYCTPRQAQGDAPQAADAMPPPHQADPA

SEQ ID NO: 177788 - protein, 158 aa, Glycine max
  Coding DNA Sequence Number=SeqID_86103
  Homolog annotation: Hit_ID=Q6WAY6; Match level="QueryCoverage=47%, HitCoverage=14%, E-value=1e-07, Identity=41%"; Hit description =Putative uncharacterized protein
MGTRGCISYNPVLAIRQLGYPMRGAPLEEELAPIIARGFNKTNVEALQKVCKAWEMVQNGYRKWLKAHMQGLDWLPSLRTTKGEEVEAPEEDEEVQALRAELEQAQTVKERFKSAALKIQKENAELRDVNIATTKALEQETKRARREEHGRNKFRGAL

SEQ ID NO: 177789 - protein, 126 aa, Glycine max
  Coding DNA Sequence Number=SeqID_86104
MVIAHLVAIDYFTSGSRRLPIPMSRGVWWSGSLEKRSSADMHHNSTPYQPKMNGAVEAANKNIKKIIQKMTVLISRIGTRYELLPSRFPARNQMANACNFGVLFSLLTPQGSAYTSKELKTFDKKG

SEQ ID NO: 177790 - protein, 288 aa, Glycine max
  Coding DNA Sequence Number=SeqID_86105
  Gene Ontology: Mol. function=transcription regulator activity; Biological process=regulation of transcription, DNA-dependent
  Homolog annotation: Hit_ID=O52721; Match level="QueryCoverage=26%, HitCoverage=24%, E-value=1e-33, Identity=94%"; Hit description =Repressor
MVFGQVASPQPVNNCCLTGQLQKLHQPIMETFAVVAHVVAVEQRQRTRVVGDAFFKNPGDGAINGFAIPLQVGLQIGVAGFQAMLRIEVITPFRHRDLFIFALPFRAHRLEDVASSLLRQRLHHVLGVVTNISRRDMPARIAGNPQSMQVPRLMGAMKRTETDVKPCELRIHVLLSLSQNAGICATAPAYLRQDTVSKEDDIRLDQKVRAAWMYYIAGQNQSEIASHLGTSRPVVQRLIAAAKEEGIVSIGLHHPVANCLDYAQLLQEKYQLHRVQYRADLQRREHAG

SEQ ID NO: 177791 - protein, 51 aa, Glycine max
  Coding DNA Sequence Number=SeqID_86106
  Subcellular localization annotation: CTP_CleavageSite=32; ConfidenceScore=5.04e-01
MSLQNLGISTKADPLAASGALFPKLAPWFFCRAKRAKATLSGGCTLCPLMS

SEQ ID NO: 177792 - protein, 341 aa, Glycine max
  Coding DNA Sequence Number=SeqID_86107
  Homolog annotation: Hit_ID=Q6UUU1; Match level="QueryCoverage=17%, HitCoverage=40%, E-value=5e-18, Identity=78%"; Hit description =Putative uncharacterized protein
RAEHGGALGHEHGEHRARHHGDRDAGPADGGGPDRHPLLGGAVHPVALADVEGGVELVEMADDGVAAELHRGVRVHGEASDRLLGAVAAAPHGGPRPEHALQAREAVDLGLRLGGVPAGEVGLHRDRQPAQVADVLADGERAVDAMVLVELAGTELGVLGDQLRGAGVEGLAILGGPPGAEVAVAVVLRALVVEAMAHLVPDHGSDAAEVHGVIGSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 177793 - protein, 668 aa, Glycine max
  Coding DNA Sequence Number=SeqID_86108
  Gene Ontology: Mol. function=RNA-directed DNA polymerase activity; Cellular component=integral to membrane; Biological process =chromatin assembly or disassembly
  Homolog annotation: Hit_ID=A7PPD4; Match level="QueryCoverage=25%, HitCoverage=33%, E-value=4e-71, Identity=81%"; Hit description =Chromosome chr8 scaffold_23, whole genome shotgun sequence
  Pfam annotation: Domain name=Retrotrans_gag; Domain location=80-170; Score=26.3; E_value=0.00011; Accession=PF03732.8; Description =Retrotransposon gag protein
MEMRMGAMEKAIEENREAVELRLSSIEGMIQWLAAAWEKKSPAMNVHTVDVSGGDEGIAAHDSNRWRNLEMPIFDGDDPMAVMVAMDGEALGWFQWWESWNPSHSWNGLKIAVTQRFQASSLGNPFQALLVLEQEETVQGFIGQFEKCVGMVKGLEEPFLVEVFLKGLKEEISTEVRFHEPKNLMEAMVKARRVEDKDKVLGKLPLSNSQGYNLLKPSYSSLKFVRDWQPVNNKVADPTNAPKTGSSGWQGRRTFHNLSPVERMKETLAYEMQAVFLDLALRTSWWVALTWSIWNHRNRIIFSNDSPNTSKILDDESYILPVLLRFDGQPDVDEEGNILYRFPSLQRTASQKSKRKEYVGRRWADWVGIEKFFKEKKWQFSKTGTPERAMVIGLGGLNLFGVIILGTMLKDMAVAPSSFIKFVADIFPLLQIYAGSFFAIPLVRWFFIRKKNADIEKRNKARQQCAQVLELPDTSLRQKIAGIIIKERKHSKDIDRANASGTKIGASAFGTKTGLVEAFVERDRNQKRKPNTTLKNLGTTLTLVAQLEHRLDVPSCAAKASNEGAVQICMVLAGKLAGDKKVLCWKMEGEQRANGTSDNGRQQLENLLGNMSENMPERDSPLDPSHSDVYSIHSFIPPAGSLLGATPCPCHISCALAITPRARQRPGC

SEQ ID NO: 177794 - protein, 130 aa, Glycine max
  Coding DNA Sequence Number=SeqID_86109
MASRPQPHYDTHKFTFDDAWNRYADNALGRNILPERNVKLFVTEFDEFRTELVIRNWHRTLTNLMEGSIDVALMKEFYANLYVPGDKPPKQVRVRGHLIKFDADSLNTFLETPVVLEPGRLFLLTPGSVD

SEQ ID NO: 177795 - protein, 206 aa, Glycine max
  Coding DNA Sequence Number=SeqID_86110
  Subcellular localization annotation: CTP_CleavageSite=48; ConfidenceScore=5.06e-01
MACLACPCSLSIIPSLVGIALSTPFSLSETQKVVSFQIPTVRLWKHVLGSSRYNLKMIQRVPIFKCQWVNGNIGVRQDKNGISFSRPSKGGFKDKLFTMAEQARQNMRMMMYMQIVMIIMKVYGRVSVHNYGIPKVMAIPPRSPSHSDAPLEAMSRSSRQSTQLRRQRIKLNVLMMPKDYMNHMLLKDLLKTKQLEIFKMDDQDSL

SEQ ID NO: 177796 - protein, 156 aa, Glycine max
  Coding DNA Sequence Number=SeqID_86111
MFLGSKCEESTWDKYVLSFHDKSCQGSENLSTRVGPVVLFPNTEGLVDLAVIDAFLAFHHGKNCLLCTGSLCVAGFTPFSPRRKGELGPFLASMEGRLLIGSLARRKEESGFYLHAKDVQMRGVPSNESIMPFIARGFGDHNARVLQGVRKAWDAA

SEQ ID NO: 177797 - protein, 150 aa, Glycine max
  Coding DNA Sequence Number=SeqID_86112
HWPEIYPKAHENPKAFSCISGPIYLESSIQCPCGVGLHHQVARPMMEREMITMIVDTLPVFYYEKMVGYTPSSFADLVFVGERIKVGLKRGKFDHPTFTNKNFGANREDVKHEGTHDVIVVPTWPNFPPTQHCHYSANISPSHFPPPNHP

SEQ ID NO: 177798 - protein, 71 aa, Glycine max
  Coding DNA Sequence Number=SeqID_86113
MNSEEQQGFIEMKMLEAKIPIHYGTLLSKAKIFQQIVSKAIIHKQGSKDFLSNAHKFILYNLMECTSFDLP

SEQ ID NO: 177799 - protein, 111 aa, Glycine max
  Coding DNA Sequence Number=SeqID_86114
  Subcellular localization annotation: CTP_CleavageSite=83; ConfidenceScore=5.56e-01
MKKRMDATSSKAGPPQQCLPPTLVFPKATGVMANVSKKPAPKKQQQPSPSAIGKGNFVDPSSPRLASGLPGSPICLGLKEPARLGEPVSSGLSISSPRRAAIVPNVLISYK

SEQ ID NO: 177800 - protein, 39 aa, Glycine max
  Coding DNA Sequence Number=SeqID_86115
MALSAPLRTKTLFKPELQGMKEEVLPCNGGLESFVGKFR

SEQ ID NO: 177801 - protein, 202 aa, Glycine max
  Coding DNA Sequence Number=SeqID_86116
MVMGDFISRLSFPACLHFSEENTETFSSLTSYPELRRSEFLIGGYVGARASLLSTIPPFVAHDSRAGQHTAEIPYGYPHPFARQTQLCPMASRDQVWSFCTRYAEIPYGYPHPFARQTQLCPMASRDQVWSFCTHDTRRYLTVIRTPLLGRHSCVRWQAETKSGHSAHMIRGDTLRLSAPLCHSDTVVSNGTQRPSLVILHT

SEQ ID NO: 177802 - protein, 15 aa, Glycine max
  Coding DNA Sequence Number=SeqID_86117
MELTSLGSSMPYLPK

SEQ ID NO: 177803 - protein, 194 aa, Glycine max
  Coding DNA Sequence Number=SeqID_86118
  Gene Ontology: Mol. function=enzyme regulator activity; Cellular component=membrane; Biological process=capsule polysaccharide biosynthetic process
  Homolog annotation: Hit_ID=Q46631; Match level="QueryCoverage=90%, HitCoverage=24%, E-value=8e-78, Identity=80%"; Hit description =Putative tyrosine-protein kinase amsA
  Pfam annotation: Domain name=CbiA; Domain location=1-194; Score= -11.8; E_value=0.00043; Accession=PF01656.14; Description=Cobyrinic acid a,c-diamide synthase
MITGASPGIGKTFICANLATLVSKAGQRVLFIDGDMRRGYTHELLGADNKTGLSNVLSGKSEFSPAMIQKGVYGFDFLPRGQVPPNPSELLMHRRMQELLDWASKNYDLVLIDTPPILAVTDASIIGKLAGTSLMVARFETNTTKELDVSYKRFAQNGIEIKGVILNAVVRKASNAYGYGYDYYNYEYGKESKS

SEQ ID NO: 177804 - protein, 102 aa, Glycine max
  Coding DNA Sequence Number=SeqID_86119
MSAFSDGDFSSLTSYPELRRSEFLIGGYVGARASLLSTIPPFVAMTQKLVARGDTLRLSAPRHSVSPKCDSRVETNMVICALSGEVAFSDGEPFQSQVIRTT

SEQ ID NO: 177805 - protein, 121 aa, Glycine max
  Coding DNA Sequence Number=SeqID_86120
MAPTKHPLDPDKSNRALGFPDLITGLCQSFGVPLHLARQAQGDAPQAADAPPPHQAGPAGSFDTEQYLRHLVRQQAANHRAHVQTHDCLYQMSLSLQSQGFTSFPCPTSDQFRAEVAWPGD

SEQ ID NO: 177806 - protein, 124 aa, Glycine max
  Coding DNA Sequence Number=SeqID_86121
MLLKLGGINGDPVLRGTRIRATWEYVSLVEGGQLRMVGSCVICGCGELICTIARSPPSTTYDGRAPDSQPIKEQRPQSKEACVVVGQLWILSDIWNIASGNRLPREVEMASGNRLPRGVIDYQA

SEQ ID NO: 177807 - protein, 267 aa, Glycine max
  Coding DNA Sequence Number=SeqID_86122
  Gene Ontology: Mol. function=beta-lactamase activity; Cellular component=integral to membrane; Biological process=peptidoglycan -based cell wall biogenesis
  Homolog annotation: Hit_ID=A9C362; Match level="QueryCoverage=95%, HitCoverage=95%, E-value=2e-91, Identity=61%"; Hit description=Beta -lactamase
  Pfam annotation: Domain name=Transpeptidase; Domain location=25-263; Score=167.0; E_value=5.1e-47; Accession=PF00905.13; Description =Penicillin binding protein transpeptidase domain
MKTRLAVMTSVAAILFSQQAFAKNLCTLIVDAESGKVLLESGNDCSREVTPASTFKIAISLMGFDAGVLKNEKEPAWDYQQGYPDWGGKNWMNKIDPTAWLKYSVFWYSQQVVKKIGQHRFENYVKAFAYGNEDVSAVDVSAPGQNGVWVMSSLQISPVQQIGFLRKVVNRELRVNKHAYDMTDNITRYDVSVKGWTVHGKTGTGSPGKNNQYDPHHAYGWYVGWATKGRKKIVFAKLIQDEQVLTPNAGLRARDEVLKQMSAVIAP

SEQ ID NO: 177808 - protein, 122 aa, Glycine max
  Coding DNA Sequence Number=SeqID_86123
  Subcellular localization annotation: CTP_CleavageSite=48; ConfidenceScore=5.49e-01
MPISPCGSISWSVSSRHRDRIHKTPSGPGKVQQGPGVSSSSYGPLSVLQGARTPPARSRHHRQAQGETPQQPGDGRQRATDAPPSPLEFTSAHPQKGLSIAYTTWPTNRRPSPKPKDAPSCS

SEQ ID NO: 177809 - protein, 213 aa, Glycine max
  Coding DNA Sequence Number=SeqID_86124
  Gene Ontology: Mol. function=aspartic-type endopeptidase activity; Biological process=DNA integration
  Homolog annotation: Hit_ID=A5AEB7; Match level="QueryCoverage=97%, HitCoverage=20%, E-value=1e-50, Identity=47%"; Hit description =Putative uncharacterized protein
MDIDYAIRKDKLPAIADESSLVDVALYKWCERPNQLRMMFFKTKILAGIHGFVDQHEKVLDLLKAIDDQFITSDKALARTLIMNLSSLRLTSVKGVREYIIKMRDILVQLKKWEVDMSESFLVHFILNTFSEEERQLLMEMSESALLKIACGKNKATKSQANQKEIGKIPPQANIMKGMQNLRKPVRSEQNILSGNKLGSPVKAIGTCIFYFK

SEQ ID NO: 177810 - protein, 99 aa, Glycine max
  Coding DNA Sequence Number=SeqID_86125
MSNRNGNRICQYAPMSLSVVGYAPMSVLADDLYIQLAPATRFEPTTAPSGRMRHWLLLLAAVVDRQTLFSSSVVKLVKVQWGQGSDSIYIYIGSSGCYA

SEQ ID NO: 177811 - protein, 98 aa, Glycine max
  Coding DNA Sequence Number=SeqID_86126
MGASSKEGKRAESPPTFIRGKHRKKPKRRETLRRWTINVLLVFERRETIRRWTINDLLVFERRETLRHWTINDLLGLSTKAGLLLIRILNCDEEIRPT

SEQ ID NO: 177812 - protein, 136 aa, Glycine max
  Coding DNA Sequence Number=SeqID_86127
  Gene Ontology: Mol. function=GTP binding; Cellular component =intracellular; Biological process=small GTPase mediated signal transduction
  Homolog annotation: Hit_ID=Q1H0Y1; Match level="QueryCoverage=96%, HitCoverage=34%, E-value=3e-47, Identity=71%"; Hit description=Small GTP-binding protein domain
  Pfam annotation: Domain name=MMR_HSR1; Domain location=1-82; Score =3.0; E_value=0.00057; Accession=PF01926.14; Description=GTPase of unknown function
MHLPEGYPVVLSDTVGFIKHLPTTLIEAFGATLEEAAQADLLLHIVDVASPNRDAQIEQVNIVLNEIGAAQVPQILVLNQIDRLGMAPGIDRDEYGNIRTVRVSAKDGTGIEDLRQALLEHQQYLKKLSTEESAYV

SEQ ID NO: 177813 - protein, 108 aa, Glycine max
  Coding DNA Sequence Number=SeqID_86128
  Homolog annotation: Hit_ID=A2I5F8; Match level="QueryCoverage=100%, HitCoverage=10%, E-value=2e-08, Identity=27%"; Hit description =Integrase
MWDTLQLTHEGTTSVKRSRIDTLTREYELFGMNPHENIHSLQKRFTHIEHEMELQCLNQNEENDKKKRSIALKASSSIQKENEEEDQMMKRFSFFVKKFHRIHQEKKN

SEQ ID NO: 177814 - protein, 206 aa, Glycine max
  Coding DNA Sequence Number=SeqID_86129
TEGCMSSPLMRDLQNGYLDKVEQERVQAIIERAHRLCHGYVSAQKAFRELDIEYQNNGVARLYCDKWPLTGMTSLKAFKQTGWSYYQHYSGNLGLFITSVIGVVMSDAPSAFRQITRTARKEHKCCECRRPIPTGAKYTYSSGIWDGSPSAVSDYDEQPMFTQLTEWLGNYFHQGYDQELSIRDICRDLNLREEVIYYALNGRFPS

SEQ ID NO: 177815 - protein, 365 aa, Glycine max
  Coding DNA Sequence Number=SeqID_86130
  Gene Ontology: Mol. function=transporter activity; Cellular component= integral to membrane; Biological process=transport
  Homolog annotation: Hit_ID=Q7M9C7; Match level="QueryCoverage=89%, HitCoverage=81%, E-value=4e-47, Identity=36%"; Hit description =PUTATIVE EFFLUX PROTEIN
  Pfam annotation: Domain name=MFS_1; Domain location=1-325; Score =118.8; E_value=1.6e-32; Accession=PF07690.7; Description=Major Facilitator Superfamily
  Pfam annotation: Domain name=Sugar_tr; Domain location=1-364; Score= -127.9; E_value=0.00055; Accession=PF00083.15; Description=Sugar (and other) transporter
  Pfam module annotation: Pfam domain module=MFS_1::Sugar_tr; Domain location=1-325::1-364
MAKIFGTDIGHIQISISIFFAGFAIGQLLWGPLSDKKGRKPMLYCGLILFMIGAVAIIFTENIYVLWIMRFLQAFGGSAGIVIGRAIVIDLYDKEKAVTIFSKQSQISGIAPIVAPLMGSIFLRFWGWNSAFSFLSILGAITLFLVVKYIPETNSRIASPETSETDIQLKNQLKVIISNRDFINNTIIGSIAFASLIIYISNAPFLFMEIHGFSSEVFSFIFAFNSMALIFAAYITPKLTQRVKDTRILFSAAILLLSMSCLHLFISLGQLFVGLEVAVLFSSLIAIGLLFPITTAHALSPFKEGRGTAAALMGFIQLMVTFLMSAIVGFLESQSIMPMIIARIALAGVAVFFAYRTFLAKKVYA

SEQ ID NO: 177816 - protein, 147 aa, Glycine max
  Coding DNA Sequence Number=SeqID_86131
CIHNASSRRQECENYIGRWLKEAGKQIYIAPYLNQAHWQLVVLCPGDNVVVWFCSLKKKPDVAIKGAVNSAMKSVTKTAEGKPPQHGPQWIEAKEITSVGYYVMQWIWCIVSGGLKDDWIHWFSDRSPLTEETMTTLRHKWAAYLSK

SEQ ID NO: 177817 - protein, 188 aa, Glycine max
  Coding DNA Sequence Number=SeqID_86132
MPGILSRLNATIYCRIREAITRQQGVPTSLYRSSALPLCSLTSSHTLHTKSMITASHSNAMLGDVYAYGLISGRGSVRDFTKPAVGCLRGSVNLRRLQPLYGPLSFGCSTFDANRRIRDSSLLHGSWLKNFSASSSACYSAGAAHAVSFDGSPPDEQLANSSFSPDPFFNLVLATLDSNLSHWVAYVD

SEQ ID NO: 177818 - protein, 130 aa, Glycine max
  Coding DNA Sequence Number=SeqID_86133
  Gene Ontology: Mol. function=RNA-directed DNA polymerase activity
  Homolog annotation: Hit_ID=Q2HSQ4; Match level="QueryCoverage=41%, HitCoverage=56%, E-value=2e-13, Identity=64%"; Hit description=RNA -directed DNA polymerase ; Zinc finger, CCHC-type; Peptidase aspartic, catalytic, putative
MARYLHGLNREIQDIVELHHYASLKDLIHQAIKVEQQVKRKQTCKKNRGSSLKSHEKVLPLVKIILTLLPLHQKRVPLNVLSVWERVILSPNVLTKGQWLWWVMGLLLVHLFQALLVLLLRVKVNVMYNH

SEQ ID NO: 177819 - protein, 123 aa, Glycine max
  Coding DNA Sequence Number=SeqID_86134
MTLLLSNILPSDRNANLPLQKYQLVCVVPTWGSHPQETPSGPGKVQQGPGVSSSGYGPLSVLQGARIAPARHPVDPKKSNRVLELSSSNYGKGIRPPTDRAFIKKYCVPRQAQGETPQQHWDG

SEQ ID NO: 177820 - protein, 220 aa, Glycine max
  Coding DNA Sequence Number=SeqID_86135
MVIDQSLFFSLTHLPSQGAPFEGTIVDDWKFDYSSHDARHMVCNDQAEMTAQASKEDLILMWAFLTGRQIDWAHLVQYRMHKALRANAPLPYPQLITLFLHHFQIPLDDEPFVQVKRSFAIGAGAVTSFGYRKDRNGQWLKKDALPPQDERTPSPPPQRKDSALMNEVLSELRGLRSYVGDCFDSLDTRFAGMDIRLTQLEEDVGYIRQSFDLPPPPPSS

SEQ ID NO: 177821 - protein, 286 aa, Glycine max
  Coding DNA Sequence Number=SeqID_86136
  Homolog annotation: Hit_ID=A4DID9; Match level="QueryCoverage=19%, HitCoverage=49%, E-value=8e-19, Identity=80%"; Hit description =Putative uncharacterized protein
IPPPQGSSTEGESGPKIRPKGVVDGQQDARCPCFFRVIRGRENASSQSSSTRRYSAEVIHAILPGKARTTFNKWVPVPETDTGVPPHKGGRSDQARATVYQKHRSPQSREPTTEAPVNGGRNYNGPKVAKFLVGHVCEDADYCTWTERPYEASLFLGIGFGLFLRSLGGGQRRPPSGGARAISLPKGNGGVQRFPRARRRLALECKGRRELDCKTHPSSRDETHIDGKVWHLDVGSSPPGAVVCSKGWAVRPLKRYVSWVQNVVRQFGPYPDREGRTSGVPVIVPT

SEQ ID NO: 177822 - protein, 106 aa, Glycine max
  Coding DNA Sequence Number=SeqID_86137
  Subcellular localization annotation: CTP_CleavageSite=65; ConfidenceScore=5.18e-01
MAFIIGESFGGSHAREGPPATLGPHRFMSLCQVSYPSRSSQVPDLTPAARQVSKQFAEGSCSMVYQSKKTGSARRSGEVAIQTFYQYQYNSGTWLPMAERISGMNF

SEQ ID NO: 177823 - protein, 149 aa, Glycine max
  Coding DNA Sequence Number=SeqID_86138
MGNPGDLQPFDPEIDRTLHRLVRHSLHLGHSVHSDHFEHFVAGDCEYSDIEHSAVNFHTENMAQPPPSESTLRPFCGRVRRGSRLRFSKEERCVESPPTFICGKRWKNRRKPVKKNIPSSGVVFTFEEGRQKRGSCSYVPSIEEEIKPT

SEQ ID NO: 177824 - protein, 107 aa, Glycine max
  Coding DNA Sequence Number=SeqID_86139
  Homolog annotation: Hit_ID=A5B2A7; Match level="QueryCoverage=68%, HitCoverage=9%, E-value=4e-07, Identity=36%"; Hit description =Putative uncharacterized protein
  Pfam annotation: Domain name=zf-C2HC_plant; Domain location=44-99; Score=43.7; E_value=6.3e-10; Accession=PF07567.3; Description =Protein of unknown function, DUF1544
MAFTIWNMTFTMAVTLWRFMVAMVDATGTWICTASSNPTSKRINIGWKHCTTVRKNDTNEICCKHCHKIMKGGITRGKHHLIGKPGNVAPCLVCLKEVVDEIRASEK

SEQ ID NO: 177825 - protein, 102 aa, Glycine max
  Coding DNA Sequence Number=SeqID_86140
MEKSEKKNFSEKKVKKAYIIWDDNDMESSEDSENEEINLCLMAKSYESDEEVSLKNKWYIDSGCSKHMMGDASKFTHISPKKSGHALSTTCLVLVNYVIKAI

SEQ ID NO: 177826 - protein, 81 aa, Glycine max
  Coding DNA Sequence Number=SeqID_86141
MEAKAQKWWPRGENLQNPWVLRFLNEGGEFWVERNSPSPRFYVSRILGSLPVALLACSELGMGRRSVDHGPSLYSRPSLST

SEQ ID NO: 177827 - protein, 137 aa, Glycine max
  Coding DNA Sequence Number=SeqID_86142
  Gene Ontology: Mol. function=protein kinase activity; Cellular component=chromatin; Biological process=protein amino acid phosphorylation
  Homolog annotation: Hit_ID=Q2QZ78; Match level="QueryCoverage=94%, HitCoverage=23%, E-value=4e-30, Identity=48%"; Hit description=AT hook motif-containing protein, putative
MTNEQKQIVQVVNNNEGDMFFLYGYGGTRKTYIWRTLASSLRAKNQIMIMVASSGIASLLLSGGRTAYSKFKIPVPIFEDSTCNILQGSQLAELLNQTNLIIWDEAPMAHKFCFQALDQSLTDITEEKKSRSIFGGK

SEQ ID NO: 177828 - protein, 59 aa, Glycine max
  Coding DNA Sequence Number=SeqID_86143
MTTLVSACQSDLGSPNDEVQITIRRLRMLPDSRVTIAGWGADNRKVSLHAIGLSGHDSK

SEQ ID NO: 177829 - protein, 191 aa, Glycine max
  Coding DNA Sequence Number=SeqID_86144
  Gene Ontology: Mol. function=nucleic acid binding; Biological process= DNA integration
  Homolog annotation: Hit_ID=Q3BZ68; Match level="QueryCoverage=75%, HitCoverage=17%, E-value=9e-12, Identity=32%"; Hit description =Putative transposase
MTPGPDDTTPAEKRVEALAAYGAVGTPCEWDDGFLIRTAIKVETKKRIDRQRGVRTADGWFTSDELLQELRTEDASEVRSDCCDPSVIYVKVRGSWFKAFHNKVQSDALLSDQERLFHLLWAPSLRSQSAKRKEEVARARHSRRVQAQAARPATEHLAPVPMPGSDERLNIEPVPPVIAQDIVPFDEREDY

SEQ ID NO: 177830 - protein, 107 aa, Glycine max
  Coding DNA Sequence Number=SeqID_86145
  Homolog annotation: Hit_ID=A6FJQ2; Match level="QueryCoverage=35%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTLSTLEDPPAERPSAASQ

SEQ ID NO: 177831 - protein, 152 aa, Glycine max
  Coding DNA Sequence Number=SeqID_86146
  Gene Ontology: Mol. function=phosphotransferase activity, alcohol group as acceptor; Cellular component=cytoplasm; Biological process =nucleoside metabolic process
  Homolog annotation: Hit_ID=A7PLQ9; Match level="QueryCoverage=68%, HitCoverage=47%, E-value=2e-23, Identity=57%"; Hit description =Chromosome chr14 scaffold_21, whole genome shotgun sequence
  Subcellular localization annotation: CTP_CleavageSite=60; ConfidenceScore=5.08e-01
MMSEETTSIDYVMEAASRSHFSALRLDGQVPSSATAPSSTLDSTLTLNSLPNQPFAIGVSRGTASGKTTVGNMIIQQLHDHCVVLVNKDLFYHGLNPEKLKRVHKEAYISRRQRADGAISRSPSTNRLNTSKGGAGGANNNKQEKNGEACLP

SEQ ID NO: 177832 - protein, 54 aa, Glycine max
  Coding DNA Sequence Number=SeqID_86147
MVHVSTQLDGTNKTAVVGILYKYGSPDPLLSKVLGKIHNGDSEDEEKSVGVIDP

SEQ ID NO: 177833 - protein, 30 aa, Glycine max
  Coding DNA Sequence Number=SeqID_86148
MDKSLKVGEDEWRERERKEQNFGREKRKNE

SEQ ID NO: 177834 - protein, 474 aa, Glycine max
  Coding DNA Sequence Number=SeqID_86149
  Gene Ontology: Mol. function=transcription regulator activity; Cellular component=nucleus; Biological process=regulation of transcription
  Homolog annotation: Hit_ID=A5AS17; Match level="QueryCoverage=99%, HitCoverage=98%, E-value=1e-124, Identity=53%"; Hit description =Putative uncharacterized protein
  Pfam annotation: Domain name=HLH; Domain location=366-404; Score=7.5; E_value=0.025; Accession=PF00010.17; Description=Helix-loop-helix DNA- binding domain
MSDDQFQASGNWWETARSVRFESRESQSSSGLTNNIGSYAASWQQHQQHDMATRSSSMDNNSVSGGSSVVFHDQKQLQVHDSSPAATSTNDPNFHMMALGLSSQAMDWSQASLPLRGEKGSENSFRSMLQENLSSSGTNFQQQECGSNSIGLSQHHHHHHQQVHWKPEKLFSAESSSNEFKRGFSLDQTQFSPQYSSGDSTVTSQGLPCSFQIDYVGNPSSILQGLLGQESNNNQQQPHQGGGAMNFPYSAASYGLNSNIELVPSWSKVPQFLRASPPKQPPNNQLHFTNNAPFWNANSEPAIKDSRSNFIPSLQPPFPTSNFDVQSKNISEVRDSGGVVKKSGSEAAPKRPRNETPSPLPAFKVRKEKMGDRITALQQLVSPFGKTDTASVLSEAIEYIKFLHEQVTVLSTPYMKSGAPIQHQQSSGKSKESEGPKQDLRSRGLCLVPVSSTFPVTHEPTVEYWTPTFGGTYR

SEQ ID NO: 177835 - protein, 177 aa, Glycine max
  Coding DNA Sequence Number=SeqID_86150
MTGRLLAGSLAFESRILHYLIVRILLPRSSNLAQALRLNAPLPYPHLVTLFLQHFNIPLDSEPYVPIKISFLIGASVIASFGYHKEHDGSWVKKGARHVDEEGHGGEDSSLLQKILDRFDGLQTFVGERFDTMELQVDMRFNEMESRITKVEEDVSIFVQALIYHHRRHHHLSFSII

SEQ ID NO: 177836 - protein, 100 aa, Glycine max
  Coding DNA Sequence Number=SeqID_86151
MDKGLKVGEDEWREKERKSMTFCASKEVSQPTLRLEGGAGLTSSSSMGGKCAESPPKFIQGKRQKNWKRCGLRTLIVKGSGVVFKHGEGISIPRVRHKGQ

SEQ ID NO: 177837 - protein, 84 aa, Glycine max
  Coding DNA Sequence Number=SeqID_86152
  Subcellular localization annotation: CTP_CleavageSite=46; ConfidenceScore=5.39e-01
MGPKSTLRLMRTLWPSPASLVKSSWSLLSNALMMQAPLELVGLGFSSSMDSFASWKMNGSGLEKEEGEETPLQGEDESRRSSPP

SEQ ID NO: 177838 - protein, 77 aa, Glycine max
  Coding DNA Sequence Number=SeqID_86153
MGAKYLKVVKRGSHPNKQMARNDIDVYLSPLIEDLTELWDEKVSVFDGFRNETFDLQYLEKVKPVGLPKSQHDERVG

SEQ ID NO: 177839 - protein, 86 aa, Glycine max
  Coding DNA Sequence Number=SeqID_86154
MQNSKRDVYLGAYLNAAHWQMVIILPKENVVIWFCSLHNRPNNYLKGIINSALKGFNDNPQSKSKVTLGGLLLNISMMLDHWNHRD

SEQ ID NO: 177840 - protein, 76 aa, Glycine max
  Coding DNA Sequence Number=SeqID_86155
MGLRKRLRMENCTKQSLRMAPNSKGGILPVENDFEWQSGLKNFGQGSKRSKVVFQWGLLSWEPNLDIWGETNLGVK

SEQ ID NO: 177841 - protein, 167 aa, Glycine max
  Coding DNA Sequence Number=SeqID_86156
MEKAPRIDPLYNPNSSSLGLFSRKKSVIEAYPFQPRDQPIKQTKIVGMVYPADGLSSVSDVLVFVGEYLSGVQVSGPCPSISGASAHWPFESGDVVACTDSHRDWVGLQCTACVAYAKRTSKGLRRKPRSRIRLFGYKIEKNALDGCPGIEKEGRFQRRKAMGRYRL

SEQ ID NO: 177842 - protein, 174 aa, Glycine max
  Coding DNA Sequence Number=SeqID_86157
  Subcellular localization annotation: CTP_CleavageSite=76; ConfidenceScore=5.02e-01
MAQLISDVIYCLQGSRPQDAQWTQRSPTGPWGFQLWLRALSVLQGARSPARNRTHKDTQWTRRSPIGPWGFQLWLRASVVLQGARSPRQGHVIIGTAPARHPVDPKKSNGVLELVPVTSSKGIRPPTNRAFIKKYCVSRQAQGETPQQPGDGRQRATDAPPSPLEFTSAHPQKV

SEQ ID NO: 177843 - protein, 121 aa, Glycine max
  Coding DNA Sequence Number=SeqID_86158
MGIQKNSQAEKGDTNEFRRLVLCSFGKGRRETQKEFRGLVLGEFFLAKGEENEKMNSTSFQGLENQKTSESFWYKEEEEVQRDSRLVKDCMNKCSRLLKCKTKPCFYRLFMSGQEDHLEEL

SEQ ID NO: 177844 - protein, 165 aa, Glycine max
  Coding DNA Sequence Number=SeqID_86159
MKLTKFIVKNFQIGSVNELLDWKSKTTLVTNDIKWLARDPLEIVRRYRGYIVDGVGFHTKIHERGCKVDNFAKKVFYVENKTQNDWLVVMHAKIRDVYDMGDEQSNDIDQGNEQVLQEINDNDLIKPEADDSDDIIEVAIPMENILPHDKDDNYIDDDERDANFF

SEQ ID NO: 177845 - protein, 300 aa, Glycine max
  Coding DNA Sequence Number=SeqID_86160
  Gene Ontology: Mol. function=glutamine-tRNA ligase activity; Cellular component=cytoplasm; Biological process=tRNA aminoacylation for protein translation
  Homolog annotation: Hit_ID=A8GB43; Match level="QueryCoverage=100%, HitCoverage=54%, E-value=1e-173, Identity=97%"; Hit description =Glutaminyl-tRNA synthetase
  Pfam annotation: Domain name=tRNA-synt_1c; Domain location=27-300; Score=507.1; E_value=2.1e-149; Accession=PF00749.12; Description =tRNA synthetases class I (E and Q), catalytic domain
MSEAEARPTNFIRQIVDEDLASGKHTSVHTRFPPEPNGYLHIGHAKSICLNFGIAKDYQGQCNLRFDDTNPVKEDIEFVESIKHDVEWLGFEWSGNVRYSSDYFDQLHQYAVELITKGLAYVDELSPEQIREYRGTLTAPGKDSPYRDRSVEENLALFEKMRNGEFAEGAACLRAKIDMASPFIVMRDPVLYRIKFAEHHQTGNKWCIYPMYDFTHCISDALEGITHSLCTLEFQDNRRLYDWVLDNITIPCHPRQYEFSRLNLEYAIMSKRKLNQLVTEKIVEGWDDPRMPTVSGLRRR

SEQ ID NO: 177846 - protein, 85 aa, Glycine max
  Coding DNA Sequence Number=SeqID_86161
MWYPPQGNSLSMSTRHSHLGKLGSKCRGHPVVHKQLPSPPPYGDPPESQGSSKPSDMPPSTSIPPHEELQVLTDKVYTVSMSYEV

SEQ ID NO: 177847 - protein, 144 aa, Glycine max
  Coding DNA Sequence Number=SeqID_86162
SFGVPVTPSKVIRPPITRAFIEKYCTPRQAQGDAPQAADAPPPPHQADPAGSLGMEHYLQHLVRQQAANHRGLLPIHECLYRFSLSQQGQGFALFACPTAKQFGAEIAWPEDWLEAQAGEEPAGSPGEAEEARMDEEMTDLLGF

SEQ ID NO: 177848 - protein, 155 aa, Glycine max
  Coding DNA Sequence Number=SeqID_86163
MEKIPDQKDQKKKFPIKEWEKAKKRRKKILDQRSEEKRRNMQKGLRTRQYLNNTNLSPSKQEKKGNHDLKWSSPFDCQPKSCVLATFSARTKQKQKRKRPKTFKAKIPTKKHTIPKKKSYRSMITHVIFDFIGNDLQDQVMAYLWFGIRTKHLPV

SEQ ID NO: 177849 - protein, 406 aa, Glycine max
  Coding DNA Sequence Number=SeqID_86164
  Homolog annotation: Hit_ID=Q6WAY4; Match level="QueryCoverage=85%, HitCoverage=60%, E-value=2e-37, Identity=30%"; Hit description =Putative uncharacterized protein
MGQLQRQAFCKAYGKIWDLAMAEVSKKAIASLAQYYDQPLRCFTFGDFQLSPTVEEFEEILGCPLGGRKSYLFSGFYPSLAKISKIVQISTQELHHRKQVENGVVGVPRECLEAKARVLAGEGEWAPFIEILALLIFGGVLFPNVDGLVDQAAIDAFFAFHDRKESPVVAILANLYDTFDRRCEKNSIRIVCYTSAFYVWLVSHLFRQELRHACPLEGHLSCTEKKEASWDRLLASKEGASINWFPRWKEGRTGVLISCGGFPNIPLLGTRGCINYNPILAIRQLGYPMSGAPLKEDLTPIIARGFNNTNAEALQKVHKAWEMVQKKDKELRGSSNGPISGYHRWLKAYTQGLDWLPNLRTTKGVEVEALEENEEVQALRAELEKAQTVKKKFKSAAIRIRKKPPN

SEQ ID NO: 177850 - protein, 54 aa, Glycine max
  Coding DNA Sequence Number=SeqID_86165
MSWLNLQTAFPLGPKQNFLQHISIQAAGLRSNRWRYWWMADMGTFRNCQYEASE

SEQ ID NO: 177851 - protein, 117 aa, Glycine max
  Coding DNA Sequence Number=SeqID_86166
MASRKRKSTASRPQEPYDTIRFISEVALERYEQNIHSRSILLERNVNLFIIEYDEFHRELERRWWHKALTRDSLNAFLETLVVLEPGELSYPNFVRGPSVVGIRPSFDHFEVLGTHR

SEQ ID NO: 177852 - protein, 100 aa, Glycine max
  Coding DNA Sequence Number=SeqID_86167
MVSGDSEAFGDANSSFQNFESAPSRIFSKQGCFLQKQPSSPGRNGAVPKIHHPPDYAFQLFWVKKIVSTKKIQAEVLPRRFRKQIREGFPSFFVRSSFFN

SEQ ID NO: 177853 - protein, 71 aa, Glycine max
  Coding DNA Sequence Number=SeqID_86168
  Homolog annotation: Hit_ID=A5BTR2; Match level="QueryCoverage=100%, HitCoverage=3%, E-value=2e-08, Identity=49%"; Hit description =Putative uncharacterized protein
  Pfam annotation: Domain name=zf-CCHC; Domain location=51-68; Score =14.9; E_value=0.0085; Accession=PF00098.14; Description=Zinc knuckle
MCVQEEEKLIMEMGESALLTTSCGKNQATKSQANQKENGKIPPQADIKKVAKCFFCKKKGHMKKNYPRFQK

SEQ ID NO: 177854 - protein, 78 aa, Glycine max
  Coding DNA Sequence Number=SeqID_86169
MTQQVEVCLTIGRYNDRVLCDMVPMEATHILLGKHGSMTPNQCMMASPTRFLSSTMTKKFILKPLMQSSLGRDQSLEP

SEQ ID NO: 177855 - protein, 67 aa, Glycine max
  Coding DNA Sequence Number=SeqID_86170
MEFLRKNRTWILVDQPKKQNVWDSKGCHTIPVHPKGNYLARSRWWKRFRTQAHRCETTWPSYKAICD

SEQ ID NO: 177856 - protein, 110 aa, Glycine max
  Coding DNA Sequence Number=SeqID_86171
MKKRDTGHQSVSLENKIGDSILLKIGDSAKVVIKQDMKGGEHKYGFNNNKREKTEKKRVVDDETGDKHELYEVLRMPSKTKYRCLNQKKCSCHLLALVTSVFAENYIRRC

SEQ ID NO: 177857 - protein, 127 aa, Glycine max
  Coding DNA Sequence Number=SeqID_86172
  Homolog annotation: Hit_ID=Q84VH5; Match level="QueryCoverage=64%, HitCoverage=24%, E-value=3e-20, Identity=95%"; Hit description =Envelope-like protein
KLSVKYAILHRIGAANWVPTNHTSTVATGKAAASGAVSKDTLIAELKDTCKVLEATIKANTEKKMELERLIKRLSESGIDDGEAAEEEEEAAEAEEDAAEIQIQMMMMILKPPHDHQTFIFFAFYQL

SEQ ID NO: 177858 - protein, 180 aa, Glycine max
  Coding DNA Sequence Number=SeqID_86173
  Homolog annotation: Hit_ID=Q6L477; Match level="QueryCoverage=64%, HitCoverage=20%, E-value=2e-07, Identity=25%"; Hit description =Putative uncharacterized protein OSJNBa0009L15.8
  Subcellular localization annotation: CTP_CleavageSite=48; ConfidenceScore=5.41e-01
MTTPPASPPPPHPAVASESPSTLKRTRKATRLRSLATRPPGAERPVVHVDLVTDKADGPHKKKLRKYLGIVARDKVDVTYEIWKEAEFEIPEASDGRTKKKVLQTVGEWWWQFKSDLTRKWTLAANKDGVEDTVSEKYDICKEKWAQFCQTCSDPSWEDVRKKAQAIQKQNTAPHMLSHG

SEQ ID NO: 177859 - protein, 46 aa, Glycine max
  Coding DNA Sequence Number=SeqID_86174
MLCWYSRSFELIGIREDPCVWSMYSKQFTCQGNLIQPLLGLHKSGL

SEQ ID NO: 177860 - protein, 120 aa, Glycine max
  Coding DNA Sequence Number=SeqID_86175
MGLLGGGHARLRIVTSEGRRGGRRKGEWRGGSGFEVGVDVVIPYSYPYLTFDYWGKLKPEPILDQLGYYPSKSERIPTGMGFLAMSKGERGKRRKKKVEGRGRRKVRREGGEKERKGKRR

SEQ ID NO: 177861 - protein, 220 aa, Glycine max
  Coding DNA Sequence Number=SeqID_86176
TIGEWWRKFKSNLTSKWALAHNKKGKDDKVYEKYGISKEKMFERRHRPLKNKTLPLTCCLASRGSFIAHRRQDILAAAIGRPEHPSRVCAARATTDTNDHRPVGGVDYTKVTQQLMMSFSQMQSQMQSQGIALPPEVKGSMTVHNIPLGNDQLKLGVDKVRHADARVSVLTQEGKQVAEGLAKPIDMSNPDVDPLYLMTLTIPQHFLKSLQVSWDASVFA

SEQ ID NO: 177862 - protein, 900 aa, Glycine max
  Coding DNA Sequence Number=SeqID_86177
  Gene Ontology: Mol. function=phosphoenolpyruvate carboxylase activity; Cellular component=cytoplasm; Biological process=carbon utilization by fixation of carbon dioxide
  Homolog annotation: Hit_ID=B0LXE5; Match level="QueryCoverage=88%, HitCoverage=80%, E-value=0.0, Identity=89%"; Hit description =Phosphoenolpyruvate carboxylase
  Pfam annotation: Domain name=PEPcase; Domain location=1-847; Score =1951.9; E_value=0; Accession=PF00311.8; Description=Phosphoenolpyruva te carboxylase
MLHFHVQGLLDLSRGYIGPCGERYCLRLRGICFLISKGYKVGLVVKGEGKGGGRIRNCLTQLYAKDITPDDKQELDEALQREHCRNAMILLCSSCMKIQAAFRTDEIRRTPPTPQDEMRAGMSYFHETIWKGIPKFLRRVDTALKNIGINERVPYNAPVIQFSSWMGGDRDGNPRVTPEVTRDVCLLARMMAANLYFSQIEDLMFELSMWRCNDELRVRSDELLSSSKRDAKHYIEFWKQIPPNEPYRVILGDVRDKLYNTRERARQLLANGSSEIPEETTFTNVEQFLEPLELCYRSLCACGDQPIADGSLLDFLRQVSTFGLSLVRLDIRQESDRHTDVMDAITNHLEIGSYREWSEERRQEWLLSELSGKRPLFGPDLPKTEEIADVLETFHVIAELPSDSFGAYIISMATAPSDVLSVELLQRECHVKQPLRVVPLFEKLADLEAAPAAVARLFSIDWYRDRINGKQEVMIGYSDSGKDAGRFSAAWALYKAQEELIKVAKEFGVKLTMFHGRGGTVGRGGGPTHLAILSQPPDTIHGSLRVTVQGEVIEQSFGEEHLCFRTLQRFTAATLEHGMHPPVAPKPEWRALMDEMAVIATEEYRSIVFQEPRFVEYFRCATPELEYGRMNIGSRPSKRKPSGGIESLRAIPWIFAWTQTRFHLPVWLGFGAAFSHVIKKDPKNLQMLQDMYNQWPFFRVSLDLVEMVFAKGDPGIAALYDKLLVSEELWPFGERLRSMFEETKSLLLQVAGHKDLLEGDPYLKQRLRLRDSYITTLNVLQAYTLKRIRDPDYHVKLRPHLSKDYMESNKPAAELVKLNPTSDYAPGLEDTLILTMKGIAAGMQNTGISVSSNFKIDGAKPILLDALKFCCIGNNLSEFHQHAAVLCPKVTNFVNENIPI

SEQ ID NO: 177863 - protein, 75 aa, Glycine max
  Coding DNA Sequence Number=SeqID_86178
MLLFFKTKRLQNPYTLRVTTAMEKPKLEDLLLRSTCLSLPRGTPIPSSGPSLPINGRGECSLMQTRQRCFKPNAK

SEQ ID NO: 177864 - protein, 208 aa, Glycine max
  Coding DNA Sequence Number=SeqID_86179
MTRQGVETNLGRAWVNVVGRVKRRVIWHYIRQSCVFIICDQQKNPRGTTVTSMDDLEKEVAVEGKQNAVVARVGVAEHEGEMNDGRPRVSPLGGNPDWPLARRSGVGVLPLHAEFPEYCATVPHCVNLNRAPIGSLYCDGTDGSGGTYKVEEGDDERMGVMRWSTKHHRVCRKTPWVKVGRKLNESTKIDKEARKGKAGFEGQNLQTR

SEQ ID NO: 177865 - protein, 206 aa, Glycine max
  Coding DNA Sequence Number=SeqID_86180
MDNEEGMQEQMKADLSALKDQMASISKVMLKLQKTIEDKATATASSTVREAEPVLQPILNSGLDRNTAVFGRRYSPQAYPYGLPPDFTPRATPEDLSQAPTFEGQLPPYDDYPGQDDEEGDTHLGPLLHLKDPSPHELLQPNIVRHIPASPTPVKESVLFAEDKGKIEALEERLRAVEGLGNYPSRISGLCLVPISSFLQVQSAGL

SEQ ID NO: 177866 - protein, 95 aa, Glycine max
  Coding DNA Sequence Number=SeqID_86181
MFSLNKRWWRLRAYSFLGRRTCESRVALLPKGRLRQIANETFSQSRLEEADIFGEVLRIANKTFSLSRSEEADFSREGGDEDVSHCMPLGLESYG

SEQ ID NO: 177867 - protein, 209 aa, Glycine max
  Coding DNA Sequence Number=SeqID_86182
  Homolog annotation: Hit_ID=Q6WAY6; Match level="QueryCoverage=99%, HitCoverage=41%, E-value=3e-20, Identity=28%"; Hit description =Putative uncharacterized protein
AYGKILDLTIAEISTEAIASLTQYYDQPLRCFTFGDFQLVPTVEEFEEILGCPLGGRKPYLFSGFLPSLSKIAVVVRDSARGLDRVKQTQNGIVGLPRKYLEGKARDMENKEEWVLFMDTLALLIFGVVLFPNVDGLVDLAAIDAFLAYHHSKESPVVAVLADLFDTFDRRVDWDQHLAGIGGRTVNWFPRWKEGKEGVLFSCGGYPNI

SEQ ID NO: 177868 - protein, 92 aa, Glycine max
  Coding DNA Sequence Number=SeqID_86183
  Subcellular localization annotation: CTP_CleavageSite=50; ConfidenceScore=5.11e-01
HRALGFPALVTGLCSPTGCPFPRARSHHHRDRAAGHPVDPKKSNRVLELSSSNYGSLSVLRRRNTTIAWGWPAAGNRRTAITSRVHLSSSTK

SEQ ID NO: 177869 - protein, 77 aa, Glycine max
  Coding DNA Sequence Number=SeqID_86184
MRRGKSEANTEKKKDTNPNEGKEVPYPLVPSRNDKERHLARFLDIFKKLEITLPFGKTLQQMPLYAKFLKDMLTKNN

SEQ ID NO: 177870 - protein, 87 aa, Glycine max
  Coding DNA Sequence Number=SeqID_86185
MLRNLTDYVIIPLLPSGTLRNFTDCALTLPFNFWHVTELHGLCYNAFILASGMSRSFTNYLTMGVKYLKVVKRGSHPNNGWSSNKIR

SEQ ID NO: 177871 - protein, 173 aa, Glycine max
  Coding DNA Sequence Number=SeqID_86186
  Homolog annotation: Hit_ID=Q2HW90; Match level="QueryCoverage=42%, HitCoverage=14%, E-value=8e-11, Identity=45%"; Hit description =Putative uncharacterized protein
MGSSQKPSLKKRFYQVKVKSLGITSLKELGQLMGQLQRQAFRKAYGRSEWTPFIVVLALLIFGGVLFPNVDGLVDLAAIDAFLANHNHKESPVVAMLADLYDTFDRRCEKSSMRIVCCTPALYVWLVSHFFRQERKEAQIGTNSYQTKKERLSTGSLDGKKEELEFLSRAEDF

SEQ ID NO: 177872 - protein, 151 aa, Glycine max
  Coding DNA Sequence Number=SeqID_86187
MPISPCGRIATTRHPVDPKEPWGFQLGLRASISPTGCPCPPTRSCHHDIGIAPARHPVDPEKSNKVLGFPALIMGLCQFYRVPVAPSKVIRPPTNRAIIKKYCAPRQAEGETPQQLVDGPQQATNAPPPPPEPLSSSTKRLEYCLLHMADQ

SEQ ID NO: 177873 - protein, 308 aa, Glycine max
  Coding DNA Sequence Number=SeqID_86188
  Gene Ontology: Mol. function=ATP-dependent helicase activity; Cellular component=cytoplasm; Biological process=regulation of transcription, DNA-dependent
  Homolog annotation: Hit_ID=Q7N1W6; Match level="QueryCoverage=51%, HitCoverage=35%, E-value=1e-42, Identity=57%"; Hit description=ATP -dependent RNA helicase
  Pfam annotation: Domain name=Helicase_C; Domain location=1-62; Score =80.7; E_value=4.9e-21; Accession=PF00271.22; Description=Helicase conserved C-terminal domain
MVQANRNEAIKRLNDGRVNVLVATDVAARGIDIDNVTHVINYDLPRTADVYLHRIGRTGRAGRKGTAISLVEAHDHPLLGKISRYVNEPLKSRVIDELRPETRAPSAKVTGKPSKKALEKRKEKKAKEEEKPRVKKRHRDTKNIGKRRKPSGSSTPESADQLQAFGKGTGDNVTLLFWRQRVKAHRIARHANGQLRIFFRMLHRIFQRFTAQHVNVEVLTAFNAHLRFLLQWNFTVSNLAKVADCNNLIFREIAFCAQAAGFGFLIVQQPERVQQLRILCLSNLNTGNHRGLQGLALRQEHSAVLRVM

SEQ ID NO: 177874 - protein, 86 aa, Glycine max
  Coding DNA Sequence Number=SeqID_86189
MEKNEETTIEEKLACGASMEAGSLSFNEVLQWRRGEERRHPLGNNPWKKELHDQECVLDKKLGEDCRSKLHDDEPSNFDDAKSPSD

SEQ ID NO: 177875 - protein, 230 aa, Glycine max
  Coding DNA Sequence Number=SeqID_86190
KIIYNGLTNEITLTHLGTKFVLHPQTPSQVAKDQLTKKNKRDEEEKLENQKKKKDSKALSSKAKGKEKEEKDQAHVAKDQAEIKLKWDEEKNRKRKEEQPLMVKEKCKEVSVSSKRLAKKESHLAIKTNIKEFSLLRQSPHLLLCKRTLVSTTIPLELEVIRQVKELLDEGLVHKSLNPCALLVPKIGIMRHQIPMIGGMMNVLSGATLFCKIIHASNIFMIHMHRDSLG

SEQ ID NO: 177876 - protein, 424 aa, Glycine max
  Coding DNA Sequence Number=SeqID_86191
  Gene Ontology: Mol. function=S-adenosylmethionine-dependent methyltransferase activity; Cellular component=nucleus; Biological process=rRNA processing
  Homolog annotation: Hit_ID=A8AFL6; Match level="QueryCoverage=100%, HitCoverage=88%, E-value=1e-175, Identity=69%"; Hit description =Ribosomal RNA small subunit methyltransferase F (EC 2.1.1.-) (rRNA (cytosine-C(5)-)-methyltransferase rsmF)
  Pfam annotation: Domain name=Nol1_Nop2_Fmu; Domain location=14-293; Score=158.8; E_value=1.5e-44; Accession=PF01189.8; Description =NOL1NOP2sun family
MRASLADEAELERFLAISQQPLRRSLRVNTLKISVEDFLTRVAGYGWQLTPIPWCREGFWIARDDESLPLGSVAEHLSGLFYIQEASSMLPVSALFDAAPDARQVMDVAAAPGSKTTQMAALMRNQGAILANEYSASRVKVLHANISRCGVSNVALTHFDGRVFGAALPEQFDAVLLDAPCSGEGVVRKDADALRNWTLASTEAIAATQRDLLDSAFHALQPGGTLIYSTCTLNTIENQQVIAWLQQRYPQALEIVPLNDLFAGAERALTPEGFLHVFPHIFDSEGFFVARLRKTASVPPLPAPTYKLGKLPFSPASRKLVAEVAQAAHKVGLHWDESLTLWQRDKELWLFPAALESWLSKVRFSRIGLKLAETFPKGFRWQHEAVVALAQPDSALAFELDEAQAESWYRGQDIHPDTPPARDE

SEQ ID NO: 177877 - protein, 167 aa, Glycine max
  Coding DNA Sequence Number=SeqID_86192
  Homolog annotation: Hit_ID=Q949K7; Match level="QueryCoverage=19%, HitCoverage=37%, E-value=9e-09, Identity=75%"; Hit description =Putative gag polyprotein
MGEAHEVPRDHTQADFEPHLIYAIEGQAFGGIPLPYTLGGLQAIEGGRDYAFTDMAELCLVPDIVIPLKFKVLDFDKYKGTTCPKNHLKMDLAAQVVPPMVEREMITMIVETLPVFYYEKMVGYTPSTFADIVFASERIKVGLRRGKFDYPTLMNRKPGANGENKKE

SEQ ID NO: 177878 - protein, 245 aa, Glycine max
  Coding DNA Sequence Number=SeqID_86193
MWLKGVKTHVCISGNFDERAKIAYCAYPAKHACAPSLTVFLLRFALLRPDPQELAAKLCIPGRGFELKDDGQPLKILRKNMTALAQTWSIISFSNLIPTSHTSDVTLDRAKLIYGIIMKMNMNVGYLISHQISLIAQYDTSRLGFSALIAALCKARGVQSDSRSLESLSPAINLAYIKKNYWNLDDPTITFRGPRKARGKRSEVPTTSAPETPTPSSSTGPLPPIQTLVIPPTPTQIPLPAPLSA

SEQ ID NO: 177879 - protein, 222 aa, Glycine max
  Coding DNA Sequence Number=SeqID_86194
  Homolog annotation: Hit_ID=A7UQU7; Match level="QueryCoverage=58%, HitCoverage=21%, E-value=2e-18, Identity=38%"; Hit description=IMP dehydrogenase/GMP reductase, putative
MWSTLTLSGTSLIVVVTLGGLPRWFICTDQLDEACRTTTRQLAGYLTLLQCWIYEHFPSVHQCVTDDTYQETSPRASRWLTSKAHMKGITGAPYRARCDGLTVTDVSWLPYTEHRGVRAFQEISSFQGQLRWGPMIVTVRPERVVRQFGYIQSIPPPPVSADYIEWFFRISHPFMTPTQAADQQRDAPAADPEDYIQPPSPQVPVAFDPPPYVVRYLRVNVL

SEQ ID NO: 177880 - protein, 62 aa, Glycine max
  Coding DNA Sequence Number=SeqID_86195
MTSPANLLRNRSTLSRYEILQHSTEEGTSTQDIPLQTATSVNDNEIYLNVDGAPNYKGNMYG

SEQ ID NO: 177881 - protein, 128 aa, Glycine max
  Coding DNA Sequence Number=SeqID_86196
MALLSWEIPLFLLPRTGMEILILGQGLWWFEVLGQKACRTTRHDVYQGVGFASGSGIKGMSHIYFHDTHTTMMIWKFYAKLVMQACTHVDTQASSFYGHVTLGLRTHFSYLSQPSVSKTCFFIKNLVF

SEQ ID NO: 177882 - protein, 135 aa, Glycine max
  Coding DNA Sequence Number=SeqID_86197
MEHLLFRKFRFVDFSRVIASHFQTRLLVDVIGVVDEVVFRYVSSKNTKVLSCTLWENYCLQFLSYLNEVEDERPIIILLTHARIKEAQGSYLPSVSNSFKASKLMINELVLEIQELRERLLDLGMEVRSVLTPIG

SEQ ID NO: 177883 - protein, 92 aa, Glycine max
  Coding DNA Sequence Number=SeqID_86198
AYAINSWGSCLDCGGRVTSVRQSIHGAPNKIRCWRMHEQRPAINSWGSGLDGGGCMNDNQFMGLRIRFDGGGCTNNVRQSIRGAPDSMVEDA

SEQ ID NO: 177884 - protein, 27 aa, Glycine max
  Coding DNA Sequence Number=SeqID_86199
MEKERGAWLKSLPLSDKENAGIRKVYD

SEQ ID NO: 177885 - protein, 317 aa, Glycine max
  Coding DNA Sequence Number=SeqID_86200
  Homolog annotation: Hit_ID=A7R1J8; Match level="QueryCoverage=84%, HitCoverage=63%, E-value=3e-18, Identity=30%"; Hit description =Chromosome undetermined scaffold_359, whole genome shotgun sequence
  Pfam annotation: Domain name=Autophagy_N; Domain location=136-241; Score=-53.2; E_value=0.014; Accession=PF03986.4; Description =Autophagocytosis associated protein, N-terminal domain
NRNTEVEGSRAENKKKESVVLPSPIPWRSRSGRLEHKQEEFDEASNMMFPSSKEESRPVKSQPSRASSRDNSVSPSPSFSSESPAKNTEDSVRKKGFYKSCPPPPPPPPPTMFQKSVFMKPRFGGSSNEAPCFNKELKRSFTSERTTPVGKKSDEENKSMQPTLFRSNKFIGHASVPLVSQPAEKESLLVESDDDDDDDDTEIEDQDVEGGRTVAKNNDSGKSPPVIGGESSKTDGDEGPDVDKKADEFIAKFREQIRLQRIESIKRSTRSARNASSCFEWEIVIRSRFWPFVVEKCQTEFPYTNIHLERERKNREK

SEQ ID NO: 177886 - protein, 381 aa, Glycine max
  Coding DNA Sequence Number=SeqID_86201
  Gene Ontology: Mol. function=oxidoreductase activity; Cellular component=integral to membrane; Biological process=protein amino acid phosphorylation
  Homolog annotation: Hit_ID=A9PFH9; Match level="QueryCoverage=97%, HitCoverage=99%, E-value=9e-97, Identity=51%"; Hit description =Putative uncharacterized protein
  Pfam annotation: Domain name=2OG-FeII_Oxy; Domain location=177-281; Score=99.8; E_value=8.5e-27; Accession=PF03171.11; Description=2OG -Fe(II) oxygenase superfamily
MVATLSLPIIDLSSPHRLSTANSIRQACVEYGFFYLVNHGVDTDFVSKVFDQSCKFFSLPVQRKMDLARKEYRGYTPLYAETLDPTSLSKGDPKETYYIGPIEDTSIAHLNQWPSEGHFRITAKLETYNEILILETTNLHILLIFPRAAGKSLLSLIALSLNLEEDYFEKIGALNKPASFLRLLHYPGELGSDEQICGASPHSDYGMITLLMTDGVPGLQICKDKVNQPQVWEDVPHVEGALIVNIGDMMERWTNCLYRSTLHRVMPTGKERYSVITNHFLSCFNLYGSSEFLDIGDRACDPHYLIHTQRGGVKNSHANSDDKKVAFFFDPASDCVVECFESCCSESSPPRFSPIRSGDYLNERFRLTYGSEKDLKCDLSS

SEQ ID NO: 177887 - protein, 417 aa, Glycine max
  Coding DNA Sequence Number=SeqID_86202
  Gene Ontology: Mol. function=RNA-directed DNA polymerase activity; Biological process=regulation of transcription, DNA-dependent
  Homolog annotation: Hit_ID=A5AQL0; Match level="QueryCoverage=100%, HitCoverage=32%, E-value=4e-52, Identity=25%"; Hit description =Putative uncharacterized protein
  Pfam annotation: Domain name=zf-CCHC; Domain location=200-217; Score =19.5; E_value=0.0017; Accession=PF00098.14; Description=Zinc knuckle
MVATTYQTSHECSEETIINILVAGFSGQLKGWWDNYLTNEEKTLADFRWYRDTFLTRVYTREDSQQPFWKEKFLAGLPRSLGDKVRDKIRSQYNGDIPYESLSYGQLISYVQKVALKICQDDKIQRQLAKEKAQTKRDLGSFCEQFGLPACPKQKKQTSRKEAHENKVVTKKIFPRRRYSHKPSISKEIENPKQKLKSKVTCYNCGKQGHISKYYRLKRKLRNLNLEPAIEEQINNLLIESSEEEETKTSSSMISDENLNLIQQDDQLSSTEDERKINTLTREQDLMFEAINSIPDPQEKKNFLEKLKKTLEVKPKQKDFITNNKFDVSNILRRLENTSAKPTTIQDLQTEINNLKKEVKELRQQQEIHQNILSKLEEESDSESVANSDTNHIENPEDNMFMGLINKIKIQKFYINI

SEQ ID NO: 177888 - protein, 103 aa, Glycine max
  Coding DNA Sequence Number=SeqID_86203
MIILFRWLLKEKGTCLNIQACYDRFRFTSQEAWDCYSDIVIGRKILLERNVMIYHAEFDEFKYELERKNWHKELTNFMDGSIDVAIVKDFYAYLYDPEDKSPK

SEQ ID NO: 177889 - protein, 473 aa, Glycine max
  Coding DNA Sequence Number=SeqID_86204
  Homolog annotation: Hit_ID=Q6WAY6; Match level="QueryCoverage=46%, HitCoverage=35%, E-value=4e-24, Identity=34%"; Hit description =Putative uncharacterized protein
MFSGFLPSLSKIAAVVGDSAKVLDRMKQTRNGVVGLPRKYLESKARDMASQEKWGPFADTLALLIFGVVLFPNVDDLVDLAAIDAFLAYHHSKESPVVAILADLFDTFDRRCEKNSARIVCCLPALCVWLVSHLFQQDIRHPCPLQSYRSCIEKRKVDWDQHLVGIGGSAINWFPRWKEGKEGVLFSCGDYPNVPLIGTRGCINYNPALSIRQLGYPMRGAPTKESLSPFLVKDLGPQSLKVIQRVHKAWRSPLRIDKELRGIRNGIIGGYHGWLRVHTRGLDWLSKLKVINEENFETPEEDEEVQALKLQLGKARLAKEKFKSAATHIRKECIELREENAATARALEQETKRAHKEEHGRDKFRGALWGSNNELKLWREERDRSRVHGMILKEELAACVRSKRSLAQHLEATEQSMLAIIGQYKEELNQSVTHEQKLVEDFAQVYAEKEARGRVIDALHQEATMWMDRFALT

SEQ ID NO: 177890 - protein, 83 aa, Glycine max
  Coding DNA Sequence Number=SeqID_86205
  Subcellular localization annotation: CTP_CleavageSite=36; ConfidenceScore=5.01e-01
MRVHCNQASRRPSMIIDSPPLLMFPRTWFPVESPTVATYTSVGRATRDSWDASSKKGIARSCHQRLFEENVGKTGKVWSTNFK

SEQ ID NO: 177891 - protein, 227 aa, Glycine max
  Coding DNA Sequence Number=SeqID_86206
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=37%, HitCoverage=72%, E-value=7e-24, Identity=67%"; Hit description=LacZ protein
MTPVNRKQTESARGSRQGETPGIFIVLSGFATTDLSVRFRDACQGGGAYGKTALPRPSHFPVKYLPGIFQEISAPFPFFSCHMKHFTDTLISANIREIACAVRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 177892 - protein, 93 aa, Glycine max
  Coding DNA Sequence Number=SeqID_86207
MTRLFPEEQKGCRRPMSVSTCHRAPPPLDDKKGADNRKGISTRHQARRLWMTQGCRMTKFCLCVSSGPPPLDDTRVQNDQILSLRVIGPAASG

SEQ ID NO: 177893 - protein, 102 aa, Glycine max
  Coding DNA Sequence Number=SeqID_86208
MTSQDQPLMQVDILDFNMASNIISNRDSGELTLTDRQAALEPTEKNPKDECKAVMTRSKMVSMNEGEKKIGEEKQQLVTEPEIDPVVELLSKTDVPSFSSIF

SEQ ID NO: 177894 - protein, 147 aa, Glycine max
  Coding DNA Sequence Number=SeqID_86209
MIIDQSLFFSLTKLPSQGAPFEGTIVDDWKFDYSSHDARRMVCNDQAEMTGVGAVTSFGYRKDRNGQWQKKDALPPQDEHTPSPPPQQDDSSTLLTEVLSELRGLCTYVGERFDSLDGRFEGMDTCFTQLEEDVTYLRQSFDLPPSS

SEQ ID NO: 177895 - protein, 305 aa, Glycine max
  Coding DNA Sequence Number=SeqID_86210
  Gene Ontology: Mol. function=hydrolase activity
  Homolog annotation: Hit_ID=A1FW68; Match level="QueryCoverage=83%, HitCoverage=86%, E-value=1e-135, Identity=92%"; Hit description=Beta- lactamase-like
  Pfam annotation: Domain name=Lactamase_B; Domain location=81-302; Score=48.5; E_value=2.4e-11; Accession=PF00753.18; Description =Metallo-beta-lactamase superfamily
MGPQVEQAVRRQRPAQSGGQCPGRPGALIRSCRLLAGNPADYRNPAFAGGRLDGGAMFGNAPRALWEKWAAPDELNRIELACRALLASPLEGKTVLFETGIGAFFDPRMRERYGVQESQHVLIDSLREAGFEHEDIDVVVLSHLHFDHAGGLLAAWSEGREPELLFPNATFVVGAQHWQRAVQPHPRDRASFIPELPGLLQASGRLEVVDGEYSKALGRSVRFSYSDGHTPGLMLAEIVGHAHAGESAHGGVVFCADLIPGRSWVHVPITMGYDRNAELLIDEKRQFLEDKLARNVRLFFTHDPQ

SEQ ID NO: 177896 - protein, 70 aa, Glycine max
  Coding DNA Sequence Number=SeqID_86211
MDVMDWCELGRIDGDPVLRETRIWATWEYVSSVGGGQQGMVGLCAHCGCGKTCCAPSPDRHLVPHVMGTP

SEQ ID NO: 177897 - protein, 154 aa, Glycine max
  Coding DNA Sequence Number=SeqID_86212
MDNEEGVQEQMKADLSALKDQMASISEVMLKLQKTIEDKATATASSTVREAEPMLQPALNLGRDRNTAAVFGRRYSPQAYPYGLPPDFAPSAAPEDLSQAPTFEGQLPPYDNYPVQDDEEGDTHLGPLLLLKDPSPHELPQPNIVRHIPASPTP

SEQ ID NO: 177898 - protein, 256 aa, Glycine max
  Coding DNA Sequence Number=SeqID_86213
MAASGIAILRDKAHIPTKKSLLELTSQDVLLAQNKLLSKQLEAFIETLRCAICGGAHNSGCCIPNEETTHEVNYVGNQRRKNFNAGGYSGFQHGQPYNSQQGQWRNHPSKQFNRDQGGPSTRPQQQGPCLYDRTTKLEETLAQFMQVSMSNHKSTESAIKNLEVQVGQLEKQLADRSSSSFSANTEKNLKEECKVVMTRSIMAIHADEGRAEEKVEGYKQQSAAKPTLEPVSDLIELEEVVEDEDDLQERETPIKE

SEQ ID NO: 177899 - protein, 266 aa, Glycine max
  Coding DNA Sequence Number=SeqID_86214
VLFPNMEGLVDLAVIDAFLAFHHGEESPVVAILAMYDTFDRGCEKSGARIVCCALALYVWGCINYNLVLAIRQLGYPMRGVPSDESITPFIARGFSDHNARDRELRGSSNGIIGGYHKWLRVRTQGLDWLPNLKTMRDDEVKASEESDEVQALKAELERARVVEEKFKSIAIKGSNSELKLQRVQREANLAATHEQRLEDEYAKISAEREVRERVIDSLHQEATMWTDRFALTLNRSQELPPLLAKAKAVADTYSAPKEIHGLLSY

SEQ ID NO: 177900 - protein, 133 aa, Glycine max
  Coding DNA Sequence Number=SeqID_86215
  Gene Ontology: Mol. function=transferase activity; Cellular component= integral to membrane; Biological process=glycolysis
  Homolog annotation: Hit_ID=A7QZG5; Match level="QueryCoverage=85%, HitCoverage=23%, E-value=1e-48, Identity=79%"; Hit description =Chromosome chr7 scaffold_275, whole genome shotgun sequence
  Pfam annotation: Domain name=Hexokinase_2; Domain location=2-127; Score=-115.5; E_value=0.0004; Accession=PF03727.7; Description =Hexokinase
MAAMHQDTSEDREIVSEKLWEIFDIDSCSPMARKMVAEVCDIVTERGARLAGAGIVGIIKKLGRVENRKSVVTVEGGLYEHYRIFRNYLHSSVWEMLGKDLSDNVIIEHSHGGSGTGALFLAAAHTHAHRADS

SEQ ID NO: 177901 - protein, 310 aa, Glycine max
  Coding DNA Sequence Number=SeqID_86216
MIMRGQDIYSIQDEATTFPSSSESEEAKGEESSEEIYPQEEEQTLMVKEECKEASVSSKRLAKKERHFEIKTNIKVISPLRQPPHFLLCEKTLVSIARPLRLEFIPQMASKKMKGPSTPSQVSYDRSRFTSQEAWERYTDIVVPRKLLPERNVVVYYTEFDEFKEELERRHWDEELTDFANGSIDVAIVKEFHVNLYDPEDKSPKQVRVRGHLVKFDEDTLNTFLKTPVILEEGENLCAYYRFALLRPDPQQLVAKLCILGRGFELNADGQPLKILRKNMTTLAKTWSVLSFSNLIPTSHTSDVTLDRAK

SEQ ID NO: 177902 - protein, 115 aa, Glycine max
  Coding DNA Sequence Number=SeqID_86217
MKEDLKKLRDMNKDDTNSQANVVKSMEDEDDVFLNTKMRSSQGYKYVGSKWGCKVYKGRHLVLQGQKSKVNICYLDGQVLKRNYDSKVKKKVKFSNVVEVLRDTSVGGGVCSLSN

SEQ ID NO: 177903 - protein, 113 aa, Glycine max
  Coding DNA Sequence Number=SeqID_86218
HAVPWRYAPPSERKEEATDISSLLAKVTNITGLSNVTHSSRVFAPPDLPTQPANVKGKAKIAEEQNDKMIPTLNENIPVKGLSEKKNGCGKKEVSLEEAGEFNRIKSDRSFMP

SEQ ID NO: 177904 - protein, 73 aa, Glycine max
  Coding DNA Sequence Number=SeqID_86219
METNMLAIISKYQEELSLAMTHEHRVADKYAQVYAEKEARGRNFPDYWPRPKRWRTPTLLPRRSTDFSAIVSI

SEQ ID NO: 177905 - protein, 98 aa, Glycine max
  Coding DNA Sequence Number=SeqID_86220
MKSLRGKEIALVKVQSGPDEGDSTWELEDRKYVHWGKDTQGLILSVLIYILPTFENGPRRVQRNARNWNQRGGMKTEAGFHHPKSFNFFFFLMAEYDV
